United States Patent 8,067,671 (METHODS FOR GENETIC CONTROL OF PLANT PEST INFESTATION AND COMPOSITIONS THEREOF) - sequence listing, part 42

SEQ ID NO: 84030 - DNA, 1522 bp, Heterodera glycines
  misc_feature (1499)..(1499): n is a, c, g, or t
  Genomic contig location: Contig_ID=SeqID_3276; Location=21..1542; Strand=-
  SCN-specific regions: Sequence locations=1-8,34-173,195-217,239 -673,695-1041,1063-1182,1204-1522
  Gene Ontology: Mol. function=diacylglycerol kinase activity; Biological process=signal transduction
atgatcaacaatcatcagcagcagcagcagagatcgaccaccacacaaagtttttgctcgtcgatggcagcggacggaagcggcgccgctgccgcggcgaccgcaagcgtttcggccgcaatggccgcgacttcctccaccgcctcgacggaagtgtccaccgatctcggacatgtatttgccaagaagaccttcggcaaacccacctattgccaccattgctgtgacaaaatttggggaatgctttcccaaggatttgcctgcgaaggtaattagtgggagagaagcactcgctggtgatgcccctcttcccaaagtgtgcaacttcgtttgccatgacaaatgcatgcgttcgattgtgtccaaatgcacgggcttacaattgcagctgatcaaaaatcccgtggcccacacttggactgatggccagcacattaagttggcctgacaaatgaggggatgcaattagaaatggcgtccgtcactttacttccttcagacgccacttctgctgtgtgtgccgtaaaaggacagaggacggcggactgtcctcggagtgtgagatgtgcaactgttatgtgcacgtcgactgtcaggtgaacttcgcccttcggcataaatcggcgcaactttcaaggatttggcgttggccgactgtcgcgaggcgtccacttacgtgccatcgttagacctcgtcactcacaaacagcagcaccacatgcgcgagggtaatttggcaagggacgccaagtgcgcggtatgcaggaaaggctgctacacggcggagtgcttctcgggcttccggtgtcagtggtgcaacctgagcgtgcactcgacctgcttccggcagcttcgctcccaatgcgacttcggcgtattgcgcaagattatgctgccccccaattcggtgaccatcccacgtgccgaactgcccatggacatgctgctcaacatccacacgggctccatcggcaatgagggaagtcgcaaagtgtcttccccgtcgagaatgacagcggacgagcgggagggatggcctggggcaggcggaccgggccgggaggaggacaaggagagcgaggactacctgctactgcgcatctacgacgggaacagctcgttgcgtaaccaaatcagtcggaccgcttccgtgccgaagacggcgtcggtggagcaaattcgggtaagggtgccatgccaaaagtgcaggggtcggtaatgaatgagaatgattaggtgcgattaatgaaaccattttcacaaaactgagtttgtccttgaatacaaagacgtaattgggtatacccaaagtcttgtccttgccaattgttacgcttcacatttgcaggacatcgcactgagacgtttccacatctgtgacaacagagacaattactacatcactcaggcgccgcacgagtcgggggacgaggaggaaatgctggaggacccaatcccgctgagaaacgtgaaaaagccggagggcaaatgcgcccaangtggccaagggcagagtcagccg

SEQ ID NO: 84031 - DNA, 936 bp, Heterodera glycines
  Genomic contig location: Contig_ID=SeqID_3276; Location=860..1795; Strand=+
  SCN-specific regions: Sequence locations=1-445,467-489,511-650,676 -853,875-936
atggcacgtaagtggacgcctcgcgacagtcggccaacgccaaatccttgaaagttgcgccgatttatgccgaagggcgaagttcacctgacagtcgacgtgcacataacagttgcacatctcacactccgaggacagtccgccgtcctctgtccttttacggcacacacagcagaagtggcgtctgaaggaagtaaagtgacggacgccatttctaattgcatcccctcatttgtcaggccaacttaatgtgctggccatcagtccaagtgtgggccacgggatttttgatcagctgcaattgtaagcccgtgcatttggacacaatcgaacgcatgcatttgtcatggcaaacgaagttgcacactttgggaagaggggcatcaccagcgagtgcttctctcccactaattaccttcgcaggcaaatccttgggaaagcattccccaaattttgtcacagcaatggtggcaataggtgggtttgccgaaggtcttcttggcaaatacatgtccgagatcggtggacacttccgtcgaggcggtggaggaagtcgcggccattgcggccgaaacgcttgcggtcgccgcggcagcggcgccgcttccgtccgctgccatcgacgagcaaaaactttgtgtggtggtcgatctctgctgctgctgctgatgattgttgatcatggcttatcaaatgaaactatcagaaataatttcagaggaagacgcaaagcaaacagaaggaacacaaaaagcggccatgggaggagggaccggcggaaaaagcgacggcgaagagctcaaagggcgaggaacggcacggagacgcagcgacggcacgggcggaggggacggagttggggaagaaaaaggaacggtggaagagaaaagacggggaagaagtgaagatgagcaaatttgggagtggtcggggaaa

SEQ ID NO: 84032 - DNA, 343 bp, Heterodera glycines
  misc_feature (243)..(243): n is a, c, g, or t
  Genomic contig location: Contig_ID=SeqID_3277; Location=2031..2373; Strand=+
  SCN-specific regions: Sequence locations=1-29,52-101,123-343
tccctttttcggtttatttttgtcactttatttgtccccaaaagcagaaaatgccgcgccaagtgctcgaattgtccgattacttcgctccattagctgccttaattatggtctttcatttgccgcttttcactttgcttttcatcccttccccccccaaagttcgctttggccatcctcgtcttctctttcttcgtgatcaatttcttttacatcaccgatcgggacgacttgacagtgttntgagaaagtgatcagccaatcaaaagaacatcatcgaatttgatcatgagtttttcagtttggtgccatttgcacctctgtttgggccccattcgatgtc

SEQ ID NO: 84033 - DNA, 574 bp, Heterodera glycines
  Genomic contig location: Contig_ID=SeqID_3278; Location=1432..2005; Strand=-
  SCN-specific regions: Sequence locations=1-76,98-285,307-307,329 -501,523-546,568-574
atggcggccctgggcgatgccgaacgcgacgagcacccaattctgccaaaagtcgggcacgccgaacattggcaccaagaaaaagaagaaggcgaagctcagaatagtcagcaaccactgagcgattgcattgggttaaacaacgaaaaaaatggggaaacggaccacaacgaaaaggtaaggcacgaagaggaagtcattttgggccaaattagcgaagaatgccatggcggaaacggcacaaaggacgacgccgaggctaacgaaggacagacggagaaatagcggacggaggaggagaagcgcgagcagtagcagcagcacagccaacacgacggtcgccaccgaagcgtggaaagcgaccttctgcagaagcggaagtgagacggacgaagctgagctgcaactgactgacctggacgtgcttcctttcgggccagcacttccatttcgggtcggactcgtcgaagtccgcctcgtaatgacgaagctcggaagcggtcaattgctgctcatttttattcttctgctgatgacgtccattttttggagcttcttccatttaatgaataaa

SEQ ID NO: 84034 - DNA, 131 bp, Heterodera glycines
  Genomic contig location: Contig_ID=SeqID_3278; Location=1173..1303; Strand=+
  SCN-specific regions: Sequence locations=1-131
tttggtgcccatttgcacctctgtttgggcccccattcgatgtccgacatttaccgagggggaccacgggattatccgcagccccaaggaacggacaaggagatgaacagctgaaaagtcaaactatctga

SEQ ID NO: 84035 - DNA, 397 bp, Heterodera glycines
  Genomic contig location: Contig_ID=SeqID_3278; Location=1444..1840; Strand=+
  SCN-specific regions: Sequence locations=1-40,62-234,256-256,278-397
atggaagaagctccaaaaaatggacgtcatcagcagaagaataaaaatgagcagcaattgaccgcttccgagcttcgtcattacgaggcggacttcgacgagtccgacccgaaatggaagtgctggcccgaaaggaagcacgtccaggtcagtcagttgcagctcagcttcgtccgtctcacttccgcttctgcagaaggtcgctttccacgcttcggtggcgaccgtcgtgttggctgtgctgctgctactgctcgcgcttctcctcctccgtccgctatttctccgtctgtccttcgttagcctcggcgtcgtcctttgtgccgtttccgccatggcattcttcgctaatttggcccaaaatgacttcctcttcgtgccttaccttttcgttgtg

SEQ ID NO: 84036 - DNA, 942 bp, Heterodera glycines
  Genomic contig location: Contig_ID=SeqID_19289; Location=851..1792; Strand=+
  SCN-specific regions: Sequence locations=1-46,68-165,207-590,619 -829,851-942
atgaaaacttgcgttgtgtgcacatgtctcgtgtcaattgtttattcaatttacatgaattggtttccggagaggcgccctttccattgtctgattcagttgggctatttcgagccgatgacatccatcacgaaagtgtgacgaatgctcgcttttagcttaatcattttaattatatttaaattttaattaataactatttatttcttccagtatatcaccgcaacattgccggacgcggggctttatgacgcggttcaaatcgctgaattggcttccatttgcattccctttttcctctatggcataacagtgatcaaaatggtgcacgatcacaagaagaatccctccacaagcataagtatttctttttttattgcgtggttttttggttgcgaaattattcattaattaactaattaatgaccttcggtaaatcccggtgatatcccattaacggggggggggggatgctaaagagagccagcgaaggaagaatcgtcttgtgtgggtctgaacatggatgggtcttttgaaaagggtcacttctcgttctcgacccaagaaatctgagaagatttattgtattgtattattcattttaattaattttatttagtccaagttgcgactgtgatgccgcgcgggagccaatcgaacggagaggagcgtgccaaatttgtcaatttgatgcaggaacgcactcggctcttctccatgtgcttgctcagccaagtgccctactatttgtcccacgcgctttaccaatcgtcccgaatttttgagctcagcgaagacaccgttcaggtgaaaaaaattggcagaccaataaaattttgaaattttcagattttggccatcctttggcaacttctcggcacaatttttcatgtccaacagcccattctgatgctgttgctcagcaaggatttgcgctcatca

SEQ ID NO: 84037 - DNA, 1910 bp, Heterodera glycines
  Genomic contig location: Contig_ID=SeqID_19290; Location=215..2124; Strand=-
  SCN-specific regions: Sequence locations=1-25,47-596,628-736,759 -789,839-874,898-1396,1419-1510,1532-1910
  Gene Ontology: Mol. function=steroid binding; Cellular component =integral to plasma membrane; Biological process=signal transduction
tccgatggtttgaacgtcttcgaacttggctctgagaatgactttgacggttggagacgaaaatcacaaggaacagaattcatacagtttccccttggtcagatcgcgttctccaagcccaacagcccgtcatggtccaattctacgccgattggtgcggcccgtgtcagaatttggcgccgagaattgaggccaaagtgaacggacagaacggagaagtgagttggccaggggagggcactttcttcgccatgaaatgttgtcagtcctccaattgttttttttaattttattttggttttttaggttttgttggcgaggattaatgtggacagttctctcggttttcttactgcacaattcgatgtgacttcggtgcccaccgttgtgagcatttccttacactttttaacattcactcattgcctcgaatgaatgtcgtctttttgtctgcataattgagcaccccttttaggtgtgtttccataacggagaggtcattcaccgctttgagggcgacgtcggtgagtaaaaaaactatgcatttattgtgttttaagtgattccattcattctccttttataaataaggagcctaaattaaaaaaaaaaatttaattttaatttctttcaattagagattcaaaaaattcatattaagatgattcatatttggacgaaataatcgcgcatttgaaggaaggagactcggaaaatgacaaagaaattatttgatggaataattgcttttattttataagtatttgttttaattggtgtttgttaacctaattaaaaattttgaatttcaattttaagtattaatctataattttatcgtaattgaagtttgtccatcacacaatataaattttccatctcaaattaatttaaaaatgtagtagtttgtgtcttcctaaatgggtatattaatatgtccagattagttttttaagtcagtgagtgattagcctttttactgattgattcgatcatacataaaaactgataatcacaaaacaattgggtgcatagttttcttttctcaattagtaattaattaagggatttgccattttaaagtgcacagccaccaaaagccattcgtaagacgcccgcccaatgccaacttttgcagaacttttcgaactcagcgcaacgggcaaatttttggcatttaattaaatgatgtttttccaattgtccctctgcagatgtcgtcctcgttgttctgttcgtatacgtcgtctacaaattgttcttcgctcgtcgccatattccgcctccccccgacgtgccgcaagtcgaaccgttggagaagcaggacatgacggtggagcagctgagacgctacgacggagtacaagacgaacacatttgcatggcaatctgtggaaaggttttcaatccttccatttttatcatttacaattgggttgccattttcagatttacgacgtgacaaagggaagggactattacggacccgagggggcgtacggaggtgagcgaaaaagcattggaaatggggcaaaataacaaaaagcaagttgatggcaaaatatcgtagagcttttcagcattggctgggcatgacgcaactcgtgcactgggcacgatggatgtcaagcaaatcaaagacgaatttgatgaccacgccggaattgacccatccgatttggaagaagcgaaagagtggcaacagcgcttgtcatgtaagtgggatggaaaggttttgcttcgacccctagggggggggggcgggaggtaaagcatcgatacgccggatgtgccgccattttttgaacaatttcatatttttctcaaaattccagtgaaatacccgttcgtcggccgacttttggctccgggtgagcaacacacggagtatgagactgttgcagaaaacc

SEQ ID NO: 84038 - DNA, 680 bp, Heterodera glycines
  Genomic contig location: Contig_ID=SeqID_19296; Location=3..682; Strand=-
  SCN-specific regions: Sequence locations=1-680
atggcattgccaaacaggcctccgtatcttccggataattgggataatgatgttgagatgagcggcttaatgtcttttttaaaggtaaggcgtcttttctttttttatactctttcttaaatttctcatcttaggctcgacatgtcaactcgacaaattatggtaaactaatgaggaattttgtaatttaaccatgctaattagttactaaaatttagatagggtcattgagttttggaagagagtgatttcaggcaagttctttgaacttggaataaggtttgccaattgtgtagcctataagcctattgtttagattattgtcgtcaccaaaagaattgcattttttcgttggatgaactcaaattgaaattcaaacgaggaacgcaacttccgagtccgttgccaaccgtcgtaatggaaatgcaaaagtatccaagaaaattgaatcaatcaaatttcttcaattcgttttgcagtgccggactcgttcaatcgaaggaggaactcgaaaagcagaatcagggctggctgcagtggagcatctctttgctgaagccgaacagttggcttccgggcctcgcgaatccaacggacgccggaagaaggcacccattcgaattggtgcacatccccacactaaaaggaattttttagactttcaaactgatcaattatga

SEQ ID NO: 84039 - DNA, 1247 bp, Heterodera glycines
  Genomic contig location: Contig_ID=SeqID_19297; Location=178..1424; Strand=+
  SCN-specific regions: Sequence locations=1-84,118-295,317-667,689-1247
  Gene Ontology: Mol. function=protein binding; Cellular component =nuclear body; Biological process=segment specification
acaatggaaatggcaaaccaattgaagctggtccaagtggcaactgtgctagggagaatctaatccgattaaactcccttaatccttacatgtaatttctttgtttatacttttttcgaaaatcgttaattattaatttggatttttaagaacgtgccctctgtgcaacggttatttggtcgaagcgaccacagttatcgactgcttgcatactttttgcaaatcatgtctgctcaaatattttgaaggtgggcagcatccaattaaaaactaattttcatcgttattgaatttttgcctttcagataacaatgattgtccaaagtgccataaccaaatccaccagtcccatccgtctcattatgtggcatttgatcggacaatgcaggacattgtgtacaaattggtgccgggcatgcaggcggaggagcagcgacggagggaacaggtccacccgcacggatttttgttttaattagagtgacttgggttacaattttcctggtttatcatggtctcctttttaaaaatgtctatccttattttttgcccaaataaattttcaaattccatttgccgttttgcagtgtaaaaagcgccaccaacaaatgaaggaggcgcgcgaaatgaatggacgagcagcggaaaaacataatcatcagaacatttcctcctcctcttcagccaccgccgtcataccgccgccaaatacaaacgatgaaaattcagcggagtgcgctgaacagcggaagagcgcaaatttggcaaccgcggctcctaaaactgagaaaatggacgaaaacggcgacaccaatggtttgtcggtgtatttggcagcagtattttacagaatttgtggccatttgcccgagttgggtcggtaagcgagcgaaaagatatttgactggcatttttaaagggaattgtgcgcatcgcgtgggtgtttgctgtgatgaacaggacgcaaccacggcacaccgaagggtatgttaatgcaaaatttatgtcaaatccgaaaaatttattttgcaattcttacaattcagcaagacgaaccagtgctgatcagactggttccgggttcaactctcagccccctcgaccgcccatttgtgcgtctttcggcattttccactgtcaacactgtgaaacgtcttcttgcctttttgttgctcaacgatatcacaaagtacaacgactttgatgttttttgtaaccgcgaactaatgggacgcgacttttccatg

SEQ ID NO: 84040 - DNA, 135 bp, Heterodera glycines
  Genomic contig location: Contig_ID=SeqID_19298; Location=1077..1211; Strand=+
  SCN-specific regions: Sequence locations=1-135
atgccaaagaaaaaggtaaaaaaaggcataataaaagtcaacgtaaaagcctcaaaccaagtggaaaatgtgttatttacagggctgcaaaaaatatgcacgaaaaatggccaaaatatacgcataaatatgcaa

SEQ ID NO: 84041 - DNA, 2145 bp, Heterodera glycines
  Genomic contig location: Contig_ID=SeqID_19299; Location=323..2467; Strand=+
  SCN-specific regions: Sequence locations=1-68,181-256,280-611,642 -844,882-1019,1096-1244,1282-1617,1642-1823,1859-1898,1922-1929,1951 -1982,2022-2145
atggcttacagggcaatgggacaacatgccaaatcattcacatccgccattttgaacataatggttagaaaattttttttttttaatttaaggttaaaaatattttgaattgaaatagtaattttataagattttataaatggcatttaaaatacaaatttttcttttaaatttaaatttcccactaaaacatttaaaaaaaaaaaccaatttttgagttatgaaattgcaaattttccctagaattttggcatttcaactgtttatttgctgttagctgcacgaattttgtccgagctgctgtcctcaatgttcccaaatgttgtacaacatcaaattggtctctgctcaatgatgccaattttggcactgcttcttttgcctgtcacatttttgaaatcgccacaagatttttggttggacaaaattttgaattgaattagagaccggacaactgggatcggaaggaacccgggtcgggataccgaccgaatcccgtttcccgatcaatcccgaagattttggaaaaacgatcgggacggaaccagcagaggtcaggatcccgaatttaatcccgcgggatgccaatcccgtccccggcctctactttgaataatatttttgtttatttttaaaattttcataggttggccgtcgttacggcaatggtcaccacaacattgtccgtgttgttgattgtttttggcacttttcttgaccaacctgaatgtgccccatatgcgcatcatccgccattcaattcgggctcctttttcctctcaattggcatatttttcttttcatttggtggtcacagtgtgttcccgacaattcaggcaattacaaaaattaatttaaaaaataattattagaatttaattgcattaaaaaaatgttttaactattttgcaaacaaaataattatttttcaatgtcaataaaagttgtttcaaccattttcagcacgatatgcgaaggccgaagaagttcactcgttcttcctttctcgcatttgccagtaataaattattattttttaaatgttttcaaaattatttttcattttttttcaaataaatattatatatttttttaccatttttagttgttgcttcaatgtatgtgccaatatcattttttggttattacgtttatggcgattcgttgcacgattcaatcattagctcaattcaaacgccttccattcaacaggtaaatgtgaaaaattaattgaatgaatcaactttaaatgttaaaaaaataaataaatttactattattgggatttcttgaatatttgatccagaattttctaaaattttcccggcggagtttaaaggcaccaccggatcccatttttttttttttttagaattttccaaggcctgaaaatagccaaattcggcgccgaaaatttatgtcaattacattgggaaacaaattttttgactcgaaaaacaaaaaaaaagccaaactttttttctggttatatatctgtttaattccgccatttttcatgtttaaataatttcgtaaaatttaaatgcattattattttgtcgaggtttgcttcttcatataggacatatatgaataaattttttatccaagttttgcaataaaattattaatttttaatttcaaattcattggcaccttattggctttccgttgttttctacattcaaaaattctgaggcttttttttacagttcgccaatttgtttattgcacttcactgtattctcacgctgaccgtggtgatcaatccgctgaatcaagaaattgaacatcttctcgacattccgcatcgtaaaaatccgtttaaatattttataattttttaaataaattttaagagtttggttggcaacgcattttggtcagaacatttgtgatgttttccgttgtttttgttggactcactgtgccaagttttgggccaattttgaacctcattggtggcacaactggtgaatatgaaaaaaaaattttttttaattattattttttaaaattttcagtggcactgacatcagcaattttgccatgcctttttgatttatatttgcattcatcggacaacaaaaaaggcgtgcaaaaattgggcggtgaccaacagcagaacaccactaattttaaacg

SEQ ID NO: 84042 - DNA, 1906 bp, Heterodera glycines
  Genomic contig location: Contig_ID=SeqID_19300; Location=1..1906; Strand=-
  SCN-specific regions: Sequence locations=1-91,168-247,270-298,330 -438,464-605,643-761,797-876,969-1097,1136-1300,1339-1544,1566 -1736,1759-1822,1875-1906
  Gene Ontology: Mol. function=myo-inositol transporter activity; Cellular component=membrane; Biological process=myo-inositol transport
tctatgaatattgtttcgccaaccgccgctggtccaaaacttccaaaacacaagccaaagcttgggaaatttatctatttggtgggatttctttttatttcttaatataaattaaaatttggtatttataataaaatattcaaaacaaaacaaaaattaattttaatgtgccaattttctgctttcagctcgcttttattgctgtcattggtggttttttgtttggttatgacacaggtgaaaaaacattcttctatattgtaaaatatgataaattatattctaaatttcaggggacttaaattaaaacattaatttattttttaattgaacaattcaaattaaggcattgtctccgctgcgatgctttacgtgccaaaaaattcggacctgaagccgatgagcaacgcatggattgggcttattggtgaggaatttttgttttagaaaattaaatttttattatagtttcaattacgccgggaatggccggggttggagcactgcttgccggaaaagcatcagacatttttggcagaagaaaagtaaaattgtttaaatgatggaatttaaaaatagtagaaatttaattgattcacaaaatcttttatttaaatataaaacataaaaattattaattttcctttccagatgatcattctttccacaataattttcacatttggtgcaattgtatgtgcaattggtctaagcaaatggattttgttggccggacgaattttgttaggaatagcaattggtattatatcttaataatataataaaaaataatattcaatttgtagggtttgcctcaatgattgtcccaatttatgttagtgaatcctcaccagcgcatattcgaggtgtgttttgtattaattaaatttatttatttaattcttatattatttttaatatttttttaaattgtttttttaatatatttgaaatattaaacaaaaattgttaggtcgactgatcaccagcttccagctgatgatcacttttggcttagtagcagcaaatatttttgcgttcgcgttttcctacattgatccgttgaattggggctggaggtaatcatttcgttattgattaattatcatttaaatttaataaaaaatctttttttgactaatggtcggatttgctgcaattccgagtgttgtccaatttgttggcttttggtttctgcccgaaagcccccggtggctttatgagaacaaatcgcacaaggaatgtgaggaggtgttgagcaaaatttacaatggcgacacggcgtggattcaatttggtgtttaaaataaatttttaaaatttaatgtttaatttatagagctttctgagattcaaacagcgcatgaccaacaaagacaggatgcagcaatttatggtacattattcttggattaagctgatcgttattggttgggttctggcaattaacagaaagcttcggaaggcaatccgaaatttggcaaaaaaatagtccactggaaatttaaaaaattaatgccattttagcgctactttaaaagtggtatttttgaattttattaaaacaaaagagggggggggggtggcttttggtttattaatttttttgtgataatgtctaatcataaaaattgattctggaatttttgggggcccagatcacgaatctgctcttttaaccaattcctacttcctagcctaaattagaccaaaaaaccataaaacaataaggttgaattttcggaattttcgacttttgttcaagtacgggttagggaaaggttacgggcctaaaggcctaattaattatttaacagtatccaaaattatctaataaattttctaacaaataaatttaaattataagaatatttcaggctcaggaagcataatttggcgaattctg

SEQ ID NO: 84043 - DNA, 692 bp, Heterodera glycines
  Genomic contig location: Contig_ID=SeqID_19301; Location=12..703; Strand=-
  SCN-specific regions: Sequence locations=1-114,147-419,460-463,486 -486,508-692
  Gene Ontology: Mol. function=SH3/SH2 adaptor protein activity; Biological process=protein localization
atggctctgaaaatgggacaggttaaggcggagtttgacttcgaagctcaaccgggcagcggagagcttaccataaaaactggtgaaattcttaccattcttaaggaggtaaataataaaaagtgtttgacttttaaaaagaaaatcaatccgttgcagggaattgaaggaggatgggtggaagggcgaaactccaagggcaaagtcggactgtttcccgcgagttacgtcaaaaagttccaagcagaaaacgccagcatttaccctcaattgtccatttcgaaggtgagtcggcggttttacttcgcgaactgtgagtgtcaaaatctaaaaccgtttttaacgttataatcgatttggtatttaaagtttcgttcttttttttgccatgcgctaaaaatgacctgaaaaatatgtggtatatttttagatttatttaatttaacatttttttaattagctgtaaatttctctattagataaaatagtatataaaaattgttttaagcgatttgagcactcaaagttcgcgatgtcccttgttagtcatttcattccatgagtaaaagggttcgggtctggcaaatttttgaagtttaaatgtaatttaccaaatgtcaaaattcctgatttttggtctcttggggagtgtgtttatatagagtataatctattttcataaagctattaaa

SEQ ID NO: 84044 - DNA, 703 bp, Heterodera glycines
  Genomic contig location: Contig_ID=SeqID_3282; Location=331..1033; Strand=-
  SCN-specific regions: Sequence locations=1-291,313-472,503-515,537 -541,563-673,696-703
atgatgaaaaagttcacagttgaggaggaaaagctcaacattgaaatgacctccggggcgattgtcgcctggcaagtgtttgagcctctggaataaggccatttgaaaattttagggatgggattaaaaatgttttttaaatctcaaattttcagttcattttcagtcctaaaattcaaatatttgcaaaatttgaatgcctaaaaaaatatttttcaaaattttcgatatcaaactgatcagtgtccctcctccgttttcaggcaaaatcggctcagtgacggtgtccacaattggggaggacgaggggggagctggaggggcgtgagctcagcgtgtcctactcactgaacgcacggaatgttgaaacagtgaaacatttataataatgaatgcataaattggacccagagatgggatctgatcgaattccggaccacccaatttttatgaaaatatcaattttaatgccaataattgttattaaaaaaaattaaaaaatgacatttgcttccattttaaaaacttgaaaaattgttattgttaattttttaagaaatttgacgctttaagaggtggaaaacagggaaatgaataacatttcaacaattcgtaatttttttttgaggccggatttctgactccgtcaactaccctcggctcttagtttttgagccattgtttcttattttgaaaaaataaa

SEQ ID NO: 84045 - DNA, 1660 bp, Heterodera glycines
  Genomic contig location: Contig_ID=SeqID_19305; Location=236..1895; Strand=+
  SCN-specific regions: Sequence locations=1-65,87-564,586-721,744 -1545,1614-1626,1648-1660
atgtatcattttcttttcttaatttgcctcgccgcactgttcgccccccacggcgttttgtgccgtcataagcattttcaccaccgagtgccaatcatcgatttggacggtgccgaacaattagtgagtgccaacttaaaaagttctcaaaatttaaaaaatgccattaaattcgttcaggtgggcacaattcgtgaagacgatcgaacagtaaatgtgtctccaaagctgcgaatttgcaaggaacaggtcattataatttattaataaactttctggcaatttaccgtatccaattacatcgtttgaccattaccgtacccctaggccctgtctgtcattatgaggtcagctgggcggacgaagacgcatttggtggtgcgcaagtgccattcgaagtgcgcattttggacaccgtggacggaacggcccaaatccggcacaaagacggaacggaagcattggactgtgcggtgaaggcgcaatttgtcatccgactaagtgcggtgaaatgcggcgacgacgcggcaaaaagcgaagcgtaaggaaaaaaggaaagaaaagccatgaaattgttaattaattaatcgtttacctctgctgttcagagtggagctcaaaattgctgtgcaagatgttaacaatcactccccccaatttgatggtacggtaattccattgttacggtcattccatttgcatatattaacgatcggctgggggaagccctgccctctccaactccccaatttgcttgatcatatttgatcaattgtcgcttcaatttcgaattttccctccttttcagctccttggtattccttcgacgttgacgagggccaaactcatgccgaaattgcgcgactgtacgcccacgacaaggactgcggccacccgtacggcgaagtgtgccgttacgaattgaccaatacgctcgcggacagtcccttccgcatcgattcacgcggagtgctcagcgcacaacgaccgttaaaccgttctttggccgagtcgtatattttgacggtggtggcagaagactgcggaatggtgtgttgattaggcagtttaagaaggaagaccaattcatgaattaagcatgtgtttatactttttgataatatgatgcctaattagggttaattagggtaattaattttccaattcatccgtttcagctccgttcaaagtccgtgcttgtcactgtccacgtccgcccgcgttgcgttgatgcgctgcgctctaacggcacggcgcggggtgcgcgtcatgttgaacaaaacgatttgcgagggattgtcgtgtttcctgatgcggaagtaatgacttgggaggatgagcacatttcaaatctcacatttgccaggtgatcgcattcggcgccgcgggtgcggaatgccaagcggaagcggacctggagttggagcagatcggctcggagcatcaagtgaaggcggacgcactggcggagtgcgggctgagcagcgcggacgccgtggaactgttgccggaagaagaaggaatacggaaactccagccggacgggatgaagaagaagaaaaaggatgaagccgagaaagaggacgccgaagcggaagaggaggaggaagaagcggacagagacacggaagggaaagcggcattagacgggaagacataa

SEQ ID NO: 84046 - DNA, 551 bp, Heterodera glycines
  Genomic contig location: Contig_ID=SeqID_19306; Location=779..1329; Strand=-
  SCN-specific regions: Sequence locations=1-551
atggacgagcaaaactcttctgaaccgctaaaaaaggtagttcaaaatgatagcacctactttgcataaattttcatttaaagatttttctacttaagatgtgctgctactgcaaaaacgtctgttctggggcgcaccagtgccgtaaatgctcaaagccgtgccatgcaattgctccttgctcatttttggctgaggacgatgagggattcggcgcaaaagtcacatgctgcagctgttggctcgacgatgacggtattatggaccaaaacgcgaacgccattgtgataaatgaagcaaccaataaagacaaagacgacgacgcgttcaaacaattcgtcaacacacaaacaatcgcagaggacaacgacaacaccgatgcattggcttcaccatcaacgcgcaaacgtcgcggctacaccatgaccaaaaatcgtcattttggacttcgccaagacgtcgtccattcacgccgccagccgacacttcaaagtggacgaaacaccgttcgggactggaaaaagcaggagacggcattgagaaaaacgtaa

SEQ ID NO: 84047 - DNA, 729 bp, Heterodera glycines
  Genomic contig location: Contig_ID=SeqID_19308; Location=194..922; Strand=-
  SCN-specific regions: Sequence locations=1-221,243-329,358-475,497-729
cgacctaacttctgaacaggcaatgctcgagttcgtccgacttttagacgtcgtctgtccatcatttcgcgcacaattagaaatcgaacgcaaagcgaagacaaatgagccgaatcaaaaagccaccattgacaatccatcaaaggattcgtgagtttcctctgggataaattccgatgttcaatcccattgataattaacggctttccaattaatgtttactctgtcactgtcttttgctttcctttcattcttccgtcaaagttcatttgcatttgtctgctgtggtcttaccgtattccttcccctccaaaatgtgtcggcggcacattctctcccccttttccatcgattcccctaattggcagcctttcgttgttctttctttcatctttcgttaatgatagtttttcctcagtgttcgttgattttcctgatcaattccactttctcccgcccaccccccccacccccactttttaattctttcccttttcagcaatggacagtccaaaaacgattgtcacctcaatgtcttagtggacagtgcgtccatccgagcgcaagaagttcttgaacaatttgaacagcaaaagtcttttttttgttcgataatgctcacttttttctttccttttcagacgacaaatccaagaggcacttaacaaacaaacttaccaccagtttttggcctatgctcaacaaacgcatccaggcgaaccgacaaag

SEQ ID NO: 84048 - DNA, 118 bp, Heterodera glycines
  Genomic contig location: Contig_ID=SeqID_19309; Location=299..416; Strand=-
  SCN-specific regions: Sequence locations=1-118
atggacgtcattgaatatgaatcgccgagagaacaaacagaaattagtgccaatttgctttccgattttggagtaactgctcagcaggcgtataaaatcgccgttactttttacaaaa

SEQ ID NO: 84049 - DNA, 422 bp, Heterodera glycines
  Genomic contig location: Contig_ID=SeqID_19311; Location=1874..2295; Strand=+
  SCN-specific regions: Sequence locations=1-94,123-422
atgggtgcacccggtatttgttgatctcagagccatctttgttctgacatttgaaataaattaacccaattcgaaataattatggcagtttgtcaaaaatttctaaaaaaaaaaatttttttgtcacaaaacttgaataaacgttttctgtggatttcaaggtcgcttatttgttagtacaaaagcttatatgaaactataaaaaaaacttattcaaaattaatcgtaatggattttcagggattcgtggccagagcaataccctagaaacatgtaacatgacctacaaatgtcaaatatttgacgatcgcctcacgcccgcgactgctcaatgcgcgtgcctttttgtccgccacccaacagtgaatgccacgccgtccggaaaagacccagagcaaatgttgaaagccaaaatgagctaa

SEQ ID NO: 84050 - DNA, 149 bp, Heterodera glycines
  Genomic contig location: Contig_ID=SeqID_19313; Location=1389..1537; Strand=+
  SCN-specific regions: Sequence locations=1-79,103-149
atggatcatgcacggacccaatcacttccatcgcaacaacgactttctgttaccggacgaaaaggcagcgatgttcagcgaaagaggagtttggtggagcacgcagaagcagctgggttcgacaaaaacacaatcattttgacagtaaa

SEQ ID NO: 84051 - DNA, 793 bp, Heterodera glycines
  Genomic contig location: Contig_ID=SeqID_19316; Location=959..1751; Strand=-
  SCN-specific regions: Sequence locations=1-49,73-73,270-453,759-793
  Gene Ontology: Mol. function=RNA helicase activity; Cellular component=cytoplasm; Biological process=signal transduction
tggaagagaaagtggaaaaggaatagaaagtctaagcgaaagtggaacaggaacaggaagtggaagagaaagcggaacaggaatagaaagtggaagagaaagtggaaaaggaatagaaagtttaagagaaagtggaaaaggaacaggaagtggaagagaaagtggaaaaggaatagaaagtttaagagaaagtggaaaaggaatagaaagtttaagagaaagtggaaaaggaacaggaagtggaagagaaagtggaaaaggaatagaaagtttaagagaaagtggaaaaggaatagaaagtttaagagaaagtggaaaaggaatagaaagtttaagagaaagtggaaaaggaacaggaagtggaagagaaagtggaaaaggaatagaaagtttaagagaaagtggaaaaggaatagaaagtttaagagaaagtggaaaaggaatagaaagtttaagagaaagtggaagaggaacaggaagtggaagagaaagtggaagaggaacaggaagtggaagagaaagaggaagaggaacagaggaagaggaacagaaagtggaagaggaacagaaagtggaagagaaagtggaagaggaacagaaagtggatgagaaagagaaagtggaagagacagtggtagagaacgtggaagagcaacagaaagtggaagagaaaatggaagagacagaaagtggaagagaaagtggaagaggaacagaaagtggaagagaaaatggaagagacagaaagtggaagagaaagtggaaaaggaacagaaagtggaagagaaaatga

SEQ ID NO: 84052 - DNA, 669 bp, Heterodera glycines
  Genomic contig location: Contig_ID=SeqID_3283; Location=1078..1746; Strand=-
  SCN-specific regions: Sequence locations=1-269,291-669
atggctcgagaagacttcatttcacattctgataagaaaaaagccgttcaattttaccgttcttctgaaaaaggacaccggtcactttcatgtatgcggtcaaaatttcgatttatcaagagtgaatctgacctaaaaatgctccggaggtataatgaaatattttttctgtaaaatatagtattaagattcgaaaccaatcttaaaaaccaaatggaagcattaaagcaaattgacgacattgttaaagggcaatttgtggagaaaacggcattaaatttaagtttatctgatcaaatcctccgaaaataggcaatttccgcaaacaacactctcggggacaacaaaattgttaattttaaagcgtcaaaaaaatgggtcactgcttttaaaaaacgccatcgcatagtttcgagaaaggttaaaaataaataaaatagtccaaaaaataaattattttagatcacgaagttcatttcaatgttttggtcccagttttacgccctggagaacaatcattattgttggtggatagttggaatggttggaatgattttcgactcccggataatgttaaattaaaagtgaagcaaatcccaaaacatgcaactggaatatgccaaccattagatgtttacattttccggtagttttgttgccaaaaataaa

SEQ ID NO: 84053 - DNA, 2046 bp, Heterodera glycines
  Genomic contig location: Contig_ID=SeqID_3283; Location=29..2074; Strand=+
  SCN-specific regions: Sequence locations=1-13,35-193,241-246,271 -471,516-521,543-755,781-784,808-1002,1025-1428,1450-2046
atggcgcgggaaaagcaacaacagcagcagaaaaagcaaaatgagctccgcaaagatatgacaatgttggatagagcgattgtggcagttgaaaatgcacgagacgcagcagcggaaaatggtgggcaaaaaaaaaatgggaaaaaattgggaaaaatattaattgtttattttttctaaaaattagagtagagcgggaccgggccgggaattcccggtcatccgaggtcccggtcccggatttttaaaagctcaggtcccggtcccggtcgcggtagggcaaccgggaaaaacaagcactggtaagaatgggggtctgacaaaggaaggtccccgggtgtccgtgggatttccgaatgaaatttggtgggtggatagagcacccatgggttcttaagaaaagtgtttttattttctgcgaaatgagtctgagtgccgagttatgacgtgccaaagttttttttattgcaataaattaaataaacatttgcactgttttgtgttgttcggtggtgcggaggttgtgctcctgccttccctttttgccctcgcaggttcgaatccctcatatgttaatttattttccccgttttatttttgattttatgcaaattaatggccattgaaatcaattccatcgggtcaaaaatttttattccttctttttcattcaattttattcattttcacacaaattgtaatcattaaaaaaatggttaaagcataaatataattcacaataagcacaccgtaataaaataaaacattcacaatttaatttctgacacatgtcattttttggcacttcaaagcagtatttaacgggatggcaaaaatttggcagaggctcgtccccgtaataacccgattttctccaggcaaaattaatccatcccatgaaaacgttctgcttgaaactgattatggattaacgattgtaatttaacaatgttatccctgtcgtgcaaatttattttcacatcataaatcattacaaattccgttatttttctcgtaaattgcttacaaattctaaaactattttttattttatttttggcaacaaaactaccggaaaatgtaaacatctaatggttggcatattccagttgcatgttttgggatttgcttcacttttaatttaacattatccgggagtcgaaaatcattccaaccattccaactatccaccaacaataatgattgttctccagggcgtaaaactgggaccaaaacattgaaatgaacttcgtgatctaaaataatttattttttggactattttatttatttttaacctttctcgaaactatgcgatggcgttttttaaaagcagtgacccatttttttgacgctttaaaattaacaattttgttgtccccgagagtgttgtttgcggaaattgcctattttcggaggatttgatcagataaacttaaatttaatgccgttttctccacaaattgccctttaacaatgtcgtcaatttgctttaatgcttccatttggtttttaagattggtttcgaatcttaatactatattttacagaaaaaatatttcattatacctccggagcatttttaggtcagattcactcttgataaatcgaaattttgaccgcatacatgaaagtgaccggtgtcctttttcagaagaacggtaaaattgaacggcttttttcttatcagaatgtgaaatgaagtcttctcgagccatttttttgtcggttgatgggaaaaaactcgatccactcgacttttcttaattgaaatattttaaatcttaaaaatttcagttcgttaggatttgtagatgttgaatactatccgaaacagtacggtcacatttacattttgccaaaacaatcggccttcagagtcacgtttgcaaggacaacaacacccgcagagcgtggctccgccgatcaccgtcacttttctgctgtttgtcactgccagctgattgtgaccggcgtacggagagtggagcacctcgacgagacttgacagaacatggagacgatggtcaacagaagcacttacag

SEQ ID NO: 84054 - DNA, 1714 bp, Heterodera glycines
  Genomic contig location: Contig_ID=SeqID_3284; Location=3644..5357; Strand=-
  SCN-specific regions: Sequence locations=1-82,105-333,356-1115,1157 -1714
atggcgatgctgacgatgtcgacgacaacgacgaccggtggtgatgcggaaccgaatcgacggcggcgcccgctgcgctttctgttctgggatgtggagtgtgcccaagtggcggacgaaaatgaagagggggacgagggagtgccggcgcgagtgctcaaacatgtgccgctgctggtgtgcgcggaggtgatctgtgagcggtgtgtggcggctggcgtggacctggagcgcgagccggaccgacgggcgcctggctgttgctgtggcggtgcggcttggcgagacggacaacaccgccagtggttgatgcgtgcgcgcgaggacgcgttcagcgacgacgacgacgacaacgcggacgggggacggcggtggcggcgaccgaacccgcgccgcttgcgtttcttccacgacgcggcgaacgggcgtacgcctatggcacagtttgcagactttgtgctccacgacgggcccgtgaatgtgcgcaccgtgatgctggctaacaacggggtacgggggtgtacaaaagcgtagttgaagaaaagctaccatatacgctttgtaggggcggtacgatgtgcatttgctgatggaggagctccagcggcgcggagtgcgcccccggcggctggtcgccaccgggctgcgcgtctacacgctggagctgggcggacgaaatcagcgcagcgtggtcgccaaggactcgctgaactttttcggctgtgccctgtccaagctgccggccatgttcgggctggacggcgtgccggacaagccgttcttcccctacaactacatcagggccgaaaacatggatgtggcgcatgtgggattgccgccggctgccgactacgacccggaccggatgcgcccggcggagcgcgacgcgttccagcgctggcatgctgaggagcaacagcgtcgacccaaccgactgttcgtgctgcgccgggagctgctccgctactgtgccaactacgtgcgcattctgcggcgcgcctgtctgcgcttccgccacgtggtcggcgagctgtcgggcggcgtggagccgttcctggccgcctccaccatcgccgggctggcgctggccatctaccggcaacaacatctgccccgtgatctgatggtgcacacgccggagggcggcttcctgcgcggacgacgcgcttccgccgcctcgcgccacttcttcgcgctgctggagagactgcgcccgcaatggcgcggtcgactgcgcactgcgcgctggtccatcggcgaagcgtgcgtggaggacgacgggtaccggctggacgcgctgctctaccgcccggtgccgctgcgcccgctcgtcatcgagttcaacgggtgcttctttcacggtaaggacgggggtggaggggctccttttccatttgcctcgtccaaggttgccccgagtgctacccgaggcgccatcaagtgttggcgggcggccaaaccgccgagtcgctgtgtgccaggacacggcagcgtgcctgggagctggagcagcaccacggcttcgcggtgcgcacggtgtgggagtgcgccttccagcggtggctgcgccgccagcccacccgagtgcggcgcctgtacacggatgtgtgccgggcggtgcccggcccgatggacctgcgccgggacgcgctgttcggcggccgagtggagccgttcgcgctccactacacgtgcacagagcgagaggaaatag

SEQ ID NO: 84055 - DNA, 812 bp, Heterodera glycines
  misc_feature (8)..(8): n is a, c, g, or t
  misc_feature (13)..(13): n is a, c, g, or t
  misc_feature (17)..(17): n is a, c, g, or t
  misc_feature (23)..(23): n is a, c, g, or t
  misc_feature (31)..(31): n is a, c, g, or t
  misc_feature (51)..(51): n is a, c, g, or t
  misc_feature (58)..(58): n is a, c, g, or t
  misc_feature (61)..(61): n is a, c, g, or t
  misc_feature (65)..(65): n is a, c, g, or t
  misc_feature (75)..(75): n is a, c, g, or t
  misc_feature (97)..(97): n is a, c, g, or t
  misc_feature (102)..(102): n is a, c, g, or t
  misc_feature (126)..(126): n is a, c, g, or t
  misc_feature (139)..(139): n is a, c, g, or t
  misc_feature (149)..(149): n is a, c, g, or t
  misc_feature (172)..(172): n is a, c, g, or t
  misc_feature (175)..(176): n is a, c, g, or t
  misc_feature (179)..(180): n is a, c, g, or t
  misc_feature (182)..(183): n is a, c, g, or t
  misc_feature (188)..(188): n is a, c, g, or t
  misc_feature (196)..(196): n is a, c, g, or t
  misc_feature (198)..(198): n is a, c, g, or t
  misc_feature (207)..(207): n is a, c, g, or t
  misc_feature (210)..(210): n is a, c, g, or t
  misc_feature (230)..(230): n is a, c, g, or t
  misc_feature (234)..(234): n is a, c, g, or t
  misc_feature (248)..(248): n is a, c, g, or t
  misc_feature (261)..(261): n is a, c, g, or t
  misc_feature (269)..(269): n is a, c, g, or t
  misc_feature (282)..(282): n is a, c, g, or t
  misc_feature (303)..(303): n is a, c, g, or t
  misc_feature (312)..(312): n is a, c, g, or t
  misc_feature (317)..(318): n is a, c, g, or t
  misc_feature (321)..(321): n is a, c, g, or t
  misc_feature (342)..(342): n is a, c, g, or t
  misc_feature (344)..(345): n is a, c, g, or t
  misc_feature (352)..(352): n is a, c, g, or t
  misc_feature (360)..(360): n is a, c, g, or t
  Genomic contig location: Contig_ID=SeqID_19317; Location=44..855; Strand=+
  SCN-specific regions: Sequence locations=1-471,493-644,666-812
atggaggnacttnaagnagaganagagaaantgaagcttattatggaaaanattgtgntgnaggngaaagttganaaaatggaagaggaaaaggganagtangaaaaggaattaatgggtaattanagtaagggaatantgtattttanagaataaagtaattttgagattntgnngannannaaatnaaaaatangnaaaatggtnagnagatggaattgataaagganaagnaaatggtaatgaangggagggaaaagnaaaaaatnagttaaataaaantgaaattggaaaatggatatngtatggatnagagnnaangaaaaatgaagaaaattgggnanntaaaatntttaaaangataaaatccggacaaattaggaattcatcattcaaagcttttaatgagttaagtttaaaaatctgaggatgaagtcgaaccgacgccatctgtgagagattgaaccagtcgaaaatccaaagaaattaaattatttttgaaaatttcaggggagggggttaaaacccaaaagtacctcactactcttttttgtcattttgagcgcctaagaactctataaaagtgctttcggatatttttggctctgtgccattgatacacatttagcttgaaattttggtttatgaaaaagcctcttttctttcgtgaaatttaaataatttaagaaattttcgagtgcacaacgccaatcgaatcgttgggattcgaatgcttgtcacaatgacattaaaatcagtgatgacaaaattttgacggtccttcaaaaggaggatatgggtaatttttatta

SEQ ID NO: 84056 - DNA, 957 bp, Heterodera glycines
  Genomic contig location: Contig_ID=SeqID_19318; Location=662..1618; Strand=+
  SCN-specific regions: Sequence locations=1-246,308-435,464-628,651 -903,935-957
atgttcttttacaaagtaaggggggggggggcagggggagtaattttcaaaaaaaaatcgaaaatttaagaaaaagacaacccagtcgaagacgaattctgaccagcagaagatgtgggaacagaagtttaaggaaggacaagcaaagctcactgaggtgggatcattttaggagcaattaataaccaattaattttcttttagactatttttgtcaaattctgtgaataagaaaactcgtgaccgttaaaatttaaaataatttttgaataatttttttcaaaaatttttattagaatttttttatcgatttttaaagattttgagccaaaaatggatagttgtcagtttttgaggaattttctaattaagaagaatggttcaggaggtgctagcataattggaaattttaatgaatttttttaattgccaaggaaaattttccatttctttccctccttcttttcatatacatactcaaagaatattgaacatttattttattaaaggccgaagcccagaatcaaaagttgaaaaatgacattgagaaaatgcaggcaaaattcgacgggaaagtagcgcaattggaaaagaatttggaggaattgcagaaaaatgtaatgatttgatttttcatttatttatttttaggtcatattagggtggggcggtaatagggatcggaaaccgattggggaatccatttctgttcaagtctaaatcagaattgaatttaaaaaagttgaaaaagaatcgggaaaaaagtatcaaagatattttctatatgtttattttttgaatttgaaaaattgaaggcacttttgaaaatttatttttttcagcaaaaggaactggtgacggaacataatgaattgaaggcaaaagttgacaaaatagaacagcaggaacaacagaagcagcagcaagaagacagcagtaagacacagacaaacgatg

SEQ ID NO: 84057 - DNA, 1140 bp, Heterodera glycines
  Genomic contig location: Contig_ID=SeqID_19319; Location=1..1140; Strand=-
  SCN-specific regions: Sequence locations=1-192,216-986,1008-1140
taattaaatccattccttcgggggaccgtgctgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaaaataagcctaaactttttggccagtttaaaaagga

SEQ ID NO: 84058 - DNA, 647 bp, Heterodera glycines
  Genomic contig location: Contig_ID=SeqID_19320; Location=767..1413; Strand=+
  SCN-specific regions: Sequence locations=1-647
atgccaattgaaccatttgaattggtgaatgaacggaccaatgagaagctgacactgacggaggatgaagattacgatggtgaattcattggcggtggtgaagtcattaaagattggctgttgaaacggtgtccaattgttggggagacggcggcggttcagcagaagaagaaagacgaaaatttggaccatttgtgcggactctacttcaatcttcatggaaattgtattgggtgagcggaaaggaggcttatttttgaatagagcccggaggggatgatacagtagtgtcctctctcttacagtactttcccagaatcttggcagggccaggggttcctattaaacaggccttgtccctcctgttctcgtccatctcgaaaaccctggtcctcttgtccgaatttttttcaaaattccgtgctctacttttagctgttctcatccatttcaaattttgcttaatttaggccgctgtctccgccagatcaaagcgatgaaaaagtgttctcttttcccggacccagtgatcagcggaagaagaaaaagtgatcattttgggaaatgaccgatcatttttgagttgtgatgtattggattgattgatcatattttgtttggcacatttaatgctgatttgtgagtta

SEQ ID NO: 84059 - DNA, 935 bp, Heterodera glycines
  Genomic contig location: Contig_ID=SeqID_19322; Location=568..1502; Strand=+
  SCN-specific regions: Sequence locations=1-15,37-276,301-935
gttaattccgtcttctttttcccctcttaaaaacggaaaatgacggccaatgagtcctttgccttggatatggcaaaagttgaattggtgcccatcagtccggtcattttgcgcgtttccttcatcatgtcactggcaatcctcggcaatgtgctgcttgtgtttgtcatccgtcgtggcaatgccgtggcacgacagcgtttgtcgccggtccaggcacggaaacggaaatccaattggctatttgcaatttgatggcactttcccctccctcgccttcagcttctcctcctccacacttgcactgctgacttgctcttcgctttggtcatttgccaatgcctttcctcgctttaccttcctttttgcttagctttctctcggcactcaaattgccattctcgccacttatccctattttcatggacctgatttggttggtatgcccaaacttagcccgtacgaccctttttaagttgtgccgttttgtgcgctaccttcaggcgttgccaatgtacgcgagtccgtgtgagtggggggggggggcaatgttcgcaatgtctttctcgctttatccgttaagttcttctggtggccataagcattgaccgttaccaagtgagtttagctcggttttcttccaaaattggcactttttggcgatctgtcggcccctcgcccattaccgtagtgaccgttaccgtcgtcccaattgccttgggattttcgcttggcttttggcccttctctgctccgtccctcaattgttcttctggcgcaaggattccctgagcaatttgtccctttttggagaggaccaaaagtgaaaccaaaacaacgaatttaccctttttatggtaattttttgatttagcgaaactccgatcagagaggagtgccacaccatctacagcatttacagtcagtgccatttc

SEQ ID NO: 84060 - DNA, 948 bp, Heterodera glycines
  misc_feature (16)..(16): n is a, c, g, or t
  misc_feature (44)..(44): n is a, c, g, or t
  Genomic contig location: Contig_ID=SeqID_19324; Location=184..1131; Strand=-
  SCN-specific regions: Sequence locations=1-46,68-211,234-328,350 -912,934-948
actgtgaatgccgccncacagggcttatctgcgcatggtggtcncgctctgtccaccagcccatgggaattgtcgccgggccggcacaaatttggcctccgcgtgaccatcccgggactcagtgccgagcagttttgaaagccaattcggctccatccgatacagcatcaaagtgcagcttgtcggcaacgcggagcatgtgaatagggccataattttattattggcaaattgatcgctgctcatttcttttccattttattgctcatttgtcagtgttcgctttcccccgcagtgttcggccgtcgaagtgttcccctttttggtgttggccaagtcctactttgacgacatcccacatgccatcaagcactttgactaccaagacgaaattgacttcaccgtctgtacgcttccgttcggcacagtctgccttcagatcagcttgccccgcaccggcttttgtttgggagaggttaagccagggaattcctgccatttgtggtaacgggaaaagtctcggagttgggctcggactggtctcaagcgtgacctggttcagtctcgaggaatcgtggtctttggtcctggtctattttctatgtttgggacaaaccccgcttttcgggaaaagtctcgataacaaataattagatcgatttccgagtataagggtaaacttcggcttcgttaaggtgatcagagcccatcttcacgtgagaaatgggacacggaaaacgctgaaagactgccgcctccaggcatttaaaagccatcatttaattttgtggctttaactcatttctgctggtaaatgcaccctttaagttggtactgaagacacaattcgaagcacggagccgatatgagcaggcaagcgaccaaaaactggtggagaatgtgatggactcgtacccattgggcaaagtgaaaggacgcaccgatttg

SEQ ID NO: 84061 - DNA, 885 bp, Heterodera glycines
  Genomic contig location: Contig_ID=SeqID_19325; Location=131..1015; Strand=+
  SCN-specific regions: Sequence locations=1-57,79-562,584-885
atggccggaaatggaaatgaattaatgagaacggaggatgacgaaaattctgatgattttttgaatttgtttgaaaatttggaactgacgacttctgaaaaattggctagtctaagggaaattgagaaaatatttgcggacaccgcaccaccgccagctggtcaaacgccaattgaaaactcagttcttgggtttgtgttcatctcacaccccatattgtgggcactggtacaaccggacattttgggcgaacaaaatgagctattggaccggaaaagtttaagcttaaaatcggatcaattagtcttccaaagtacatcaagttatgtgacgactattacactggaccctaacaataactggccacatttcacacaaatttcgttgaattggaacaaacaatctctattaggaactcgggtcaaaacaattgatttgaagcaaatgacttctcctccaaaactgggacaatcagtgaatcaaattgtcccttcgagctgctgtggaataattagggaagtgatccaaaataaaatcacctcagacattatggccattgatgtctttttgtatggggaagaaactaatcagcgttttttcccccaccaaatcgattcaagcgtcaacctgacggagttagaagaaggcacacgggttcaaactacgggattttgggccaaaacttctgcaatggaatggccaacttcgagtgatggaattcgcgattggtggactgagcagatctatatagggacgaacttaaaaatatttggcgctgatgaacatgaagacattcatcaatggctccaaaatgaacaatttcgactatcataccgttacctatgtgccgccatggacttgcaacaatcaccaaaacgcagatga

SEQ ID NO: 84062 - DNA, 276 bp, Heterodera glycines
  Genomic contig location: Contig_ID=SeqID_19325; Location=77..352; Strand=-
  SCN-specific regions: Sequence locations=1-144,166-276
ccacaatatggggtgtgagatgaacacaaacccaagaactgagttttcaattggcgtttgaccagctggcggtggtgcggtgtccgcaaatattttctcaatttcccttagactagccaatttttcagaagtcgtcagttccaaattttcaaacaaattcaaaaaatcatcagaattttcgtcatcctccgttctcattaattcatttccatttccggccatattttctgtttcttgcccgcaggctaaggggataggagaattgttgggattaat

SEQ ID NO: 84063 - DNA, 304 bp, Heterodera glycines
  Genomic contig location: Contig_ID=SeqID_19325; Location=2305..2608; Strand=+
  SCN-specific regions: Sequence locations=1-304
atgcaaaaacctattccttcaaatcgccccaattcttctgtctccaaaacccttgcctgcgggcttgaaaaaattgtgaatttgagtggaaatgagccactctcggtgccggtgctggcggatcggagtgatccgctgggactcaagtcggtccaacccgacccggtgccaatggaaagtgccgaggctggcacaaaagaaatggaagtgatggaagtggatgaaatgagcggagaaaaagggaaaaagggagaaatgggtaaagaaaaggtgaaaagtggtggaattgaagaggaggaagaaa

SEQ ID NO: 84064 - DNA, 1319 bp, Heterodera glycines
  Genomic contig location: Contig_ID=SeqID_19326; Location=353..1671; Strand=-
  SCN-specific regions: Sequence locations=1-284,306-602,624-783,808 -844,889-914,950-978,1000-1319
atgaaaattgtcaattccaatggaaaaactttgccaaccccgcaaaatccgttgccgaataaagtgatggcattcagaagcatttcgatctagtaagaatgatttgtgatcaatgaccatcgtcatcatcataccttcgtttgattttcagcttcatcgaccaaaatgtgttcacttttctccaccgctttcaccgttttctggccacttgtgcaacagaattggccattgccactgaaaatgttcgaatttcggcattctttgtgctcaacatttggccgatgttcaacaacaccaccattctgatgcatttgaacacaatgaattttcatcaaatgcgcatgtttgcgccgtcaatgctcaacgattgtccatgccttcgcgttgtcactttctacgacggcatttccaccgaatttccgcccgacgacagtgccaatgcgacggatggccaagcggtggccaaatggctgttcacgcctcgtgccgacaatttgccgaagatgctcagaattgagaagacaacggtggatcaatggttggcatccgtggaacaaatcaaaacggtgagtagtccagtttaatacgttttttggtggtaaattctaatggagctcctccctctaattttcgaaaaaaaatttgttttcaaaagccttgaaaatcccaaaggttttcggtgttgctgtatccgacatccgtttcagccaattccgaaccccagacccaaattcaaacaaaaagtcaaaactcaaatcttcgttttttccatttttagtctaaaaataatttaaatgatcttttattgaagcaataatgacttctgcttcgtttctgtgtatttaaacaaaaaattgaacaaaaatgtgaaattcaaaatttgatttttgttcgaattcgagtccggagtccatgtcttttggaaacaaaaaaaaattttttgaaaaatggggggggggggggtaaactaccacacatattacccttccttttctttttaggcatttttcatcgcttcttctcccgttaatttcgtcatttctatcgacgttccgccgttgtcttcgctttcttccgccgttgtgccatttaaactgaccaacgcattcaccggggagaaattgacactgtcacaagaaaatgcggaagatggaaattgttttttgctcatccgttgtccactttctgcatgtgatgaggaaaaatgggagaaggaaatggaagcagaatttgatgctcgacagaacaaaattggcattttcattggctacggcggaatcgacaacgggtgaacaattaatttaaagatgctcaataaa

SEQ ID NO: 84065 - DNA, 457 bp, Heterodera glycines
  Genomic contig location: Contig_ID=SeqID_19327; Location=70..526; Strand=+
  SCN-specific regions: Sequence locations=1-457
atggcgaacaaattcaatgcggcgagttagacctaaaaacgtaaacaatatgggataaaaatttgaaacactataaacccgaatcaacggatgggaccgcttcttcagtgtcttcgtcgccgtcgtcggacgctgcgtcgtcaaaatttaatcaaaaaataatcatcttcaaaacgtcactcaattcacaaacacacattgcgatgcttaattgtcatttaataaaatgctgttaaactgaccctcaatgttcagtgtcggctccaattcgcctctccaccgctgttaaactgaccctcaatgttcagtgtcggctccaattcgcctctccaccgtcatttttgatgttgcacgtgtacgccccgctgtccttagcctaaattttaaagtcattttatgtcaacaatggcgtttttgaaccgctttagtcgacattggcggcttaataacaatagaa

SEQ ID NO: 84066 - DNA, 249 bp, Heterodera glycines
  Genomic contig location: Contig_ID=SeqID_19327; Location=1643..1891; Strand=-
  SCN-specific regions: Sequence locations=1-61,93-146,168-249
atggtcgcctttgcttcaaatacctttccggatctcaacaataaatttggttagatttattaaaaaccttattttattttttgctatatttgaatatggcccatttcagagcttgtccacatccccgtcgaattgcgtgatacattgatttgttgtattttgggagatttggtctgctgtttgtttttggatcggatgttgaattatctttttggtgatcagcgagttcgaaaaatgttgatgtattaa

SEQ ID NO: 84067 - DNA, 390 bp, Heterodera glycines
  Genomic contig location: Contig_ID=SeqID_19329; Location=734..1123; Strand=+
  SCN-specific regions: Sequence locations=1-24,119-390
atggttactgtaattgcttggacgtaaaatttaaaaaaaaatcctttagtataagaaaaattttataattctactttaaatttgaaaattattttatttattttaatttttatattttgttcaacagattcgtggcaacaatcatttcaagggaattgaatttagttttttatcggcctcgggcaaaacgaagtatacgaacagaattacggcactcaggcaaatcaatgccacaaatgggttcggctttttggaatcaggagaccggattaatgtaatggtgcaaagcaaggatggcacaatgccaaaatcggcagtgaaagtgtttttcttaagcgaggcattggcgttcaacgaaatcagtgagtgatgaaaaaagtaaaaaattta

SEQ ID NO: 84068 - DNA, 675 bp, Heterodera glycines
  Genomic contig location: Contig_ID=SeqID_19330; Location=158..832; Strand=+
  SCN-specific regions: Sequence locations=1-167,190-326,446-539,561 -613,671-675
atgtacaaattcgaattcatcgtcgtcaatagcacagcgttcaatgtgtccgttaatgaggtgcagaactgtgcctacagtacaccacttccgctatggacaattcaatacatttcggtatgaaatatttttacaatggaacttgagcaatttcctgcaaaattaacgaattttttgggaaatttcaaaatcaagtttttttttcataaataaacattacggtagaaattttttatacggtagaatatattttttacacttgaagctgaacaactttcgctgcaaaattcataattcttgcttaataagattttaatctctaattgtttaaaaaaaatttttttataaaattaaagttttaaatgtaaatttaaacaaatttatagtaatttcaaacaattgataattttttttttgtagataattattcaaaaaaaaaaattttgcaaaaaaaactttttggtaatttaaggtcgattatgctaaatggtcctttcatccgcccattatcacttgtaacccttcaattcgatgctttgagccaacatccaataattccaatatgtttatggcatttcccgagaagaaaggaaacaattgaataattgcgcacaaaaaaacaattataattattttattttactttatttataaaatttttactattttagaaaa

SEQ ID NO: 84069 - DNA, 694 bp, Heterodera glycines
  Genomic contig location: Contig_ID=SeqID_3285; Location=31..724; Strand=-
  SCN-specific regions: Sequence locations=1-319,341-658,680-694
atgcagaaggtggtcagatcaccgggctctgatctgctgtacactggtaagttaaactacaaaaaattttttgtgcacaaacatttattttagacactgacagcctcatcctcgtccacccggaggagcggtgcccactgaaaactggcccccatttgggccagttcaccgacgaatactccgaccacgacattgtggaattttgcagtggcggggcaaaacaagtgaattttcggctcattttgcggtaattaatgaaaattaacactctagtacggcctttgtctgcgacgcaagggcgcggaagagggagcccaattggaacatgtgctcaaagtgcgtgggctgacgctaaattatgatgtgatcaacaaccaggggatgcgctatgagaacttcaaagaggaggtggtccggtacgcgacaagtggtgaatacgagccgataatcatcacataccccaacttccttcgtccaaacatcagggagggaggtcgggtggtttccatgcctatgcaaaaatgttatcgcccgtttgtgggaaagggaatcatcggggccaatttcaatgtattggattttggacacacattgtaatttgtacattatctatcacacacacacacacatatgactgtttcttttgtacctcaaattgtgtacattttatgccattttattaaaatgtaataaa

SEQ ID NO: 84070 - DNA, 1908 bp, Heterodera glycines
  Genomic contig location: Contig_ID=SeqID_3286; Location=1504..3411; Strand=-
  SCN-specific regions: Sequence locations=1-920,942-1251,1273 -1358,1380-1388,1411-1908
atgcaaaatcagcctcccaagcatccctttttgttttccattgaccaaattctatcggtcccaagcaaaaagccgcgtcgcggctttctcatcaatgaattgcttggagaggtgcttcaagagggcggcggcagcagctcatcatcatcaaagtctgcaaaggaatacgtcaaaaagctggacagcaccgttgagcatgtgccccgcttccagtacagcaaagtcaagtcgcggttcagcattgaggatgtgccagcagcaaatcctgagggactcctggccggcatcttccagtactgccttgacgcagcgatggaggagagtcgtggacgtggaattgaacccacgcatctcggctgcatgatcagcagtccgttgctcaccggcggggacatccccatcccggttcgacaaatcaccgacaacaccgtaaacaccatcctcaaccaattcaccaaagtggctcagagcaagcagcagcaaaacgtcacactgtggggcgagccattcactgtggtggtgaccacagttgaccgtactggactgcccggccgaagggtgctgaagggcggtgctcgacgaagcctagcatctgtgcatcatagggtgacggaaacttgtttgattaaggtcgtgtcgcgccatcaaatcaaaactattcgatgacaatttgttttaagatttgcaatccggacgggcattgcctcttctacgccttgcaggcgacaatggtggccaaaacgtgcggttggccccgttgtagattttacgactacttgcacagtcggaggggacaacagggatgtctgaggcgggatgctttacaactgatgcagcaaattggtgtacggaccggtcggaacacttatgatgctgagatttgtgtgccgcgtgtggtcgaccactggaacaacacgcaacagcagcatcgatttgcagtgttcatctttggctcatcgggacaatacaagccgttgtacaaatacatcaacgatcattacgacactcccattgtgctctatttgaacaaccagcattttgatggtgtgcagaaattgcatggcttgtttggacaacactactgcctcgactgcgaaaagccttatgagcgtccgtcaaggcacctcaattcttgcaaggcgcgctgtatgctttgctcacgcgtcggaccagcattcccgtgtgtcccatcgggcggatttttccatcaatgcgcgggctgcaacaaaatgtttcgcaataacgggtgcctccaacaccatttggcatccaacttttgcgcccagtcaaagcagtgcaaggactgcggcgttatatgggccacacgagtacataacagagatgggagaaaagtaaacataaaaataaaataaaattttcatttcttgatggatttagggtcacaaatgccacgagacctattgtcagctgtgcaacacatttcacaatcccgagcgggggtgcttcattcagcccattgagccaaaggagcacgacccgtaccgcattgtggctttcgacttggaaaccatgcagcatcaaccagtggacccccagcagccagagaagagagagcaccagcccaacttcattgctgcccgagtcgcgtgccctaagtgcattgagagcggaaattggcggagggcaacagcgggctgccgattttgtggtccacatcgaactgtcgctttctgccagcgaccctttgaggacactcgtgtggacaaacgagtggtggcggacaacccactgcaggcgtttgtggattggctcatcttccaactaccagccaaatacgacacatacgcctactcacactttggcggacggttcgacatggttctggtctttcgcgagctattccggattgggttcaacccggagatgcttcgacgggtactcaattaa

SEQ ID NO: 84071 - DNA, 1036 bp, Heterodera glycines
  Genomic contig location: Contig_ID=SeqID_3287; Location=3944..4979; Strand=-
  SCN-specific regions: Sequence locations=1-478,500-1036
  Gene Ontology: Mol. function=calcium-dependent phospholipid binding; Cellular component=synaptic junction; Biological process=cell proliferation
ctcagttaaatcgacagccaaggcgccacctccagcttcggtttccgctgaattggctcctcgcgctcctctggcagactctccaccgcgttttgaagaaactgagcaacagaagcctacaactcctgcaaaaccttcagttaagacgacaattacggcgcctccggcgcaactaaaaagctcggcaacgcctcatcaacaaaaacagcaagtgcccgtaaaaccaccagctccagtttcgattcccgcaaagccgtcaggctctccacagcgttttgaaggaactgagcaacagaagcctacaacccctgcaaaaccttcagttaagacaacaattacggcgcctccggcgcaactaaaaagctcggcaacgcctcatcaacaaaaacagcaagtgcccgtaaaaccaccagctccagtttcgattcccgcaaagccgtcaggctctccacagcgttttgaaggaacggaacagaaacagcagccaccacccccgccaacatcagctgctttaacactagcagatttgaatttaccagaaaataccctcagcgttcaaatagaccctctctcatatgtacccaattccgtctcaattcaatatcttgagaacatggaacgattcaagctggtgttcaatgaggcgatcgtcagtcatgtgtccttctcaccgcagttgggctatgtgcttggctttgaaaaccctcaacatgtcgtgtcaaatgagctatcaaagtatccggtggatttgcgcggaggcatctcaagctttgctgtctactcgaaaggattgaccgaaaacatgataattggcaattcactgagttcgctgcttcgtgttgtgtctatcagcggtgccatcccttgggagtacaacgagaaaatttacgattcgcccatttttgctcgtgtgttaccacgggagatcaatgagattgagattgagctgcgcacaatggacaaaggccgtctcgtgccgttcgcctatgggacaacgatggtcgtgttgatatttaagaaagtgataaatttctaa

SEQ ID NO: 84072 - DNA, 129 bp, Heterodera glycines
  Genomic contig location: Contig_ID=SeqID_19331; Location=1054..1182; Strand=-
  SCN-specific regions: Sequence locations=1-129
tgccggtggctgcggcattgaccgccgcgctctcttcccccgccgtttccggcactttgtcctcgtcaaattgaccgtttggtggcccatcaatcagccgactctcaaaattatttattaattattgct

SEQ ID NO: 84073 - DNA, 1533 bp, Heterodera glycines
  Genomic contig location: Contig_ID=SeqID_19332; Location=296..1828; Strand=-
  SCN-specific regions: Sequence locations=1-157,180-325,347-1024,1054 -1533
  Gene Ontology: Mol. function=cysteine-type endopeptidase activity; Cellular component=spindle; Biological process=regulation of exit from mitosis
aaatttgtcgaacatttccaattcatttggctctcttcatttgccccccttttcctgccacttcccgtcaacgcggagacgaccaattccacggaactgaaacggttggaacgcacactgaccagtgaacatggcatggcgaaggcattggcactggtaaaaaaaataaaaaataaaatgattttgggtcccaaattttagacactttcacgccttttaccattcattgaaacgatggacgaatggttagggtttggcaaattgttgtacagaatagacaaacaacaaatcgacttggattcgccggatgagcagcacacgacgagggtcagctttaaaattttgaaatttttctgaattttctaggagaattaggtttttttttaattcgaaggagaagatgtatggctaaatttgaacgatttcttattggaattttgattcccactttttcaggcagttccgaccaaatttttacagttcataagcaatttctggacaaattatcgctcaaaaattgttggaaaatcgccaaaagtatcaacaatgaaggagtacaccatgttggtgattccgccggttggttttttaaaatggatttatttgtttgaatttcgtccccttgtcagtcacttagccatttgccttgggaatgtttgccaatttactgtcgcgcaccgttcgtctaccgtatcccgtgcttccatctgtttgaacatttgatggagcagacaaaaaatgttagttttccctcaatttttttttttttttgcccatttgattattcgcgttgactgcaattgaaaaagcacagattccgacatcggtggacgggcgcaactcctactacgtgctgaacccgggcggtgacttggagaagacgcaggaacgccttgccgcgttcatcaagcgtttccattggcgtggcattattggacaggtggaggaaatgatggatgcatttccccccggttttaagcaacagcctttttttaattttctaaatatctgaacgattttctagttaaaaaaaaaattattttttcattttttgctgcaggttccgtccagggaacagatgcgagcagtgctcaacgaacatgacctgttcctgtaagttcatgttcaaataaatgggtgcgcacacttcattacactcctttgctttttttctcgttttactttgaatattgaaaaaaaaataataattttaccgataaaaaatatctgagaaattagaatttccatccctttcctggattgtatatcaaccaacattattttttgtacacccattattccttccattgtttagttacatgggccatggcagtggcggtcgctattttggccgttcgttgatccgcgaaagtgagtgccgtgccgtctccgtgctgatgggctgctcctctgtccgtgttgtggacgaagggcccggcctggacgggcgctcgtccgtctacgaatacatgatcgcccgcgcgccatgtgtgatcggctgcctgtggatggtcactgacggcgaaattgacc

SEQ ID NO: 84074 - DNA, 374 bp, Heterodera glycines
  Genomic contig location: Contig_ID=SeqID_19335; Location=344..717; Strand=-
  SCN-specific regions: Sequence locations=1-374
atgcacgcgttttgcgctcgagctatttatcatcgggcttgtcaatccaaagcgaaacaacaaagatggtgttttgaacgaataaagggcataggttattttgaagaagtgtcaaagaacatgcagcaataagcctgcaaaatctaataagtggaaaatacatgagtatagaatttattttcagaaagtgtcaacagacttttgggaaaatatatttgcaatttatcaacaattttgagaagtgagttagaaatgataaacttcacgattcaaaccaattttcggtgctctaattaaccgcgataaaaacatccgaataattaaatagcttctgagataataaggtttatcataaaatttcatttaaaaataaa

SEQ ID NO: 84075 - DNA, 397 bp, Heterodera glycines
  Genomic contig location: Contig_ID=SeqID_19335; Location=753..1149; Strand=-
  SCN-specific regions: Sequence locations=1-397
atgagaagtgagttagaattgataaacttcacgcgttcactcgagctattttcgttggtctaatcaatccaaagcgaaacaacaaagatggtgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataaggtttatcataaaatttcatttaaaaataaa

SEQ ID NO: 84076 - DNA, 234 bp, Heterodera glycines
  Genomic contig location: Contig_ID=SeqID_19339; Location=1178..1411; Strand=-
  SCN-specific regions: Sequence locations=1-234
ccatagccattccttcaaatagccataaccccctttccgacgctctttggttgtattctgccgaccccgcaagtttttatcagtgctttctttttgatgataaatgaggagccgatgaaaaggctcgagctgatggccaacccgagaccaatgtaaaaatcgacgagactcgcgccgtttcttacgtgtggcacggggctagcaaagtctgcggacgacggccgatcgccgccc

SEQ ID NO: 84077 - DNA, 340 bp, Heterodera glycines
  misc_feature (309)..(309): n is a, c, g, or t
  Genomic contig location: Contig_ID=SeqID_19340; Location=406..745; Strand=+
  SCN-specific regions: Sequence locations=1-340
tgttcattctttacgttgcgctcgttttgctgttcacttttgtgctcgtcgtttacgttgcgccccgttatggccacaccaacattttggtgtacatcgccgtctgttctttgatcggttctctgtcagtgatttcggtcaaagggttgggcttggccataaaagagagcataacgacggaggaacagttcaccaattggtccgtcctttgcgccttttccattcctcgccacttctcttttcaggctcacttggttttggctgttggctgtcctcggctgtatctcagaggcaattggtctatctcancaaatcattggacatttacaaaagatcgatg

SEQ ID NO: 84078 - DNA, 281 bp, Heterodera glycines
  Genomic contig location: Contig_ID=SeqID_19345; Location=709..989; Strand=-
  SCN-specific regions: Sequence locations=1-124,146-249,275-281
atgacttttttggtaagaaaaaataagatatttcttgaagtattgtattaaatctgccaggaaattgtatgtaaagtttgaaatgttgatatttttttctagagagcgacatttggcgaaaatacggatcaggatcaggactacggactaggcatccatacggactacagacttacggactaaaaacccggaaaacccttactccgtataagtccgtatgcaggaaaaatacggacccgtatacggatcagggttttttgaaaagttttttaatcaataaa

SEQ ID NO: 84079 - DNA, 1202 bp, Heterodera glycines
  Genomic contig location: Contig_ID=SeqID_19345; Location=1542..2743; Strand=+
  SCN-specific regions: Sequence locations=1-33,56-421,565-670,693 -1079,1124-1147,1169-1202
atgctccgtgtcgtgtccaaggaattggtttccaaggacatgacgggaaaatttcataaaatccaaggacaattaaaaattttatcatttttcgaggaacaggtgggtccggcggtgccgataggcgccgccggaaaatttttttgaaaattagagtgtaatttgttaacagattttcaccaaaaaaggtggattttgcgattttgagatgatggcgatgacaattttttattttcacaacccttcttcaaaatattgttaaaaattcaaaaatttctcaaatttcgttgaattttttaaaatttttccaaatgctgatttccaaggacgtccttggcatccaaggacattttttatttccaagaaagatagtcaaattccaaggacgtccttggcatccaaggacgaatgagaacctgtatctctttatcttccttttacagttttctttctcttctctttatttctctgtcatataatttttctctatttatctcactttatctctctctatttctatgtcatttctctctctcatctcctctctctctcatcctcccctcttatttgatcatttcattgtgtatttatttgtcgaagtggaaggattactttcaataggaaaatttttgggtaatagttcagatggtatgatacagtaacagtttccataaattttttaaattttaaaagtcaaatcaattttgaaccctgaacacgaattcgaacaaaagtcgagtttaaattttcgattgacgtttttcgtataaaacggcttaaaataatcttttttgcaggaagtgatcgccttcagtatgcttccgggtttttagtcctgtggtgattttggtggatggtggaaaatgcgttttttatgcttaatatatcggaactaatgcgcagaaaaaaggcatatgcttcaaaattcgttctctaataataattagagaccagggttgttccgggtcgagaaaaatatcgggtcgggtttcgggtcgggtcggccgaaaaatcatcgggtcgggtttcgggtttcgggtcgagaaaaaggccgggtttcgggtatcgggtcaattgacaaatttttaatttgtttaaaaatcaataagaaaaattataaattggtaaattccgatgcaaaaaaagaagcttctccaaattttctgcagttaaccgatttcttaaatcagtagacgatggaa

SEQ ID NO: 84080 - DNA, 1182 bp, Heterodera glycines
  Genomic contig location: Contig_ID=SeqID_3289; Location=476..1657; Strand=+
  SCN-specific regions: Sequence locations=1-973,1003-1182
atggctggtcttgaccaatcatttctgtcaaaaggactcgtctacgatgtgatgggcacgcaaaattgtaattacgactacaatgtgaaagggtgcgcaatgggtccatccgccggaagagagggtttgttggaatagcatttttggtgaggaaggcaccgaattatgagccaaattggcaagcaaatgccaagtgctgaacatgagggcatagctgtggccaaagaacgaatgggccagatattctctcggaaaaaacggaaatttaaggcccacatgaagaggggatgccagaccctttaaaattagccacaattggttaattatcattaaaacagtgaccaattgtacgcggaaggaccaattcgaatgtccgttgtccgaggattgtgtgccgttgtcaaagcgatgcgatggcaattacgactgtgtgttggaggaggacgagcagaattgccgtcagtcaaagccaaaataaggtggcaactgattgagtttgtatttagcaatgtgcaaaccaacgcattttccatgtgttgtttctgaacaatgcattccggtgagtgggaaagagaagacaattgaggagagaagacaatttgccactgtttgatagcttggccaacgctgcaacggcatcaaagagtgtcaggacggaactgacgaattggagtgccaaagttggtcattcaagggaaacaaacagcgaactactgaccaaatgcaaaaccaatcacagattgtggagctggaaaattcttatgcaggaaatcgggcaaatgcatttcggcaaaggaacgctgcgatggatttgcgcattgtccgcacggtaattaaatgaacgattagtgaacgaatgtttgatgaagaatgattaatgatgatgaacaccaaaggtgaggatgaacaattgtgcaagaaagcacgaattgtccttgggccgcggatgttcgtttgcgaggttttcaaaaacattaataattatatttaaaaaatatatttctaaactacaactgataatcaccacaaatgttattttcagagtggcaaacatcaaatccctcaacaaaatgtgtgtgacggcgttgtgcactgtccagacgatgcatcggatgaaaaatattgccaagtcggaacagcgacagaaacaatgcgcaaaatgggagcaaggacaatgccaag

SEQ ID NO: 84081 - DNA, 2346 bp, Heterodera glycines
  Genomic contig location: Contig_ID=SeqID_3290; Location=44..2389; Strand=+
  SCN-specific regions: Sequence locations=1-121,143-855,877-1107,1130 -1889,1911-2255,2277-2304,2326-2346
atgattaatgatgatgaacaccaaaggtgaggatgaacaattgtgcaagaaagcacgaattgtccttgggccgcggatgttcgtttgcgaggttttcaaaaacattaataattatgggcaatttaaaaaatatatttctaaactacaactgataatcaccacaaatgttcttttcagagtggcaaacatcaaatccctcagcaaaatgtgtgtgacggcgttgtgcactgtccagacgatgcatcggatgaaaaatattgccaagtcggaacagcgacagaaacaatgcgcaaaatgggagcaaggacaatgccaaggtgggaaggcatgttttcaatctcatttatgcaccaacgcggaaattaaacctcttaaatgtttatgactccgtaattaaagtaaaaggcaaattcgaaaaaactaatttggcagtccaaacgctcctccaaatcagctggccactcccgcaatccaactttcaaaaattgcgtttgatcagcctatcactgcacagcaacagcagatggagcaaataaatgccggaaaaagtgagccatgggttggcacaaacggcggaatgacgcaaactgatggtggaccaagtggcaaaccgccgcagaaagtccgttcaatttggtcaattaaaggcatgaaatgctttttagttttcactgagtacggcgaaccaaccgaacaaaattggcaatgttagggatgaaacatttccaacctcaaactttggaccgatgagaaatgcgatgaacgcgcagcaaatgatgggcatcagcaacgggacgaatcgactgatggtggaaatgccaaggcaacgaaagccgacggaaaacaaaagcatgcaaatgaaaacggaggacagcagcggggcaaagactttggtggagggccacttccaagcgggcgtttggaacggaagcgcactccaagcgcagcaccagcggaacaacccttacgcggacgaatggtatcagcaacggcagaacagtggcaccgaaggaaggcaatttcaacagcaaatcgggcaaaacaatttgatccaagaggaaggcgaccaattcgtaatgagaatgggaaagtaaggcatgggaaggaaaaaacacattcagaaatggctaacatttggtggccaattgccacaaccgcaacccgtggtcattacgagacaacagcaaattgagcagagaagggcaattaaggaggagatgggcggagaggacagaaaagggggcgccgagggggcaaacacggcgggaacggacagaacggcacaaccgcagcaaacagcgggcgaggaacagaaagcggcggaaagcggcagtgccggactaaccgcaacggaaacaacgaacgaaggcggcgaccagcagagggtgacgggggttccgctgatcactgtgggattgacaaaagccgaggagggcgccaaagaagtgagtgatggcgtaaaggaatggaaaagcatcggcactgactacgccttagaaaaatattttgaatcgaacaccgaccaatgcccaaaattcgacgattgataatcctttgcaaatgttattttcgattagcagttgtcgtcgcaaactctggccacggttggaggcgcggaggacgagctgaaaaaatcagcggaaacgaaagcaacggaaatggtggcagaaagtggtaagtgcgacaacgccggagaaaagacagacgaaggaacgactggggccacagaagaacagcaaaaggcacaatttgggacggaaatgcccgaattggaacagacaaaaacggaggtaatcccttaacaatgtcagatgaacaaaagggaaaagtgtgttcattgtcagcagaatgagcagcaacaaattgagagagacggcgggacggaacgccaaacggaaaagaaagaagaaaacgatgggacgaaagccaacccaacgggggaagagcagcagctgaacagccaactcacagcactgaaagggatcggcgaaatgggaggtcagagagtggaactgaacacgggagacgacagcgaggaacaagagcaacaagcgatactccggcgattgtacagcaaatacgggtcgaatgcgaggtaaaggcggacaatggcaaaagccatgccgatccaatttcgaggccgcgtttgtgcttctaacagggatttgcttcaacgagtggagaatttgctgttgttagccgaagatggaatatcggcaaaaaagacggtgaacgaacccaatgatagcggaaaaagccaaaaaatgaagagaaggcaagcggaggaggacaaagggctgatcagaaaatatttggagcaactcatggacagtgagacgggaagaa

SEQ ID NO: 84082 - DNA, 1165 bp, Heterodera glycines
  Genomic contig location: Contig_ID=SeqID_3291; Location=19..1183; Strand=-
  SCN-specific regions: Sequence locations=1-253,276-330,352-1069,1091 -1165
atgaaagacattgccactgaagaaagtattggtaagcgacaattcagttttacaaattatcgtttttaaattcagcacagaggcggcttaacctaaaagcgaatttcatgcggcagctacaaattcggcgtggtgttcttcccagcgaaattcccccggttggagtcgccacaaacgcagtgcccacaatgggaagaaagtttcgaaaggtttgctgtgaaaacaaaaaaacattcggagagaagagtttgattttcccacagcctttggaaagtcgctttccaccagccaaaccccgttttggccttggaatgacagccgccgatttcgaagacaaaacggacaagtcgggccttttaaactttgcacggagtactcatttttcaatcattcatttagctgttcttcattagccaaagggccttcactgacagaaacaaatgccccaaaaggaaggaatgttcgtccaaaagtgcgtaggtccttccttaaccacgaaccttgcaaatccttattgcctaataggagtcatctggagtcaaaattcaggcaattaactgttacatcaatccgtcgcaatccgtctccacttggccaacttcgaatgacacggactccgatggacaaagtccctctccgacggttttcactcatcaccacttttgcgcgtttatttctgtttttcgtcagagttcggcttccgtcacgtctttcggttcttcgctgaccaccgccactgatcccctcgtcgcgcaacacgtggaccaaaatgggaccatctttttccccacttcctccactccgtcggaccatggacaaagttacgacgagacgccggcttcttcagtgctcactttcgacttgtcctctcacacttcctccgatcgtactctcacaaacaactcgcccctttccatgaacaacgaaactccgcgcccggtcttttccctttttcacgaagtccaatttctgcattcactcggccgtcgtctttctctgcattgcaacagtcggcaggacgagtctgttgcctccttttccaatgttttggcattaattcgctttttctaggggttctttcattttcaaacatcagatgctgaacaaaatgattgtgctaacccgaagcgaagcactcggcgaggagggaattcgcatatctcaa

SEQ ID NO: 84083 - DNA, 1983 bp, Heterodera glycines
  Genomic contig location: Contig_ID=SeqID_19349; Location=4..1986; Strand=+
  SCN-specific regions: Sequence locations=1-442,464-1079,1101 -1158,1180-1203,1225-1566,1589-1903,1925-1983
atggaagccgcaattcatcaactcactgcggcaatccagcaattattgtcaaatcaaaatggtgcgccagccgcaaatgcgcatgcttcgccaacgcttccgcccatcgactgttttgagccatcggacgatagaagcatttccgattggttggaacgcttcaattttgccctcgactgtgcggcaccgcaactggcagacgaagcaaaggtcaagctgctcatgacgaagctgagtgaagtggctttcagccagtacagcaagtcatgtctgccgaagaaagtcatcgattttgactacagccaaacagaggagcgcctaaagattgccttcagccggccacaatctatttggattgatcgctatgaatgtctgagggcctcaaaaagcgaagatgaaagctttcgtccttttatcaacagacataagcgactcttgcgtgattttcagtttgaaaagctcaacgaagagcaattttcttgcctcatgcttttgacggcactgaaatcaccgaaggatgccgagctgagaaagcgaattctttcgaagcttgcagcggatggttacctggtcgagtatgatggagtcgtcgaagacctccaaatgtaccagtcgaccatcgctgaagcaaaggtcctcgaacaacaaccgatgggctcacgaaacttgatggcgaccaaattgaaggcaaaaaagaaacgaacgaactcggatctttcgtcgaatgcgagcagcatttcgacaggaacacggagcagcaatcgatcgcaacgcgtatgttggcgatgcggtttgagccattcgtcgaggaattgtcgacatgaaacaaccgtttgccgaaagtgcaagaagagtggccacttggaaaggatgtgtgccaagcaccaggcatggttgaagaagaatggaggaaaaaatgaaaaagcggcgaacaacgtccgcgttggaggagttttcctggttaaatctgagaaccagaggaagaatggaataatcgatgttccgattgatgtgaatggcaccaaagtggatttcattgctgatttaggcactgagggaactgttctttgtgaggacactgtgcgccaaatcagagctttgaaattgagccgttgtcaagaacgtgctcagtaccacgatggcacaactcgtccattcgttggcaaaggaaagacaactttttcgttcggagaccgctcatgctatggacatttctttgtttccaaagacggatccaagaatttgctcggattggacatgatggacagacttggattgtcggactccatcagaaatggtctgaaggacaaattccgaactgaggcttccaaagagaacggagcgagccaaaagaaaaagaagaaatcgtcagaaaagacggacgtggcaaaaagaagaatttcttcgctgtgggagcgaatgtgatcgccagcttgggtgatgagccatggcgtgccggacgtgtgatcagccgaaaagaaggcacttacgacgttcaatttttggacggcacgactggagaattcccggcaaaaggtgtacaaccgtacaagccggatgaagatgaaaatttgaattttcttcttgacgggtttggtctgaagagagcctcatccggtggatctatcgggaagcacggcagcgatggccgacgagatcaaacgaaagatgatcttcgagaagcttccgactgtggacacaaggcataagaacgccgatctgaggatgcggatgatggacggaggcccggcatttttcaaggggggagatgttagggttgggacccaattgtccggtgcccattttgaccctttgtttcatttgtatttcccttctcccttcgttatgtcacgcccacttctccgcccataaatacccgcgatgttgacccttccccatcattcttttgcttcttctccatttatttgttccctttgctcccaatcgatatttgaccccgttcgccctgtcccttctttttga

SEQ ID NO: 84084 - DNA, 758 bp, Heterodera glycines
  Genomic contig location: Contig_ID=SeqID_19349; Location=156..913; Strand=-
  SCN-specific regions: Sequence locations=1-447,469-758
ctccattcttcttcaaccatgcctggtgcttggcacacatcctttccaagtggccactcttcttgcactttcggcaaacggttgtttcatgtcgacaattcctcgacgaatggctcaaaccgcatcgccaacatacgcgttgcgatcgattgctgctccgtgttcctgtcgaaatgctgctcgcattcgacgaaagatccgagttcgttcgtttcttttttgccttcaatttggtcgccatcaagtttcgtgagcccatcggttgttgttcgaggacctttgcttcagcgatggtcgactggtacatttggaggtcttcgacgactccatcatactcgaccaggtaaccatccgctgcaagcttcgaaagaattcgctttctcagctcggcatccttcggtgatttcagtgccgtcaaaagcatgaggcaagaaaattgctcttcgttgagcttttcaaactgaaaatcacgcaagagtcgcttatgtctgttgataaaaggacgaaagctttcatcttcgctttttgaggccctcagacattcatagcgatcaatccaaatagattgtggccggctgaaggcaatctttaggcgctcctctgtttggctgtagtcaaaatcgatgactttcttcggcagacatgacttgctgtactggctgaaagccacttcactcagcttcgtcatgagcagcttgacctttgcttcgtctgccagttgcggtgccgcacagtcgagggcaaaattgaagcgttcc

SEQ ID NO: 84085 - DNA, 463 bp, Heterodera glycines
  Genomic contig location: Contig_ID=SeqID_19350; Location=119..581; Strand=+
  SCN-specific regions: Sequence locations=1-24,80-133,202-242,423-463
atgcctgtcgttgcggctgttgatctaattttggagaaccaaatgaattttgttaaaaaacgaagaaaacgaacccacgtgagtcaacaaaaccttccaatgttttgagtggaatccatctgagtgaatttaggatgaaactgatggaaaccacgctgacaagaccttattcttcagtgatccgaattcgcaaaatgacgagtaatattttgtttaaaactcaaattatttttatattttagatcaactgatgaagttttcttgaatgaaattgatctggaaaacccatctatccatgattttttcgttgcattggccgcacatttggataatctccttcaaaaccggaacgagaaaatcagtttccaagctgcgcaaattttcgacttggtttcttgcttttcaaagctttttacaagggttagtgatattttgttgtatttttttatattctttgaatgca

SEQ ID NO: 84086 - DNA, 930 bp, Heterodera glycines
  Genomic contig location: Contig_ID=SeqID_19350; Location=960..1889; Strand=+
  SCN-specific regions: Sequence locations=1-667,689-769,791-930
atgatggacgtagcgcgggacaattttgagaaagttctcattgaaatggtacaaaacgctgagaataaaacagcactcaaaggaattcaatggatgggcgtaagatatccttttgaatttgtttatttttcacctttttaagaaatcaatcctctgctatttctccaaggacactgcaatttttgaatgttctgtgtgttttacagaatcatatgtctcgacggcatttcgatgcactgcaattcaacccctgaaagacgattctgaaaagcgacatttgttctgtttggactgtgttcgtggtcaagccgaagcatctgtgaatgaagctttgctttccgaagaggcgttgggtctgcgctgcatggcatcggaatgccgaaatccaatccttttcagtatttttaatgctaattgtaagtttggcaactgctttttcaccattagccgaaatcagcggatatctttcgcgtgcgcttcgtcgtcgactcgacgatcgcctcacaagtcaggccctttgctccgctgggctttctggcctcgagtactgcttgaagtgcgattttgcaatggttagttagcatgccttttccttagatgctgtgaacaatggctttttacttcctcaaattaatcctgctattctttatattaatatagtaattcgcatgaatgaattgaatttaaatcaaaaattcaagtattttgcagatcatggaagtcccaaaggaagtggacaaagtcttcaactgccagaaatgcggatattcattctgcaggttttaaaaattccaaataagatagtgctgtttcagactttgtgaggaggactggagcaaacactttgggttttcgtgtgacaaagtgaagctttaaagagggggaagcaaagcggagagaaaagtaagtgactatgggtgggagtcagaa

SEQ ID NO: 84087 - DNA, 1710 bp, Heterodera glycines
  Genomic contig location: Contig_ID=SeqID_19351; Location=91..1800; Strand=+
  SCN-specific regions: Sequence locations=1-548,570-824,846-1710
atgtatgaagattgcaacaccgtttttgcacggtgccatgacgcgaagaaagcgcgtctcttcattactttcacgaacaacagggaatggcctgagttcaaagagaatttacacaaaaacggtcaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccatctgatggtggtgcccaattagaggtaaacggcctaatatacgacaactcacatgtcgtgccgtataatccttatattctgctgcgttaccgagtacaccataatgtactgtttgcatatggtaacaaagcaaatattaaatacgcactcaagtaccctttcaaagggccaggacattgttatgtcgagtgcaaagaagagtccggcaataaaattggaattgatgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctttttgtgagcatcctggtctatggccagccgagtaatgccatagaattgtggaacaagtacaaagaccaaatgtacaatccgcaaggcattattactctggcacagcataaagtagcagagcttgaagccctagccgacattgattggcggctgcacagctgctttaacttaagctgtgtgcattttagcctgccagacccgccaacttcaattgccaaaaatactgacgcggcaattgaaaagtttttctttggcgatgatgatttgaatttgcctccagggcaaccaaatcctcgtccacagccaaatacccctccgccacttaacagcgaccaacagaag

SEQ ID NO: 84088 - DNA, 846 bp, Heterodera glycines
  Genomic contig location: Contig_ID=SeqID_19354; Location=345..1190; Strand=-
  SCN-specific regions: Sequence locations=1-846
atgtcggtccgcaaaagtcggtccgcaaaagtcggtccgcaaatgtcggtccgcaaaagtcggtctgcaaatgtcggtccgcaaaagtcggtccgcaaatgtcggtccgcaaaagtcggtccgcaaaagtcggtccgcaaatgtcggtccgcaaaagtcggtctgcaaatgtcggtccgcaaaagtcggtccgcaaatgtcggtccgcaaaagtcggtccgcaaatgtcggtccgcaaaagtcggtccgcaaatgtcggtccgcaaaagtcggtccgcaaatgtcggtccgcaaaagtcggtccgcaaaagtcggtccgcaaatgtcggtccgcaaatgtcggtccgcaaatgtcggtccgcaaatgtcggtccgcaaatgtcggtccgcaaaagtcggtccgcaaaagtcggtccgcaaatgtcggtccgcaaaagtcggtccgcaaatgtcggtccgcaaaagtcggtccgcaaatgtcggtccgcaaatatcggtccgcaaaagtcggtccgcaaatgtcggtccgcaaaagtcggtccgcaaatgtcggtccgcaaatgtcggtccgcaaaagtgggtccgcaaaaattcggtccgcaaatgtcggtccgcaaaagttggtccgcaaaagtcggtccgcaaatgtcggtccgcaaaagtcggtctgcaaatgtcggtccgcaaaagtcggtccgcaaatgtcggtccgcaaaagtcggtccgcaaaagtcggtccgcaaatgtcggtccgcaaaagtcggtctgcaaatgtcggtccgcaaaagtcggtccgcaaatgtcggtccgcaaatgtcggtccgcaaatgtcgcactacggtccca

SEQ ID NO: 84089 - DNA, 346 bp, Heterodera glycines
  Genomic contig location: Contig_ID=SeqID_19357; Location=786..1131; Strand=+
  SCN-specific regions: Sequence locations=29-114,136-148,180-346
taaaaaaataatttttaaaattaaaattcttgccacgaaaatacctttttgagaaaatttttttcatttcttaggagtgctttttgaaattttttttgtcgattcttaggggtgtattttttgaaaaaatttttaggtcgattcttaggggtgtattttttggttttattgcatttttgttaaagaattttccaaaaaatgtcgaaatagtgacaaaacgccaaaatagtgatttttaactattttagtgacgaagtcgccaaaatagtgatttctagtgaccgataatgacatcagaatcgaaaatttttaatgcagaaatgcgttttttgagctcctttcttca

SEQ ID NO: 84090 - DNA, 443 bp, Heterodera glycines
  Genomic contig location: Contig_ID=SeqID_19358; Location=206..648; Strand=+
  SCN-specific regions: Sequence locations=1-150,196-443
atgattgtgaaaaccgactatagcaaaacattgaaaatcacggacattggcaatgcttacacgccaaatgaggagccattggcacaaattgtccattggcattgggacgaaaaaggggcacaacggatcgttgatgtaagaaatttaacgaaaattatcaaaattaaataaaatgattaacaaaaattattttaagacccatacactcaacaagggtagtgaacataattgcggcatctataccaatgcttcatcatttgttgtccgaattcacaaaaagcgggagaaaaagtccaatgaaacgtaaagtgttaaaattttatctaaatagttaaaaaatttcggttcgtattctatcgtttgtctctgtcgtctgaattgtcttgtccgatcacaattaacaaaacccttaggttttattcgatcgaaatgataaatcacaa

SEQ ID NO: 84091 - DNA, 1045 bp, Heterodera glycines
  Genomic contig location: Contig_ID=SeqID_3292; Location=1457..2501; Strand=-
  SCN-specific regions: Sequence locations=1-49,72-78,100-195,219 -496,518-626,662-915,938-1045
atgaccgcagcggcaaaactcagccgtttcttccgccgtttggtgcacgtccgacagatggactttgaattcgctgcttggcaaatgctttacctgctggtcaatccgcaaaaggtgtacaggaatttcatgtacagaaaaagtttgttgtccctctcaattaatttctaatttcgttcagaagccaaagatcaatgggcccgcgatgaccccgcctttctcctccttttggcactttctctgctcggctcgagtgttctgtttgcattagcgctcaatttgtccttttcttcgttttgcgcctttttcctttgggttgtgttcatcgattgcatcggaattggcattgccattgcaaccgcactttggtcgctattttgcgatatttactctccgatttcacatatttttgtgtccctccctttttaggttcatttcaaatcgctttttgcgtcggacgagggattgcgacgtggtcgagtgggcctattgcttcgatgtccatttgaatgcttttttcccgttgctcattcttctccacgtcattttacctttgcttttctacggtccctcttttttttctttttttgaacaaaatattttttaggattggttgattaccaaaattttctcgcccgcttttttggcaattccatttggtgcattgccaccatttattataattacattactttcctcggctataccggttgtattttaatgatcaattgaaatatatttaacaatgtttgttttcagcacttcccacgctgaaaaacacgcaattcttcctctacccaatcactttccttttcattttcttcgttgccgccacaagcgccggttggaacgtttcgatcaccgcgatggacttttaccatttccgagtaacgaacgcagaccttagaggatgacatggagagagagaaagaggaagcaaaatagacgaaggaccatccccaacttaaaaccaacccaagtcattgtccgttccaaaagagtgcataaatatattccatagacaaaaacaacgtgttcaaataaa

SEQ ID NO: 84092 - DNA, 1064 bp, Heterodera glycines
  Genomic contig location: Contig_ID=SeqID_3292; Location=4310..5373; Strand=-
  SCN-specific regions: Sequence locations=1-1064
atgacaacaaacaatggtgcaaaaaaaggtacttttcgaagcacttttgtccatcgacctgaaggagtgcgaaagcgtttacccgtcggaaacggcgcgtaattacggaatcgaaatcaaagtgagtgccgaagggctcgttttgtgctttcggcaatggtctgtgcttttttgtgtgattttgtctttccacaaattcatttatgtttcctatcggtttaagactcccggcatcctgactcgtggatcatcgctctgcagcagaacctgcacattcaattcattcggactatccacttttgtgtaaaataaagcccccatttccaacaataagacctgaattttaaactttatctgtgcttattttcactccgttcgtatttttaggtgaaacgcataagtacggtcggttggctatcaaggacattactccgctgatcactcgtctggacactcattggcgttgcgacacggaacatgagcgaaaggaagtgctcagagaatgtttggccgcaacggcggtcgtatctctcttcaattggttgaatggacaagcgcattgtcttggttagtttggcatttaaaatgtgcgtcaagattttcggaattacacatttttaggacacactcaatacacagaaattgtcgccccgttgagttcccaattgatactttctgacggcttgcaattgttttatttcgctctcggtcaactcaacactcttgcaattaacattgatgttgaaggtgaatggacagaacctatcaaactaatgaatttgtccatgtcgaaattgtttttaggcttcaataatcagcggtccaatttttgttgtgttaatggacccttcaaactgtacgatgaattcgatccggcaacggtttgttagcatctttaaaatttattcattatttaccaaaaaacagaacaccgtccgacacgtcgacccttcggatggcctttcgaaggacggactgaatcccctcgtgttgcaccgaatcctccaaatgtgtgttgtttaattgtgagtgatacaacatttctccttttttgtttgaataaa

SEQ ID NO: 84093 - DNA, 1463 bp, Heterodera glycines
  Genomic contig location: Contig_ID=SeqID_3293; Location=400..1862; Strand=+
  SCN-specific regions: Sequence locations=1-726,749-811,833-1439,1461 -1463
agttatccgtacactttccaattttgtgtgttatgccaaaagaatgtccacagcagtaagaatcgcttcctcccaccgccttcaccgaattttcgtccaatttaggcaaattgccctgtcacattcgccagtgccatgtcggcaaaccgatgttccaatgtccggtgtgcgatttcacttcgacttactcgaaaaacaatgtgaaaagtcacatggtttcgcttcacggattggcggtaacattctccaaagaacaatccttcagcagatacagccaatttaagggggatcccatcagttacatggaccaatacgcaacacaagtggaggagttcatgaagcagtgcttcccaaatgtccggggtcggtatgatacattaaaacctcaaacttgaggggtcatttcatttgactggacgaattatgtccattctttttaatgaccctcaatttttaaggccgtggacgtcctcttcacgggcgacagtcaccgaatgccaaaaaccaattgaccatcacttcgactgttgtgagttcgacacggccgaagccaactgttgcgccagggaacggaaccatcgctccgatggcattcggtcagtcgcaaagccaacagagacatttctctcctccgttggcggggccttcgccgcagcaacggatcggcggacgaccgcaaaaggcgaccacaaaaagcacaaattgtcaacaaacggcggacggacagccgacggtgagaaaggcaaagagagaagggaaagaatgaacgaacaaaccgttacaattcgtcgctttctttcgttcattttgcaatttgaaatctgtccatttcccttttcagatggccattggtcgtacggattccctttgccttccccccttctccaccaattcaactgcaaacgatgccaacactttgcttccattcggtgtcactgatttttatggagcagccatgggaatgctgaagacgacgcagggccacagaacgcccacatcactgctgtccagcagagacggcggtggggcagaaggaaatttgcccaattttggcaggggaagcggcgcgtcgtttgggccgatccttcagagggacagcgggtcgacttttggatttatttccgattttattttttgcctttcattcattccattatttaaggtttctgtccgccttcaatcccttcctttatctgcaacaaatcaacaatttgttcgccgttaattctgtgaatccgaacgcacattcgcagcaaatggccatggaaacattgggaggcggcgaagaacggaacaaaatggaggtgaacggaagcgaccaaaatgacgtcaatttttaaatttgggtttcgttgtcttagactgaaatggacgtgtcagttggagaagaatcgcctcatcagcaacggtttctggaagaatgtctgaatttgagtcaaatttctgaaggagatgagtaaaga

SEQ ID NO: 84094 - DNA, 846 bp, Heterodera glycines
  Genomic contig location: Contig_ID=SeqID_19363; Location=545..1390; Strand=-
  SCN-specific regions: Sequence locations=1-90,120-137,304-427,517 -531,555-601,638-732,754-846
atggaacgaacgtttcggaaaggaaggaatggaacggacggaggagaacggaaacaacgcagacaagggtttgacgaggaggacgaagacacaacaacaaaacaacaaaacaacaacaagcacaaacagcggaagatggaggaagaaggagaggagaaagatgagaggaagaaggaggaaaagggaggagcaggaagagggaagagaaaaaagaagagaagggaggaggaaaaggagaaagaagagaagggaggagaggaatcgaagcaagagtagaagggagggggaagaggaagaggaagaagtggaaaagcgagtcaacctgtcggtttccgaggatagatgatgatgttgttgttgaagatgctaatccattaaacaacaacatgtcccccgaggggtggcaacggcagagggtaaagattattctctttcttttcactatttctctgtctcctcttttcttctctctctcatcttttctccacttctctctccctctctctcgctctctctgtttgatctttcgcctatttcccgccccctcccccgaccgattaagcatcgttgttgttttgttgttgttatttgtgttgagagttgggggcggaggcggaggagggtcaatggaaaactgagaattatttttggaaaacggccgatttttttttttgaatttaaagtagttttttatgtagataatcagttgaaaatttataaattctttcgatatgattttcatcaatttttattgccttccctccacaatttggaccttaacttttaactccatttgtacgggaaactgaaaaattggtgaaggtagtgcaaaataccataaataaa

SEQ ID NO: 84095 - DNA, 885 bp, Heterodera glycines
  Genomic contig location: Contig_ID=SeqID_19364; Location=844..1728; Strand=-
  SCN-specific regions: Sequence locations=1-391,413-885
atggcacttttttctccccttttctgttcttcatttttacttttatcattctgcttttcaatttgtgcttttttgcctcaaataagcgaagttgaaaatgaaattgccgaatttattcaccgtaaccctttggccattgaccaccgtatcgcactcgtccaactcattttcgaacaccaaaccgaactgattttggccaatgaacaaatctcattcccaaagaacatctctttagacgatctggcatttccctatgaaatgcttgtcagcaaaataacaagtgaaaattttgaagagttggcacagaatttgcggaaaaatgcactcaaattggcaaaagaaagcactgggaaattccattttctcactgaaaatcacttttatggccaatttatcaattatttggcaaaaattgcccaacttaaagtggaagaagcactgaagaagcgacgggagaatgacaatttggacgaattatcggagaaggaaacgaatgacttttcggagggatggaaatcattacaaatgtttgtcgaaatgtattcatttggctcggaactgttcatgcaattagcggccaattacggcggaaaatttcccaagaaaacgcgaaaaacaatgaagcaattagtggtcaaaaaaataccgcaaatggacgaattgtgccaacaatttgtcgactatttccaggccaaattcatgaaaagcatcccacaaaagctgagcatgtaatggtggaattaatatttttgtaactttccctatgaataataaatacacttttggccaattcagtgagccgatgaacgctcaaaaaatcatcgaccaaaatgacaccgcaacggcatgggccaattggttccgcgaaattggcgacattaccca

SEQ ID NO: 84096 - DNA, 493 bp, Heterodera glycines
  Genomic contig location: Contig_ID=SeqID_19365; Location=520..1012; Strand=+
  SCN-specific regions: Sequence locations=1-493
atgccgcgacacattgcaattgtaatggacggaaatcggcgttttgctcgcacccaaaactgcgcaactccgatggaaggacattcggccggatttgtgcagctgacaaaggttttttttactgtttttatttatttggttaattgactgaatgaactatttccttaacgcgaaaattaaggcgttaatttgttttacggtactaaattttgtttttttcacattcaatacaaatcgcataaaaattaagattttggctctaaaaagatgagtgcttttttgaatcaaacaggacacttgactgcctaaaatctaactccaaaatcgcaaattcctaatttttttttggcattttgctctattattcctcgaaatttccttttccgatttctttcatttctcattttgtttttttcaggttttggattggtgcaatgaattgggcgttgaggaggtgggaatttctattctccaatttatggaaacgaattga

SEQ ID NO: 84097 - DNA, 294 bp, Heterodera glycines
  Genomic contig location: Contig_ID=SeqID_19368; Location=338..631; Strand=-
  SCN-specific regions: Sequence locations=1-44,66-71,94-294
atgtcaaacaatgaaaatgaaaatgtgatgaatggagaagccgtgggaggggtggaaatcaaagtggaggccaaagaagaagtgaacacggaaccgcaggaggacgcggaggaggcgaaaagtgagcggaaaatggcagaaatgcgcttaattgttttgattggaacaattatgacaaattcggaaaaaattgggaagttttcagttccccagttcagcaaagagcaaatggaacgttcggtgatgtgttgcacaaacgaaggcgaaattgtcaacgtacatttgggcttttga

SEQ ID NO: 84098 - DNA, 1620 bp, Heterodera glycines; identical to SEQ ID NO: 19369
  misc_feature (56)..(57): n is a, c, g, or t
  Genomic contig location: Contig_ID=SeqID_19369; Location=1..1620; Strand=+
  SCN-specific regions: Sequence locations=1-17,39-204,227-485,507 -556,627-826,865-982,1011-1359,1381-1396,1418-1620
  Gene Ontology: Mol. function=zinc ion binding; Cellular component =nucleus; Biological process=regulation of transcription, DNA -dependent

SEQ ID NO: 84099 - DNA, 1082 bp, Heterodera glycines
  Genomic contig location: Contig_ID=SeqID_19370; Location=1..1082; Strand=-
  SCN-specific regions: Sequence locations=1-218,240-428,450-489,512 -1082
agccgcgcgcggtcgtccaatgcgccagcgaagcgtccgcgcggttttcttccgtttgtgcgcttttgcacgcgttcgctgtcaggtgcggatacaaaattagagaggggatttttttttgtaaattgccctctaatgatccaaaatgcctcaaaactttttgccattcaaatggtcgctgtggcattccgccccctttttatcgaagtattggcatttgtgaaaaaataattaattaattacagtatctttctttaacagttatcgtctgaacatgcaaattatactgatcgaagaacgcttggacagtgcgcataaaagggacaaagcggcagaatttgtgatggaaaaagcgaagaaagagggcgaaaaggcgccaatccatccgtttaaaatgagcggacattgtgacggagaggccgtagaaaaggaggaggaggagtacggtagcaaacaggtggaataccgtagtttagcaatatgtaagcgacatagaagaaaatttaggagagatagtctaacaatggaagtatgtgcattaatgaaggtttatgggcaggcacagtattaaataattgtggaggagttacggtagtataagtaaaacaagacgcatagatactgtatttgaattcatttgcctggactacagtattatcctgcccaatcagctgatcccttgtgctccgtacgctcgtctgttgctcttcggcacgccctctgccattcaaagtgcgcaattggctcagctccgtgcgctcgtccccggcgcgcaactggccgtggccaactgtcggcctggcctggacacggacgaagcggtggaggaggaaattgttgccctgggggctagccatctggtatttgtccatggggcaggtgagacggggaaatggcatttcaaagaaaatgaattatggcacgacgatttgccagacggagaaacgcgcgacgtgtgggaagcgggcggaccggcgaatttgcgggagaatgtgcgcgtcaacctgttcaggtaaagacctgggtgaatccatttaaattttgtgcattttctgcccgcgggttctctccaacatttgtga

SEQ ID NO: 84100 - DNA, 4868 bp, Heterodera glycines
  Genomic contig location: Contig_ID=SeqID_3296; Location=4..4871; Strand=-
  SCN-specific regions: Sequence locations=1-1297,1319-1433,1456 -1604,1626-2033,2057-2071,2094-2225,2247-2872,2894-3043,3065 -3365,3388-3437,3459-3467,3490-3551,3574-3851,3878-3947,3969 -4023,4046-4337,4424-4436,4458-4625,4647-4868
atggatttgaaaggagttattgcacttggggaaaagaaagttcggttgggtgaaatttggacaagcatagtatcagtgataggcacagaaccaccaaaactaccgagagtaattttaccaaaaaatgacacgtttgaaccacggacggaaaatattcttaatgcgagaattgatgaaatttttccaactggacaaaatttcttggtaaggggtatacagcatcagtaccctgggattatcattggaaggacattggttgccccaggcgcgaccaaagaagtgataataagacttatgaatgcgggaaacgcaccaattaaaatttacgggaactcacatttggcagatttggagccattacaaattaatgcattacctggcgatgagattgcggctaaagattttattccacctgaaactcggtggagtgaaaatttgcctaaattacccgtaaatgacatgaatcggcctccttcagaaagaatagatttggaagagaccagactaagtgaaaaggcacagcgagaattaaagcaaattgtggacaaatattccgatgcatttgtcggtgatgacgggaaaattggtcgttacaatggtccaattgttcacaaaatcgatttgacgcccggggcgttaccattccattttagaccttatcggtaccccccagagactcagaaagaaattgagagacaaattaaaatgatgcttgaccagaatattattcgtgagtcggaatccgagttcgcttctcctattgtgatggtcccgaaagcggacaaaaaatcatggagatttgcggttgattacagggcgttaaataaaatgaccaaaaagagagtttttcatcttccaaatattcaagagcttttggatttaatgggagccaaaaaatattacacatgcatggacatgcagcaagggtttatgcaaatccccatggcaaaggaggacattgaaaagacagcttttatttctcatttgggcatttatgaatttatcacgatgccttttggtttaacggcagcaccggacacatttcagagggtaatgaattcgttgagaagacgattgacagcagcaatgttaatttatttggacgacataatcattgggagtgaaacggaggaaattcatttggtagacattgagaattttttgagacttttaaaggaagtcggattgaaactgaaaattgagaaatgccattggggaaaagctgagattcgttacctcgggtttttgttaagtgagaaaggcgtccgaatggacccgaggcaggtacaagtagttcaaaattttcgggcccccaaaagtctaacagaattaaaatcattgctgggggctttaacatatttccggcgatttttgagaaattttgcgcatatcgcacgtccattacagactctaactcaggataaattcgaaggaaaaattgaagaaaattggggaccagagcaagaaaatgcgttaaaaattttgaaggaaatgttgaccacagcaccagttttgcaatcgccaaggtttgggagaccattcacaattgaatgtgatgcgtcaaagaaggcaattggagctgtacttctccaagaaaaggggcctgtcgcgtttgtttcccgcgcattaaatcggcatgagactaattacccatcgattgagcgagaagctttggcagtagtctattcagtgaaagaattttcaccttatattgtgggatcaggaataagtaagatcatcacagattgtagtgctctgacgggaataatgaaagcgaaggagttgaaatgaagactagaaaagtatcagattactttgcaaagtttcgacattgagataatctttcgtcctggaaagaaaaataaggcggcagactttttatcaaggtataatgttccgggaattgacagtggaggagaggaggaaataaatagccaaaataagaaaattctgagtaccgaggataaggcggaaaagcaaactaaggaaaatgaacagataggagtacaagaagaggcaatttctttaaaggaaataattgaagcacagagaaaagtgaaggaattggcaaaaatttattacattttaaaaacgggcaaattccctgagaatgttttaaaatggaagagagtcattcaagattatgacttagtaaatggcgcgatttactataagagaggtaaaagtaactcagaaaaaccgaaattggtcataccatactcgttaagggagaaaattttccatttaattcatgatcagggacattttgggtttgataagacttggcctgagattaaaagcagattttattgggttggaatgaaggatgatgtgagtttgttgaccgaaacatgcgagggttgtcagaaaaggaaagtccaacccggacaggcaaaagcggcaccaaatattccgataaaaccgacagaaggaccttttcagcgagtacattgtgatattatgggcccactgaaaaaaacaaaaaatgaaaattcttacattcttttggcaatcgacagcttttcaaaatggattatgacaaaggccatttccgatcagaaggcagagactattgcaaattcatttgtcgagatggtcatacatcagcatggaaccccagaaatcgttgtcacagaccaagggagacaatttacgtctcaattgtttgaaaatttgagcaagatttacggttttgagcacaatatgagtacggcatatcatcaacagagtaatgggttagcagagggatcaatgcgaatcgtggctaacataatttctcagagcattaacgaaggaggagataattgggatgagattttgcaaggggcaatttttgcttataacacctcgattaatacggcaacaaaaaattcaccattttttgttattcatttgcgtaatcctcgtttaccgacggatcaattgttaaaattgccctcttctgacgaacttttgtctgatgtgtcggtctatacccgtacacatgtggaaaaggcagcgaaagcttgggaaatcgtgagaactgagattgtgaaagcacaggaaagaaataaagagggaaatgatgccataaggagggccacagaaagagaattcgaaattggggatttagttttggttaaaaaggaagtgatgaaacataaatttgatcagaagtggatgggaccattgaggtgtgttggaattgagacagagcgaaaaaatttgattttacagaccttagatggaaagggaaaatttaaaagagtacatcaagaaaaagtgaagaaattccatggtccagcaactttacctttgcgagaggcagatgaaccgataaattgggaaaaatatgtagatgatccaaatttggaacaggaagaagcagaagaaagtgaagaggaaggattcgagattgtcttaagtaaagagaaagcaatgagtgaggaaatgattggcaagagcaaaaaattttcaaaatttagttttgaaagcagtgaagaggaggagaatggtagtactattgcttttgtccaaaatcaggaagatataagtgacgatgagggtcccgaaattttctttgagaacagaaattttgtgtttgaaaatgatgagacaccaactttgttagacattgtgttgaatggtacaatagttacggcatgcacagggtggttaaatcccaccataattccccttacttcgtcagttcctgaaaaccaagttgatgagaattgggaaatttataggaaccaagagggcgagagatacgtgatgtgttggatttttggtgaaaattttgaaatgcatattagcagtataactgacagaatcgttttgggcatggaagttcaatttctttttgcggaaaaatggtcattaaaaacagaaaatgaacgggaatcatattgggaaataatttcgggaataaatggagtaatgtacgaaataaaccggattccagaaattttcataagtgaaaaagaaaattatgacgaccaaaacgagttcagaatgggtataaatatcataaatagcgggcgaaatgaagaaatgggagaaatggagaataatgataagcaatttttagacaaagtggaaaatatgaacaaaaaaggcagattaaacgagtccagcaaattaaatggagttacttacgagagccattctttttttaaaacaattgatcatacagaaatggaactcttgacaaaagacgaagagcacgttctcaaatcactggaaaaatcgctacaatcgcagttgttagcggttcggaaaagtttggctgaaagtgaggggtcgaaaatgccggtggaggacgaagaccaagtagcaccactaatggacgagtggagagaaaaggaagaaaaggaggaaaagaaggaaaagaaggaagagaaaggaatgaaggaaaacaaaaaggaggaaaagaaggagaagagggaagtgcctaggaaaaaggcggaggaagaaaaacgaagcgcaagtgcggtgacggtcggagaagaagtcgtgtcaatcgtggactctacagaagaacgggaacaggaacgagaacaggaattgttcctaaacccgaaggtaacaagtgagcgcatggctttttgggaatcaacgctgtataatcaggcaaaaaaagacgtggcagaaatgagagagatgaaccgaaagacgggtcaagtaggagtcacagtaagctccaaaaagcgagtttggagtgagctggagcctccggcgttacccgatgagccaagttcgaaatttggcgaaaaaatgcgtcgatgcgcagagatggaccaaaacacgaaggaagcacgtgtggtgatggacacgctcctcgtaatccgagaaaaggagcgcgaactgagcgatcaggcccagaaagg

SEQ ID NO: 84101 - DNA, 717 bp, Heterodera glycines
  Genomic contig location: Contig_ID=SeqID_19375; Location=22..738; Strand=-
  SCN-specific regions: Sequence locations=1-359,381-627,649-717
atgtcgcctcgaactgaaagtccgtttggatttacaagtttccaaatatgggttatccgagccttttttcaaaaatcatgaaccccgtctagccctaaatttaatccgttttcacaggcggccatttgtgcttatttggcactgctccaaacgtacgttgcttttgttgaacaaattggggccggcatcgaatttgtgctggtgacattggaagcactgctccaactgttcacaatgatcactttttccacgaaccgatcaactgcttctgctgctgtccaagcgcataattcatagtgccgtcatttctcaagtccaagaatttctctgggtcgaaattttcagggactcaaaaaccttgagccccaaacccaagactgaaaattttcttaaacccaagacaacaaagaactctaacttacggaaacattcccggatcgagaattttataggactcaaaaacggcgaaaaccctaaaccccaaagatagcagagcactttaacttcaaggcctgctgagcccgagtctttgccaggaggaaaaagaccgagcaacacttaatccccaaaattggaacctgaaattttctagacccgagactgatgagatctcataatattgatgttcccaaaacaaacaaaaaccaatataaaatcttttttcattaaaaatgatatataatggcatcgtgaaagtgttcaattgtgaataataaa

SEQ ID NO: 84102 - DNA, 539 bp, Heterodera glycines
  Genomic contig location: Contig_ID=SeqID_19375; Location=1052..1590; Strand=-
  SCN-specific regions: Sequence locations=1-29,69-117,139-490,512-539
atggtcgtccaatctgacaaaattgtgagaaattttgaaaattttatttttttaattaattttttttagctttcatccgttccgcttgaattgttgcttcgtgtcaactcaaaattctccattcttttttgtttgcttacatatgcattgttcatttataaaagttagaattttcaaaaaaaaatttggaaatttccaaaaatttacagttttttcgctaccctacccgctccatgtgctgctcagtgaagcgttcattgtcatcttgtttggcccgattgaggcattccgaatttcttcgggttgttttattggaggggagcggaataatttggcgactgaaattttcaaaaaaattttaaaaaatggaaaaaccgaaaattcgaaaagtatttaaaaacaaataagcgttggaatattttcagggtaagttagtcctgtaccggggagtatctctattaaatttggagtgattgtgatcatttttttatgtttatttttgtgttcaattttccttaccccattaatggttaaataaa

SEQ ID NO: 84103 - DNA, 2919 bp, Heterodera glycines
  Genomic contig location: Contig_ID=SeqID_19379; Location=22..2940; Strand=+
  SCN-specific regions: Sequence locations=1-206,228-533,555-707,729 -1215,1237-1918,1941-1942,1965-2075,2097-2919
  Gene Ontology: Mol. function=ATP dependent DNA helicase activity; Cellular component=nuclear telomeric heterochromatin; Biological process=DNA replication
atgacgtgtaatccactttgggaagagatttctgagaatttgtttcatgagcaagtgtcaagtgatagaccagatttagttgtgagagttttcaatttgaaagtgaaagcacttatgaatgagataaacaaagtaaagatttttggagaagttattgcatggatgtatccggtagagaaccaaggaaggggactaccacacattcatttgcttttgacattggcagaacaagacaaattggtaaatggtgaagatgttgagaagaaaggaattagtgcaagaataccagacaaggaattagaagttgaattgtttgcgttggtgaaaagatttatgatccatggcccatgtggtgatttaaacccaaattgcccatgcatggaagattttgttgacaagaatggaataagaggaaggaaatgctcaaagggatacccgaaagcatttcaagaagagacaattgttcttgaaaatggtttggctttgtatgcaagaccaaatgatggaagaacagttgaagtatttgcaaatggaagaagacatggtttagacaacagatgggttgttccacacaacttatacctgttgaaaatgttcaagtgtcacattaatcttgaaaaggttaacagtgttaattcagtaaagtatttgcataagtatgtgcataagccaccagacagagcacgattggaattagaagagaaaaatgaccatgatgaagttaaagagtttattgacgcgaggtatgtttgcccgcaagaagcagtgtggagaattttagaattgcctatgtacgaccgaagtcattgtattatgtctttgactgtacatttgcaaggcgaacagatttgttattttgacgagaatatggaagaagaagaaattcgagaaagaatttcgaatggatcagagttaatggcatattttgaattgaataaggaaagtgaattggcaaagactttgttttatcatcagatacctgagaagttttgttttaagaaaggtaaatggaccgcgagaaagacatattttaacacaattggtcgaatggtgaaggtgtcaccggctgagccggagcgataccacctgaggctgttgttgttaaatgtgaagggagcatgctcctacgacgatttgaaatcagtaattgatatgaatggcattgtaaaagtatgtgaaactttttcagcctcatgtttagaaagaggactgattagaaatgatgaagaatggaaaaaagctttagaagaggcagagagttttgaaatgccatggaaattgagagaattctttgcactgattttagtacactgcaatccggccaaaccggaggagctttggaatatgtttaaagactctttgtctgaagatttttgcaggagttttagaaaagaattggcttatgctaaagcttataaagagataacactgagcattatgaaggctggaaaaacgcttgccgattttccaaccatggaacagataaatgttgatgatgatgttgagcaagtatttgatttagctgaagaattggatttgggacaaagagaatatgctttgatgtatgccgaacagagagaaatttgtgatgaaattttgcatagaatatggaatcctgtaaatgaacccgcgttctactttcttagtggaccgggtggaactggaaagacgcatgtgaacaagacaattgtacatatgctgagaggacagaagaagaaagtttgtacaatggcttttactggcattgcagcaactttgctgcctgctggaagaacattgcacaatagatttggactgactttggatatgagtaattcgagtattagtccgagatcaaaggcttggcaagaattgaaaactacagatttgttcatttgtgatgaagcgcctatgataaataagcgcgcaatgagaactttggatgagaaattgaaagagataatgaataatggaattgcatttggtggcaaagtcatgctttggacgggagactttcgtcaaacccttccaattcagaaacatgccacgagagctgaagtggttaattcaaccttaaagagaagtgagtattggagattggctaaaagatacaaattgacgaagaatatgagagctcttgaaactgagcaagaatttgcaaaagatttgttagaaattggaagtggaaaatggaatagtgaaaatgatgagataattttgtccgagaattgtattagctatggtgatttagcagaagagatttttgcaaattgtattgcttctgagaattggaatgaaatggccaaaagtgccattttagcaccgaaaaatgttgatgttagtgaaatgaataatagagttttagaaatgttgcctggtgaagaagttgtgtataccagtatagacttagctcaagatgagaatagacaaagagcagatgactatttggatgagtatttgaatgctttgaacccttcagggtttccccgacataagttgagattgaagaaaaatgctattgttttgttaatgcggaatttgaatatagaaatgggactttgcaacggttcgagaatgaaggtagaagaaatgcatccaaatttgatcatgtgtaagattttgactggagacaaggcaggtcagactgtgtacattcctcggatcacgctttgctgttctgaagattacccttttgacctgcataggcaccaattcccgttggtgttagcttttgcaatgacaattaataaggcccaaggccaaacccttgagcaagttggcatagatttgagaaaagatgtgtttagccatggtcaattgtatgtggctctttcgagagcaagagcttggaataagttgagaattagattagatgatggcaatttagagagaaaggtgaagaatgttgtgtacagagagttattagataacagtgattag

SEQ ID NO: 84104 - DNA, 430 bp, Heterodera glycines
  Genomic contig location: Contig_ID=SeqID_19380; Location=656..1085; Strand=+
  SCN-specific regions: Sequence locations=1-69,98-430
atgagtttgctgcctccagttgtggcactaatgaggttggtgaaacaaatgggtgattagcagatggcaaagcgatgccgccgccgctgccacctgctgctgatgaagtggccgatgaggaggacacattgttgacctaatcattttgggagataaaaaaattaggggaaattaattctctattaagctaaaccaccggagtgctaaattgtatattctagtcccaaaacatttttaagtatttaatataggtaggtattagagttcgacatttttaaaaaagcctggacctggttttcctggacaaaaatccaggaaatttcaggtccaggaaaaatccaggcacctcgggacctggatccaggcctggacctgggggttttttgaaatttgttttttaaaaagcaaaacaatgtttgaaaaaaagcaa

SEQ ID NO: 84105 - DNA, 823 bp, Heterodera glycines
  Genomic contig location: Contig_ID=SeqID_19380; Location=651..1473; Strand=-
  SCN-specific regions: Sequence locations=1-255,277-305,369-721,750-823
aattaaaccaagtttgttcaatgaacgaacatttgcgcgcagaaaatgcgcggctcattcagcaacaggttgattataattagcatgctcttaagggccaagggatattgaacacttagggctatcgaaggataccaaatgtatccaatttggccaattatgctaccaaaactggcccgagccccctgttggttagggcccaatcgtgccagtccaacacctaaccccccgtccgaaactggatttcctggacaaaatttaagaattaattattttaagtgaccgatgttttttttcaagttttcaaaaaaatgattaaatagatttaaaacacattattattattattgtaaaattagatattttttctaggtttataagcatttaattgctttttttcaaacattgttttgctttttaaaaaacaaatttcaaaaaacccccaggtccaggcctggatccaggtcccgaggtgcctggatttttcctggacctgaaatttcctggatttttgtccaggaaaaccaggtccaggcttttttaaaaatgtcgaactctaatacctacctatattaaatacttaaaaatgttttgggactagaatatacaatttagcactccggtggtttagcttaatagagaattaatttcccctaatttttttatctcccaaaatgattaggtcaacaatgtgtcctcctcatcggccacttcatcagcagcaggtggcagcggcggcggcatcgctttgccatctgctaatcacccatttgtttcaccaacctcattagtgccacaactggaggcagcaaactcattttgg

SEQ ID NO: 84106 - DNA, 645 bp, Heterodera glycines
  Genomic contig location: Contig_ID=SeqID_19383; Location=1758..2402; Strand=-
  SCN-specific regions: Sequence locations=1-270,293-645
atgaagaaatgcgccaaagatggaaaattttgggcagaaaagatgcttctcgcctacaggacaaccccgaattcagcactcaacggactttcgcccgatcaattgttcttcggtcgaaggcttcgaactcagctgtctctcgtccatccgaaggaagaacaagccgaagtcattgacccagccaaaatccgcaaatcacaagctgattatgcgcgaaaaatggcccgtcaatttgatcaacaccacggatcaaaatcggttgagtttttgccaaaagatcccgttttgcttttgaatttcaacagtggaaagagattttggctaaatggaacgatcatcgaaagattggaaaagtccccgacgtatcgtgtccacgtcccggctctcggaagaaacgtccaccggcacgcaaaccaactgcgacgccgttatcctcttgaggaggacggtaatgatacggtaaggatcccaccccaggctcaagaagagcaagaccgggacccatcgccgatccgcgagcctcctccgcaaccggcaccaattcgacggactcaggcaaagcgacgatctccgagtcctcctttggccccgcgtcgatcgcaacgccaacggaaagcgccgatccgcttctcgccaaacccttga

SEQ ID NO: 84107 - DNA, 598 bp, Heterodera glycines
  Genomic contig location: Contig_ID=SeqID_19384; Location=835..1432; Strand=+
  SCN-specific regions: Sequence locations=1-277,299-422,455-598
atgtttttggactataacttttttctttgtcatccaaatcaaagattattggtatcattcgaaagcccttcaaatgctctattagcctgcaaaaatccaaaaaattctgtcaattttgaacaaattatggccaaaaaggttggaaaatttggttttttgaatttttctggccataacttttctgaaccttaacgaaatttttcgaaattttgcaggctaatagaagacacttagggctttcgaatgataccaacaatgtcggatttggttgacaaagaaaaaagttatagccaaaaaaccgctggggtccaaacgtgccggggcccaactgacgggttccgtcaaattattaacgtcagaaatttttgagaatcggcgaattgaaattttaattaaatttgtgccgatcagcattgacggggaaattttcaatttttaaattaaattaataatagatgcggaaaatttgcgttaggctgactgaaaaattttgaaattttttggaggcaaaaaatgaaaatcttttgaaggtttgttaaaatggcacgcatatttaaaaattttcaattttcaggctatggcattctcttatcgcaaa

SEQ ID NO: 84108 - DNA, 642 bp, Heterodera glycines
  Genomic contig location: Contig_ID=SeqID_19384; Location=1779..2420; Strand=-
  SCN-specific regions: Sequence locations=1-322,345-642
atgggaaaagtcgatgagagcacacgcgaagcgttggaggaacaatttcaagtaaaaattgtcggttgcatattttcaaaaattttcagtcgttttacacttcggttctggcgtatttggacaaatggcatcgcattgaccgatttcctgaaaagttgcaatgggttgcgctggcataccgcaaaattccccacgacgatgcattggctctggctcgacaaattgcgcccgagttaacaaatgatttgtttgacgatgttaacgaagcaaaccaaatattgaattctttcccaaatgatgaatttcaaaaattaacccccgaacagaagtggaagaagctgtttgaagcagatttgcagatttgcctaatctgctcaagctggtcagcgtcgtactttccgtgcctgtctcgaatgcatttgtggagagggtattctctttgtgcggatcgcaatggactgataaacgaaatcttttgcaagtcgaaacagtcaaggcgttggtccaaaccaaagtcaattacgatctttcttgcccacaaatgtaccaaatgctcatttccaatcacaaattgtcagagaaaataggcggatgggaaaaatacttatgatgatcaattttaattgtttttacgctaataaa

SEQ ID NO: 84109 - DNA, 109 bp, Heterodera glycines
  Genomic contig location: Contig_ID=SeqID_19387; Location=514..622; Strand=-
  SCN-specific regions: Sequence locations=1-71,97-109
gcactgcggagggcgacgcgttggatcagttggggctgcgtcactactgctgcctttggatgttgttgtcgcacgtggacctgatcgaaaagctgcccagcaagcgcac

SEQ ID NO: 84110 - DNA, 1368 bp, Heterodera glycines
  Genomic contig location: Contig_ID=SeqID_3297; Location=340..1707; Strand=-
  SCN-specific regions: Sequence locations=1-123,151-176,198-240,262 -1368
  Gene Ontology: Mol. function=general RNA polymerase II transcription factor activity; Cellular component=transcription factor TFIID complex; Biological process=transcription from Pol I promoter
atggatttaattcttgctaccgattggataaacaacgcttatcccgaaatggaccagcaggaccataataaggaaacgacaaaaaaggaccagcaggaccataacaatgaaacgccgaaaaaagaccaggaggatgaggaggagacgaaggagcctagctggatcagcctcattgacgaagagcagaagcaggacccgttcaccccaatttatgatgagccgccaagagcaagtattcagtttttttttttttttttttttaaacaaattggttaatttaggtaccccaaagacttgtgcttgtgcagaacgcccgcgcccgatcccgctcgtcgagcacttatgcaagcgcttcaactgtagcgcgcatgagctgcacgtgttgttccgaaacttggagaagcgccgagacattgtcgagcacttgcgctctgctcaactgcggaccgcccacctgcgcccttttgttcgaaatttcccggtgcgctgtaacgacctctccattctcgacgcccactcagtcccggcctaccgcggcttcttgggaattacggtactttttggcaatttggtggacataattaaagattttaggtacgaatgcattactacataaaacatggaatccgtttgcatcatccaaacttgccgtgtgtcgtagaatttggaggcggtgatcacaaaacctttttcccgcttgaaattctcactattatgttttagatgtttttcaatatttaattgttgttgtttttaaaataaatttgttgcgtaaaatttttgtccattttaatttagatgaaaatttctaactgtactgttatttttaaaataaattccttgaacacgcaacagtttttggctattgcacaacgtggaattaatacagaatataatccacgccgtttccacgcaatcatcatgcgaatccgatatggagcaaaaactgtggctgcactcatatttcaatcggcacgtgtcgtcctcactggagttccacaccctgatcaagcccaaaagtttgcagcaagggttctacgacgaattgaatacacgcaatgcagaacgatgacaatctatgagctacgtgtggtcaacattgttggagttttaacgtttgaccaaagaattcgagtggagaaactacaacaatctctgggtggcatctatgatcctacgatcttcccagcccttcggtgcaaattagataatggagccacgtgtctcatttacatttccggaaaagttattcttactggggtgaaaaatgtagaaaatttaaaaaattcatttgattacttgtctaaaattgttcctaattattttcggtaaattttattttctcgtaacaaaaaaaaaacgaataaa

SEQ ID NO: 84111 - DNA, 549 bp, Heterodera glycines
  Genomic contig location: Contig_ID=SeqID_3297; Location=882..1430; Strand=+
  SCN-specific regions: Sequence locations=1-549
aaataacagtacagttagaaattttcatctaaattaaaatggacaaaaattttacgcaacaaatttattttaaaaacaacaacaattaaatattgaaaaacatctaaaacataatagtgagaatttcaagcgggaaaaaggttttgtgatcaccgcctccaaattctacgacacacggcaagtttggatgatgcaaacggattccatgttttatgtagtaatgcattcgtacctaaaatctttaattatgtccaccaaattgccaaaaagtaccgtaattcccaagaagccgcggtaggccgggactgagtgggcgtcgagaatggagaggtcgttacagcgcaccgggaaatttcgaacaaaagggcgcaggtgggcggtccgcagttgagcagagcgcaagtgctcgacaatgtctcggcgcttctccaagtttcggaacaacacgtgcagctcatgcgcgctacagttgaagcgcttgcataagtgctcgacgagcgggatcgggcgcgggcgttctgcacaagcacaagtctttggggtacctaa

SEQ ID NO: 84112 - DNA, 1833 bp, Heterodera glycines
  Genomic contig location: Contig_ID=SeqID_3297; Location=2868..4700; Strand=+
  SCN-specific regions: Sequence locations=1-357,387-597,621-1833
atgcaacatacaaagcgctatttgttggtccccgaagagatttatcagagtttggcaacactgtcaccgtctgacggttcaccaattgggctggtccgtgccagaattaaacaaataaaaaatgatgacgccataaatgaggcggaaagagcagtcaaatatgagcaggaaattaagcgtctcaacaagctcaaaaaggacgaggatgaacgccctgtcggtgttaaattagaaaatttgagtgatgtggttgacgccatgccaaaaccattcaacattaaaagaccgattgttgtagctacgcgtcgccatctcaaggttgggcgtgcgcgaaaagaaaatgttgaacaattagaagatgatgatgatgatgaagatgattatgaaactccacgcgcgtcgagtacaaataaacgtcaacccacacaaatggaaatcttaaatttaatttataaaaacgcccaatctcttggggtgtcggaggaaggacaggtcttgagagcgggtggacggccatttataaccagcagtgtcgatgatattgttagtcacctgctgaataaggacaagcgtggccaaaaagagccaacagcattcaaagaatttattgaaagggcaaagcagaatcgacaattaagtaggtatttatttcccgagggccaatccggcaaaggaatttataaaagcactttacttaagtttaaaccatccctatggatttgaaaaaatttcgtttgctcgagttcttgtacaaggacttaagttcgcctgtctcattcacgagcgttgaaccgcttctgaaagaggcgcgtaaaagtcaaccaaaaattaatagaattgatgtccaaaattatttagctacccaacgtacatacacactgcatcgccaggcaaaacggcgctaccgccgtttgccaaccttggcacccggcttgcatactgaatggcaggccgatttggctatttttgaccgaattactaaacaaaatcgtggctacaagtacttgctagtctgtattgatacccttagccgacaggtgtttgtcgaacccgtaaagaccaagacgagcgctaacatgatcaatgcctttgaacatatattcaaaaggtctaaatatattccttggaaggtgttaacggatcagggaaaggaattcactgcccgcgcagtgcaacagtttttccgcacaaaagacgttgaacacttttgtatgctcacttctccccaatttcatgccggaatggctgagcgtgcgaatcggagcatcaaagagcgactttatcgctactttacggagcataacacgtacaagtggataggtgttgtgcaagaccttgtttacgcaattaaccactcgcaaaattcgagcattggaatgtgcccagcagacgtgaactttaaaaacgcagaagcattgagacaaaaattacatgatgcagctgcaaatgttctccgacaccagccaaaataccgtgtgggggatcgtgtgcgcattgaaaagtataagcacgtgttccaaaagggttacctcccacgcttcagcaatgaactcttcacggtggtagaggtacactctgagcgttcaccagttgtctatcggttgcgtgatgacaataatgaaattattagtggttggttttacgcaaatgatttatgcaaaacgctagaaaacaaacagcaaaaaatgtatgaaattgaaaaaatattaaagaaaaagaggcagaacggtgtaaaatatgcacttgtgaaatggaaaggttacgatactcgcttcaatagttggattcccgcacactcaattagcgaaaaatctatataaaaagcagttttta

SEQ ID NO: 84113 - DNA, 215 bp, Heterodera glycines
  Genomic contig location: Contig_ID=SeqID_3298; Location=2630..2844; Strand=-
  SCN-specific regions: Sequence locations=1-215
gtacgatttctggaccgttgaatatcgtgagtaagttgatgcgtacgcacgcatctaccgtaaaaccttaatctaccatagtcatgtagacaacgtaggcatcaagaataaatatgtgttgatggacgtacgcatttctggagcattgaatatcgtgagtatgtggatgcgtacgcacgcatctaccgtaaaacattaatctaccgtagtcatgt

SEQ ID NO: 84114 - DNA, 1255 bp, Heterodera glycines
  misc_feature (1080)..(1080): n is a, c, g, or t
  misc_feature (1149)..(1149): n is a, c, g, or t
  misc_feature (1194)..(1194): n is a, c, g, or t
  misc_feature (1201)..(1201): n is a, c, g, or t
  misc_feature (1210)..(1211): n is a, c, g, or t
  misc_feature (1222)..(1223): n is a, c, g, or t
  Genomic contig location: Contig_ID=SeqID_19389; Location=6..1260; Strand=-
  SCN-specific regions: Sequence locations=1-27,49-56,190-208,230 -253,275-320,342-347,369-400,427-488,624-1027,1050-1098,1120 -1152,1174-1255
atggctacttatgtttatttttcgctgtcttcctttctctctttcttccgtaagtttctctctctctctctcacacactatttcactttttctctcttactttttctatctaactatttctttctccttctctctctctctctctcttatcccactctttcactccctcactttttctctcgctctctccccacattttgtcattaagataaaattattattattatttctttgaaattaaacaggatttccttattttattaagtaaaataatgatttattcagttttttaatcagaaaaaaaatcatttaaatgccccaaaaaatgaattgccatttaattgaagaaaaattaaataaaatcatttcgagacgacaaaaatgaaattatttccgctactattattaattatattatttttaattgtcaaaattggagcagaaaagaaaaagttacagcaaaagtcatttggcgaaatatttggagaaaaatggcagaaaaaaaaagaagaaaaacgaaatgaactcaaaaaaagagaaataattggaaaatattataaaataaaagaaaaaataaagcaaaaagggagaaaatattcaacaaaagaatgggataaaattaatttgaaaattgcaaaaaaattggggacaaatcgaacgaaaatttataaatggatcaaagaattttgtcttcaaaaaaataaatgtcataaatcaaaaagtgatgaagaaaaattagaaattgtgcaaaaattcattgaaatgacaaaagaatataggcaaaaaagaaaatattcaagaaaagaatggaaccaaaattatgccgaaatttgtaagaaaattggagttagccaattcataattgataaatggaagaaacaatttggcattagcaagaaaagaataacggagaaagaaaaaatggaaaaaatgaatatttattggcaaacaaaaatagaaaatccgaaaatgagtgataatgcaattgcgaaaactgtgaacacttctcatcagaatatttttaattggaagaaacaatttggagaagaaataaacgaggaatgaaaaagggataattanatttgtttcagaagatagctgaagaagagtgatttttcattatgcttttcaatttaaatattcttttgngtgccttttttaattaattaaatagctttcggtttgtcctaattnagatcgntttaatttnntatttatgttnngccctgattttgtaaaaaacaaagacaataaa

SEQ ID NO: 84115 - DNA, 593 bp, Heterodera glycines
  Genomic contig location: Contig_ID=SeqID_19390; Location=1292..1884; Strand=-
  SCN-specific regions: Sequence locations=1-132,154-175,197-219,241 -415,526-593
atgaaaccaaatctcatttttaacccggtctgtccatgcctggttgtggttgaaacggtgctggtcgaagtggacgatgtaggggttgtgctgctggaagtgctggtggtactgcttgactccgtcgttgagcttggtgttgtgcttgtagttgtactcgtcgttgagcttggtgttgtacttgtactggtacttgtgctggtacttgttgacgttgacgtggatgtggatgtggacgtgctgctagtggtcgaacttgttgaactcgtcgatgttgtttcttccgatgatgaatcacacaaaatctttgaagacatattggctaccaagaaaattattacaagaatagcaattggaagcggaatagaggaaaccatttttatcaaatagaaaatttattggaaaattgaatatcttaaattttaaaatttagattaatttatcttttttaatttatataaaccaatcttttcaatttataagtttttgaaataattatattaatttaatttaaaaatatttattgaatgtgaaatattaaagattatagcacgttcttttatagtgacattatttcgtagtatgtaaataaa

SEQ ID NO: 84116 - DNA, 1618 bp, Heterodera glycines
  Genomic contig location: Contig_ID=SeqID_19391; Location=167..1784; Strand=-
  SCN-specific regions: Sequence locations=1-16,38-58,80-92,122-142,164- 176,206-1042,1064-1199,1254-1448,1473-1483,1595-1618
  Gene Ontology: Mol. function=transcription regulator activity; Cellular component=nucleus; Biological process=cell-matrix adhesion
atgggtccgttgggcccaggaggaatgggcccaggaggagcaatggggccgatgggtccaggaggaatgggcccaggaggagcaatggggccgatgggcccaggaggaatgggcccaggaggtgcaatgggacaattgagtccaggaggaatgggcccaggaggagcaatggggccgatgggcccaggaggaatgggcccaggaggtgcaatgggacaattgagtcctggaggagcaatgggaccgatgggcccaggaggagcaatgggacaattgagtcctggaggagcaatggggccaatacaaacatgcatatgttcaccaagtgaatttctttactatcgttgtccttcgatatgctcatttagttttgcaagatgcgtgctgttcctcccctcctcccgtttcgccttcatatgacgatggtccaatgtgtttgtgtacccctgctgctggtaagttcttcaattattagttgtgaagtcaataaaaagcgtcgcaatcagatgcgtgctgtatggaaagtcaaagggcaccgcaaattggcgcagaagcaagggcacttcaggcattgacaatcagttgcatttgcacgccggtgcagagaagcgactgctgcccaccgccccctccgatgggacaacagtttaatccgccgatgggacaacagttcagtccccctacccctccgatgggacaacagtttaatccgccgatgggacaacagttcagtccccctacccctccgatgggacaacagtttaatccgccgatgggacaacagttcagtccccctacccctccgatgggacaacagtttaatccgccgatgggacaacagttcagtccccctacccctccgccccctccgatgggacaacagtttaatccgcctccctttccgccacccccttccggcaatcagcccgtctgtgtttgcactcccgccgcttcagtgcagcaggatgcttgctgtgctcttccccaacaactccaagcagctccgctcctcccgctacctccaattcctcagcaaaatttcccacgttcttctccgcctgttggcggttttgcaacaggcggaccattcacaccgcaacttcaagcgtaagagaaatagcttcataaaaaattcgctggactcaaaccatgggatggacacaaactcggctcggaaacattaaaaaaccgaccgagacataaaatcaatttatagaaaaaaaaacaaaaattaaacttttatttatttttaagttttgctgtcgaaacaaactatcgaaattctaacagcaccagattaagtgctcctccgatttccgggattggtttcggtgcgtcttctgctgacggaagtcaatctccgccaattggctatgccggaaagactcagccgtgtttatgtgtgcccactcaattgggtggaggagggcaaatgccattgtgttgccagcaaaaaagcaaacaaaagagggacaggaggttcagagaaagaggagaggagagagagagaatgggaaaagaggaggagcagacggacgagcgggaaagcagtgcagcaaagagagagggaggagaaagagaggaggcagagaaacaaacaacgaaaaggccaatataa

SEQ ID NO: 84117 - DNA, 84 bp, Heterodera glycines
  Genomic contig location: Contig_ID=SeqID_19393; Location=573..656; Strand=+
  SCN-specific regions: Sequence locations=1-84
gccattgaatttgcacaattcgccaccgccggcattgtcctctccgcctttgcgcttcccttcgtcctcgcccacgccggagtg

SEQ ID NO: 84118 - DNA, 237 bp, Heterodera glycines
  Genomic contig location: Contig_ID=SeqID_19394; Location=220..456; Strand=+
  SCN-specific regions: Sequence locations=1-237
atggtaatcggccaaaacacgtataaagcaaagcgaaatgcttccaacctgaagcgaaatttcatccttggtgagttcagcttaattcgcaaaatgtacttaaaccctcagttgcagcccattgtttgttgaaaccttcaatttcttcaaagcttccaactccgcatttgtctgcttccttttgactaatgggaagagattatttccgtccattatatagaaacaaaatttgaaaca

SEQ ID NO: 84119 - DNA, 289 bp, Heterodera glycines
  Genomic contig location: Contig_ID=SeqID_19394; Location=180..468; Strand=-
  SCN-specific regions: Sequence locations=1-10,33-289
gtacagatttattgtttcaaattttgtttctatataatggacggaaataatctcttcccattagtcaaaaggaagcagacaaatgcggagttggaagctttgaagaaattgaaggtttcaacaaacaatgggctgcaactgagggtttaagtacattttgcgaattaagctgaactcaccaaggatgaaatttcgcttcaggttggaagcatttcgctttgctttatacgtgttttggccgattaccatcgtttggatcttcaatagtccattcttccaacaaaaatcg

SEQ ID NO: 84120 - DNA, 677 bp, Heterodera glycines
  Genomic contig location: Contig_ID=SeqID_19395; Location=7..683; Strand=+
  SCN-specific regions: Sequence locations=1-60,82-677
tgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 84121 - DNA, 625 bp, Heterodera glycines
  Genomic contig location: Contig_ID=SeqID_19396; Location=683..1307; Strand=+
  SCN-specific regions: Sequence locations=1-6,28-55,77-157,187-193,215- 234,256-491,520-625
  Gene Ontology: Mol. function=arachidonic acid epoxygenase activity; Cellular component=microsome; Biological process=eicosanoid metabolism
atggttcacaaccctaaagtgatggagaagatacaggaggagttggaccaaactgttgaaaaagagcagcaaatttgttgggaagaccgactcaaattaccgtacacatcggctgcagttaatgtgaggcttagttcaaatgttctctatcggcttgtaaatataaaaatagttataaatttaaaagtgcatgaaattttattttaaaaataatccaaaaaatcattaaaagacaataaaattagcaacatttatgatagattgttttgataatttgtcaaaaaaaatttcaaagtttctttgaccgcgatgggcttttacccaatgccaacgaatgtttggtttgcaggaggtgctcagagtgggcaatgttgtggcccaggactttccgcatcggatgatgcgcgacacactcgtggacaattggacattgcctcggggacagccaatcgttgcacaaatttcggttgtgctaatggacccagaggtgataaatagaaatgaataaaaattgaattttatttagtgatcggaaaatatgttttagatgacggaaataatctatcattaccgttactattttaactggaacattaaaaaatggcataaaacattaaaaattaaa

SEQ ID NO: 84122 - DNA, 711 bp, Heterodera glycines
  Genomic contig location: Contig_ID=SeqID_19397; Location=67..777; Strand=+
  SCN-specific regions: Sequence locations=1-573,595-711
atgctcaaaacggacgaactgatcccattcgcattgggaaagcgccaatgcttgggcgaatcacttgcgcgcatggaaatgtttctgtttttcgccaacattttgaatcggtacaaagtgagtgatttctgagcgattttttaattgggttaagtggttcgggtggaaattcaccacatttattctccaaattgatcaaattcccactgagctctatagtataaagataattttattcttaaaaattttgctttttagatattgttttgtatttttttagctttggtttctttcgagcaatttcatttctttttttcactgactaagcaaattttcccaattttttaccatttcaatcggttcaataacagacttttggcatttacactcctcatgactattttatgcttgtcggagctcattatagtagaataggaatatttaacactcattattctgcttttgtcagctctccgctgggcaccaaatgccatcgttggagcgtcggatgggcattcccgtgctgtgcccaaagttcacgtgtcgcgttgagaagcgatgcacggaatagaaacaaacaatttgaaaatgtttttaattatccgatgctgattgactcattttaaacaaaaattaaagttttattttaacattttttccattgagctgcacagaaaattatgccattggtgatagacactaaataatgaa

SEQ ID NO: 84123 - DNA, 481 bp, Heterodera glycines
  Genomic contig location: Contig_ID=SeqID_19399; Location=23..503; Strand=-
  SCN-specific regions: Sequence locations=1-238,260-426,450-481
atgaggccattcagcatttgcctgcttcttctcccgctcattttgcttcttctccaacgttcgactgccattcgaccgtatccgatcgatcaacacggtagaattggtgaaaatgatggctacggtcgttatggttatggtaattcggctgtaatgccccgtggtgagtcgaaggacaaaaagtgcataatttgctaaatttttgactaaatcaactcataacttttctcagacgcaaccaaattatttttcaaattatcgatttaaaaaagtgatcagcaaaaaaaaagttaatgtttgatcatgatgagaattagagtttgcaaatttttttgtttagatttttgtaaaaattcgtcaatacgattggagggtagcattgaaagaatatagaatttctcatttttttaaaaattatgattgagtcaattaagttttcctgaactacaagtcttctttttgtcttaaaatagacaataaa

SEQ ID NO: 84124 - DNA, 85 bp, Heterodera glycines
  Genomic contig location: Contig_ID=SeqID_19399; Location=261..345; Strand=+
  SCN-specific regions: Sequence locations=1-85
tttggttgcgtctgagaaaagttatgagttgatttagtcaaaaatttagcaaattatgcactttttgtccttcgactcaccacgg

SEQ ID NO: 84125 - DNA, 495 bp, Heterodera glycines
  Genomic contig location: Contig_ID=SeqID_3299; Location=670..1164; Strand=+
  SCN-specific regions: Sequence locations=1-57,79-126,168-495
atggaaaagtgcgaaaaattgacggatggaaaaacggatgaggatgaagcacgaaggaaagcagatgccaaaatgaaacaatttgaagcgaaaatggaaatgattggcaaaatgttcgtttaagcagtttcttttttgaatgcccattcaacaaaaaacatttatttgtaatttgtttcaattattttaaatcatttaattgatgacaaatcacttgaaagtagagaccggacaagagggtcggtcgaacggtttcggttaaaaaccgaaaccgaaaaaaaccgaaaaactcaaaaagttctcggtcgaacggtttcggttaaataaccgaaaaaaaccgaaaccgaaaatcgaaaaataccgaaaaaaaccgaccggtccgatctctacttgaaagcattgaaatattccaccaacattttaaaatttacagctttagttccgggttcattgaacactattccattttaaaagctcaaaatttctcctaattaa

SEQ ID NO: 84126 - DNA, 831 bp, Heterodera glycines
  Genomic contig location: Contig_ID=SeqID_3300; Location=159..989; Strand=+
  SCN-specific regions: Sequence locations=1-43,88-368,394-608,671 -709,745-806,830-831
atgtgctcgcttatgcattcgaaaatgcgggaaagtatggcgcaattataattaaaaataaattaattataaaattttaaatttattcagtccaaccaccggtgttgtggcccccaacccttgcctacgcccttgctatcggcaccagggctgggaccgcgccgacaatgcgcgatccgcggtcgcggcaaaatggccgcgccaaagtgggtggttcccaatgggagccccccccccatactattcagtcccatcgcaaattttgtatatgcaggattttaactaatttaaacaaaattgagtattgaaatgcttggaggcatttatagcaattaccaaatggatagatgatactttgttgtattgtctatttttattttattttttaattttctgtaaaaaatgttgatatttaatcaactgagacgcagttggccttttactactaagacgcagttggcccgtttcgtattttggcgctagttaaaaagtcaccacttttgaaaattttttcaaacattttttttcatgcaatttttttgtttgtttattttcaatcatcctcagctaattttggataaacatttaactctcaattttagtcaaggttaaaatattaagaaaaaatttaaaaattgaaataaaattaaatgataaaacaattaaatatcttcagctagctatcgatttttttttcaaaatttttggcttttattattacttaaatttgtaattaattatatacaattttgttcagaactgctggacggaatcacttggtcttcaaagacttgactgattccaacaattttaaatatattttctttttta

SEQ ID NO: 84127 - DNA, 965 bp, Heterodera glycines
  Genomic contig location: Contig_ID=SeqID_3300; Location=1982..2946; Strand=+
  SCN-specific regions: Sequence locations=1-221,261-376,398-451,520 -678,730-748,770-965
atgtcgtcaaatggcatcatcacaattgtggcgctattccttgtgttgtttggcactcacataacaacacaaattggggcaatgaatcgtcatcgccagcagcgctcacttggccatccgtttacggtggataagcagcagcatacggtaggagacaaagtcagtcagtcaattagaaacaattaagcgtaaaactaattgatccatccggattagaaaggaaaattaattttaaatataaatcttttttgattttaattggttttgcgaaagttttcgtttttttttgtcccattttcatataatccgttgaagggattagcaaaagttgcctctgtctgatgtcatcatcaccatgtgactttaaaatttagcggaagtttaattttaagacaatgggaattaattagtgaaataaactgagaatgacgtcaattaagaaagggaaaacaaaaattgattaaaaaaattcaaaactaattaatttatgaatattttaatttgttattcatttaatttgcacttttataggcacagaacgaaaatttggtcggcgcttatttgtctcggggaatgttcagctgtggcgccaaatatgttggcacattgcaaagactgaaaagaatcattgaggtaaaaaggaggcggaaaatgacagaaatttgaaaacaaaatgccaaataaatttaaaatatttaaaatataatttaaaatgttattgaatataaaggaagtgcatgccgactattcggaatgccaaaaatcgatgaagcaaatggacgaggacgagcaaatggcattcggaaaagggcacggcacagagcgatttgcggtgattgacgaactgatcaattgagcccaggggggcaatttgtggcaaaatcacaaaattcgaagcataaccatttgaaaaacattgaaatgatttttcattgtttgtgataaagcgaaacagcaatttgtta

SEQ ID NO: 84128 - DNA, 879 bp, Heterodera glycines
  Genomic contig location: Contig_ID=SeqID_3300; Location=3464..4342; Strand=-
  SCN-specific regions: Sequence locations=1-48,77-216,238-290,322 -441,463-789,811-822,844-879
atgcgccaatattccgctcacattaatgcattcttttttgggttagtcattttttaaattttaaacttttatttttcaaatttcccccgcttttcctccctcagttcgcttttcctcttcattttgccgtccgtcgtgcgcactttggcggatgaaaatgaacgatttgccagcagcaaaataatgagacgagggccaacaattgcaatggttttacagcgacaaaaacaacaaaaaagtgaggcggaagaaatggcaccggccgacgttgacgatgacgaaaatggggcaggaggaagaggaggaggagagggaagaggacggcacgtgccaatagaggaggaagacgacggggcagcagaaagtggacaacaaatacagtgccaatttcacgccaacgaagagttacatggtgagaaaatgggaaggggacaagtggacacaaaagtggacaattggaagttaccgtacatttgcgccccagacatttgcgactatgtccaaaatcggattcaaacttcagtttttcaatctctgatagcgtaaacagctttaaataagcgatagtagacaatggaaaaaagaaggactaaatgaaaaaaaatacggaacaaaagagtaaaaacagtgcaaattgattgtcaaacgaagagctctgcaaggtgagaaaatggacaaattcgagataaaagtggggacataatgaccaaaagagggacatttggacaacggaaaaaaacgagtgacaaaatggcaaaaaaatggaatatttgtccaataaggccaaattgactatgaaagaaggctaaaaaatatggactattaaaagtcacaaaaatggacaatggatcaaactggatgaaaagcggactaaataaa

SEQ ID NO: 84129 - DNA, 499 bp, Heterodera glycines
  misc_feature (487)..(487): n is a, c, g, or t
  Genomic contig location: Contig_ID=SeqID_19404; Location=77..575; Strand=-
  SCN-specific regions: Sequence locations=1-35,57-75,97-288,310 -333,355-499
atgtgtgccaagcaccaggcatggttgaagaagaatggaggaaagaatgaaaaagcggcgaacaacgtccgcgttggaggagttttcctgggtaaatctgagaaccagaggaagaatggaataatcgatgtaccgattgatgtgaatgggcacaaagtggatttcattgctgatttaggcactgagggaactgttctttgtgaggacactgtgcgccaaatcggagctttgaaattgagccgttgtcaagaacgtgctcagtaccacgatggcacaattcgtccattcgttggcaaaggaaagacaactttttcgttcggagaccgctcatgctatggacatttctttgtttccaaagacggatccaagaatttgctcggattggacatgatggacagacttggattgtcggactccatcagagatggtctgaaggacaaattccgaactgaggctagtagttacacatcactttttcaccggattncggtagccaagg

SEQ ID NO: 84130 - DNA, 739 bp, Heterodera glycines
  Genomic contig location: Contig_ID=SeqID_19404; Location=536..1274; Strand=+
  SCN-specific regions: Sequence locations=1-739
ctccattcttcttcaaccatgcctggtgcttggcacacatcctttccaagtggccactcttcttgcactttcggcaaacggttgtttcatgtcgacaattcctcgacgaatggctcaaaccgcatcgccacatacgcgttgcgatcgattgctgctgcgtgttcctgtcgaaatgctgctctcattcgacgaatgatccgagttcgttcgtttcttttttgccttcaatttggtcgccatcaagtttcgtgagcccatcggttgttgttcgaggacctttgcttcagcgatggtcgactggtacatttggaggtcttcgacgactccatcatactcgaccaggtcaccatccgctgcaagcttcgaaagaattcgctttctcagctcggcatccttcggtgatttcagtgccgtcaaaagcatgaggcaagaaaattgctcttcgttgagcttttcaaatcgcttatgtctgttgataaaaggacgaaagctttcatcttcgcttttcgaggccctcagacattcatagcgatcaatccaaatggattgtggccggctgaaggcaatctttaggcgctcctctgtttggctgtagtcaaaatcgatgactttcttcggcagacatgacttgctgtactggctgaaagccacttcactcagcttcgtcatgagcagcttgacctttgcttcgtctgccagttgcggtgccgcacagtcgagggcaaaattgaagcgttcc

SEQ ID NO: 84131 - DNA, 777 bp, Heterodera glycines
  Genomic contig location: Contig_ID=SeqID_19404; Location=650..1426; Strand=-
  SCN-specific regions: Sequence locations=1-777
atgggcgacgcaatccaacaactcactgcggcaatccagcaattattggcaaatcaaaatggtgcgccagccgcaaatgcgcatgctttgccaacgcttccgaccatcgactgttttgagccatcggacgatagaagcatttccgattggttggaacgcttcaattttgccctcgactgtgcggcaccgcaactggcagacgaagcaaaggtcaagctgctcatgacgaagctgagtgaagtggctttcagccagtacagcaagtcatgtctgccgaagaaagtcatcgattttgactacagccaaacagaggagcgcctaaagattgccttcagccggccacaatccatttggattgatcgctatgaatgtctgagggcctcgaaaagcgaagatgaaagctttcgtccttttatcaacagacataagcgatttgaaaagctcaacgaagagcaattttcttgcctcatgcttttgacggcactgaaatcaccgaaggatgccgagctgagaaagcgaattctttcgaagcttgcagcggatggtgacctggtcgagtatgatggagtcgtcgaagacctccaaatgtaccagtcgaccatcgctgaagcaaaggtcctcgaacaacaaccgatgggctcacgaaacttgatggcgaccaaattgaaggcaaaaaagaaacgaacgaactcggatcattcgtcgaatgagagcagcatttcgacaggaacacgcagcagcaatcgatcgcaacgcgtatgtggcgatgcggtttga

SEQ ID NO: 84132 - DNA, 360 bp, Heterodera glycines
  Genomic contig location: Contig_ID=SeqID_19405; Location=229..588; Strand=+
  SCN-specific regions: Sequence locations=1-145,211-360
atgaattttttgtatcttggtgggtactgctgattttgggcttgtttaacctcattgtattacatatttgattgacattttgttttcattcagtccgttttttaatttataggcattgctggaaatgcgcaatttttcaatacgcagcagaaggaggaagaagaagaagctgatcagaaagaagatgaagaaaacggcgatggaaaagaaagcatcactcaagggatttaaggcacataaatgttgtaccaatattttgattaaagtccgttttttaattttgaatttagttcctttaatttacaattgatttatccgtttatgagcaaatttgggcttgggatgtaagacaaaatgcca

SEQ ID NO: 84133 - DNA, 228 bp, Heterodera glycines
  Genomic contig location: Contig_ID=SeqID_19407; Location=1076..1303; Strand=+
  SCN-specific regions: Sequence locations=1-111,148-228
atgtccgatcaaatccgttgtttaattcaatcgggagttggatctgatcattatgcaattacgagtgacggttggtctaagccgacactgtcaccacaattacaaaggttgataattattttttaataatgtttaatcattttaattgtaatttcagtgtcactgttcattggattgataaaagtttctctcgccacgatgccgtacttttgttagtaaaattacgaa

SEQ ID NO: 84134 - DNA, 346 bp, Heterodera glycines
  Genomic contig location: Contig_ID=SeqID_19408; Location=58..403; Strand=+
  SCN-specific regions: Sequence locations=1-346
atgtcatttgttttgcataattcgcctgtaatcacttcatttttccaatttgtcccctcaaattctctccgcgccgtgccattttttatattccaaaagcatccatcgcattttggtcggccgattggaatgattggagttgcgcccgaatgctttcgatcgcttcttccaaatcctccaatgtccgctggtcgtcctcccttatggtcgggtcggtgtcctgctgaatttgctggcgaagttggtctgcacgttgctgaagctcttggagttgctgttcgatttgctaaattaacaaaatgataactcatacaaaggaccaaaaaatagtaaattaataatttta

SEQ ID NO: 84135 - DNA, 992 bp, Heterodera glycines
  Genomic contig location: Contig_ID=SeqID_19409; Location=551..1542; Strand=-
  SCN-specific regions: Sequence locations=1-812,834-992
agaatggcaaacaaattattgaacatttgaggaagaatgaaaaagagcagaaaattagcaccattagcggatttaatgggacattggccgaattcttggcacaaaagtcgggatcagaaactgaagcgcagaaattgtttctttccgttaaaaatttatttcgagtgatgtcccatcaattggatgccgagggaaaagcggaagaaggaaaagatggcataagatatggagaagaagcagaagaacgaaccgagggcaaagggtgtgacaaaaagcatggggacaatgggaagggtcagatcaaagaggaaaatgccaatgccaataatagggagagaaaagcctatgccaatgatggagacaaggatggcgttttaagacgaagaaaagtgagaaaggtgaaggatgaagtgcaaaccagagaaataaacaaagaacgaagtgtaagagtcggcgacaaaaaacaaaacaaagccaaactggggaaagagaagacgaaaaccaaaaaagtggacgacaacggcatggaaaagggtgaaaatgaagcggcaaatgtgcaaaaaataatcaaaaaaacactggcaacgaatgccgtgccaatgccaagcgatttgctccaattgctcatgcaattgtggccaaatgtgctgcttttgggtgccgaaggtgggccagccgatacgtcggcagcaaatgatggcaaaacgtcgccacgagggcaccgacgcagaaaacggagccagcaagccgaaattgaaaagacggcagatgtactgctcgccatcctcagtttggcagtcgctttcgttttgctcaacattttcacaattactttaggcttttttgagtcatggccttccatttttgcacttaccattgcagggatctgttgttataaactcatgaaaaccgacttctaccacgggcgtgtctataaagctttgatttggctaaacaatcgcaatcgaatcggtggctatcagttccactaa

SEQ ID NO: 84136 - DNA, 2092 bp, Heterodera glycines
  Genomic contig location: Contig_ID=SeqID_19410; Location=1..2092; Strand=+
  SCN-specific regions: Sequence locations=1-83,105-137,159-286,317 -468,502-572,601-753,797-905,930-1138,1181-1818,1840-1841,1867-2071
  Gene Ontology: Mol. function=helicase activity; Cellular component =nucleus; Biological process=regulation of protein activity, epigenetic
aactgttgccaaactgcacgcggacgggcacaaagtgctcattttctcacaggtcctccgccgatggcatttcgctggccctttcattactacaatatttttaacaactatgagagtaggagggttcgaaaaaattaggaaatccacatattttttcttggactgtgggagacctggaatgcatgaaaaatttgtttttttttggtttaaagtttctaggatgtagttctatttccatttttgtccatattttgacatttttccagaaaacctgtaattttctctgtaaattttttgaatttaattattattttttgttgattttagttaaaaattggaaatttttgcttttacagaaaattaatattttagctgtttgtttttttttcttataaaataatggggttttggttttcatttagcgaatttgatgaaattccaggaaatttattatatccatatttttgcaattttatattcattaaatttgtaaaaatttaagatggtccgtgtgcttgatctgctcgaggaatacctgtccatcaaagggtatctccgtaattagaaaattgataaaaaaaaattaaaaataaataaattctcgattaaagctacccattcgaacgcattgacggcaatatacgcggcaatgatcgccaagcagcaattgatcgcttttcgaggccacaaagctatgatcgttttgtgtttttgttgtgcacccgagcgggcggtttgggcataaatttggtgaataattataatttattattatttttttttaatatattttaatcatcttttgatttgaatttttttttttgaaaatcttgtttttttgagatctctgatcatgaatctggcactattttaaccaagtccaacttcctaatctaaatttgaacaaaaaacaacataaaacgagaaatttgaattttcgatcttggttcaaattcggcttacaaattagagattataaattggtccaaatggatgtaatatttgtgctcattgtcagtgactaaaaaaaaacccctagaacaaattttcatgaattattattatcacaaaaaaaaattatataacctaataaaattcaaaatatacgactttttaactagcgccaaaaaatctcaagaaattaataaaattaaaaatatttttgtttaaatttttttatgtggctttaattaatcccattcatttgcctgccgatcattatacaatatttatcctccactcttccactgtgatcagacatctgcggacaccgttgtgctgtttgacagtgattggaacccgcaaaatgatttgcaagcgcaggcgcgatgtcaccgcattgggcagacaaaacccgtgaaaatttatcggctgatcaccgccaacagttacgagcgcgagatgttcgacaaggccagcctgaagttgggcctggacaaggccgtcctccaatccatgttgcacaacaacaagggcgaaagcacacagcaaatgtcacgccaaggtgtgaaaaaagaggcaaaagcagatgaagccacccccagtgcatgacaaatatcgtcgagacataatgtcgcagggacaaaacgtcgtcgagacataatgtcgctggacaaaacgtcatcgcaaaaaaatattttcttttaaccctagcctaaatcaaaatttttctataaatcagaaatttttgtaaacagaaacatcgaggttttcaaaaaacttctttttttctgcgatcttttgtcccggagacattttgtccattggcgttttgatcatggtggcgattgtgttatcctgatcaggggctgacttttgctaataatttctttgaaaatgatccgggttttattttctttttttaatcccccccccctcttttccaacacagaggtggaagatttactgcgcaagggcgcctacggtgccatcatggacgacaacgagggcaccaagttcagcgaagaggacattgacaccattttgttgcgccgtacacaaaccattcggctggagccgggcgtgaagggctcaacatttgccaaggcgtctttcacatcgtcacacaatcgggaggacataaacattcagg

SEQ ID NO: 84137 - DNA, 785 bp, Heterodera glycines
  Genomic contig location: Contig_ID=SeqID_19411; Location=41..825; Strand=-
  SCN-specific regions: Sequence locations=1-410,432-463,495-611,634 -694,726-785
aggaagcgtacgctttgtcacaagaggccaacatcagcttagagcaaatcatcaaacggtacaccaaatgccgtaatcagttccttgaacgtgtcgccgaccaaatcagcgaccaactacaacaggtgacacccaatttagatgttaaatgattggatggatgccgaaaaaacttcttttttcgtccacgcataccaatttctattacatttcggtagaattcgaactttttttaattttcaggatcattctgacagcactgacgacatcagcaccaacaaacatgagcggaaaaagcgtccgattgtgttcatttcgccacagttgcgcaaacgggtcaaaatacaacaacaattggcggaagcggactcggccaacgacggcgacgacgacagtgaacaaaagcaacaaaaaggtaaagacagaaaatggcttaatgattcaatttacattttttcggcagaatataatttttatgtaaaataaatttaattgacaattttgtggggcattagaaaattagttttcacccttacaatttgataaaaattggccaaatttattggtaaaataaattaaagtaatttattggtaaaataaattaaagttcgttgtttctatcagaaaaaagtccatttaccattcccggcggtgctgaagacgacgaaatgacagatgtccattctcaactggagcagaaacaacaacagcagaagcagcagcaggaaacagaagcaaaaaaaagtgatgggacaacaaaaacggaggacattccaagcagctag

SEQ ID NO: 84138 - DNA, 156 bp, Heterodera glycines
  Genomic contig location: Contig_ID=SeqID_355; Location=1142..1297; Strand=-
  SCN-specific regions: Sequence locations=1-124,146-156
atggtcttctcccacgacgaatggtttgtccaatgtgtgcccgccctgggcgaacagcttgacaaacttttgctcctgtcccaacaccagcgggaagaggaaggaaactcatgcctccaacaacgacggaatacggacgacgacggggagtgtcat

SEQ ID NO: 84139 - DNA, 945 bp, Heterodera glycines
  Genomic contig location: Contig_ID=SeqID_356; Location=5545..6489; Strand=-
  SCN-specific regions: Sequence locations=1-880,902-945
  Gene Ontology: Mol. function=chaperone activity; Cellular component =basement membrane; Biological process=rRNA processing
atgaagcaacttcaaaaatgcccaccccagatcaataacctaacaaattcccaggtctcaacgaactcgccgagtattgccaaaggaggaggaacgacttccaaaggcgacagcaaaacggacaagccaaaggacaagaaagaagcaacatcaaaaggcggcagcagcaccaccaataacgcgccgaatgccatggtagatgaagcaacttcaaaaggcggcagagcatcaataacctaacaaattcccaggtctcaacgaacgcgccgagtattgccaaaggaggaggaacgacttccaaaggcgacagcaaaacggacaagccaaaggacaagaaagaagcaacatcaaaaggcggcagcagcaccaccaataacgcgccgaatgccatggtagatgaagcaacttcaaaaatgcggcagagcatcaataacctaacaaattcccaggtctcaacgaacgcgccgagtattgccaaaggaggaggaacgacttccaaaggcgacagcaaaacggacaagccaaaggacaagaaagaagcaacatcaaaaggcggcagcagcaccaccaataacgcgccgaatgccatggtagatgaagcaacttcaaaaggcggcagagcatcaataacctaacaaattcccaggtctcaacgaacgcgccgagtattgccaaaggaggaggaacgacttccaaaggcggcagcaaaacggacaagtcgaacgcacaagaagaaggaccagcatctgaaggcggcagcagtaccaagaacgcgccgaatgcccaggtagatgaagcaacttcaaaaggcggcagagcatcaataacccaacaaatttccaggtcacagcgaacgcgcctgcccaaggagaaggaccatcttctgaaggcggcagcaccaagaagccaatcaaagacaaatcagagtatatgagtcaaccataa

SEQ ID NO: 84140 - DNA, 1033 bp, Heterodera glycines
  Genomic contig location: Contig_ID=SeqID_356; Location=2889..3921; Strand=-
  SCN-specific regions: Sequence locations=1-425,448-562,584-645,667 -707,729-1033
atgacggctcttggtctacaggtcgaaggatacgcaggaaaattgaaggactacgaaaacaccgaagattcgatcgtgcatatcccttaaaattgttcatttccatgtttttttaactctttttgttatgcttgttttttcctgaaatttttattatttggtatttgattacacgattccgataaattttgataacttaaagtcttgaaaaacttttttttcgacttttcgctaattttatttggcgggatttcgactcattttggctgtggcgggatttcgacgcagcgggattttgacagcgcaccggagttaacccatagtggtactatctcttcctttctttttttctttgtaatttctctcactttggcgtactatctcttcattttaattatgtaaaaaacaacattttacttttcgcatcaattagaatttatttgcaaaaataaagcaaactgtacaattgtttttgattaaaggcgataaatattttagggaatttaatgggcaaaaaaaaaagaattttaacatcagcaaaccggtgcaaatacggtgggaaaagagagaggaaaggcgagcgcaaacggccggccaaggcgatgcaagcccgatgggtcaaggaaagtgagtttttccatttgtttcataaaatctctaatttttccaatttttaccttctccccagcccgaccccgatgcagaaatgccgcaacaaaccaaagaagggccgtcgacatcagtagaatcggtagaggacacctccgaacaactgccaacaacacctacacccatgacgccgcaggaattggacgtgccgtcggtggagatggtggacaccgatgtgccattcccttcaacacctgccgacgctgaccaacaagccgaacccgtgccgtcagcatccacggcacgctgtgagcttatggcgacaccatcaactctgtgcctacctcaaattcactccggcactgatgaggcaccaaggatcgacggcgacattcacttgtccgctttgcgcagctcggagtga

SEQ ID NO: 84141 - DNA, 1732 bp, Heterodera glycines
  Genomic contig location: Contig_ID=SeqID_357; Location=59..1790; Strand=-
  SCN-specific regions: Sequence locations=1-110,140-280,302-803,825 -990,1012-1177,1205-1356,1378-1640,1662-1710
atgttattcttattccctttgccccttattttgcttttgctcgtggccattgttttggtcagccagtgctgcggcggttgtgtgaaaaaggtgtgttcagaaaagaactttcgttttatcaatttaaaaatcccttttccctttttgcagaaaggcgacagcaaaacggacaagccaaaggcccaggaagaaggaacttcaaaaggcggcagcatcaacaccaagaacgcgccaaacgctcaaatggacaagctgaaagcccaggaagaaggaacttcaaaaggcggcagcagcagcaccaagaacgcgccgaatgccatggtagatgaagcaacttcaaaaggcggcagagcatcaataacctaacaaattcccaggtctcaacgaacgcgccgagtattgccaaaggaggaggaacgacttccaaaggcgacagcaaaacggacaagccaaaggacaagaaagaagcaacatcaaaaggcggcagcagcaccaccaataacgcgccgaatgcgatggtagatgaagcaacttcaaaaatgcggcagagcatcaataacctaacaaattcccaggtctcaacgaacgcgcctgctcaaagaggagcaatgacttccaaaggcggcagcaaaacggacaagtcgaacgcacaagaagaaggaccagcatctgaaggcggcagcagtaccaagaacgcgccgaatgcccaggtagatgcagcaacttcaaaaggcggcagagcatcaataacccaacaaatttccaggtcacagcgaacgcgcctgcccaaggagaaggaccatcttctgaaggcggcagcaccaagaagccaatcacagacaaatcagattatatgaggcaaccataaactttcttggaaaatgatcctgtatttatgttatttgttgtgataagttataattgatcccgtattatgttattgttgatcatttatgattgatccgtattatgtatttattgttcattgtgattgagatttttgtggctttttgagaaattttgaggcttttggggaaaatcctcagaatcttttaaattttgataaattggcataatgtttggtaattatttaatttgaattttggtttttaatagagtatcaaacggaatttcactcaaatttagccagaaaattacaatttttttcgaaaatccacaaaattatgaattttttaaatgaaaatctgctaaaaatatggtcaaaattctcaattttcccccctccggcggtgcctatcggaaccgccggaccctaaaaatcctttttatttttttttcaattttactcaaaattgcaaaatttggccattttgtggacaaatctgttaacaaatcacattaaaaattacaaaaattttcacggcggcgcctatcggcaccgccggcccctcaattccccaagttttttggaagaagcgttgcaaaaaaaatcaacttcgatttttcatgctcagaatctcacaaaatgcttatttcgaacaaaaaaaattactcaaatcgataaatcctgcattttccaaaaatgcaggattgcggactgggatcctgcaaaatcctgcgcaggatccggtcctgctccgggctcattctctccgattctcgtcatccgatctcggccttttccgctttcctccctccccacactctctcgtcacttcttcacctgactctatcttctcacacagcagcagcagaaacaaaatataataaa

SEQ ID NO: 84142 - DNA, 1348 bp, Heterodera glycines
  Genomic contig location: Contig_ID=SeqID_3304; Location=163..1510; Strand=+
  SCN-specific regions: Sequence locations=1-7,38-148,170-236,258 -473,495-708,730-745,768-914,936-940,962-1197,1220-1348
atggccgaacgaagcggaggaggaggagggagaaaagcgggacaagcaacagatggtcacgctggccaagaccaccattcagttgagtccatcgtgggaaagggacggcacaaaaatggcggagaacggcatggacagggacacgacggtgaggggataaagcatgggaggagggggaagagtgagcgaaaagcagcatttaaaggggataaattactgtaaagagggggtacggtaagaggatgaaaagggaaggaggaaaagccgagtaagcaaggcatcatcccttcagcagaagttcaacattagcaacaacaccaacagttgcacaatgccaacacctttcattgttggcaaaagtcggacgattccattgaaaaacggatggaatacgacaaaagcaattgagaagactgatcagtcgaaaagcgaagacagagggaacgaaggtgatcggaattgaccatttgtgggcgggggagagagaaaaaagagatattggtggaggagcggttaaaaatggtcttaaagcccaaacatttgctagttgctgtgaaagctttcacctgagctactgtagcagtactgtaaaagcaaaaacattttgcggtatctttccgacaatataatttctccttttcgactcatccagtgagcgtctctttgcaagttgtccgggaacacaatgtgaccatttcggcatcgtgctgttttggtggtgtcgctgagaaaaaattcccgccactttttgcgacaacgacggcacaccgcggaatgccattgtcattttgtagaaatgaaaaaggcagcaaaagcgtcaacagaacgccaatgggggcggaagtgcgggcgaatggcgccgccggtgacgtggtgagaaaattggaactccgaatggtcgacattgagctggaagagggggaggacgaagaggacggcatggaggaggagaagcgcaaatggcgacggagggaatggcacgacggaatgagtgggaagagagtgagtgctttccgaagttcgaagtttcggactctcgcttatttgaaaatctaatccaaaaatttgttctaattttggcaaatttatttgtcagagtcggcaagaagaagaagacaaaggcggagcagcaccaactgcagcacaacccaaacagacaacgacggggtggacacaattcaaacggaacagagagcagcagcaaagagagaggagggaggacggaggtgaaaaaaaggggcggtggtttgggcatgctttgattagctatgcccgagagtctcgagtcaattaaacctaacctgactttttgcgtctcgactcgagagtgccccccgccgggcagcca

SEQ ID NO: 84143 - DNA, 1406 bp, Heterodera glycines
  misc_feature (1383)..(1383): n is a, c, g, or t
  Genomic contig location: Contig_ID=SeqID_3304; Location=2299..3704; Strand=+
  SCN-specific regions: Sequence locations=1-16,38-119,141-391,413 -431,453-457,480-763,786-1217,1239-1248,1270-1305,1327-1406
atggatagaacaattggagaatttgacaattgcactgacacaatcaaagcaaagaaaacgacgactggggaatacggtaagggtaactgtaagaacggaaccaagaccaaataaattcgagagaaaaccgacaaataaaacattttgaggccaagaaatcacagcgaaccgagtcgaaactctagaatgtatgtacaaaaagattggggaatggtctcttccatggcaccgactgatctttgcccccccccccccatcttcagcagctgcgtcgttcaccaatgccaaaacggtggtccgcgagaatcgcaattacgacttgcaaagcgtcgactgctggcgacggtggtcatcgcttcgccgaatgccaacgacggcaaatgccgcaaaaggaggaggaggagggactttgccagcaaagaaaagggaggcgaagcggacggaggagagtcaaaatgacggagaagaagaagatgaagcattgcgcagagatgagtggggccgactgattgtggttggttggagacggatgaccaaatgtgtgggggggggggggggacgggggagactttcccggcttaaccgaatcgagcctcttactaatttcagatggggtcccgaatgtaaatatttacttggatcttttgtcgctaatagccactttttttgcctaggatcgaagagagtggcgtcaattcttagcggaacagcgaacgcccagcagccgacgcgtggagagccgaattcgtttgctcgacgcatgcaacgacagcaacaacaacagcgagacggacgacggattagagcagtaccggtatagactaatggcgttcgcaaccgaaaatttctcgagactcaagaccaaaaaccgggacttttctcagtcgagatcctgggtcagctctcgttcgaaccgaggaagtccgggttttaccttgggattcagactcaacaaccaagctaattctccatctcgagtcgatcgggtttttaaggtttcagtctcgggctaaattctcggccttaaaaaaggaacccatacacttatcgaaacaccaaattgttggcatttaacagaaaaattggcacacgcaaaaagccaatggtcgtagttcttgacggaggagggaaagaagggcagcagcagcaaaagttggcatacgatgaagacaaaaaactgctgaggagcgcgacgatgaacaacggcaattgtaatggcaacggaaggacgacgacgacggcacttttaatgagaatgaaaaaagaaaacggcgacaaaaagtggagacaacggaaggaggacgaagaaatttgggagggataaaagggatgagagagaagcagaagcggaaataatgatatgataaatgataaggggagaanagcgatgggaaaatttaaaaata

SEQ ID NO: 84144 - DNA, 1235 bp, Heterodera glycines
  Genomic contig location: Contig_ID=SeqID_19417; Location=27..1261; Strand=+
  SCN-specific regions: Sequence locations=1-55,77-86,110-144,171 -173,209-454,494-514,536-629,651-720,748-815,838-862,884-893,915 -936,964-992,1014-1119,1183-1235
atgcagattactattcgggggtggagagatagtacacaacttggagaggaagtgcggagaagggaagagagaaaggtagagacaacgaaaacactctgtccctttcttctcttcccttggccacccatcggctcgagtgcaaagggaaaaggatgagaagaaaagcaatgaagaataaaaaatttatttaaataaaaataaaaatttacagtataccaaaaaatgcacgaaaaataaacagccaatacacttgggtttttgcgcgaaaaaaaagtgtgaaaaccagggacagtcgaccacctgccccagaaaatgcgcgaaaaaacagccaatacccttgggtttttgcggtaaaaaaggtgaaaaccggggaccgtcgaggtgtgaaaacccggccaccgtcgaggtgtgaaatttcacaccttgacggcgacggataccgtggactcactactaattatattataataatttctttcttttttttatatttgaatccaattaatttcttttctgttatttatgcttgtctttttatctcatgtcttcatactctccttcctcttcttctccaggcaccggtggtgcttacatttaatattgcatgtctataaaatataaatttaacttagttttttcttcaatattattactttggttaattattatctttttattaaaactttttttttcaattgccaacagtaaaaaatgttgatcaatttttattattttaatttttttaatgatatttcagaagttagcattgatttattcaagtgactgaaataattggctcttatttctgccgaaagtattattattattattattattgctaaattaaatgagtatttaagtgaatattttttacaaattttaaagtggacccgattatattttcaattattgattcaagaattgaattattttagcaaaattatttaatattttattaattaagcgcttaaattatttttcaaaaattcttgttcatgcctgtgtagtatttcttcttgaaacattccactctattgaaatctggatttgtttttattttttctattcataattttagaaatatacataattattgtatcaatgagttatttgtttaagaatttttaaaaatttattaagtttatttgtaaatgacttattaatcatttttttttaattttagctcattacccatttcaacaagcattgactgtgaaaagaaaattgttttcaaa

SEQ ID NO: 84145 - DNA, 1167 bp, Heterodera glycines
  misc_feature (106)..(106): n is a, c, g, or t
  misc_feature (134)..(134): n is a, c, g, or t
  Genomic contig location: Contig_ID=SeqID_19422; Location=804..1970; Strand=-
  SCN-specific regions: Sequence locations=1-152,176-390,460-597,640 -789,852-934,994-1097
atgccggagaagagacaagggaaaaccaaaaaggaccccagatctcccaataaaaagatgcggaaacacataataacggcatcaaacaaaaattcgccaacatttnacttaggtaagcaaaatggcatactttnaaaccggttaaaactcggtttaactgaattcttccaaaaaatgccgaaataactcaactgaggtttcgatgcatgtatttttttgataccaatattgtgcagattgaccgtcatttgacaaagttacgaaataaatggggatgtcgtaaacatatgacaattattgtacattaaaatttgtttacgtattaacaaataaggtcatttaaaaataaatttatatgtagaataaaaagctcaaaaatgtatcaaaatcttttaaatataaaaattaaaaattaacattttataaaataatattattattttttatcaaatttaataacttacctattcggactttgtcctagcacctttttatgttgaactattatcacaagatttaaaaagttttcaccatctattgtttgcgtacgttctttactgagatttggatgcctcggttgcttgatttttgattttcaattaattaattttaatagatattattttttttactataaatgaaaaacatatatcttgaatctttttttactttatctgttcttacattaattttgaatacctttagttgaaaagcattttattagctttacacgttttctataatggtacattttttcttttttcaataaaagacgctcttttaataggcaaatttaatttttttattgttaaaaaataaatcttttaaattattttctttattttattttagttgattcttttgggaatattttcattgtattgaactattcgatgcattgatttatattgccataatttttattgtaatttggatttattaaatttaatatttttagtattttttatttaaatcaaattttaataattatttctaatagatcgtatatgtaatttatagtttcttttttgcatagttcttgacacttgccttccaacacggcagcaattcttaattattcttgtttgtgctctttcaatttaaaatttattattgtaattgatcgatttttttatatattggttaagttaaatttataataataaa

SEQ ID NO: 84146 - DNA, 1502 bp, Heterodera glycines
  misc_feature (30)..(30): n is a, c, g, or t
  misc_feature (151)..(151): n is a, c, g, or t
  Genomic contig location: Contig_ID=SeqID_19425; Location=587..2088; Strand=+
  SCN-specific regions: Sequence locations=1-107,132-323,349-409,442 -487,525-732,756-883,905-937,970-978,1030-1078,1101-1195,1222 -1461,1501-1502
atgacggacaaatgcattaatagagaattngataatgttatgtttgatggtgtttggaatgatacaactgccggagggtcaattcgatttggagcaggtagaaaaaattcaagcaaaaataagaatttacaaataagggaaattagcaatntaaagaatcttcagtcttgcactaagttaaaaaccagaaatacatttgcccttcgttccaactaaagttttgtatgggttggtttttgtactacaaagtcttataagcagtttagaattaagtgtaatttcaattgttaatctttttaaaaccgggtaaaattgttattcaaattgattataataaagtattaaattgaggttagaaaattgtatatacaccagggctgggcgcaattgcggattacgaaattgcgagttacggatttttgggatttttctgcaattttgatctgtaatttgacttggattatttttcgagacgatttcttgtaagattatttttataaaaataaatttttattttatttaaagggatggctacctgtatttcgattgtctcaaattcaatttcattttttctccagtattccaaattggattatttctgaattttcttcaaaatttttttgtaaattttcagaaggatttatttttttcttcttctgaatttttggtccaaattatctggattttttaaaatttcccatcaattaatattcctggtccagcttgggacccaattttttcaatttttaaaatttggctattcagttctttaactgatttggttgcccaaaattgtatcgtcgggcttatccattaccaaagccaataacaatatgcataaatccaattataaagctcagaacttcaaaaatttttacaaaagtgacccaattcaaaaaattgaattttttagacccaaaattataatttctttgtataattgaaataaaaaataaagaaaatgtttcccgaaaatccatttttttatttttattaattcaatttaaaaatttgtttttcaaaaattatgacaaaaattgattttgaaaattacggattgcggattacgggaaattgcggggttttggacccccataattgctgattacggatttccgtaattgaaaatccagttgcgcctagccctgagccacactatagcctcataagttaatgtgatagtaaatcgtgacggaataaaattttaaaataataatttatcatcataacaaatttcggcattacagttttaattttagaaaatttcacaagaaaccctcaatattggataaaagttgctggtgacaacccaaacaaaagcgtgattctgatcatttcgttgatgcaaaagtatcaacgagaagaacgccggccaaactacgcagctggtttcaacattttcaaaatggtagttaacataaaaatgggtttagacaactaattctatatatggaagcattcttttaaataataataatattatttaaaattaaaaaaaatga

SEQ ID NO: 84147 - DNA, 766 bp, Heterodera glycines
  Genomic contig location: Contig_ID=SeqID_19428; Location=232..997; Strand=-
  SCN-specific regions: Sequence locations=1-5,36-64,86-234,320-436,468- 591,620-703,725-738
atgacaaatttttatattattctttttaaatttatctttttccgacaaatgaatataagcaacaaagaaaatattcaagaaaagaatggcgccaaaaatatgccgaaatttgcaagaaaatcggagttagccgtagaacaattgacaaatgtaagaaacaattgtgataataaattttcattcttaaaagtgtacgaattttttttaattaaaaagcaagaattgattgttgagatattttatttaaatttgcataaaattttattttattaatttttaattggcataaatatctaaaaaacaaattaattaattaaatcctatcaaattttccgtgagttttgccttaattcttttttgtattgacaacagtacaatattaatgtcaattagtttatgcgagagtcgttgatataatattatgaactgaaattacaatttttcaaaaaaataaatttaaaaaaaaaccagaaagttcttcaagtggcagcaaattaagcgaaacttatgagaaaatttaattagcctaatttatgattagaaaattgaaaaaaaagttgcaattagcctaaaaataatcacgaagaaaggaaaaattaaaaaattgaaaatttattttcaacaaaataggaattccaaaatgaatgatcagaaaattgaaaaaatgattaatacttgtgcatgaacatttgagatggaaagccaaatgagagaagaaattattcattcttaggagacattaaattttgattaatattttaataaa

SEQ ID NO: 84148 - DNA, 513 bp, Heterodera glycines
  Genomic contig location: Contig_ID=SeqID_19428; Location=1484..1996; Strand=-
  SCN-specific regions: Sequence locations=1-13,46-513
atgcccatcatcatttatttttcattaaattttcaacttgtgtttctgcttttcaatattgatatacaaggatgggattggcttctgtattacaacaaactctcaccttttccaattattttaccgtccgctttaaatccaatcgtatcattttgcaccatcaatgcttaccgtatcaaatttgtttcgaatataaaatgtttcggtatgtgataattagttgactgtttgattttcatttatttaattgtttttaatttatgttgattatttaggaaaaagcatgaagcgtttgtttcgcatgaaaattggtgatcaaaatgcggtttcaaatattcagatgcagcaacattagtagcaacaaaatcattgttttcacaaaatgcaattttaatttcgtatttatcctggcattgattttcaagaatttgggcgatgcgaaaaaaactcagttttgggataagaaaaacctaatatttaattatgcgattcactaatttatataataataaa

SEQ ID NO: 84149 - DNA, 374 bp, Heterodera glycines
  Genomic contig location: Contig_ID=SeqID_19428; Location=2109..2482; Strand=-
  SCN-specific regions: Sequence locations=1-124,148-280,316-374
atgttcatttgcttttttccacctgctgatcacgcaatattggacgacaaatctgtcgcggaaattttgggcataaatctcgacgaccaaattattttggctgcatatgcaattaatgtaacggtaaatcaataaaatttaaaaattcgtttttttaatttaggatatccatttggctttaagtttatattaccttgtcattataagcacttttgcttatatcataatgtttggactagcatattgtatcaaaaaattcttggacatgaaaaccaaatggtaattaatttaaaattattttttattttaatttttgtgtttgaagcgtttcatcttcttctgaaatagccaaaaagatgattgatgtgaataaa

SEQ ID NO: 84150 - DNA, 385 bp, Heterodera glycines
  Genomic contig location: Contig_ID=SeqID_19429; Location=27..411; Strand=-
  SCN-specific regions: Sequence locations=1-115,137-254,294-385
atgcgtccgattatttggccatctccgctcgaccattgtccacctccaatcgcattgtcgggccgcacttttgcgaaacgaattgtactcgcagaggacgatgtaattaacaaatgatcaaaatttaaattcagtaacaaacaaattgattgtagggaagagagacaaaacgcaatgaatttgcgatttgaaaagggcaaaaaattggcggacgaactgccggcactttttttgcattctgcagaagtaaagacatttaaaatatttttttttatttatttaaattttttttagtttgatgctggtaaggaatgcgtgaagaatttgagcggaggaatttatgtgcaatttgttgggcaagaagaaacactaacgcacagaaaaa

SEQ ID NO: 84151 - DNA, 1184 bp, Heterodera glycines
  misc_feature (7)..(7): n is a, c, g, or t
  Genomic contig location: Contig_ID=SeqID_19430; Location=1..1184; Strand=+
  SCN-specific regions: Sequence locations=1-42,78-387,410-702,724 -973,1025-1184
agcacanttctgttactactcaacttcttgaagtggtggatgatttcagttttgctttagaaaatagaaaatcaattgatgtaattttttttgatttagctaaagcattcgacacggttccacataaccggctaatatctaagctccaaaacattggtataaataattccttattaaaatggattcagaattacttagaaaaccgaaagtttttcgtcaaaatcgggtctgatttctctgacgaatatccctgtctcagtggtgtgccgcaaggctcaatattgggaccactgttatttcttatttacatttacgatttaccaaaattctgcgaaactgaaaatgttaaaattaaactatttgccgatgatcttaaggcctatcatgttctttcaaatatttccttttctccactccaaaattttattaacaaatttaatcaatactgtaaatttaacggccttaaaatcgcttcaaataaatgtttaactttacatttaggacacaaaaatcaaaaaataaattattttattgatgactttcaaattcctaaaaatcccggaaacgaaccagtcagagaccttggcatttattttactaatgatttgaaatgggcacaacatattgacattatctcgaaaaaagcattacgatctgctttcgctatactaaagtcaatcaaaactcgtgatacgaaaatacttgtaaatttgtttaatatttattgcagaccaattttagaatttggatctccaattttcaatccttatttaaaaaaggatattgaaaaactggagaatgttcaaaaaacttttttgagagtaatatttagacgtaacaattatgctgctgattaacctaattatgctgaattgttaaacatttatgatcaaaagtcgcttgagagtcgtaggttaaaaatagacttaaaactttttcatgaaataattttaggtaaaataaatttacaaaataatgaatccttttctttttccaaaaacattgtaaaaaatgaatacactataagaacagcttattgctcaaccaatgctagatacaattcgttctttattcgaacctctcgtctctatagacttttacctaaagagacgagattactaaatccaaatgagtttgccaaacttcttgaaagatctgatcttaatttgttgatttctttgcca

SEQ ID NO: 84152 - DNA, 733 bp, Heterodera glycines
  Genomic contig location: Contig_ID=SeqID_3306; Location=1034..1766; Strand=+
  SCN-specific regions: Sequence locations=1-733
atgcaccatcaaattcatcgccgacagcgccaaaatggcactaatgaggcggctaatttattaattaacgcagtccaagcaaatgaatgtttacgcctaactgacactaatgaggcggaaacgatactactaattgacgcaatcaaagaaaatggcactgtaccactgaagccaccggcacaacctgccaaagccatgcactttgtggtcatttcagcggtgtacagtacaaaaagcaaactgtaaatgccgtggccaaactgtaaatgctttggctgacgattggtctcgcattccgtcattaaatacttaaaaaaaaatgaaaagcataataatgaatacaaaaaatgcatgcgaaatgcgtcggttgtggaaaaacggattcttatatgaattaggggcttaaaaatgcctgaaaatccagcaattactaatctttccataaatctaattatactaattaaaaaagaaaagctgctaatttgttttaagttactctgacaatcaaatcgttttgttggttgatgcacaatttgatgatgcaattgtgcaacaaatttttgttgctaaaacgtccaatgggacaaatgagcaacaaacaaattttacactgcataaagcttcaagacgtactgacgtatgcttatggagttcttatatgtctgtgtttgattcggttgatcaaccagaaatgcttcaagttggccaagccgaaaatatggcacaaattgag

SEQ ID NO: 84153 - DNA, 1499 bp, Heterodera glycines
  misc_feature (304)..(304): n is a, c, g, or t
  Genomic contig location: Contig_ID=SeqID_3307; Location=16..1514; Strand=+
  SCN-specific regions: Sequence locations=1-351,373-677,699-749,811 -1027,1049-1260,1283-1384,1424-1499
atggtcagcaaacaatgtaaggtaatttaaatgtatgaaaattgttcaaacatcaaattaatttacacccggcaattgatatgaaaagatagcacaaagattctctcccgtaatacctatgggtcattcattcttatcaaaatgcattcctcctcatcttctgaagagggggaaatccacgaaccccagcaaaatattcaggctcaagagcaaaatcacgaccttgacaattatgaaaaacgtttctttcttggtgaacctatccgtcaaaaaacacataggcatgggcggtcgacccccgccntaaaaaatgtacggccaattaagtcgggacacttttagtctgtatagtcagttggcatcaaaatagaatgtattttgaatattttgaatttaaactaactttttgcgaaagaattggcaaaattatggcctttcggtgccattttgagctttttttcgcggttgacggtaaattcataaaaaataaacataattaagccattaattatttcattaagttcaattaaaattgaattttcttacactacttttaaggtgaagcggtcgtacgataagaagcgctttgaagttggcacttgttttagtccacttttctttgccgaacattggcaattggttgtgttgaccatcgaaatttatcgccattttggcagtgctcttcaaatcatttatttaatgagcgcaatcgaaggcattttcgatattttaaaggtggatgggttacgaattaattaacattaattaattcattatttatttgtttaattattattatttaatttattagctgtatcaagcagccgatgttgtccaaattgagcattggtattcaattcaaatcgaaggggaaaagtacaagggccttgcacagaccataaacacgaatcaagactggaggaatcaaatatcggcgcataccgattgtctgataaaatatggggtaaatttaactaattaaaacggacgggagaacaattattggaatttaattttgataaaatgcaaaaagaaaattataaaatttgtgaaattcttaaataatcactaattgcctaaatgtcctaaagaatgcagccgaatttctgattattggagacattgacgatgttttggtgccaaaccatggcttttattatgacgaattcattcgaaatgatttgcaaaatgccgccgctttgttgtacgaccgcttttatgttgatacaacgaccagtgggtgccatgggccaaggccttaaatttgaaaaaatggccaaaaatcagcttaaaatttttcaagcagtaaaaagcggaggattggaaaggatttgtgctgttcgagtccgagatttaccgagactttttttacaaaattttttgttcacttaaaatctttaaaaaacaaatctttgaaggttttcctcacaaatttttgctttccttatttcaccttcgtctatttaatacccatataaaaatgtacgaaaactcgttaa

SEQ ID NO: 84154 - DNA, 402 bp, Heterodera glycines
  Genomic contig location: Contig_ID=SeqID_3307; Location=1753..2154; Strand=-
  SCN-specific regions: Sequence locations=1-124,151-248,291-402
atgcgacttgtgcaagtccacctttgccgacatgacaatgttgaacagcgagaagcgctccgggtccctagcttaagggcaatgatttgtgagtgagttcgtgaccaaagcgggagccaaaaataattaaaagaagatttttaaaaaatacgagcatcggtggtggtgggccccaaaagaacgagctaagtcttaatttactctcagcagctgcgcggaacttttcaacccgtaccaatttcattaccatttaaaaaattaattaaagataaatattaaaaaattttaaagtgcgggcaccggttgggtgaccactggatatcgacacgaagatgccggaaacgaaatcggactaatttaatttgttgtatcttagagaaaagaaggatttgttcaaataaa

SEQ ID NO: 84155 - DNA, 652 bp, Heterodera glycines
  Genomic contig location: Contig_ID=SeqID_3308; Location=3507..4158; Strand=+
  SCN-specific regions: Sequence locations=1-141,164-245,274-432,454-652
atgcgaaatttgaaagtttggattttcgaccttctgtacaaattgggctctgggtttagtaattggtcgaaatgtacgccaggtgattgatcattgatcagcgaccccgaaaccccctgctggaaacatattttcatgatttttaaaatcaaaattatttttccctaaagggataacatcggcagtaattaccatttcctcaattaaatgcttttcaatattcaaatttagaaataatttccttgaataaaatatatatattacatttaaattgctctctcatgcaaattctgaatgttacggatgattgggttgtcggagtgatccgtcgcctcatcgaagtgacccatcggataataacccatgagaaaatgcaacgattttacaccgattttatccattggctctgttttgcactccgttggatgaacgccaaaaactcagtgctcaacaaaaaattaaaattttccacattaatcggcacatttttctgtgtttatgttgtccaacaattgctgcccataattttcccaattcgtccgccgcctgcgcctgtttttaagccgatcacccgcgatgtgatcatttatgccaccttttcatacaaaaacagcaccaggtacatatctctttagacggacaattttcggta

SEQ ID NO: 84156 - DNA, 1348 bp, Heterodera glycines
  misc_feature (1109)..(1109): n is a, c, g, or t
  Genomic contig location: Contig_ID=SeqID_19432; Location=338..1685; Strand=+
  SCN-specific regions: Sequence locations=1-288,311-339,425-819,843 -931,953-1123,1166-1288,1310-1348
atgcactcaaattttcaaattttttttcaaaaaatttcacttgggaaaattcctggttggtcccagtcccggacaaaaatcgaggtcccggtcccgacttttctggtcccggtaagtcccgtttccggtttttgtcaaaattcccggtcacgtgcaactctaataattaccttttttgctaacttgctatttaaataggtaaaaaaaaatctcaaaataggtattaaataggtacaaaaattccaaaataggtaaataaaaatttttattaacgattttttagtggaaaaaagcaaacaaagagggaaaattttggttctacatatctctttgtaaacgaaattttaaatatattaatattttcttagatactattgacattttaaattaaaaattttgtcaatagaaaaaataaataaattttgggataaatttttgagaaatttttccaattcttagggtgcatttttgaaaatttttttggtcgattcttatgggtatattttttgattttattgcatttttgttaagaattttttgaaaatccttaaaataggtaatcaaaatgccgaaataggtataaaaataggtacctaggtaataggtagaaaaatcccgaaataggtaaaaataggtattataaaagtgggtgtagaagctccaaaccaagctaaaaactcgttttttatgcttatctcaacgttacaagtgcgcaaaaattttaggtatttaactaaaaatcgcatccctatttattacaatttccaaaaaattttccggcggcgcttatcggcaccgccggaccttcattttaccttaatttttgaaattttaaccacaaaatgggtagaatttgtcattttttatctgagaaaaagatcgaaccggaaaatgcagattttttttgcatcacaacctcaaaagctattggtaaaattttttttttaaatttcgcttttcgcattttcgcatattttggcttttcgcatttcgcttttttttcatttcgcatttttcagtttcgcaaatttcgcttttcgcatttcgctttttatttttcaatttggcccatccctggtgtatagtaaggcaattaaaaaaaaattaanaaatgttcagcaatttttgctgcgttttcaatctttattgtttaaaaatcaaaattcgtttgtatttggcaattgtcacatttatttctgcgttgcatggatgtattgtcagtttgggtttgcttaatagtggaaacttacatggtgacctaatgatcacttgttgcttcattgactttttcatggtgtaatttaaaaaatatataaaggcgaagcacgaaaaagtgcaagtgatcaaa

SEQ ID NO: 84157 - DNA, 1470 bp, Heterodera glycines
  Genomic contig location: Contig_ID=SeqID_19434; Location=713..2182; Strand=-
  SCN-specific regions: Sequence locations=1-301,325-631,655-820,859 -1191,1213-1470
ttggatttgcaacgacgtttggatggacattttgcccagttttgaccatgcccaactcggcctcaaattggcacttctttcgccacgtttcgatgcgttggtggacaaacatttcgatggcaaaagcgaattgacaatttggagatcaatcgaaattcgtcgcaaggacaaaggaccagaaccgaaactatctgtgcggatggatgacaaatttgtgccatttccgttgccggaccgtccgttgcccagcaaaatccgttttaaatgccttcagattgagtaattaaaaaccagagagctatgacaataaaagcatttatttcattttcagttacatcgatcactccgtcatcgcttttcttcgttcaaatcaccaaattttcgacaaaagaggcaccaatttacacttgcggattcaatcatcacacaccacggaaggccagcggatttgggacatttttggtcgtgaaatttggccaattttttcggcaaatattcgccatttgtgcttttcccgtggtgatcatttggactatttgcttcgtcaaatttcgccgacaattctcatcgatcttaaccaattggtttcaatccattcatttggtctgttgccctctgcgtttggtggtgattttgatgggccaaatgcaacaattactgctggccaagcattgtccaaatggttgcactctccgagaaaagatggccaacccaagcaattgcgttgcgataattactacgaacaaacgaacactgattggatcgacaatttcaaggaggtgtggtccgggggggggggggggggacaaaacgtagccgcaaaattttattttaattaaaaaaattatttaaaatttagttatctagcctaaatcaaaaaaaaatagataaattcgaaaaaaattattaagaaaattcaaggaaatgtaaaaaagtcgtttttttatttttctggaaattcagaaaattagtttttatacgagacggcgacgttttaggggtgtacccggtctgtggatggcattctgagttattttctgaaacccgaccccaaaaaagttataaatcgaaaatttctgaaaaattccgaattttatcaaaaatttcggaaatcggaattcagtgccatccctggtgtggccataattcgacaaatgactgattgttgttttccaatcaaattgtttagcattttcttcgtgccaatgccatttcttacgtcagttacgaaattcatttttctgttcgtgcgccgtcaatgccaatggtgccattcgaattggtgaacgaatggacaaaggaaaagctgacattggccaaagcaaagaaaaatgaatggggcatcggttggataatgaaacgatgcaaaattattggggagacagcggcggtcaattgggaagacggaaattgggacaacaattgtaacaatgtgttaatttggcttaatagtgacactaattgcattgg

SEQ ID NO: 84158 - DNA, 126 bp, Heterodera glycines
  Genomic contig location: Contig_ID=SeqID_19435; Location=301..426; Strand=-
  SCN-specific regions: Sequence locations=1-5,28-126
ttttgaaacaaaaggggggacccttttgttttgcaaaatttttttaagataaaaaaccatgataattttttatccggggttttaaaggtcgctaatcacgaatctgacatgtatttttactaattt

SEQ ID NO: 84159 - DNA, 360 bp, Heterodera glycines
  Genomic contig location: Contig_ID=SeqID_19436; Location=1127..1486; Strand=+
  SCN-specific regions: Sequence locations=1-47,108-192,214-287,310-360
atgtccttctctccaaactcgaattgggacaacgactttttcaccgggcagcaacagcggaacaacaacaacagcaacaatggcgcaacggcgaatagcagcaacagttcctccctcgggtggtgtgttcgtggtaagacatccgaaccaatatacctcatataaaattttttttgttttaattagagcgaatctctcttctcctcctgctcatgcttttggtcaacatggcccattttctgatgatgttcatcgtgctgctgaacagacgttgattcaaggacgatgaaaaaattttattatttttcacaattgtgatcatttttttgagatctctttttttttgatcgcttctctaaa

SEQ ID NO: 84160 - DNA, 1499 bp, Heterodera glycines
  Genomic contig location: Contig_ID=SeqID_19438; Location=57..1555; Strand=+
  SCN-specific regions: Sequence locations=1-54,93-567,603-726,765 -942,964-1075,1097-1107,1130-1226,1264-1499
  Gene Ontology: Mol. function=adenosine kinase activity; Biological process=ribonucleoside monophosphate biosynthesis
gttttcccattttattatgcccattttaattggccttggcagccctttgctcggttattaatatttaaataatttgttaatatatttttttacgtaaagatatttcggcaaatgttgggtcagaattattggacaaatatggcctcaaagaaaacggagctgtgctaattgaccagcaaaacatggacaaatttatgccactgtagcaaaatccaattaaacactttgtctccattaaaaaggcatttaagcgaggacgaaattctcaatttggactctgtcatttttttacccggcggatcagcacttaacacaattcgcgtgttccaatgggttttgaacggaatcaatgggcaaaaaaaagtttaatgatgcgattaatcacttaattagctcatagtttcataaggctgatcgtgcaatatttttcggttcggttggcgatgattccgaagcggaaatgctactcgagaagaccgttgagacgggtgtcgaagcgaaattccaacggattgagggggttcggaccgggaaatgcttctcactgattaatgccacaaatcggtcaattaattaattttattaattttaattgtatttttcccaattttagttcgctttgcgcttgccttggcgctgcttctcttttctctttggattttttgcatttgcccgaaaatgcgaaattaatcgatacagcaaaatttttttattcatctgtgattcaaaaaataaaataaaactaatataattaaaattattaaggcccatttttttacggtttgccccgaggcaattaaacatttggccacaaaagcaaatgaattggagaggccttttttattcaatttgagtgccgattatattcctggaaaattcaaaaaggaattgaacgaaattatgccatttgtggacattctttttggcaagttttcatttatcaaataacaaaattaactgataaacttttttgttttatgtttaaatttaatagtttcccccaatttagctaatgaaatggaagcatttgcttatgcaaaggcaaatgaactcaacccaactgatcatttgcatcaaattgcattgcttttgacagaaattaaaaggaataaataattaataattatttggataagcaattgtttttcttttttgttttaggccaacagaggaaaacggggggcgaattgtgctgattacacgaggggaaaagccgctaattgggcacaaaatgggacaataaagaatttcctgtcatttttgtggataaaattgtggacacaaatggggcgggcgacgcattttgcggaggtttctttttgcgctgaattttgaatgtttaatcattgaatgggcaatttaaaggctttttggcagcattcgcctgtgacttttcgctggaaaagtgcgtgaaattcgcactgtccgcggctgccataattgtacagaattgcgggtgcactttcccggaagaatgggtcggcgaatgccgggagcga

SEQ ID NO: 84161 - DNA, 449 bp, Heterodera glycines
  Genomic contig location: Contig_ID=SeqID_19438; Location=1801..2249; Strand=+
  SCN-specific regions: Sequence locations=1-195,224-225,248-449
atgcccattaaacactgtgtcatttcgctttcgctatttgtgccattgcaaatgcaaaattcggaagtacaaatcggcatgttcgtccgctgctggctccattttttgactgtttttgtttttgcgtctcaagaaatagtgatagaccaccaaagtgatgatggcatgggcgaagagaagccaaaatggaaaatgtaataattactattttaattaattaattcagaaaatcgcaccaaagtgattgtttcgtacgtgcgaatgtacaccaaaatgccaaattgttcacgtttgattcgaatataacccgaaaggatgttgaaaatggagaagaaaatggtgtaggagaagtccaacgggaaaatgatacgcatggtcaaaatgttttcatttgtttgatagtttctgctcagtgaatagtcctgcactttgttggagctttggaggga

SEQ ID NO: 84162 - DNA, 496 bp, Heterodera glycines
  Genomic contig location: Contig_ID=SeqID_19439; Location=673..1168; Strand=+
  SCN-specific regions: Sequence locations=1-75,105-496
atgtccactccaaagcaggaaaataaatttccaaaaaaacccgaattttgcaaaaccgagcaaggtatgtatacctattttattaattattttaataatattttcaaactattcagacgatgatgaagttgatacggacccttctcctgaagaagttgagaaatggacgccggagcaagtgattgaatgggaccagcgttgctatggaaaaatgcctgccgaagaagagatttggcaagaattcctcgacaacggagaagcgaacgtaaataacttctttttttgtctttcgataattattttattaaaactaggttatacgtgaatttttcggtggaaaaggtgccatggaagttgagaagagccttcgtgaatacgccaagaagaaagaaaagagggatgaaattttgatgagaaagcgaaaagaatacgaacaaaagatgggaaataagaaggacgaaaattaatttcgcaacattgtatcaaaattcggata

SEQ ID NO: 84163 - DNA, 391 bp, Heterodera glycines
  Genomic contig location: Contig_ID=SeqID_19439; Location=1308..1698; Strand=+
  SCN-specific regions: Sequence locations=1-122,145-355
atgcttcaaaacgaggattcctgcatgaacgaaccaaaagaaattccaccaaacgtcccaataactcaatcctggaaactttttcgcccaaaatacatgttgacttaccgcttgtgcgattgtaagttatttatttaaacttcaatatgttaaatttgtggcttaagtctgtctttcggcactttggaacaacaaaaacaaattcaagactaacgaagaacgatcagtgatcagttttgaactctgtgagaagtgtacgatcgacaattgccgagcaaccgacattttggccccattcaaaccaaagaaataaacttgatgagacttataatttcgcatctaactcatatccttcaattaataatatcattatatttgttattaattttta

SEQ ID NO: 84164 - DNA, 2130 bp, Heterodera glycines
  Genomic contig location: Contig_ID=SeqID_19441; Location=274..2403; Strand=+
  SCN-specific regions: Sequence locations=1-348,371-1477,1504-2130
atgcggcttgaactttcagtggcagacaccgaagcgccgagcatcatgggattggattggatcatccctttcgagcgtgccacccaacagccaattgccacgactttggagcagcagtcgcccattgtcaacagtgtgcaaccaacaaatgatccggtcaaattggaagggcaaatcaaggcttccttcccgaaggtgtttcaacctggcctcggacattgtgtgaagacgaaggccacgctgcatttgaagcaaaatgtgaagccagtgttctgccgtgcgcgacctgtgccgcatggagtccaagcagcagtcgacgaagaattggaccgacttttggactcgggagtgctgaagcccattgatttttcgcgctgggcagctcccgttttggcagttcgtaagaaaagtggtaatgtgcggatttgcattgacttttctacgggactaaacgatgcgctggagttgaacaggcatccccttccgcggaccgaagacatttttcatgctctgcgtggagccaaagtgttttcgcagcttgatttgcgtgatgcttatctgcaggtcgaactggacgaaagttcaaagcagttagtcggcatcaacacgcaccacggactttttcaatatcagcgtcttccttttggcataaaatcggccccgtctatttttcagaaagcgatggaccaattgacgtccggtattccaggcgtgtttgcctatttggacgacatcatcattgcttcggccgatcactcgcagcatgttgctgctctcattgaactcttttcccgaattcaggactatggatttcgagttcaattggacaagtgccactttttgaaggctgaattgaagtttctcggacacgttgtctcgtccgatggtctgaagcccgatcccgctcgatccgatgccatccgtaatatgccgtcaccgcatgacattggcactttgcgctctttcctgggtgcgctcaactattacggtcggtttgacaaggaaatgcgcaatttgcgtacacctttggatctgcttttgaagaaggacactccttggttttggggtcctgatcagcagaaggcttttgatcaggccaaacaggttcttcaattggatttgttgctgacgcagtatgatccgagtttgccgatcattgtcgctgcggatgccagccaatgtggaatcggagccacgatcagccatgtgtttccaaacggagtggagcgcgtcatcgagcacgccagtcgaacgctcactcccgctgaacgaaattacgcccaaattgaacgtgaagctttgtctctgattttcgcggttcaaaaatttcacaggatgatttacggtcgtaattttactctgttaacggatcataagcctctcttggctatattcggtaataaaaatgggatcccgatctacacggcttcccgattgcagcgttgggccctaattttgtccaattacgattttacaataaaatatgttaaatctgcaaattttggacaggccgacgttttgtctcgattgatttctgagcaccggacagacgaagaagtcattgtcgcccacacatcggacaacgacgtggacagcactgaagaagtcgaatatgctcttcttgtcaacttggagcagctgccagtcgatgcaaaagaagtgagcgaactgacgacttcggacgatttgttgcagcaggtggcacaattcgtacgttccgggtggccaaacaaatgcccagctaatgaattaatgcctttctattcgagacgtgatacgctcaccctcgtgggcggttcaattttgacaggaaaccgagtcattgttcctgcgccgcttcgtcaacgtgtactcaagacgttgcactttgctcatcctggcattgtgcgaatgaaggcgctggctcgcaaccatgtcttttggcccggtcttgacagtgacattgaggcaatggtaaagcattgtgcggaatgtcaattcgccgccaaaatgccgccgaaagcgccacttcgaccatggccaattcctggtgaagtttttggacgtgtccatattgaaattgcaggaatgcgataacatttatctcagctagtgtgataaacttttataatacacattaactaaaattta

SEQ ID NO: 84165 - DNA, 1318 bp, Heterodera glycines
  Genomic contig location: Contig_ID=SeqID_19442; Location=120..1437; Strand=-
  SCN-specific regions: Sequence locations=1-81,116-609,633-853,875 -904,926-983,1017-1318
atgcctttcctgaccgaccgttgcccaacaaagttcggtttgaggaccttcggattacgtaattcaaaatgataaaaaaaatccaaacatttttaaaataaaagtattcccttttcaggtacatcgaccataccgtcatctcatttctacgttccaatcagaaagtgtttgacaaacccaccgatttgtgcttacgcattgtcgaagtgatgccgatcgtttggaatgttttggtccatgaaatttggcccatttttgcgccaaacatttgccgcttgacattttttggtggtgctcatctgaccaatttgcgtcatcacatctcgccaacaattctctgcgatctgaagcggctgatttcgatcaattccggtgatctgttccccgcggtgatcggtgacgatgtgccaaacacaactgctggccaagcattgtcaaaatggttacacactccgacaaaaaatggacagccgaagcaattgtgttgcaaagattacaattcattacggaacagtggatgggtcaacgacttcaaggaggtcgtcgtcgatacagcaaatattttggatttactgcagtttatacgactataaaaaaagagacgaccataaaataatttggaaaaatttaaagcaccataacactttcaagaagcatccaaattaaacattattgacatcattcggtagccccaagagttctctgtctactaagcttggaaaaaattcactcaagattcaaaaatttatgatcaaagctttttgaaaaccgattttttgatgtttctggctataattttttttaaataacgaaataattgaaattttgctgaaactgttaaggctatcaaatgctgccaagaatgtttaattttgataattttgaagaagttatagtgctttaaaattgtcaaattattttactgtcggtcttttttattgtcgtttaaactgtaatagagccatttgatcactgatcatatcagaaattgcatttttcatttcttcatttcattttgcttaggaatttcttcgtgccaccaccaccactcgtgccagttacgccattcgttttgtgctccgtgtcgcaacgccaattgtgccatttgaagtggtgaacgaactaactagggaaaagctgactttggagacggaaaacgatgggcattataatgctaattggctgttgaagcgatgtccaattaatggggacgagacggtgccgggggcggttcaacgagcaaaacgaaagacgaacgaaaatttggcccgatttgtgcgatgtccgcttttggttgtattgtgtcgagttgcgttgg

SEQ ID NO: 84166 - DNA, 1063 bp, Heterodera glycines
  Genomic contig location: Contig_ID=SeqID_19442; Location=1899..2961; Strand=+
  SCN-specific regions: Sequence locations=1-95,118-149,172-217,239 -334,380-497,519-604,638-756,794-839,862-1063
atgaggcgaaagaagtgccattttgaagccaagtcgaagacggtcaaaaaatggcataatgtccaaccaaacatcagtacaaagccaactgaaattattgaaaattatttacggtaagaaaatgaaattccaaattttttaatgcaaaaattttctcacattttccttaaacgccgctccattttgctacacaaagattagttaatttgtgtatggtatttgtaaatttgtgaattttttagacaaatattttattttataccgtaaaatcgaagaaatttggaagaaatgcgaaaaagcacaaaaatgaaacgaatcatttttgcctataaaatggcctttttcttcttcctcccctttcattcattcgctcataatttccccccgatcattttattgccgtaatgtcttcaagaattccgtacgtttttctttttatatcatatagcatttcattaagaaaaatttggccagggttgccaagattgaaattttcagtgaatttcataattttatttgagtaccgcatcagtcggccccactaaaacttcaaaataaaactaaatttcacatttggctttcctggccttggcactttcctttgctttcccattccattcattattcattttatttcccaaattcgttttcagttggtacgccgtgtctcttctgctgttggttggctgtggcaccattctttggttcttttggaacaacgtcaaaaaacgacgacgccccaacaaaaaagaaatgtaaaaaacaaaaataaatatataaaaatcaaaaaattccctttttcagcttcatctccgccgactgttggctcgaagtgttcgctttacttccgccttctcagcttggccttggaatcgctctgatcagtcgccgatttgaccgccgcgtggacgaacatttcaaaacacgcaaatggatattggacaaagaattgcgaattcaggagaaaaagcgatggtttggcgaggaagcaaatggaaattgtcgatgccaacggagaaaagccgattgccgaatcccacaaattccgttgcccaacgaagtc

SEQ ID NO: 84167 - DNA, 927 bp, Heterodera glycines
  Genomic contig location: Contig_ID=SeqID_3310; Location=1194..2120; Strand=+
  SCN-specific regions: Sequence locations=1-280,302-328,359-412,434 -562,584-631,653-656,678-732,754-900,926-927
atgcgaataatgcgaaaggcgaaatgcgaaaagcgaaacctcggcccatcccttgtaaatacatatgtacgaaaaatttgccaaaattttggattttttttgaggatttccaaaaatttaatttaaaaaatcctcaaaacatgtaagaaaaaaatgaaaaatgttagaaaaaattccaaaataagtaccaaatatgtataaaatcacgaaatgtgtaaaataaaaattccgaatatgtaaaaatatataaataaaagtcccgatttttgttcgcaaacacaaaaaagaaagtgtttttcctaccattcagagcatggagaagtcaggaaaaaatatgtatttaaattaaattgaaatgcttagagtgcttttaaatgacacgaaaatgtggttgtttttttttttgaaattgacagaattatgcacaaaaaaccaagacagttgaagggactcaaaaaatttgaatggaattaaagtgcaatgaattcgttttttcagttttcctcgacgccgcttctccctggccgcgtggtcagcagcagaaatgaattaattaatcaattgattgatgtaatttgtgatcgaaatgattttggcactttggaatttcacattggaaattaggagaaactgggccataaattgggaaaataatacccaaatttggctggaaaagcatgaagaaaagtgcgaaaatgattgaaaaataataattcaaatattcgctttaattaaaaacgataagtaaaaacagtcatttaaattttgcattttttgttttcaaatccaaaaataagcacaaatcttagaaatatgcacacttggccactctgcgataacaccaaaaatagaaaacttcttttcaatttactttcttagaggaaaatgccaattgctctaacataattgaagaaaaatgatggaaaa

SEQ ID NO: 84168 - DNA, 212 bp, Heterodera glycines
  Genomic contig location: Contig_ID=SeqID_3311; Location=1429..1640; Strand=+
  SCN-specific regions: Sequence locations=1-212
atgattttttccgctttattttttctgaaggcgccaattgtaccggcggtaggcgtcgcccctgaatataaaagtaagttggcccgatttcttaacaaaattgcatcaaaatttataaatttttagtttgattttcacatttattaagcacaaaagaccggcggacgggatcgatcgggatcccgctcgattttctcgggatcccgcggtga

SEQ ID NO: 84169 - DNA, 909 bp, Heterodera glycines
  Genomic contig location: Contig_ID=SeqID_19443; Location=2113..3021; Strand=-
  SCN-specific regions: Sequence locations=1-452,476-736,759-793,815-909
cgaagaatccttcaaaatcaaccgcgaattggagaattatcggggcagcattgtgcacgggacgtcggttcagcaattcaacgacatcatcgaccaacttctggttgtgccagttttcttttctccttaatctattctttttaagaatgaattatctcgtgccgctgacgaccgtgacaaactcatcgcctctcatcgcgaatacgtcggccatttgcagttgacccattcggccgcgcaggaaatgaaagacagacggtgcagtcaaaagcattacttacattagcttccttcaataacccatcttatagaattaaacagctcgagcagagcttagaccaaatccaacaaaaattgatggcttcgttcaaacacgaacagttgcacctcgtcaagaacaatgtggagggcaatggccatgcaaagggaggcgagggagagcagaaacatccgatggagcaccaccaccagcaggaaggcatcggttctgcagctggggactccgctggaggcgttgcgacggttgcccatccttcgaacctttcgtctgcctcctctcaaatggaaaatttgcgtcccgccggaactgtcgtccgtcacatttatccaattggccaaaatccgtctcaaagtcagcgcgttagaggggccgtgagcagtatgactgaaggcggcgacggcactggccaaatgccacacgcaacgcaatacggcctcaacagtccgtatgacgacgagtacgacgacgagctggaggatgacgaagaggtggcatttgggttgattttgaaacgaaaatgtgaaaaaatttttaattgtaaccctgttttctctctccaggatttcgagtatgacgagggggacagtgcggacattgatgacgatttgggtgcccaagtgaccatttga

SEQ ID NO: 84170 - DNA, 161 bp, Heterodera glycines
  Genomic contig location: Contig_ID=SeqID_19443; Location=711..871; Strand=+
  SCN-specific regions: Sequence locations=1-161
ggtcgatgttggggcaattgggtaggaaaatgggcgaagagacggcacaaaatgccggaggcattgtcctttgggccaatctttcgggacaggtaagtgcaagtaaattgtgggcggggtggcaaatggagcggcaaaaatgggacaaatgaaggggagag

SEQ ID NO: 84171 - DNA, 664 bp, Heterodera glycines
  Genomic contig location: Contig_ID=SeqID_19445; Location=220..883; Strand=-
  SCN-specific regions: Sequence locations=1-12,646-664
tcactggcgaaatcactcactggcgaattcactcactggcgaattcactcactggcgaattcactcactggcgaaatcactcactggcgaaatcactcactggcgaaatcactcactggcgaaatcactcactggcgaaatcactcactggcgaaatcactcactggcgaaatcactcactggcgaaatcactcactggcgaaatcactcactggcgaattcactcactggcgaattcactcactggcgaattcactcactggcgaaatcactcactggcgaaatcactcactggcgaaatcactcactggcgaaatcactcactggcgaaatcactcactggcgaaatcactcactggcgaaatcactcactggcgaaatcactcactggcgaaatcactcactggcgaattcactcactggcgaattcactcactggcgaattcactcactggcgaaatcactcactggcgaaatcactcactggcgaaatcactcactggcgaaatcactcactggcgaattcactcactggcgaattcactcactggcgaattcactcactggcgaattcactcactggcgaattcactcactggcgaattcactcactggcgaattcactcactggcgaattcactcactggcgaaatcacctgggcaa

SEQ ID NO: 84172 - DNA, 1468 bp, Heterodera glycines
  Genomic contig location: Contig_ID=SeqID_19447; Location=20..1487; Strand=-
  SCN-specific regions: Sequence locations=1-394,416-1250,1286 -1418,1455-1468
atgcatttgttgttcacttatgccaattacaacgaatccccgccagaaatgatcaattctcaggtaaaaaattctcaaaaacaaagactgattttttgaccattctttgaaggttattcgggtgattctcaaacacattcacgggccaaacggacgcgaagcatcgaaaatactcaaaattgtgacggatcagtggaattccatttcatacaattatttgattcaaaatgaggtggtctccctttctcttttttatgtatatgatcttaaatggcccatttgattttaagaagaatgccacggcattgcgaaagcccgaatttgagttgcattttgaaaggacttttgcgaaggaaagtgctgaaatgggaacagcgaagaatgaaaggctaacgaaaaacagagtaaaacaattcaaaactgtgccagtttccctttactctgaacttttgaaggttcgcgatagacttatctctgttctttcggcgtccggacatcgtgcccgatcacccaaacattcttcggttcgttttcgtttcctttgcaattcgatctgatctcacagattaattctttcaatttctcatttatcctttcagatgcttttctcccattcttccagtgacattcaccaaagagtgcgggagacaacagttttggcagcaaaaagctcggcaatctgtcagaatggtgcttcaatgttgccctcacccgactccgctgacactgctcacccttccgcttggtcccaacagcaaccgtccgatgagatgggagtgtcgggagggatcggctttgatcgcatgtcgagtccaaacagtttgatgagtgccgttgtgggaggcaataacagcggggcgaatagtggcggcgaattggcatcattacgaaccaccgattcgttcccgcgagtgttcaaagagttcgacttcctcgaggctgaacacgactccgtctcggagtccactgagtcttgcttcaattggttgtccacaatgagaacagcgcgttgtggagtctgtcgcgaggatacggacggacagaacggaacgaaccaagaccaggaggaggatgtgccggatgaagacgacttttacattgacgaagaggaggacgagatggaccaccaaagtgcattggctgcgaacagagcgtgcatcggcaactttggctcgtcgccgcgtacaatgaccggttcgcgccattcgatgggcagcaacaatggcaaaagttgtcggaatggcgtcgcaatgggtggaggagaaaagaaagggacagcaaatgcaggaggaacagtgatcaaacgacctccgagcaaaagtgactgattatttacgaatcaatttaaaaattgaaattccagtgagcgattcaaatgatgtctcatcggacacaacgccagtccaattgtcacggcacagcgacgaagaggaggaggaggacgaagacgaagaagccgaaagagaca

SEQ ID NO: 84173 - DNA, 1809 bp, Heterodera glycines; identical to SEQ ID NO: 19452
  misc_feature (1802)..(1803): n is a, c, g, or t
  Genomic contig location: Contig_ID=SeqID_19452; Location=1..1809; Strand=+
  SCN-specific regions: Sequence locations=1-455,477-561,600-853,876 -1211,1278-1426,1448-1809
  Gene Ontology: Cellular component=membrane; Biological process=cell organization and biogenesis

SEQ ID NO: 84174 - DNA, 1123 bp, Heterodera glycines
  Genomic contig location: Contig_ID=SeqID_19454; Location=1115..2237; Strand=-
  SCN-specific regions: Sequence locations=1-59,82-131,161-559,610 -938,961-1049,1072-1079,1101-1123
atggaatttctgcagcgcagcggactgacaaaagcagcagccgaatcggtgaaaggggcggaggaggagaagaaaaagccgaattgtgatcagaaaaaggagcaaagtcgaaagaggaaagggtaatggaaagaaggaaaagccaaaattcattcaattaaatttaagagaattcagtgggcaattaacgcaggcgaaaacgatcaaaagggatacggacgaaccgacggaatgccaacggacagaaattaaaaaagcaaaagttgaagagccaacaacagcaaaaatgaacccaacggcacaattgccaaggccgaagccaatggtaaacgaagcgaagcaccaaccgaaatggcattgactttcagttgccctttggccctttcgaaccttcgccaaacggcgccccaccgaacgccttcttctgcaggccacaacagtcgaacttggttagacttgccctgatattatgtgtaacactttacttcttcagtctttttggccccctccgatggctttgatctcttcgcttatcggtcgaccccctcccaatcatctcccccctcctcttccccctcctcttccgtctcctctttcccctcctcttccgccgtcttcgctctcttcgcagcattttgtcgcaacttcgtccgcttcgtttcccgtgccctcttccaaaagtgccaatgttgcgccattgccaaaagtgcgccattctgttcagtctattttgggcgtctctcaaaaaggcaaaaacatttttatattcccgatttgttcgcttaattaatggcaattttccttttcagaaaacattggcaatatgtcttcaaccgtgccaaattcaaatgtgctcaaagaaaatgccaactttggaccaacaaatgtttttcggccatttcactcgaacactatctcctcttcgcccaaagcattcaaacctgtgcttcagcagcgacaaaatttcaacaatttttgatggtatgttgtgccaatgccattcatcattcgctgctgacctttgcccatttctcttcggattggcatcgctttcccttcccttccctccctatacattttcccttcctcccctccgctttttccgtccgttgagtgaaataaa

SEQ ID NO: 84175 - DNA, 1010 bp, Heterodera glycines
  Genomic contig location: Contig_ID=SeqID_19455; Location=94..1103; Strand=-
  SCN-specific regions: Sequence locations=1-90,114-1010
  Gene Ontology: Cellular component=cytoplasm; Biological process =negative regulation of cell growth
ccaccaacattccaatcactggggactcaatccaccaacattccaatcaacgggactcaacccaccaacattccaatcattgggactcaatccaccagcattccaatcactgggactcaatccaccagcatttcaatcactgggactcaatccttctacatttcaattactgggactcaatccaccaacattccaatcaacggggactcaatccaccagcatttcaatcactgggactcaatccaccaacatttcaatcactgggactcaacccaccaacatttcaatcactgggactcaacccaccagcatttcaatcaacgggactcaatccaccagcatttcaatcactgggactcaattcacctgcatttcaatcactgggactcaatccaccaacattccaatcaacgggactcaatccaccagcatttcaatcactgggactcaatccaccaacatttcaatcactgggactcaacccaccaacatttcaatcactgggactcaacccaccagcatttcaatcaacgggactcaatccaccagcattcaatcactgggactcaattcttctgcatttcaattactgggactcaatccaccaacatttcaatcactgggactcaacccaccaacatttcaatcactgggactcaacccaccaacattccaatcaacgggactcaatccaccagcatttcaatcactgggactcaatccaccaacatttcaatcactgggactcaacccaccaacatttcaatcactgggactcaacccaccaacattccaatcaacgggactcaatccaccagcatttcaatcactgggactcaatccaccaacatttcaatcactgggactcaacccaccaacatttcaatcactgggactcaacccaccagcatttcaatcaacgggactcaatccaccagcattcaatcactgggactcaattcttctgcatttcaattactgggactcaatccaccaacatttcaatcact

SEQ ID NO: 84176 - DNA, 1127 bp, Heterodera glycines
  Genomic contig location: Contig_ID=SeqID_19456; Location=130..1256; Strand=-
  SCN-specific regions: Sequence locations=1-249,271-1055,1077-1127
atgatacatcatccgaatgctgcttatccagacacggcgattatcacaaagcacaaagtgccatcgacagtctcatgttgaaaaaagaccgattttcagttcatctcggagcccatcgcaatgcaatttcagcgcgacatttccgacttccttttccatgaagaaaatttcttcaatcattcaattgttacttatggggtcggtggtagcattgaactcgaagatggacaacgagtaaacgtcttttcaatggtcagaaacagagaaaaatggcgccggactttcaaaatgcattagtaattgttaaagcaccttgattggaagtcttacggaccgtacgcagcaaacaacaaacaagtgaaaagcgagaagcagattatgagtggagaacggaataaagagggttacggtaggcaaattgaaacggtaaaaattaagtcaaaataatgttaaaataaactgaaaggtcgtgcgcaaaacatcgaacaactgcttgaaaacgacaaattcaaaaaattcaacgacctttccgaggaacaaccgttcatcgtcgcaggtgacttcaacagtccttcccatttggattggatcgaagaaacaaagtgaaactttccattaattcgtcccttaaattgaattcattccaagagaaaaccatggcggatggactttcgaatggcctgccaccaaattattgacggacaaaggatttgtggactcataccgttccgttaaccctgacttagtgaaaaacccaggtatttttaacaatccaagagtcggttttaaaatgaaaagaacaggagagacttggtcgacagtgcaaaaatcggctggtcccgaatgggactggacgattcccgaaccgcaggacagaatcgacttcattttcttcaagcctaacaaattctttcggcccatccgttctgagatttatgcaggcaaaaactcactacgcccaatccctgatcagtgggaaaacgattggccatccgatcactacgcggtgatcacagaatttgagataagcgaaaggaacggaactacgcaaaatgagagcaaacagagaaatgacattaatggcaaaattgtactgaatgggagatgttgtggaaacaatggaaaat

SEQ ID NO: 84177 - DNA, 671 bp, Heterodera glycines
  Genomic contig location: Contig_ID=SeqID_19457; Location=395..1065; Strand=-
  SCN-specific regions: Sequence locations=1-281,304-671
atggccgcgtctgaacgaatgatggacggggatgagaaatcggtcggggaaggacgaagtactgaccgggcgtgtcgcggaaataatgtgtggtaatttctcttacgccgcccttttctttttgttggcattggtacgctgaagcaaataaaaataatttcagcattgcttattgtcttaccaaacaaagggacaaaatgaaaataattggagtaaatcaattgccaaaaagtgagcgacgcctttagcaatctcggcccatccgcaaatgtacaacagcgctaaagggaaaagggcaaatgccaccgataatgaattgtttttgttttttggcacaaacttcgcaaattatctcacggattcttggcatttctccgccattcgtcgccatttgttcagccaaatccctctccaattcttggatcaattggtttagcattttcgcatttaaattcatcctccgattgtcaaactttttaagatctttctttggcataaaattgtctttgtcttcttcgatggtcacctaatcttttaattttagttcggttagcgaattcgacttttgtctaatatccaaaatggctttccgcccgacaaccactcaccaaatctttcattacattgcctttatgatgagctgtcaccaaatctataattatcataataaa

SEQ ID NO: 84178 - DNA, 208 bp, Heterodera glycines
  Genomic contig location: Contig_ID=SeqID_3313; Location=251..458; Strand=-
  SCN-specific regions: Sequence locations=1-82,104-208
atgccattggacacatttgctaaaccccaccataactcatacggatatcacaattatggcactttttatggccccatcgacgagaatgattcattcaatgtttttgtcgagctgtcaccgtctttgtttggcatcggcgacgtgatcggctgcggcatgaacttggaaacgcgacaaatcattttcacgctcaacggaaagcgtttga

SEQ ID NO: 84179 - DNA, 870 bp, Heterodera glycines
  Genomic contig location: Contig_ID=SeqID_3314; Location=1512..2381; Strand=-
  SCN-specific regions: Sequence locations=1-58,80-303,328-332,380-870
atgtcggccaatcataaagtacactactattacctttggcttgatcagtagggaagcaatttttagtgaaaaaacttttctttttttttgctcaattgttttgaagaaaggagctcaaaaaacgcatttctgcgttaaaattttttgattctgacactatttcgacattttttgaaaaatttgtcagcaaaaatgcaataaaaacggaaaatacaccaataaaaatcgactccaaaatttcagaaaaatatacccctaagaaacgactgaaaatttaaaaaaaaaatacactcctatgaaatgtaaaaattttctcaaaaatttttcccccgaatttttttttttgacaaaatttttaatttaaaaagttaaaatatttgctagaagaattttataagggaaatttacctcattggcaactgaactagtgaaaaaaaaatagttttgttcaatttttggctgaaaattatgtcacttattcgtcactattttggcatttttagcgtgccaccccaatccccgggacattgccatttaattcccaatcaaaatttttgccatttttacaggtacagccaagtttcgcttggtctgtccacccgcgattttccactaacccgtaaatggcttccaacttatggccaaacgtacgcatatgtgttcagaaaaaaactagctggtttttggggccacaatgttgagggaagtgtgccggatcagggcaatcgtcggatcgctgttgcaaatgcgtcattttacacgggcgacgtggtcggctgtggcgtcaatttggcaactcgccaaatcatttacacgctcaacggaaaacgtttgagtctgtctgtctaaccaatcggttaaatcaataaa

SEQ ID NO: 84180 - DNA, 296 bp, Heterodera glycines
  Genomic contig location: Contig_ID=SeqID_3317; Location=385..680; Strand=-
  SCN-specific regions: Sequence locations=1-98,255-296
cgacacttgcggcgacgacacttgcggcgccgacacttgcggcgacgacacttgcggcgccgacacttgcggcgacgacacttgcggcgccgacacttgcggcgacgacacttgcggcgccgacacttgcggcgccgacacttgcggcgacgacacttgcggcgccgacacttgcggcgccgacacttgcggcgacgacacttgcggcgccgacacttgcggcgccgacacttgcggcgacgacacttgcggcgcccagtcaaaaggacatttgcggcggcgcaaaattcaacgac

SEQ ID NO: 84181 - DNA, 507 bp, Heterodera glycines
  Genomic contig location: Contig_ID=SeqID_19463; Location=368..874; Strand=+
  SCN-specific regions: Sequence locations=1-63,109-347,383-507
atgcacttgcaagtcaaaagaagattcagcaggtgattttatgaattttgatataaataacacattaaaatataaattatttataattattaaataagataattatatgcttttgcaaattgcttcatttctccgcagattctcgcaaagcccgggatggtggaacgctttttcccgcacccaaatgaagcggacaaagtggcggcaattcgcaaaacattcaccggattgtatcgcgtccagacatttgcggacggacatttgcggacggacatttgcggacggacttttgcggacggacttttgcggacggacttttgcggacggacatttgcggaaggtttctgaattaaaaaaaattatttttttagaaaaaaaatttggaagagtgggcctcgtcagtatggtctcttccggttaaaaagcaactaattacgtgtgtttcggcccaaccgtagacacaataacttaaaaagcgcacaccaacaaacaaaaaaagcaaagcaa

SEQ ID NO: 84182 - DNA, 255 bp, Heterodera glycines
  Genomic contig location: Contig_ID=SeqID_19463; Location=2071..2325; Strand=+
  SCN-specific regions: Sequence locations=1-165,187-255
atgccattttttattttttccatttttcttttgtttaacggagggctagcaattaacacatctaaaaatcgcgctttaatatattttggagggtacgaatatcgtcaaaaggggacgagtgtcgatgggcaaacccaattttggcaatgtacacaaaagaattgtccaggaagagcacatggtcctatcggcactttggatattacacgtattgtgtctgaacataaccatccccaagtttcttctcagaatact

SEQ ID NO: 84183 - DNA, 802 bp, Heterodera glycines
  Genomic contig location: Contig_ID=SeqID_19464; Location=185..986; Strand=-
  SCN-specific regions: Sequence locations=1-28,51-168,201-371,394 -485,507-514,536-619,641-701,746-757
atgccgacaagctatcattcaagttataatattccaaaaatttattattttaagtaatttgcaagaatatatcttactcttcaattattttattcttaatgaattgttcggttattaatctttttatttttttgatgaatgaaataaggttttttgtaattttgaaacatttttaatatttttcaatataattaatatatcttctttagctctttttaaatttagacccctcggtgtctcacattttttctttaatatacagaatttaattatatatgctcgagcgatttatctcaattttaattccgttaaaaggtattaattatagactaattaacattaaaagaattgaatttgtctttgattaattcaaatatatttttattatttgaactgttcattcccattttattttaaaagatggattattaatgcatatcctctaaattatgttctcccaaaataatacataaatcacgagattaaatttatatttctctcctttcaaagttcaaatttttgttgttctaaataatatgaattaatcagttttattgcttatttcaatcgttaatcgttctagaccaatctacatatgatattaaatcgctttaaatgcatttcttttttaaaacaattctatattaattgttcgcttcttgcgtaagacattcttttatattcgtttctttatgcataagaatttattctttattaaaaaatatttatttattaaatataaattcaaattcaaacacacattcaagtaaaataccaaaaaatatgcaaacaaacaaataaa

SEQ ID NO: 84184 - DNA, 1083 bp, Heterodera glycines
  Genomic contig location: Contig_ID=SeqID_19466; Location=1375..2457; Strand=+
  SCN-specific regions: Sequence locations=1-663,705-1083
atgttagaacggttctacaatgacccaaaatcccctgctgcgtttgccggtgtcgaccgattgtggttggaagccaaaaaggaacttggaaataaaattcgtaaaaatgatgtaaaacattatctggaggggcatcgcacctacacattgatgaggccaagacgcataaattttccgcgcgctagaacaacggctgccggttttatgaccgactgtcaagtcgatttggctgactttcaaaccctttctcgacacaacaggggaaatcggtatttaatggtagtaattgatgttctttcgaagcggatttttgtgacacctcttcgtaccaagaaggctgatgacatggtagacggctttaaagaagtgttttcaacgatgccaatgaaaccacacagaattttctccgacaagggtacagaattcagaaatcagaagctgaaaaaactttttgatgaagaggaagttgagaaatatgagagcacacattctgagaagaaagcagcattagccgagcgcgcaatacgacaaatcaaaaatcgtgtgtatcgctactttgcccaaacaaaaactctcaattgggtggacgtaattgatcaaattgttaatggtattaataaatcaccgagccgggtgcatggaatgcgacctattgacgtgaactttaaaaattcacaacaaatatgggaaaaaatgtttggagatgatcagcatatggccctttttggaaagcccagaaaacgagccagatttgtccctggtcagacggtaagaatgagcatagcaaaaggtcaattcgagaaaggttatatacccaattacggcgacgaaattctcgaagttgatgccgtcaaacgccacatgaaaccaatgagatataagctacgtgattcaaagggggagaaatttaaaggatttttctacccggaagaattggcacccgtacgtaaggatgccgagacgacttacagaattgagagagtttttcggaaacggaaaatgcctgacgggacgacagaagtactcgtaaaatttattggataccctgaaagggaatggattcatgagacccaacttgtataa

SEQ ID NO: 84185 - DNA, 633 bp, Heterodera glycines
  Genomic contig location: Contig_ID=SeqID_19467; Location=702..1334; Strand=-
  SCN-specific regions: Sequence locations=1-143,165-301,323-381,403-589
atgaaaatttttaaattttctccgagggaagtaaaaaaacagagaatgcggctaaggtaagcaaatgaatggcatcgaaacgatcccttcggcgttagtccgtcggtgaatctatgaactctgatcagtgtgattgatcactccccatttccttttcattgtcagtcacttcagcaaagcacatccattgcctttgcacgcatttccacccaaattcatcagattaaacagctccgaaatgcaaaaattttccgtcattagtttcaccgaaaactgaaggtttggtgaatattgttatggtaccgttatctttataagaaagaattatcaaaacaatgctccaaaattgaaatcatttgcaaaatctatcattaacaaatcatttctttttcataattttttccagtggcatcatttggtgccaccgaatactctcagagcaacaattttacattaatatgcaaaaaaatggcttccacaatgatgcttttaaaaatttgtccatatttggtcattttacacatatttcatcgtttttgttcatataaatccagtccctatattaattatgacttttataattgttgaaattttaacttgaaaattttcattttttatttctttcataataaa

SEQ ID NO: 84186 - DNA, 921 bp, Heterodera glycines
  Genomic contig location: Contig_ID=SeqID_19467; Location=1478..2398; Strand=-
  SCN-specific regions: Sequence locations=1-53,75-127,149-346,415 -461,521-572,621-921
atggcctgtacctgtacaaaagtacaggaaaaatacaggttgccaaaaatttgcctgtacctgtacctggatccaggaaaaattcaggcctggatccaggtacaggtcgatctctaacaattagaaaacaattttaatttaattaattagttggagaaataattcttttaaattttgttgaattgtaacggttctgattaatttctaagaaagtatttaactttcacaatcagaattgaccacacccctccattttcccattttcatttgtctcttctcatcatcaacaacggtgggtggtatgaagaagtacggaaaagtacaagtgatcaaaggaaaagcaaagtaattatttaatttaaatttattaataatatattatttaaagtttaatttgctaatatatattatattggctacacaattaaaaattataaacagaaaaggtaaattaatatgacaaaaaaaatataaaaaaatctttcattcatttaaagaattcatttaaatattttttaatcgctacataagtaaaactttataatatgtaaccatatcaaaaaatcggtgagattttatttttatgtatttaaattaaataatttttaaataattattttgcttttacttcgatcacttgcactttcgtacttttgtctcagcacgatcaacaacatttggatagaaaagcgttgttctgtccgtcgttgtccttgttttcatccaccgaatttgaactttttggtgccggtggaatcagacaaccgctgatcatattgaagacggaagcaacgtgaaagtcttcacgaaagagacgaacggcacgctaaaagaaggcctctgatcagattatgaaactaatgtaatcttccgaaattcccacaattatatttattttatactaactcggctttaaataaa

SEQ ID NO: 84187 - DNA, 655 bp, Heterodera glycines
  Genomic contig location: Contig_ID=SeqID_19467; Location=2468..3122; Strand=-
  SCN-specific regions: Sequence locations=1-166,188-261,283-329,351 -505,527-583,607-655
atgatttatgcagccattgctataactgccatcaccgtcatttttggagttccgtttatgattttcattgcttgcgtggcctgtcgttcgtctagaaactcgaggagattggttgaatcgttggagcaaagggcgcagcagagacgcgaggcggaaagaatagatggaactgctgctttaagaaatgtattagaaatgcgagcatattcacggaagtattaattgtgaatgagaaaagacgcctcacatttctatttggatgcggaatttgaattttaaaattccaaaccaaggcgtagcacgattttttttcaaattttcaggattttctttgaaatgaaaatttgaaatcctttggtggcttgtattcatatttggacttttgcggtttaggccccccgaaaaaccataaaggggactcttttggctttcaatagagctcggtattttggaaaaagcctgtacctgtatttcccaattggcctgtacctgtattttttggaacttcttttaaaaatcaaacaaaggtttgaaaaaatcaattaattgcttaggaacatcttaaaatatctaatttactataattatgtctctttaaatatatttgatcatttttgaaaaattgaaaaaaacatcgatcacttgaaataataaa

SEQ ID NO: 84188 - DNA, 225 bp, Heterodera glycines
  Genomic contig location: Contig_ID=SeqID_19468; Location=427..651; Strand=-
  SCN-specific regions: Sequence locations=1-225
ttttaaaacttcgaaaattttcaaaatttttcgagctaggcctaaaaaacggtttttgggtttttgaattttaagaatttttaacgaattttcccgggaaaacgaagaccacttccaaaacatagtttttcgagctctatcgaatggtattttttttgaaaaaatttcgatttttttccggaaatagaaaaaatttttggcctaagcgggacatttgagtcccgg

SEQ ID NO: 84189 - DNA, 396 bp, Heterodera glycines
  Genomic contig location: Contig_ID=SeqID_19471; Location=1353..1748; Strand=-
  SCN-specific regions: Sequence locations=1-396
atgcaccaaagcgacacgggaagttcgactcctggagactctcctgtcgaccgaattgagatcactggtccaatgagtcttgccgaatttgtagaaacgatcgaggctgaattccccgaacaaattcttctcaaggttgtgactttttcatttatttataattctcattttaatatgaagttgtatgctgattttcgtggccataatttgaaaatgcctgtcgaagttgacgaaccggatgatccgcaattcgaccgtttcgatggtcaggggcatctgctgtaagctttgtttaggtgtctaatatgaagatttattgatttaagggtggaggacatcgtgtttgatatgatacacaaaacgaaaagggaccatcaccacgatatcccgtttaag

SEQ ID NO: 84190 - DNA, 285 bp, Heterodera glycines
  Genomic contig location: Contig_ID=SeqID_19471; Location=2156..2440; Strand=-
  SCN-specific regions: Sequence locations=1-78,100-285
tgaattattacacttattttggatttgtttcttcagttgagcctcccgttgatgtgctgctggcggagacggactgccaggccgaggtggccaagctggtcgaggaacggggcggtttggccgtgtccagcgaatgggtcattcaggttggttctttccattattttaagccatggttttcccggaaacacgaaaagccattccattttaaaggccatcgtcactggttcgctgcccgacctgggcgagcccggaggcgagaagttccgctacgattttgtttag

SEQ ID NO: 84191 - DNA, 1390 bp, Heterodera glycines
  Genomic contig location: Contig_ID=SeqID_3318; Location=424..1813; Strand=+
  SCN-specific regions: Sequence locations=1-186,208-362,408-695,720 -764,788-869,917-1009,1033-1153,1178-1193,1268-1390
atggttaagaattccagttttccctcggcggcacctatcggcactgcatgacaccttttctttcttaaaaacgctcaaaataacaaaattcgatattaagttgcaccaatttcaaaatttttcccgacggcgcctatcgccaccaccgccccctgttcccagaaagttttcggaaaagcgcgccgcaaaaaactaaccctttttattgattttttaataaggggttttgagggcaaattaaaggtctactaaagtcataaaaatttatttcaagcaaacaaattttcaattatgctagccactgttgcttgcctttgacttttggtcaatggtattgactctcttttcagatagtcaataagaattaatttaaatatttaatttatttaaattaaatttattttattggatttcccaatacttcaattatatttcacactttattagtgaattttgatcgaacaaatatatttattaatgaactattgaacgataaaaaaatggtgattttacaatggtttaaatacggcaattttacataggcgggctgacagaaatttaaatgtaaacaatgctgactaataaaaaggcttaaaatcacaaaggttatgaatttggcgtaaaattattttaaacagatgaatcataaaattttaaattttcgtcgctaaggatgaaattagcgacaaatggtttagaaaaatatttcaaacaaaaaatttctagatttgaattttttaatttccggtgggcgcgaaacaatacggggcggggagggagggcgaggaaacgaatgcatccattttgaaaatggtttggttttgttaagtaaaaaaagttttgaaaaattttcggaggaaatgttacactttaaaattattaaagaaataaaagaatcaaattattaaaaaaaaaactcaacaataattgggctctgaatttacagatttacaccttttaatgacaatttaagttggtcgtgtcttctttaaggtcgttaaacaagaccttttttgtttaaaattgaaaaaattacgtcatagattagggttaccaaacatgaaaaagcattgttacaacactaataaatttaggtaaagatttttattcccacaatcaaaaagtacagagttcaatttagtacaatagaaattgattgttttaaattaaaaaagatgaaagatatacaatacaataattactaatttaatattaaaaggaaaaataaattattaaaaggattaaaaataaattattaaaaaaaattcaggggattttggggcttcggatttgcacactttttgcttccatcatcttcaattcttaattaagctgatcaccaaattcggaagaattcacgagcactaaactcaattaaatatattaatta

SEQ ID NO: 84192 - DNA, 1329 bp, Heterodera glycines
  Genomic contig location: Contig_ID=SeqID_3319; Location=306..1634; Strand=-
  SCN-specific regions: Sequence locations=1-469,491-734,763-785,807 -924,960-1004,1083-1189,1226-1329
atggagctgatcagagagtttgatgaaatgaaaaaagaaaaaatttatggctttaattatgacggaagaaaaagagcaaaaattgaaaaggaaattatgcataatttggggattagtcgtagggaaataaaacaatggaaaaatgaatttggtaaaaataaatttaaaaagagaaaaaaaagaagattaaattttgttgattaaatgatacatgtttaaaaaataacgcaaaaaatataattttgtgctttaagaggtacacacctcagttgggccggcactttgggccccagcatgcttttcactataactttctataacttttttctttattatcaaaatccaacatttttggcatcattcgaatgcttaacatgtttagaagactttttctaagctattgcttcgcgattagacaattaccaaaaaagttatacatgaaaattgcgaaaaagtcgaaattttgggtttttcataataaaaattttttccaggcttgaaatcttttcgctttttgtaaggctaatagagcatgtgaagagctttcggatgacaccaagattattggatttggattacaaataaaaagctatagtggaaaaacacgttggggccgaactgtgagggccgaatcgtgacggccgaactgagcgagtccgcttttttcagttgctattccatgtgtggcgaatcgcaaaaaaattgtgacgacattttttgcaattgcttaagcgtaattattctttttaattaaaaatatttggaattttaagtacagtttgcccaaaaaataataataattttaagcgacgcacacaattcagcgagtgtggaccattggccaattcgttttgttattccgtccaatgggctggcaaaaaagcattcgacgcagcgcaggtagaaagaagcaaaatgcaaaacataaaatttaaatacattaacattttaatttaaatcgagcttctaattcatttttgtgcatcttaaagtggaaatgttggattttataaaattaaaatgattatttaaaattattatttaaaaatcaatacaaaatcactatatttattttaaaaaatgaaaggattcacatcttttaaaattactataatttgaaatgttttcaaaaaaatatattttttcgtattaattaatagggatgggaattagatgtaagaaaaatagcaaaaaaatatgtataaaaatatttaaaaaaatttttctgattttttggacaaaaattcctagaaagtacaataccaaatagggcaaaaatgccataaaaacggcataatactgttagaataatgtttaatacataataaa

SEQ ID NO: 84193 - DNA, 607 bp, Heterodera glycines
  Genomic contig location: Contig_ID=SeqID_3320; Location=114..720; Strand=-
  SCN-specific regions: Sequence locations=1-462,484-530,552-569
atggcatggtatatagagaattggtgtgatgagtcaaggtataccacgaatgtccgatgtggctgtatggaagataaaacatgcaatgttttaactgatttattactaaaacgaaaaaaattgctgaatgtttgggctttcgaattttgccactccatcaggcggacagagactttcttgtacaaacaatgggcacaggtatcaatgaattatgtccaaatgtaattctacaaaaaaaaaataccggattttttttttttaatttttcaatagataattgcatttggactgctcatcgcccaccgtcaactcgtcacattagtacgcatgaaaaaactgaacttggacgcgccagatttcaacacaattgtggtaaataataaaaaaaattctaaattttcaacaaaaaaaaacaactaaaaatttcagaatctaattgaatgtcataaaacgaatctcatgcaaggtgatcaccaagtcagttttggtcaaaacctcgcgataaattaactaccatgtatttctttaggtgccaatatgtctgccaaaaattaacctaaagttgagtgaattatttatttttttgtatgaaaaaatttaaattaaa

SEQ ID NO: 84194 - DNA, 225 bp, Heterodera glycines
  Genomic contig location: Contig_ID=SeqID_3320; Location=2570..2794; Strand=+
  SCN-specific regions: Sequence locations=1-107,130-225
tacggcgcccccacaaagtgtccaagccacgaaatgtccaaaagagtaaaaacccacgaaatgtccaaaatttttcaaaatttataaaaacaaaatgagtctaatttaggatttttagggtttcggggtcgctgaatacgaatataccctttatattaccccttgcctaaccttaggcccatctgaataataaaaaactcaaattcgagacttggacatttgtgg

SEQ ID NO: 84195 - DNA, 2190 bp, Heterodera glycines
  Genomic contig location: Contig_ID=SeqID_3320; Location=933..3122; Strand=-
  SCN-specific regions: Sequence locations=1-147,172-424,447-469,496 -1216,1238-1632,1655-1693,1715-1993,2023-2030,2085-2190
atgtgccacaaaattttgctgtttattttggttattagccttaacattggatacggaggcggatgggaattcctcgactctattggaagttttattgcaaatgtgagtggaaattgacgaaaagccaaaataacaccgttaaagtgcagaaaatggaaaaaatttttggcactaaatttttatttaagttggaattcaaattttcaaaccaatgaaaatgaaaaaaatttagacacataagccaaaaacagaatgccgaaaaccgaaaacatttatatgcaacctttttttctggcaaaatgaaattacagtagtagcgatcgctgacccacaaatgtccaagtctcgaatttgagttttttattattcagatgggcctaaggttaggcaaggggtaatataaagggtatattcgtattcagcgaccccgaaaccctaaaaatcctaaattagactcattttgtttttataaattttgaaaaattttggacatttcgtgggtttttactcttttggacatttcgtggcttggacactttgtgggggcgccgtagcgatagacaccgcctggaaaaagaagaaatttcaaacaaataaaactgatttttgttaaaatagttcgaaaagcaaaggtcaaataaatgaattgggtggcattaattagcaaatgacactaattagctgcaaattgcactaattagctgcaaattgcactaattaataacctgcgctaattagtttcaaatggaatggtacttctttgtagcgaatgacaatgacactaatttgctgcaaacatcactaattagtaacctgcgctaattagtgccaaaaggaactaattaattgtgaatgacactaattaatataaattgcactaattagtcgcaaatataattaatcaggtggcactaatttggtgcatgtctgtcctcgtttttgcagacagcaaaatcgatttgggacaatggccatgtggttgttgaaacgttggaaaaagtggtcaatgttgttgccgcaatgagcagcgttgtttatgtgcacacaatgcccctcggaatgatcatgcatttggtggaacaaattcagtacccgaacgctaccaatgagccatttgcttgcggtgcagccggtgccagtgaggtgagatcaattagcactaattgctcgagtcgccgaaaattttccgaaaaaacgcgagactttaccccgagaccgtgaccaagaactcgactcgagattcgatcagacttaagaccggggcatgacaaaactcaattccgagactcgagaccgagcttcgaccccgagacacgagaccgagaccaaaaaaaaaatccgagttttctcgagttgaaaaccgaccactagactcgtggcctaggctcgatcccgagacttaacaccgtgaggctagaggccaagacagataatttgacaccgggactcgaggccgggggctcggccccgagactgagactccgaaacttaattttgccttgctgcgttttaaagaaaaaagattgcaagcttcttcgcttctaaacttggtatggggtatgggcggaattaggggcaaacggaggaccttttttttgttgaaaattttactaaattttcttaaacaatcgcataaaatttccaaaaaattttaccgatgttaccctatctgtagtcattgcccgacctccattttaacaaattttgaaaatatgacaccaaaatggacgaattggtaaatctttgcgaaaaaaacggctaaaaattcctgtttttttttctcttcgacactaaaaattttgcaaaaattaatggcaaaaaattttttcgcgttccctcctcccaaaaaatttttctggttacgagcctgtacttgtctatgcaaaaattttttggcttttcttaaggtgatggcgaaagagctcgtcgcaaacagtttgggttgcctgcaaatgagaagcaagttgtttattggcaaaaatattaaatttaaattattattattattattattattattatctccatcctttaatataaatttgttttattttattttttctttattaataatttgtttatttcaaggcaattttcaaatttataaggacgttcctcaccgaattcccgagcttcccatctctgatccctaaattttttgggtcttctccccgctgggtcgtttcgtaa

SEQ ID NO: 84196 - DNA, 1246 bp, Heterodera glycines
  Genomic contig location: Contig_ID=SeqID_3320; Location=3685..4930; Strand=-
  SCN-specific regions: Sequence locations=1-6,33-133,155-199,221 -241,263-263,285-308,357-586,615-968,992-1008,1031-1127,1149-1246
atggttaaatttttatttttcaaaagaaaaagtttctcaaaattccatttgaaacttataaattttcgaccaaaattttttaattgaatttttgccaatcttatttaatgcggggtccaaagtttgttgctttttcagattaaatttggttttgaaaggcttgaaaaaggataattaatttttaaagccaattttactaaaaaataaaatcccaattttataaggaagacataattggtacataaaagaaaaagaaaacccgttaaatttgaactaaaaaatctaattcaaatccgaattccatgggctttaaaattgtaaaaataatattaaaaaaacaataaataaatatttttgatgccctccacagcactaaaaatgggcaagcctcggcacggaaaatgaaatgagtggcaaaatgaccccgcggggaacagagggcaatcaataagaaagccattcactcgcccccattagcaaatgagggtagccaagaagacgctcattaatggcaaatgataacttggacaattgatggacgggatggcattgtgccaaataaggaaggcattttcgggacgggtagaaaatttataaaaaatatatgtaaaaatggaaaaaatgtttagaaatataccaattgtttttatacagtaaacgatttctacaaaaaagtgatttttttgttttgttttatattttacattattttcataattgcatccataaacatttgttaaaacgacttaaaatggttcagcggtgggaacaaatcgttgctaattatgaaaatgtgccagcaaatgggattagagggatatgtttaagtgcaaatccctctattttgatcataatttgcgtcaaattttttgctgaatttgagcagcaagcagaaaattgtcgtcgatatctctgcaattttgtatcatttaagaaccaatgtcaaattgggtgatcagtgatctcaaaactcattttttgagaaattttaacctatgttaaattgaatttagccaatattttttaaattatttcagtcacgactaattgatagaaaaccgtctaactttcagcaaaaagataaatctgaataatcataatccttggtcacgagcccggtttttaaagttaatttctttatttttgaacgattggatttacacaaaatatttccgtgcgtttgcgccaactgtgaaattgttccattgcgaagcacaacgccaagaaaattaacgggacaaataaa

SEQ ID NO: 84197 - DNA, 886 bp, Heterodera glycines
  Genomic contig location: Contig_ID=SeqID_3320; Location=5069..5954; Strand=+
  SCN-specific regions: Sequence locations=1-16,38-772,794-886
atgtctgatcacacgcaagaagaagaaatgccaaaactgaagaaaaggtaaatgccgaattattagtgaggaataatttcttccatctctgaagatatgaaattttcttttgtaatacagtaagaatctgtcaaataccgtattactctcaatttgttttattaacagaatatcacttctcttaattgaaaatcatgactgaaaccaaaactttttaatgaattttaataagtttaaaaagtttaaaaaatgtatgtttgaaaaagtgacaaattttaagtttttaaatgcgcgaatcgcggaatttttaaatatttttgcttcacttttcgttccaaaaattcttccgccttttaccgtacctttttacagtacacatttgtttgtatttgccacctttttcaggtgctttctctgcaacgatgtgctgttcaatgtgttcactttggttagtaataagttcattcttggcacgcgattagctcttgtcaatggccaatttaatacgattgtggacaaattgttgttgcgtaaaagccgagaatggtcacttggcattttggaattgcgatgtgccgaacagcagcagggggaaggaaaagtgccacaaatttacaaggaattcgtttggaatttgatgaatcatatgccaccgtgtagagaatacgctcaaatcttgaaggaagtgccaattgcgacagtgccggtccatcaaagtgttaccggcttccaaggcctgacaattcggttggaaacacttgcatttttggctaaaatggatttgctaataaaacaatagaccacaaattggaaagtaccgggcccttggacattactgagcttggacaattggccgtgacggaccgaacgttgattaattataata

SEQ ID NO: 84198 - DNA, 1222 bp, Heterodera glycines
  Genomic contig location: Contig_ID=SeqID_19474; Location=488..1709; Strand=+
  SCN-specific regions: Sequence locations=1-78,101-287,379-553,575 -715,737-752,775-952,975-1009,1031-1182,1213-1222
gtgttgatgagtgtcccgattatggaatgaattcggctagtgacgacgaacgtcggcattttctgcgccgttattttgtccattttggccaaccaattggggaagagtgtgaaatggacaaaatgttgtgcaaaattcggcactttgaagcggtacattcataagcacaacaaaaatagtgtaactgttcattgtttttttccttttcgatatttcccatttactctaacggtctgatcattagctctctcgttgcattatactcactctaaccgtctgaccatgacctctcctccccctttccctctctctctctctcactgtctctctccgccttgtctctctctgtctccctctgtctgtctgtctctctatctcggtgtctatcgtttactttaacgtctgatcctgtactcttttcattaccaaacatctgatcatacattttctcattggcatacccatctaacgtctggccatgtactctctcgttgcattatattcactctaacgtctggcccttgtgttctctcatggcgccccctgttttttaattacttttaatgctttttctatcactttacaggcagcccattttttctggactctgtgggccatccatcaggcagcaaaatccgcgattcaatttgattacatgctttacgcgatcacacgccatcgttactgcactcagcttatgacctcattaggcattgctaaaaataattagcacaaaagcacaacattaattgatttttgggtaaatttttattgggtctgtccttaagaaaaaccaaattacgcatccttaatcggtcttaaaaagttttatatgtatatttttcacgttgtctatactttatcaactctcttaatctgcacttaaaaattataattgaccgtatctttctttatctgttcttcctgtgcttaaaaactgtttaattgctcctattatttatttattttttaaacctgtccttaaatgttgtttatttgcccttaaaaatgacattgatttgctcttacattgaccttttaatcaagctggaaaattaaaaatcacgacaaatttctgtaaaacaagacactcgaaaattttattttgaagttattgaacaaaaaaaaaaaaattcaaaaacccggccgtttgattacggtactaccgtatacccttcgctttatgggtgtttaaccttttttattttatcttaccatacaa

SEQ ID NO: 84199 - DNA, 867 bp, Heterodera glycines
  Genomic contig location: Contig_ID=SeqID_19475; Location=40..906; Strand=-
  SCN-specific regions: Sequence locations=1-839,863-867
cattcaatcactgggactcaactctccagcattcaatcactgggactcaacccaccaacattccaatcaacgggactcaactctccagcattcaatcactgggactcaactctccagcattcaatcactgggactcaactctccagcattcaatcactgggactcaacccaccaacattccaatcaacgggactcaactctccagcattcaatcactgggactcaacccaccaacattccaatcaacgggactcaaccctccagcatttcaatcactgggactcaactctccagcattcaatcactgggactcaactctccagcattcaatcactgggactcaacccaccaacattccaatcaacgggactcaactctccagcattcaatcactgggactcaacccaccaacattccaatcaacgggactcaactctccagcatttcaatcactgggactcaaccctccagcattcaatcactgggactcaactctccagcattcaatcactgggactcaacccaccaacattccaatcaacgggactcaactctccagcatttcaatcactgggactcaacccaccaacattccaatcaacgggactcaaccctccagcattcaatcactgggactcaactctccagcattcaatcactgggactcaaccctccaacattccaatcactgggactcaacccaccagcatttcaatcaatgggactcaacccaccaacattccaatcaacaggactcaaccctccagcattcaatcactgggactcaacccaccagcattccaatcccactatttcaccgggactcaatgggactcaacccaccagcattccaatcactggcactaa

SEQ ID NO: 84200 - DNA, 659 bp, Heterodera glycines
  Genomic contig location: Contig_ID=SeqID_19478; Location=329..987; Strand=+
  SCN-specific regions: Sequence locations=1-56,116-188,303-369,440 -485,507-659
aaattaggtagataattaaatgtacttcaaatttttaaatagttaatcccttcaagaaataattaattaaattaaatttatttttaaaaattaagaaaattgatttcctttattccttcctttttttaatttcaatttaaattccctcggggaaaaacggactcaaatttaaattgtgatgccgctggaatttattattaaaatgagtagattatattaaatttaactttaaataattttcaaacatttaatccttataagaaaagaattcattaattttaaattttttaattaaaaatatagtgtcctttattccttttcaatatttcaattccccgagggattgaatttaattggcaaaatgaaatgccaaaagggttttttaaatttattcattcaagaaattaaagctgagaaattaattttaaaaaagttttttgccctcacaatttttaaataattcagagaacttaagatcgattttcaaattttttaaaaatttatttgaaatacaaaaatcccttattgctcggactaatctttgaattgataatctaatgaattatgaataaaaaaacaatatttctattccattcataagagtgactctctctctttttttttattattttggcgttgtgttacgctgaaaatccgtc

SEQ ID NO: 84201 - DNA, 324 bp, Heterodera glycines
  Genomic contig location: Contig_ID=SeqID_19480; Location=754..1077; Strand=+
  SCN-specific regions: Sequence locations=1-257,282-324
atggcgtcggatggccaagcgttggccaaatggctgttcactgcccatccggacaatgtgccaaaggttttcgaatgctcgtggggcaggaataataaggacgacggggattggccgttcaaaattgctgacttcaaagcggtaaacttatcattaattaatgatgtcactcaacgaaatttcgtcactttctttaatcgtgcgaggatttttaagggcgaaaataaggacgaaaagctttcaaatttaggggtatacttttttaaattgttctttttattatgaaaataatttcagattaaggcaggcaattttattcactga

SEQ ID NO: 84202 - DNA, 1502 bp, Heterodera glycines
  Genomic contig location: Contig_ID=SeqID_19481; Location=636..2137; Strand=+
  SCN-specific regions: Sequence locations=1-10,32-638,682-754,788 -957,979-1138,1224-1261,1284-1301,1323-1347,1375-1379,1402-1502
atgagcatttcggtgggtggggggtgccattggtttcagggcggcggttggcggtgccgttggcacaccgcgacggcagagccgaagcggcggaggtgcgggcattgcatacggcggacgccggtgccgcattacaattggaactttgcggcggcggtgccgacttcaacaaccgggactcggcactgggcagcgatgtgagtaatttcattttttgtgccgttttttgttttgttttggaaattgagtgtttctggcggtgccgagggcatccacaggaaaatttttgaaaatttcttactcaatttgtctgatgtgctctcactcacaatcagcacttgtggtcaacaaaatatatcattcattttttacttttttaatttcgtcaaaaaaattattcatttttcagaacccaaccagcagaagtggcaccatccgttgtcggcatctccaaattgacccggacaccggacgatgtcggacatgctcataccggtgagcagaatgaacagagggtcatctggggaacagtacgtccccccctcccgaaatttttttttcaaacagtaatttaaggaaaattaaagaaaaggcatcttgaaaatatcagcgatttcttctttcaaaactttatgatgaatttaattttttttttttaattttctaaaatattaaaattttcctattgatttattgtttttccaactttgttagaaacaaatttctctgatctttttcaaaagaaaaacatttgataatttgatttaaataaataaaaataatatttctctccgttccagcccaacaagttcaacccgtacagcaacagcaactgccactctgatggactcgggtcgtccggtggcggtggtggcctcaacgcgtgcgctccaacctcattctgttcgttttgaggtaggtgtttatgtatgtggtggttggtgctgcacaccaatgttttaattttaaaaaattaatccattttcatggaaaattttcaatgattttttaaattttttttggcggattgttggtgggcgattttcatcatttcccagccgaaatgaaaaataatattttgagtcaattggcgtcgaccgtttttcttcccttttttgcatttgccttttcatttgcttttatttgtccattttttacatattttttatcatttcgtttattttcatatatatttatttgtttattcattctttcatttgtttgtcttaaacagatgggttcatcaacaaattgtgctgataaaatcattttttgtcatttacccctcctccgtcgaatgatttctctttaattgaatcaaaatttacaaatatatatacctaatcctattttattttccttattatttgcactctctctccccaaaatgctttataaaaatcccttttcattcaattttaggtaattagggtaaaagccggggggatcgccgccagtcaaacggtgataaaaaaaatcacaatttcaccgataaaatttta

SEQ ID NO: 84203 - DNA, 775 bp, Heterodera glycines
  Genomic contig location: Contig_ID=SeqID_19482; Location=651..1425; Strand=-
  SCN-specific regions: Sequence locations=1-56,78-775
aaagttcgtcgacaatgaatattcctccgaaatcgttcaatttggctccgattgctgagcaggaagggtgtgatctcgaccagtccgtgtcctcgtcgtctttcactaatcatcaacagattgggcaagcgcgaagaccccatcccaggggtatgccaaggatgattcggctgagacggaagcggcgggatgatcctttcggcacgctaattcaatcgaccaagaaaatgcgacttaacgaccagtggaattcttcggaggggcaagcctctggcgtagaagggactacgacaattgcgaaaaactttgcaatgattggggagagagcgccgagtggaagccataacattagcaaaatggatggtgtgctgttcacggaagacgaggaagacgaattgttgttttattatggcggacaggacgaggaggacgactcagacgcggacggatacgacgacgaatcggactcaaacgcggaagaatactacaaaaatgactacccggacgaagagaacggcaaatttatcagtttcgcggacggagtgcgcaccaacgaatatgaaaacgactcgacaagtggggacgacaatttcggtgagtttaatattcaaatagtagagagatgaatgatttacaaacagatcattacggtgacgaagcaacaaaatatggccatttttgttacgaggacgacaaagaggaagacgaagacccgttcagtttcggcaaaatgatttcggcacaaaagaagggcagcgaggacgacagtgattga

SEQ ID NO: 84204 - DNA, 182 bp, Heterodera glycines
  Genomic contig location: Contig_ID=SeqID_19482; Location=1524..1705; Strand=+
  SCN-specific regions: Sequence locations=1-108,130-182
tagtctatcatcaatttatattgtcaaaaagaacatagataataatcgccggtttgccgtgtcaacatcgttcgatgtgttcttttgtcccgtctcttcgctctctcagatcactgctgctgacactgcacgtgctgtgccccgcccggccccgtcggcacttcgtcgtcgctgctgtcgtc

SEQ ID NO: 84205 - DNA, 429 bp, Heterodera glycines
  Genomic contig location: Contig_ID=SeqID_19483; Location=100..528; Strand=-
  SCN-specific regions: Sequence locations=1-429
  Gene Ontology: Mol. function=Hsp70/Hsc70 protein regulator activity; Cellular component=cytosol; Biological process=G1 phase of mitotic cell cycle
gcgctggtaatcatgaagatcttttcgaaatgctcaatgggggcggcatgccctcctttatgggcggcggaggcgggttgttccagcaaatgtttagcgggggaaggcagcggtcgcgcaagggggagacgacggttcagcctttacaagtttcgttggaagacctgtacaaagggaagaatacaaaattgcaattgacgaagaaagtgctgtgcaaaacgtgcaacgggtgagagggcgggcgaaatgcggattattcatttaaatccataaaatgtggtgctaaatttttcagaattggtggaaaacaaggctcggttcggaaatgtgaccgttgtcagggaagcggaaaggtctttcgcacgcgtcagattgggcctggaatgatccaacagatggcggcgcgatgtgatcaatgctcgggtgaag

SEQ ID NO: 84206 - DNA, 1287 bp, Heterodera glycines
  Genomic contig location: Contig_ID=SeqID_3321; Location=83..1369; Strand=-
  SCN-specific regions: Sequence locations=1-861,893-1051,1074-1287
atggtcggattcgtttccggcacttccaatacagcagacattgcctctcgaggagcaaaagcaacggaattgttggacaacaatctatggcaatttgggccaaattggctaactctcaaagaagaggaatggccaatggatcaaataatatttgatccggaagtcgaacgacacacagtcatcgacgaactgccaataatggaaatgacactgccaacgatggagcatccaccgcaaaaggcactcatcgatgaaaatcgcttctcgtctttcatcaaacttaaaaggactatggcattagtccttcgcttccttcagccgagaaaagcggagcccaaaaagggcaatttgaaggaaaaattggaagcaattccgccaacaactgctgaagaattgctaaaagcagagcaaattttaatcaaaaatgctcaacaacggcacccagccgatcctcaactggtacaaaatttacaattgtacgaggacgaaaggggaattttgagaagcaaaggaagaattcaaaaaggggacatcgcagaaaccgccaaggacccaatcttcctgccatgcaaagctgaattaacggccctcctcatccggcatattcacgacaaactccatgccggcgccaacaatgttttgtccgaaataaggcaaaacttttgggtctctcaggcccgacggaccatcagacatgtccttcaaaacggaaggagccgacacttttgtcacacctgccataagttcaaaacaaaaccattcggtcaggtgacaatgcctcctcttccccaatttcgcgttgatggacacacaagtcgaccatttctcaacattggccttgactacttcggtccaatgcttacaaaaagcaatggaaaaaagatgaaagtatggggatgcatcttcacttgcgccgtcactcgtggcattcacatcgaactggtgaatgacctgacagcagaagccttccttaacgcactatcacgattctgtgccaggaggaaggtccccaaattgattgtctccgacaacgctaagactttcaaactcggctcaaaagcggcacaacaaatttgtcagacaccgaatgccgcgcagctcttcaatcagccaacagtacaaaaatcagtggcagacaaaggaatcaaatggagattcaacattgaaagagcaccatggaccggaggattcttcgaaaaaatggttcatttggtcaaggagcccttacgcaaaacgttgggcaaaaaattggtcgactacgaacaattgatgacgactctcatcgaa

SEQ ID NO: 84207 - DNA, 360 bp, Heterodera glycines
  Genomic contig location: Contig_ID=SeqID_3322; Location=6537..6896; Strand=+
  SCN-specific regions: Sequence locations=1-226,248-330,354-360
atgaatggacaacgaaaagataatcaaacggagaatgagcttgtatgtaatttactttgggtccccgtcattaaatcttaaatcgacacattttgtaccactccgatgggggggggcggttctcagttaattaaaagataaaaatccaaatgataaaaaagtgagaggggtgaaaaactatttaaaaaaagaaattttaaaattcagaaggaatccgtggcaagggtggaaaaaatggaagaatttgcaaacaaattcaatttcgacgaataattacaattatttatttgcggacagttaattaattttgcaaaacataaatgaaatttcatttcaatttataatgaatagttccgctga

SEQ ID NO: 84208 - DNA, 2792 bp, Heterodera glycines
  Genomic contig location: Contig_ID=SeqID_3322; Location=510..3301; Strand=-
  SCN-specific regions: Sequence locations=1-1608,1630-2792
atggctcgccttttgaagacccgacttcaaactgcgactgatcagctggaggagctgttgtcgcacgaccaccccgccgcaactcaacaaatgaatatcggcgaactcaccctgcgcattcatctcatagatgatgacctggacaaaatcagcaaagtggtcgccgaaataaaaagcataagcgcagaatggactcaaatcatcagcaaaataccacaaaaagaccaagacgcggccatcaacgactacgacaaccatgttgcgcttcttcaagttgcggacaaagtgaaaagctccggaacacgcgcaagacaattcaaaacaagccaaatcagcttggcgtcggcaaaggcgacattggaagctgcgcaactccagcaacaaaacgcggggggagcgccggccgctcaagcagccggagcacaaacaacagggcgcgtccaataccaagtggaaatcgccaaaataagaccacagattttctctggtggcaaatgcgaatggcaatcttggtggccggtatacaatttggcaatacacacggatccatcaaagccaaagtttctgaaaatggctgacttgatgtctttgcttaagggcgaagcaaaagacatcgtttatgggctgcaactgaccgacgccgactacgacttggcaatcaaagcattggccgagaagtacgacgacaacagccacatgattcgcgagttgcatcgacaactcatctcgctgaaagcgagtcagtcattcgaggacgacagaaagttgctcatcgacgtgcaacgcatcactcgaatgctgaaaaacaacgcgcaagacataaatgcgccaacaatttggctgaccttggaacaaaaggtcacaaaaccagttttgcgccaactgcaagaagcaaaggcaaaagctggagtggactgggacacggaaaagttcctctcatcattcaaggatctcgtcatcgccgaagaagcaattgaagagatctacaaccaatctcaccaaagaagggaaattggcaaaaaacccagaatggtcgaaaaaacaccattcaaaaagttccaaacaacaatacagacaacggtggagcaaaaagcaaaaattgctccaaaaaatgggacttttgggcaacaaaagaagggagtcaagaagccacaacgcgatgacaaagcaaaggcaaccccttcttgccgtctctgcagccaaagccattggacgtcaggctgtagctgtttcagggatgccaaatccagagaggaaaaggcaaaggagctaaaattgtgcctcaaatgccttggcatcaaccactcatcaaatgagtgtacagcaaaaatcagaaattgctggtactgcaacaaatgggggcacaaccgagtgttctgtccacaacaatttggggtgaggaagcaatttcctcccacggtgcaacatgcatcaatccagcagttcaacgcaaccgcaaaggaaaacaacagcagtacaaaacgaacggcatcagagatgtatacaacccggaaaacccaaaactttccaaaaaagttttggtattcttcgacagcggatctgaacgctcctacgtcgaaaaggcactggcctcatttctcaaactggaagccaaaaatccagcagagataaccctgaccgggtttgcaggtgtcgacttaggcacctacaccatgcacatgacaaaattgtgcatgaaaacagcgatgggagagaaaacaatcgagccggagataacgactcgggtgctgcgtgagatggctcacgtcgaattcgccgatctgtacgactctgattttgaagcaacgcaactgcaacgccaaacagagtcactgcagccactggtcctaattggcactgactactttgccgattttgacatcaaaacagagaagcgactcccatcaggcttttgggttggcaactcaaaagtgggcagattaattttcggcaaaggaaacctttcaaagccaaagatggcgaaaaaggtcacttcaaccgccatctctcaagaggcagtggaagtgcagcttcaaaacgacgacgacggactgaattcaatggtcaaacagttctttgacctcgaagctgctggtatggccgatgctgcccatccaaccgaaaatgagcaatggttggaccatttcaataaggagctccacttcaacatggaagagaaacgctacgaagtcgcgcttccatggaacaacagggctgaagagctacagcccaattatggattggcacgaggaagactggacaacaatttgaaaaagctggacaaagaaaagttccaactttacgatcagatcatccaagagcaactcagcaaaggcattgtggaaatggtgccggatcctaaggcatggactggcaaactgcactatttaccgcaccaagcggtaataaaggatgatcatcaaacgacaaagttaaggatcgtctacgatgggtctgcccacaccaaggacactccctcactcaaccaatgcctcgacaaaggaccacagttgctgaacgatctgatcggcatcgtcatgcggtgccgcatgtccgaaattttgatttgcgcggacatcgaaaaagcgtttttgcaaatcctaataaaagaagaggactgtgatgcactacgctttttgtgggtcaacactgacgggcaagtcaggacctaccgcttccgtcgcgtgccatttggactgataagcagccccgcgcacttatcagtaacgctcaagccctcggccaaacggatcatccaatggccaaggacatcgcgcaaaacttgtatgtag

SEQ ID NO: 84209 - DNA, 539 bp, Heterodera glycines
  Genomic contig location: Contig_ID=SeqID_3323; Location=168..706; Strand=-
  SCN-specific regions: Sequence locations=1-7,51-539
atggttcctttattttctatttttatttcattattattgtcacattttggcattgctgcacctataattggaattcgggaaagtattttcgatgcaaatgtaatttattcatatttcataccgagtagaactaataccgatcgctattgcattcaaaaccatttgactaaaaaataattttttcaaaaatgtgcactaaaataattaaaatttggacaattaagttccaactaggcgcatcagcgccgagaacgctggtgtcgcgcctagttggacggaccatccggcgccggcacagtttcactctgtcctgaatttaaatgcgaacgaactaattttaatttcctaatttttaataaatttagctgaatgctgaatatgttatgctcataaacaccaactctggctcagattcagctgtatacaaactcagctcaacagaagcacaacaattaccgcattttacaaggaatgaagaaagcaattttcaaaatgcatatccgatgactaattttatgattggcattatgtttggttga

SEQ ID NO: 84210 - DNA, 726 bp, Heterodera glycines
  Genomic contig location: Contig_ID=SeqID_19488; Location=2086..2811; Strand=+
  SCN-specific regions: Sequence locations=1-93,117-127,176-316,437 -500,522-726
atgtccggtggacaaaacgcaccgaaatcagtgcagggcatgccgactgagaaagtgtttggagattggcatgaacaaagacggtgagaaaagtgggggaaaattgggggaattttgattaacggacaaaaaatttatatttattttttaaaatgaattaataaacatttaaaatgggttttggtcctttagtaaaatgaggaaaataaatcataaattgagcaagaaaatttaatttacttatccttaattgttgaactatttttgtacaattagaaattctctataaattataataatttcccaactaacatgtgccccgttggcttagtggcagagcgtctgtctagtaaacagaagatcgctggttcgattccagcacggggcattcaattattttttgaattttaaattaattaaatttgttttttaatttcgcagcgtttcctttttatatttttaatctgtttttagctttttccatttttttaatattcccttctttcttgtcattttcttcttcgcttcagctgttcaacacgaacgtggcccccgcacttcgacgcttcgccgtcagttggcgttcggactcagccagcagttggcccaacgtcaccaccagcggatgttggccaattctgcggccgtcaaaaaatcgctgcgtcttccgccgccgacgacggcaatggcacattcctcacggcacaaaggccgtcctcgtgccgg

SEQ ID NO: 84211 - DNA, 673 bp, Heterodera glycines
  Genomic contig location: Contig_ID=SeqID_19489; Location=29..701; Strand=+
  SCN-specific regions: Sequence locations=1-437,459-574,596-646,668-673
atgtatggagtattctgccgaagggacgcaggaatgcgaactggtgtactgtcactacgtaagagaggaggactttgtgcggatgagcaaagagctcaatatcaccagcttataaggagagtgaatggtgtggaaaagcctataatgaaatgcaatgccaacataaagaaaataatggcaacataatgccaaaatagttttttataagattgatagtggaaaatcgccatccttcgctacaatgtctgataccgaggagacaaagtacgaaatgcgcaagaacgaggcgctatcggtgccattctctactcagacccagcggaagtggcacgagacggaatagagccgggtagaatgagccgaattcattcattcactccttaatactttctatcccttccccccagggcacactttcccttccgccgtttggatggtatgccaatgccaatgccaatttgatttggttctcacttgtccttttcagccaattggcggtgttcagcgcggctcactgaaggaattgaacggcgatccgttgactccgttgctgcccgcccgtgccgatttcttcaaagaacgcactttggaagaggtgatcccacccaatcaatcactgatcaatcgatcaatgcctttccataacattcattctcaaattctcaacttctaa

SEQ ID NO: 84212 - DNA, 93 bp, Heterodera glycines
  misc_feature (51)..(51): n is a, c, g, or t
  Genomic contig location: Contig_ID=SeqID_19493; Location=1409..1501; Strand=+
  SCN-specific regions: Sequence locations=1-93
atgcctgcaaatatatttcgaggtgccgaccctatggaagtgtttgataanattatcacaaatgaggccccgccaaaggcacgagttggacat

SEQ ID NO: 84213 - DNA, 2265 bp, Heterodera glycines
  Genomic contig location: Contig_ID=SeqID_19494; Location=16..2280; Strand=+
  SCN-specific regions: Sequence locations=1-266,306-347,374-378,426 -509,531-593,615-657,708-1122,1186-1242,1277-1305,1337-1503,1525 -1555,1595-1683,1706-1750,1787-1909,1948-2025,2047-2265
caatttttccaaatctgagcacttcggaggaaatgagtgttctgattgccagaattgctgagctgaatcgagtgaacacaattgaaccatcaatcgcaagcagatcggatgtgttagggcaagacagaaacggtaggaaatatttaatttttctggatactgtaataatccaaaaaattctaagtcaatgatgatgggacgaccagcttttctaacggtaacaacagaacaacaacaatcggcggtgagaaagttttattttttcgtttaattttttttaataataatttgttaaaagttaatttctgaagttcaattaaatgcaatttgaggagaatcattgcttcataaattataataattttttttaaaagacaagatgatctaataatgaaattacgtaaaatttatttatttttaattttcagacagaagaaaaatgacgaaattgttcatgttgacggtagtgaacattacggtaacagtggcactgatcggcttcattgcggtggtttaaatttagaataattccttcttcaaatatacgttatattcaataaagaatcggactgagaatgcacgaatcaccgcattggaggaacagcaaaagaaagatgaaaattttgttgacgttttgaaagaccgatttggaaagggtaaaaatgaaaatttaatttataaattttaatattttaatttatttttttgcagagcttttaaaagctgtgcatccggacattcgcaagaaaattgctgaggtggaaaagaacaaataggtttaaaaaataaataaaacgaaaatcagtttagaacttttcgaacccaaaacacaacttttgggatgtcaataccagtcacactgatctcgaaatctttggctcgggatctctgaaagtgcattacaaaggcgatggaagcggtaagtggattgatttctgattaagtactaaggatgtgtgcaattaaggttttccggaactaaaaaatctcccgaattacgagcgggttacggattttcgcaatttatttttgtccattgagctggtttggcaaaactctttatttggaataagttttttgggcttttactgaattatatttaaaaaaatacaatgtggaatgaattttatttatttattttttaatacaaataatttttagtaataaatattttatagaaaataacattaaggtcgtcgctctgtcttcgctaaacacccaattttgttctctgaatccggcattttttattttgaaatcaaaattaaaaactgcaaaaggtagcactaccatatgaaacatatgaaaatggttgatttttattttcaaattcagtctttgctcaattggactcgccaccaaagcgatgccattggacggaagtgttggccaaaattcggacagttgcgcatatcaaagcgatggccaattttgggccaatgggtcaacgaattttggaatgccaaacttttctcaaggcgatttcgtcggttgtggcattaatttggccactcgtcgggtcattttcacaaagaatggccaacctttgagttgcttattttattttaaattatttatatttcaattattttaagatacttctgatttattcctttcgccttcttttgattttccattgtttccgttcatttctttaaacaattctggcgatttgattgagacaaattttggaccaaaattcaaattcgaccccgcaaaagtccagcagcaggtgaaaatgagagaacagaataattataaattatttatttaaagtaaattttaagttaattctcaaatttccacgacaaaattattgggatgtcaatgcttgtaatgagaatctccaaatcattggcaacaaaagtctgaccgtccattttcacaaaaatatttctggtattttcactaaaaataatttataaattctattttttcttaaaaaaaggtttttattccgtcttcgctaaacattctattttgttgaacaaggatttgtccaaatatttttactacgaaatttcggtcaaaaatatgaaaaagtaagagatttatttttattttttttgaatatcaaatttagctgaacttatgaaagtagattatttaatttttcatttttcagttggatcaccttcggatttgccgttaaacagcagtcaaaatttgaatcaataattcaaaatggcacttatgcgtatcaaagtagaggctatttatggattaacggagaagaaaagagaataatttcccaatattcgtacg

SEQ ID NO: 84214 - DNA, 1091 bp, Heterodera glycines
  Genomic contig location: Contig_ID=SeqID_19497; Location=539..1629; Strand=-
  SCN-specific regions: Sequence locations=1-124,146-316,338-462,511 -1091
atggaagcggaagacgatgaaagcgacgacaacgacgcggaaaacaactacatgctcggctacgatgaggagggagagaaaccgcgctctgtgacgacctatgcatacgcacacgcaggtaaataaattttaacaaaaataaaaggaaaatttatcgatttttaagggtcacgttacgatcacgtgctgatctacggcgagatgctgcgcatgggtgtgcgtcccgaactcgtgcgccaggggaatcacctgctggagatgaaggcccgcaagagaggagcaatcactaccaccatcttccgggacaggtaaaaagtgtaaaataacataaataatcgattatttttcagttacaaactgatccccatcaagctggcctcctttgtgaagacgttcggcttggaaatcgagggagtggacaacaaaaagtacttcccacacaagttcaacaaggtaaaatttaaaaaaaaaaaaaaatcaataaataaataaaatcaaaaaaaaaaaaaattaaggcggcaaattatggtgttgtgctggacactcttccgccgcttgaggactactaccctggcgggcacttccctgaggagcgcaagaagttggagcagtggtacgaggagaaccgcaacacgccctttgacctccgtgaggtcattgcggactactgtaaagcaggtaaaaatcgggaaaatcttgaaaaaaatatgcaattttcttcagatgtccaaattctcgcccatggaatggtcaaaatgcgggagttgttcgccgctgcaacgagccaggagctgaccgactccatcaccatcccgtccgcctgcatgaagttcttcgtggtcttgtcgcacgtcggcaaagagagggtggccatcatcccccaccttggctacgagaagcgtgggaagcagagtgccatcgcacgaaaatacctcaagtggcgtgccgaggaagagatgcgcgacaacggatggactcttcgccatgtggaaagccctggcggcgagtacaaacatggcaacttcctcttggacggcatgctcgagaggatcggcgaggacaagaatttggccatcgaagtgaacgggtaa

SEQ ID NO: 84215 - DNA, 236 bp, Heterodera glycines
  Genomic contig location: Contig_ID=SeqID_19497; Location=1799..2034; Strand=-
  SCN-specific regions: Sequence locations=1-53,75-236
atgcactacggacttcaagccggaccccgaactcctgcgcttcagacatcaggtaaataaaacacaaaatatacgaaaattaggtatttctttcaggtgaacttctgctacgcgcacgtcacttgcacggaatgcattgcaaagggcatctgggaccagccactggaccggagctgcggaatctgtggaatgacgagaaccttcgcataggcgccgttcgagttctacgatactga

SEQ ID NO: 84216 - DNA, 1565 bp, Heterodera glycines
  Genomic contig location: Contig_ID=SeqID_19499; Location=848..2412; Strand=+
  SCN-specific regions: Sequence locations=1-3,25-799,830-1093,1116 -1214,1237-1565
atgcaaacattgaccaccgccagctgttcgtcatcgtttgctgctgaccaggcgtgccaattgttggccaagggcaccgcactgacacccgacgaattcattgcccttttgaagacagtgactgcggacgatgtgaaaaaggtgaacccaattttccaattggatttcattacaaccgctaaatttgtagcactacgtcccccccccccgagaatgtataaaaaaaactttgatttttttcttgaaaaatttctatgttagtaaaaaaatttaaaaatttctcggggaaaacgatgcgggggaggaaacgagctgctcccctaaaaaatagggttcaattttccatttgaatttttcaaatttcatcttttaaggctgcttcccaactttgcgccaaattgtccatgtcagcgtacggaaaagtggaccaagtgccttacctggaccagctttaaatgtgacggacgaaaattttaatgagtgattgaaaagggtcgcgccgaaagagaggcatatatataaaaataggaattgcattcttctgctaatatgtagtgtttcatttttttgtgtgtgttcccgattctttgttatgtgcagtaaaatctgaattaagcgaattgttttcattttcacggttttttttcgcgtattttaaacaattttttttcttattttccgattgtttgttttttaagcaattaacaaaactttttgcatttgtaatgttggttggacgtgagccggaattcatcaaattggagtcgttgctgagctcggcactcggtgcccgcgctgattgtgacgctgctgctgctgctgatgatgagccaaaaccgttggccgtttacatttgcggaccgccggggaccggcaaaacggccacagttggggcggtggtcaaaaaattggagagcgcacacaaggtgaggttttgttggacattatactgcacttgcttttgtgcatttcaaagatttaatatgactcttgcagttcactcgaccgtaaaaaagacactataatttgacaattttaagcgtaatttcaaagaatctatgtttcaaaaaaagagccaaaaatgttcggaaaccattttttctaagttttcttgtcctaacttttttttgaaacagttaaattctttggaattttgcaggcttgagctcttggagctatccaaatgatgcaatgaattctagaaaaagttttatagtgaaaattgtctaattttttattttatagccgtgtaaattgcaataaactttatcacaacgacgtattttgattagaaaatggcaccgtttctgcattttttgccaatttgaattacaaaattacagtttgagtttcaaaaacaattttgagtggcgaaaaatacggacacaattccttgaaatttaagtttcacttcgtttctgtcaactgctactccacacagtcatcgtccagtttggcaaaggaagtgctctccaaattgggccacaacgacgtgacggcgaacagagcgaatcggaaactgggcgaagtgttcgacagcaccaaaaagccaatgtataattcaa

SEQ ID NO: 84217 - DNA, 1505 bp, Heterodera glycines
  Genomic contig location: Contig_ID=SeqID_19500; Location=1234..2738; Strand=-
  SCN-specific regions: Sequence locations=1-743,767-795,817-886,912 -993,1020-1435,1457-1505
atgttagaagggtcagggaaccccacattggtcccagtcatcgaacgactagaaaagttagaaaagttggtggaatggctaattgcgggcgagaatcggtatgggaatcgatttgctgacccccagcatatctcatcctcaccatcggcacacacttccaacaacggcactcaactccaatggggtcaaccgccgcccttcgctgggaatggcgccgtttcacggatgataaccgatgcaatcatcaactccgagcagcttaaggagaaggccaaccgagcagtcattgaaaaattgccggaggcaatcgacgaacgggcgctggtggagcaaattgccgatgaatgcggtgtcaaggacaaactgtcgccggacattcatcgccacccaaggacgcggactgatggaggggtaaaaagggaccgaattttaaaagtgccatttacggacaaatattcgcgcgataaattcatttataatttccgtaatgctgtgaaaaaattgcccaatgtgccccaacacatcaaagttcgcagagatatgactcaaagcgagctcaaaatattatactccctccggcaacaagcctatcaggccaatattgccgcaggtgagtataagtattttgtggttgacttggagatcagatctctgagagagtcccgcccactcagaactcgctagggacacgcgagcaaaccaaacaaaaaaattggaaaaatggtagaaaataatccctggatttcttgccttttaataaatgcccgatcaatagcaaataaaatatctgacttagaatacatagtcaaaaaatatgaccccactataattctgatcaatgagacctggttaaactccagaaatacggtagaagcggaacttacgataaatggccaatatcaaattgtttttgcaaaccgaactgaaaaaaagggcggaggatcggcaattctattaaaaaccttgatcccttatcagacacttttctctgggacaaaattccaaagtgaaattatacacattaaattacttttaaaaaaaccaacacaaattataaatatatatcgtccaccaaattgtaacgttcagaatactaaaaagctactcaaattcatttcggaccaaagcgattctgaaaataccatattctggtggtgattttaatatcccaaatatattatgggatgaaaataaagtaaaaaaaataaatgataaggcgtctaattctctaattgagtttatgcaccaaagacaattgatacagcatgttaaggaaccaaccagagaaaaagcaattttagatttagtaattactagtgaattagaattaattaatgaattgacagttctagaaaatttttcaacttccgatcacaaaatggtcggattaaaataaaagtaaaattcagtcgtaataattctaatgtttatagagattttaaaaatataaatttttcgaaattaagtcaagcgttacttgaaaatcgaattgatttatcaataaa

SEQ ID NO: 84218 - DNA, 434 bp, Heterodera glycines
  Genomic contig location: Contig_ID=SeqID_19500; Location=2947..3380; Strand=+
  SCN-specific regions: Sequence locations=1-27,90-197,232-434
atgggcgaacagaatgacagtgagtgcaaaataataatgaataaaataaattcaaaattttaagaatgttctaaaataaatatattatagaaaatcgaaaaagtaaccaaagacagggtcattttttgacaaattatgttaacaaatcgcattaaaaattacaaattttcccgacggcgcctatcggcaccgccggcccccctttcttcccccaaaagtcttggaaaaaacgcgccgcgaaaaaagcggtgttgaaagcaaaaaaaaaaaaaaaggttaatcaatttacatggcggacccagacccccttgtcttgcaaaaaatctgaattttagtgttctttatcctgaatttgaaaaagaaggctggtcaacctgtacatatacttctgaaaaattctaatgctaaaaaacaagcactcgcgtgaaaattga

SEQ ID NO: 84219 - DNA, 693 bp, Heterodera glycines
  Genomic contig location: Contig_ID=SeqID_19501; Location=2..694; Strand=+
  SCN-specific regions: Sequence locations=1-110,283-452,474-693
  Gene Ontology: Mol. function=ornithine-oxo-acid aminotransferase activity; Cellular component=mitochondrial matrix; Biological process=ornithine metabolism
atggacgagttgcagaaatgcccaaaacagaaagtgaagagtgcgcgagggaagggactgttgtgtgccattgaattggacaacggtaagtcggaaaaagaaaggacaacagagagagagaagagtaagagagcgagagagagaaagagaagaggggcagacagacagacagagagagggcgagaaagggaagggggaaggaagagagagtaagcggagagagaggatagaagagagagagagagaacggagaggaaaggataaagagggagagagagagagcatgtctgtgtgcatttttcaaaattaccctgacgaagaatcagtattccgggaaacctctgacagaatccggtcattttctgggctctacaaaaaaataaaatgtggaaaatttgaggcattgacgcttggcaaatgtgccttcgtctaatggacaacggagtattggcaaaacaaacgcacgaacacacaattcgatttgctccgccattggttggttggattgaaaaccaaaaattaataatattccatcataattttaattatttttcaggtaattaatgaaaaggacacacgaacagtggccaaaatcatcggacggacattaaatgcattcgattgattgtgaaaattgtgacactaatacatatccaccagggatgtgccgagccagacaaaatccgattccga

SEQ ID NO: 84220 - DNA, 365 bp, Heterodera glycines
  Genomic contig location: Contig_ID=SeqID_19501; Location=2401..2765; Strand=+
  SCN-specific regions: Sequence locations=1-33,59-79,186-365
atggaaatcggcggctctctcgaagatgaacctatgaggaggagaaggagaagaagagggcaacaacaacaacaacaaaataataacgatgacgaagacgatgatgatgataatgatggtaacgaggagggagacgacgatcacggtcatgatgctgataatgaggaagaagaagaagttggaacaaatcggtcggtcagactttgctttttcgacgctgaaacgtcccaagatttaccacttcaactgcgtacaaaggttgtacagaaacatgttccgatgctcattattgccgaaattatctgcgaagcgtgtataaatgaaggaatttcggttcattctggtgttggacaatacgcaaatgg

SEQ ID NO: 84221 - DNA, 700 bp, Heterodera glycines
  Genomic contig location: Contig_ID=SeqID_3324; Location=92..791; Strand=-
  SCN-specific regions: Sequence locations=1-432,491-573,605-700
atgtatcggcagtaccgtatattttgcccaattacagtatgcttgttccctcgttttgagagtggataccgtaagattggaaatagaccaattcaaacaatttattacattttaagcaatagctaagcagttgaacaattcacaaaaactcgaaaatcgggccaattttgttcgtttttttgtccgaacttttttttggcgagttgtataatagcttagcaattggcttacaaattaatatcagcttctaattgttgaaatgcttcaaatgattctaaggttttgaaaattggtcaagtaggaaaggtgttatggtgccccaaaaaaagttggttggtgccgaattttcagtgcaaattttctccaattttcctgtgccaatttttcatattatgtgttatattggaattgtgccaaatacatatttcaatgattatttaaatttaaagttttaaattttattttagaaattttaaaagattttattttagttgcccattcgccaccaaaattatgctgttttcccgcgattctttccatgtgcaccaatcgttccgtgtcaatgaattgttgtcttcttcgtcctcttcctcagcttcttccatcactcacaaatccggcacaatttttgatcaagcccagcaaattgccaatgccattcagagacagcaaaaacaacagcaaagaattgcgcatttaa

SEQ ID NO: 84222 - DNA, 1164 bp, Heterodera glycines
  Genomic contig location: Contig_ID=SeqID_3325; Location=684..1847; Strand=-
  SCN-specific regions: Sequence locations=1-8,79-324,358-365,401 -483,528-539,580-893,923-1164
atggctcggttggtgaatgatgctgatttgctgatgatgatgatgataatggttggtggtatgtataatgatgatgattaattcaacaagtttgtacggaaatgaaaaactggggatcggattatttataaagataatgcgatttttaataccctacttcgatttcttgaaaaatttttttactaatttctaatgacttacattttaccatgaatacctcttattgttaggcatgaattttcacaaattttcaaaaattttgcggttacaatttcaaaaggatttaaatgtttgccttttggcattttgtttgaaatggccggaggcacaaaaaatttgttcttttaaattgttttacacatcagaattttttaaaaacttagaaattatttcctttttcaatttttttagatgttaagcaccaaagatgaaaatttgcttgacgaaaatcaaaaaagcacaaaaattcaacgattacgaaagtaataaaaaatataattaacaaaaaaatttttatttaatttttagctttgaaattcggccaattcttccttcttcacttcacacagaacacattgaactcactgaagcggttgtgcttaacgttacaaacaaaagttgagtttagtttctcgaacagtgcaattttttgcataaaaatgctttaatggacggttaattgagtcaatttttgttgaaatttttgtgccaaatttttcatgatttttttgaaattttctgaaaagttttgtttctgtaattatttctttttgcatgtttatcaaatattaaatgttcaaaaaaaattaatatgcaaaagaaaaattgcatgcagtaaggtggaattgaaccctgacgcccaaaaacagaaattttaccgactaagccaccgattttaaccaaaaatttttaaattttcaattgctttagcttcttctctacactgttgcgcattttgcccccattgccggcccaatttgagcatttgaagcgcgtcaatggcaccgaattgttggtcagtgttagccaaaatggcgacgacggcacaattggcaccgccgaacggacggcgattggccaactgattggcggggagccaacattcatcggacggcacattccatgccgaaagcctcagagtcggcaccagttggagatgtacag

SEQ ID NO: 84223 - DNA, 621 bp, Heterodera glycines
  Genomic contig location: Contig_ID=SeqID_3326; Location=808..1428; Strand=-
  SCN-specific regions: Sequence locations=1-358,380-399,437-621
atggcaaaaatcttgtcattttttgcgcaagaccggtacaaattcctagcttttcccggttttggtttatttggaggatcaagattatcataaacgatttaaataaatttgtaatgctaattgtaagcatatgaccagggcccggatttttaggttttcacctttttttttttgcggatagcatatggtgagataaacgcaaaaaacacattttcttcgatcaattttcgatttcgagtgactttttagcaactatttaggtacctatttcggggtttttagcgcctaaaaatccgggccctgcaatgaccattcaaatacatcgataaaatagaatcactgagtgatttttctgtattttttcatgtttaataaacatttaaacaagtttcaatttagaattaaataatttttgttaaaattttaaaaaattttagaaatggagactgggggattatttttcaacctcctcagaaaggggggggggtaattggagactgcgggattaatagagactgggcgataattagagaatatacggtatataagagagactgttctaatcaggagagagtgctagagaaaaattggcgtactatttttcttggcaatgtgtactaa

SEQ ID NO: 84224 - DNA, 383 bp, Heterodera glycines
  Genomic contig location: Contig_ID=SeqID_3326; Location=2396..2778; Strand=+
  SCN-specific regions: Sequence locations=1-160,183-383
atgacactgagccccaacttgaaatatgccacacacatcatctttttcatctcgtggattttgtttgtcgaaatcctttacggcgtaatcccgtttcttgacaatgcaaaaagtgccgtggcattttccatcgacgaatcattcagcccaattgaaaggtgattggaaaaacaaatttattagctccaattgaaattttggcttattgcagttttcacgggactagctggtttcggagcgagcccaagtttttggttacaagttttttcttggccaaccaaatccaacaatcttggtatcattcgatagccctaagtgtcctctattagtatgcaaaattgcgaaaaatttcgttaaggttcaaaaaagttacggccagaaga

SEQ ID NO: 84225 - DNA, 1898 bp, Heterodera glycines
  Genomic contig location: Contig_ID=SeqID_3327; Location=670..2567; Strand=+
  SCN-specific regions: Sequence locations=1-677,712-898,920-1000,1030 -1129,1153-1177,1200-1289,1311-1359,1381-1462,1484-1486,1533 -1647,1688-1693,1715-1765,1787-1798,1829-1898
gtatggcgttgtgaacacatttctactttacgtactccgtttcctgtctttgctagtacgttttgcgcaacattttttgctgtttggcattttgcggttttggctttttaccctaactggacaaatttttcattttttttttcaaatttttctggggttggatgccttatttagcccagaaaaaaatttacaggaataatttctgttcattatgagcgggtggctcccaaatgtttttggctatttttaaaatttttccggtacgccctgacgccttttatctcaggtttttttagaaatttttaaaattatcattaggcctatgaattgttttttcaaaattttcacgggctgctttcctctccccccgggtcccaaacccgtaaaatttgtgccatttttctctctttttaaattattttttcaatttttgccccccttttttgcccaggtgcttccccagtgcatttgcaactcgttgggtctgattttgttcaacagtttcaaggaccgcatcaagctgaagaccacgccgttgttggcgccgttcatttgcttccgcgtggtcaccaagggcgactacccggacctggtcaaggtcttcgcattatccagcaaaattttacaaaaatttgtcgggaaaataggcacatcttaaatttggggaaaaatcgttgaaaaacaaaatggaattttacaaataaatttaaaatgagtcggtgggctggacaaatgtgcgccgccatgggccaaattttttttttttttttggctataatttcttttaatttgtccgaattgaaccatttttggtattatttgatcgcccatatattctcctaaacggctttttattgtcaaaatcgaaaagttttttttttgaaaaaaaattttcattcgaaaaatgtttattgttagcaaaattagaaaaagcaaaaatgcattctattttttgagccaattattcaaacaacagaatgagtgcttaagctatcaggaaaatttttcaaaaatatattttttactgaaacattctaattgtaagtttgaaaacttaaacagaaaaatgaagttcatccccctccaccctctccaacaacggttttcaatttttcaacccctctctcgcaaaaaaaaaaatttaaaaattttctaattcagcccctcccctcatccatcacacacacaaaaaagattttgtgtttttttttgcaggtaaacctggagaagaacttgcaaatgtgctacgaggcgggcctggagagcttcatcttcgaggtggtcacggacaaggccatccatttgccccactgcagcaaccgcgtgcgcgaaattgtcgtcccccacgcgtacaagtgggttttgttgttggttgtttgggttggtggacttcctcacaatcaatcccccccccccccccccctccgagaattttttttttaatttctaaaaattacctagaaattttttaagaaaaaaccttaggaaattttttataagaaaatttcaagaaaaattttttttttttttttcgacgattttttcaaacttttatgatgagttactaagttttccttaaaaactttcctaagattcgctgaaaacaattaaaaaaaaatgttttcttaacaaatttctaggttagagaaatttattaaaaattattaatttaacttaaaaattttttgatttggaagaaaaatgggttggttttgaaaaacgaccaaaaaaaaagactaaaaaagcgtgtatttcgcccataatataaaatttggaacacaattttaaatggtcgctgaaaaattttcaaaaaaatatatttttttttcttgaatcccctaataaaattttcgagaggaacataggcagtggcatttatttttttttttttgttatta

SEQ ID NO: 84226 - DNA, 694 bp, Heterodera glycines
  Genomic contig location: Contig_ID=SeqID_19502; Location=13..706; Strand=-
  SCN-specific regions: Sequence locations=1-244,291-315,337-638,660-694
atgcttctacttcagacaaatgggtaataataaattatgaaattactttactaattgctgctaattatgccattttcagttggcgtgcccgcgagcgtgcaattgaattggccgactcggacgaatcgatcgaattgcagaacattggccaacggaaaacggacattcgaacaccgacagaacgaatgtctgctcttcgtcaaatgatgtaaaaagggatgggaatggcatggacaaaatggccataataatgaaaaatgattatttaaaaatctattaaaaataaaaatgatttagcgaacgcggcttttccgattggaatgcttacaaacagaagcatggcaagtcataaggaattggaaaataaacgagataaaaattaagggaaagcatacgcggaccaagaagtggagaacgaacggatgctgacttatttgaggttagctgaaaatactaaattaatttgaaattgaaatacccaatatttatagcgccaaacagttcattgacaagcacaacgaggcgtacaaagagggcaaagtggtccttccgagtgggagagactcatattgccgacctggtcagaaatcccgaactgttgttcgaatttccccctctgtttcagcccttttccgaataccaaaagctgaacggattccgtcgtttgatgggcgacagtttgcgccgcaatgcg

SEQ ID NO: 84227 - DNA, 132 bp, Heterodera glycines
  Genomic contig location: Contig_ID=SeqID_19503; Location=130..261; Strand=-
  SCN-specific regions: Sequence locations=1-132
atgattaattgtaaatcgtcactttctttgctttgcattttgcgcgactaccagcagcagcagaattattttcattcagcgttaagcgatccgactactgtagagactctcgggactgtagtcagtactacg

SEQ ID NO: 84228 - DNA, 345 bp, Heterodera glycines
  misc_feature (22)..(22): n is a, c, g, or t
  Genomic contig location: Contig_ID=SeqID_19503; Location=1..345; Strand=+
  SCN-specific regions: Sequence locations=1-312,340-345
ggcccttttcccgaatttggcnccaattattcctcgccatatttcactcgcaccgccacttattccttcccgaatcattaccattggcaaaacgaccgtttctacagtgccttctttcgcgcgtcttaccgtagtactgactacagtcccgagagtctctacagtagtcggatcgcttaacgctgaatgaaaataattctgctgctgctggtagtcgcgcaaaatgcaaagcaaagaaagtgacgatttacaattaatcatttttactgaaatgataaaacaattcactaacatgatatacgaattgtgtaggttttttgaatgtttaaaaaataaacacattta

SEQ ID NO: 84229 - DNA, 353 bp, Heterodera glycines
  Genomic contig location: Contig_ID=SeqID_19504; Location=1561..1913; Strand=+
  SCN-specific regions: Sequence locations=1-353
atggccgatgtttttgccaattggtacttttggatttttaaggttcgcttttcattttttgggtcatcgaaaacctttcttgttttcccatggaattccaattaccaaatgttttttagcatttgcctttgccttatctgatcagagtgatggactgttttctcgtggaaggtgactaatttcgcttaattattaacacattgcaattttaaaagacaacaatttttactttggtcagatggaaggattttttatgaatttcgtgggatttattcctcataaaattcggggaatgctttgatgtgccttcgcttctcaaaatttttactaaattttcacccaaaaatgaatca

SEQ ID NO: 84230 - DNA, 1126 bp, Heterodera glycines
  Genomic contig location: Contig_ID=SeqID_19505; Location=1134..2259; Strand=-
  SCN-specific regions: Sequence locations=1-631,655-798,820-1126
ttggatttgcaacgacgtttggatggacattttcccatcctttgaccgtcctcaacttggcctcaaattggcacttctttcgccacgtttcaatgcgttggtggacaaacatttcaatggcaaaagcgaattgacaatttggagatcaatcgaaattcgtcgcaaggacaaaggaccagaaccgaaactatctgtgtggttggatgacaaatttgtgccatttccattgcccgaccgtccgttgcccagcaaaatccgttttaagaatcttcagattgagtaattcggaatcagagatttatggcaataaaagcattcatcccatttttaggtacattgatcactccgtcatcgcttttcttcgttcaaatcaccaaattttcgacaaaagaggcaccaatttacatttgtggattccatcatcacactctacgaatggccagccgattttggacattttttgtcgtgaaatttggcccattttttcgacaaacattcgctgtttgggctttaccaatggtgttgatttggacaatttgcgtcgtctcatttcaccgacaattctcaccgatctcaaccaattgaattcaatcaattccggtgatttgtcgcccgctgcgtttggtggtgattttgatgggccaaatgcaacaatttctgctggccaagcattgtccaaatggttgcactctccgagaaacgatggacaacccaagcgattgcgttgcgataattactacgaacaaacgaacactgattggatcaacaatttcaaggaggtgtggcccaacattttcaacaaatcactgatttttgattgcctatatttttgttttcaaattgtttagcattttctccgtgccaatgccatttcttccgtcagttaccaaattcatttttcttttcgcgtgccgtcaatgcaaatggtgccgtttgaattggtgaacgaatggacaaaggaaaagctgacattgaccaaagaaaacgaaaatgacttggagaattggataatgaagcgatgcaaaattggagaggccgcggatgttcagcttcagaaagatgaaaattggggcaacaattggaacactgtgatcatttggcttgatagtgacactaattgcattgg

SEQ ID NO: 84231 - DNA, 1072 bp, Heterodera glycines
  Genomic contig location: Contig_ID=SeqID_19506; Location=469..1540; Strand=+
  SCN-specific regions: Sequence locations=1-110,141-145,167-414,451 -740,762-1040,1062-1072
atgtctgacgattttaatcggctgatgtcgtcaaattccattcacaacatcacacaagagacggacacttgtgacattgagccgtggattgaagactgggtcagttttggaaaatttaaattctttttaaattttaaaatcagagtttttcaagcaatttgtcagatttttttaatgaaaaaagcatgggattaaattggataaaaataaaaaaattacaaatgtatcaactaaagcaatgctcacttttgttgtaataaagataatgtcgtgggaattgctcagccagcccaatacgctaaacccacagaataagaagcggagaacacaacaattcttgaaattttaattggctaatcaaaaaatgcctgaaatactcccgttgaaatggatgcattttggctcaaaatttccaaaaatttataaataaaaaacaaaattattttaattcttcatatctttcgatagtactaaatattctctattatcctgccaaaatacaaaaaaatctcgttaattttccaaaaactaatgacaaacaatgttagaaaaacctgcatttttgagttcctctggccataacttttttttggaagctaacggaatttttttgaaaatttgctggctaatagtgaattcttagagctatccaatatcaattgcaaatttgctgctttttattccctatttaggcattaatttggattaaaaaaaatcatccatttttagcatgaaactccaaaggcacgttcccacacgacgccgtcggaattttaccaatgcatgagcaacaacagcacaagaattgaacttgtatgcccaacatttgaatttggcgctgcttttttcaatttggcattttgtattatcccccaaggaaaagccgaagcagcagcagaaaagcaccagcggaggcggcacttctctgctgtttcgccgaatgtcctcaaatgacattgatgacagccactttttgtgagattttaaatctcgctcgaaactgatcggggcttaattatgtagttaattatacacgattagcatttcaattttctttaaaaaattccacaaa

SEQ ID NO: 84232 - DNA, 2138 bp, Heterodera glycines
  Genomic contig location: Contig_ID=SeqID_19507; Location=506..2643; Strand=+
  SCN-specific regions: Sequence locations=1-14,36-174,207-394,416 -604,626-729,751-1045,1067-1117,1139-1508,1544-1777,1803-2138
atgggcacggaacatgacgatgacgatggtgaaaaaggggtgcaacaattgttggaacagttcgtcgccgagggcgccgtccaattgggccaattcacgctgaagagtggccaactgtcgccaatttacgtggacctgcgtgtgctcgtctcggtgccgaaaattatggcatggatttttttaaaattttttactattttaaaattgttttgctaatacggcgtgaaaacactaaaaaaaattttaggattttaatcacataaatcacatatagtcaatcaaatcgtgtccaaaaatggggtccgaattctccggctcttcgcccctctgctgggacccaacccaacctccacctgcatattcaagaaaattcacatttgctgttgtttctcgcattttcattttgttgaatttcagtaaataattttagggaaaatttcgatttttatcccaaatttctgttggatttttaatttacctaaacaaaatgcatataaaaaatcactcttctcactcaacagaaagaagctgctcgctgtctgtgctcggccattgaactcgctcagctcgactttgattacgtggttggcgtcccgtttggggccattatgttggccacagtgagttgctttctgacccctcggaaaatatgaaattttcaattcaaaaattagggacgattttccgtaaattggaggcccaatttttgttagaatttgctgaactcgaaaatttttaatttattgtccaaatatatctcaaaaatcgacattttaggataaattaacactcataaaattctccaccattttttagttggtctccgcctcgttggacaagccgatgttgttgaagcgcaaggaggccaagacgtacggcaaaaagcagttgatcgaaggccgtttcgaggcgggccaaaggttcgaacggcggcgacggtgcccaaattaggctagcaaaaaatttttaaaccggatttcatatttttacaaagttttcacgcttattcccctcccacctgaccgtccgtcatccctggcctcggagttgaattagttttttaaatgctcaaaataaaaaaacttcccacccttttcggtttgaaagggtaattaggaaatttttaagaaaaaatttgtttgaaaattttacagcgatttctatgcaaatttttgagaaaaactattttgaaaaaggcgctttaaaaaaattgtaggttgaaattttctcataaatttctaaggtttttctagatttgcaaaaaaaaaaatagaaatttttccggggggggggagggacatggtgacgcacccaatttaggcagttttccaaaaattccagcgcactgatcatcgaggacgtggtcacctccggtgccagcgtgttggagacggtggccgccctccgtgcggttgggctgcgctgtgtgcacgtcttttgcgtgttggaccgccagcagggcggtgagcagcgactgggccgggaggcggacattgttttacggaggtgggggccaaaggggagggggttttctaaaaatttacacaattttttcatgttttttttaatatttgggagggttcgccaatcctgaagaacgggtgtccctaatttttaacttttttttaaatcttgggctcaaaaccagtttttagggggtttcgaggctgctgattacgtatcttaactctgatttgcccaattccgaaccccggaccttaattcgaacaaaaaaatgagtttttttcaagaatggattttttgaggtaaaagcttctaaaaaaatatttatttttttatttctttcaatttgttttcctttttttgtaagcatttgccgttttgtgactcggtttcctttatatatgaatttttaattatcaaaatttctcttttaaacaaatttttccgggtttggacaaaattttttccatttttcaaattaaattgaatattttttcagtttgctttccatgggttcgctgttggactttttggagcagtgcgggaccattgacgcgggcaaaaagacgcaaattgttcaccaacttcaaaacccgatctttgacgacagcgccacgcatttgcaggagcaaaaaacggagaaaaatgaaggtcaaacggaaatgtttttttaa

SEQ ID NO: 84233 - DNA, 989 bp, Heterodera glycines
  Genomic contig location: Contig_ID=SeqID_19509; Location=571..1559; Strand=-
  SCN-specific regions: Sequence locations=1-458,480-650,672-960,983-989
atggaaattgtcgatgccaattcgaagcgtttgccaatccctcagattccgttgcccaacaaagtcatcggattcaaacggattacgttctcgtaagaatggcgatacattgaaatattttgatcactttttcttatttcagttacttcgaccacaatgtgctcacatttctcggccgttttcaccgctttttcgcttcatctccaacatatttgacaattgtcactgaaaatgttcgcattttggcgttcgttctgtccaccaattggccactgctccgcaattgcattcgtctgctttatttgccgaacttcgcttttcgccgaatgcgtcaattggcacccgccattctcaatgattatccatcgcttcgttttgtcatgttcagtggcgatgacattctgcccgaatttccgcccgatgacagtgccatggcgacggatggtcaagcggtggtcaaatggctgttttcgtctcgtccggacggtgtgccgaaggtgctaaagtacaacgtgaatttatcagcgaatgaatggtcgtcaagaattgaacaattcaaagcggtgactgatgaaatttttaaccatgtgcaattcttttttgtgactttttggcccatttttaggcattttccattgcttcttctcgtgttggcttctccattttctttcaatgttcgccgttaacgccatttttgatgaccaacgaattgactggggagcaattggcattgtcaaaatgtagtagtgagcaacgctttgtgctcacccgttgtccaattgcgcagaatgagagagagaaacaatggaaggaattgcttatggatgaccagtggaaccaaatttacattggcattggagaccacggaatcgacaatgggtgaacaaaaaatgattccgatttaaatcgtttcattttttttgttttagtcttctcgacgcttcccctgggccgagtggtcagcagcagaaatgaatgaattaattaaa

SEQ ID NO: 84234 - DNA, 2451 bp, Heterodera glycines
  Genomic contig location: Contig_ID=SeqID_19510; Location=1..2451; Strand=+
  SCN-specific regions: Sequence locations=1-52,74-420,442-695,734 -912,944-957,979-980,1002-1021,1070-1222,1244-1247,1270-1579,1629 -1751,1773-1842,1872-2003,2067-2178,2200-2270,2398-2451
atttttaaagctaacaataagcatatctcaattatccgatggcaaaggaaattaaatttctataaaaatttaacaggagttaatttattagaaaatccatcaaaaaataatcggcttctcctcgacctattcaaacagctgacagtttgccaagttctttttaaaggaggcactgaagcaagagcccagctgtgaggttgaacccgcagaaaaggacgacgtggcatgcattttgtacacaagcggaaccacgggaagaccaaaaggtacaaatattctttaggttttttctagagtagaccgggatctggtactgaaagacgggacaactgagttcctaagtcccggtttttcaacccgaaaaggtcccggtccaggttttgcccaaaattcctggtcccgctctactctagttttttctaatgcaaaaatcccagaatttttcttattcagtaaaaaaaaattacgtattttttcaaaagatgtccaaaaaattcctagagaaaaaatgttatctaaaaataaatctaaaaaaactataaacattgccaatatgtgcaaaatccaattatacaaaaaaattccaaattttaacaattgaaaaggtgccatggtcactcacggcggtttggtggccaatgccgagacgtgcactgacatttggcacttcagcgaaaatgagtgaacagaatgccaaaattttatttaataaattaaattattttaaaaaatacagtattaatttgcacgttttgcccttctaccacatccacggcctgttcatcagcttcaactgcacgctaatgtccaagtcgagttgcattttcttgcccaaattcgacgtggacgaaacaattgcgtatttgcccaaatcgaccgcgatgatgggcgtgccgacattttacgcgtcggatttttttaaaatttttttttagtattttttctagacacatttagaaaaaagtaaatgctttttcatcatttttaaaaatttcccaaaacttgcggtttatctcccgtgtaaaaaatttttcgagggacaattggttaattttttgattggtttttgcccatttttagtcggatggtcgaacacgcgggactgaatcgggccgcggtgaaaaacatgcgcgtgttcatcagcggctccgcgcaactaacgccccaagtgtttgagaaattcgagacgatgaccggcatgcgcattttggaacgctatgggtgaatttactaaaattttaaaataatgcgtgtgcttaatttatacatatgacagaatgacggaaacattggtgtccacatcgaacccgtacgagccgattaatgccagaacttcgggctcagttggccaaccagtgaagggggttcaggtaaatgttgacaaaagcagaaaaaatgacaattttcaatttaatttcaaatttaaaggcccgaataaacgtggacggagtcattgaggtgaaaagtccgagtctgttcaacgggtatctgaacctgccggagaagaccaagcaggaattcacagcggacggcttcttcatcaccggcgacatgggcgaaattgaccaaaacggtgaagtttatttattattatattaaattttattatttttgaattaattaataatggagaaagaaatgaatttagttaatgtatgaggagaaaataccaatgaaaattcgtaaaaagttaatgaattttttaaaacgattgaatgtttaagtgcctttgtcacaccccaaagttttggaaaattaaaaaaattatttaaggatttaaagtataaatttctgttgactttttctgctcccataaatgatttgttcgtgtaattataaaacttaattgtttgtttgttttttaattaggcttcgtttggatcaaagggcgccaaaaggatttgatcattacggggggactgaatgtttacccgccggaagtggaggacgtggtgaccaacattttcggcgaaaagctgaaggaatgcgcaattattggtgagaaataaattattattaatttcgtaaaaattcttttttaaatttaaatccaaatttattaatttccttaactttttactaactcagaaaaagtacatttgttttctaaatgccaatttaaatgagtaaaatcatttttttattttcattttactaattatgccgtatttccgaattctgtcgttggcattctcttccttaaaaggtgttccgcaccccgactttggcgaggcggtcgtcgccgtctgcgaaccttccgatgccttcgcagaaaagctcagcggcgttgcgcaccaattgacggacgatgagaagagtgccttccgtcaaacattggcaccctacaaaattccaaaggctgtccaatatatgccgttgccacgcaatcaccttggtcaatcacaataatatttaataaattagatggacatttgagattggactaggtcc

SEQ ID NO: 84235 - DNA, 1279 bp, Heterodera glycines
  Genomic contig location: Contig_ID=SeqID_19513; Location=59..1337; Strand=+
  SCN-specific regions: Sequence locations=1-309,332-682,704-721,744 -851,873-1133,1163-1234,1272-1279
atgttgaatgcttcggatgtgttcgagtcgatgttccgttttgatggcgaaaacgcaaaggaaaaaagtaaaaaaaaaaattggaaaatcctttcaaaataaaaaaaaattaacgagcatctcaacacttttggcacattgttcggctgagcagtgaaaagccatttggccaatgtttgtccatccgacgccatggcactatcatccgtcggaaattcagtgaagatatcgccggcatataaacagacaaagcgaagtgatggacattcgcagaaacggcggaaataatccgtaaacgcaatgccataaatgtttttaactacataaaaatgaatagaaaggactgattgaatttatttatagtcagtcgtcaattttacgatataatgattgatgcatttgaatccgatgactttgcgtggcaattgaatttgcggaattggcaatcgtttccaatagttattggcaatttccattttgttggtgccattttctccaatgttgggccaaattcgaataaattccaatgtccatttgcgcgtcttgaagtttatatccatatttttgacatccctactaatgattgtgacttagatttaaatggattaaaagctagagtttaagacaggagaggccaaactaactaaagaataacaattggtcacctatttacatacctaacataagaaaaaagagaaaagatcctgagaaattagcaacgatttaaataattaatttaatttcaaaatgaaatgaaaattgctcaattttaagtatcgcttgctaccccataaattgtttataaattattaatcgcgaatttaatgccaatctttccttctcaatgtggctgcttataccttaatttttcctacagcattttgtgttatttggcatatgatttgaacgaatcgctttcaatcctcctctgccattgttaagtgtgtgttttttaatcacttgtacaattacaaattttgcccattttttggcttcactttatgcaattcatctgtcgttgattcggcgctgatcagccaggcgacttatcatcactgatcactgatcgaaggatcaagttttttggtgagagggcaccgaaaatgagcgtcgtttttttgatttcatttacgaattaattatttttaaatttgttataaatcatctaccgatcatcctaattgctgcattttatcacaaagtaatatgatattaaaaactaattgttcataagttatttttattaaatgaaataattacatttaaaattaccttttca

SEQ ID NO: 84236 - DNA, 1118 bp, Heterodera glycines
  Genomic contig location: Contig_ID=SeqID_19513; Location=1775..2892; Strand=+
  SCN-specific regions: Sequence locations=1-3,25-267,306-446,468 -554,576-994,1055-1118
cgatgcttcttcttcgctctgtccctcttctgtccgcttgcctttccttctttggcttccttttgccgcctcccattggtgcataaaaagagcaaatttcggcaaaaaacactttcattcccaatttcttagtcggcctgcaatgcaagcagtaccccgagctggagccggggacaaagttcagcaccgaaccaaaggaagtggactgtgaagggaaaaacgacatctgcacggtcacgaactgcaaggacgggtcgaatggtcgacaaaaattaaaataataaatttgaatataattttaaattgctttttttgagtcgccatcccatggtacacacacggcgactgtgacattgagagtcgctttagctgcgacaaattgggcgcacaatgcacggccaaaggtggcactttttgttgccacacatgcaaagaagacctgtgcaatacggaggacatttggtaaaaaagtgaagtgaccaattaatgtattaccgagaaaaacagtcgaaaatgccattgtgaccggcaaccgaacatttatttatgtggggaaagggtaattttaaatggaacgaaagttaatgatcagcaattagtgagaatgggaggaagctgaccgcttacgtcatccaatcttttttgaccgttttaatgtaaaaattgaataattagtaatgcattcattcttaataaaccgagagcataaggaatataaattcgagatgtttccaaactatttttgagtcctaacaccgctgcgatgcgtgccggacagcaggtgatcgcacttgtggtgccgttgttggtcgctgtgtttgcgatccatgccgccaaaagtttaattaccttattttgtactaattgaatttttgtcccttttcatcgaagtcggcttttgagaatggacattggacgacgcttttgctgcgcaagaacaaacagtgccaaaattttgagaaagtaccaaaaaaatgtgaccaatttttaagggtttaataattattacaatttatatatgtatcatttatgttatttattgattattatttttgtaaaaagtgtttattttttgcataccttaagaattgtaaattaaaaggtttcactcatttgca

SEQ ID NO: 84237 - DNA, 683 bp, Heterodera glycines
  Genomic contig location: Contig_ID=SeqID_19513; Location=1612..2294; Strand=-
  SCN-specific regions: Sequence locations=1-53,75-215,254-496,518 -632,654-683
atggcattttcgactgtttttctcggtaatacattaattggtcacttcacttttttaccaaatgtcctccgtattgcacaggtcttctttgcatgtgtggcaacaaaaagtgccacctttggccgtgcattgtgcgcccaatttgtcgcagctaaagcgactctcaatgtcacagtcgccgtgtgtgtaccatgggatggcgactcaaaaaaagcaatttaaaattatattcaaatttattattttaatttttgtcgaccattcgacccgtccttgcagttcgtgaccgtgcagatgtcgtttttcccttcacagtccacttcctttggttcggtgctgaactttgtccccggctccagctcggggtactgcttgcattgcaggccgactaagaaattgggaatgaaagtgttttttgccgaaatttgctctttttatgcaccaatgggaggcggcaaaaggaagccaaagaaggaaaggcaagcggacagaagagggacagagcgaagaagaagcatcgtaatcggcggacaagcaaaagattggaatggggggagtggctttgaactgtctaaatgaattaaattaagcgattaatatgcttaacactcgtcagatggcaattggtgaggggaataagcatttttattcctttccgtatgatcacgatgcattttaataaa

SEQ ID NO: 84238 - DNA, 2211 bp, Heterodera glycines
  Genomic contig location: Contig_ID=SeqID_19514; Location=1..2211; Strand=+
  SCN-specific regions: Sequence locations=1-260,283-590,612-1071,1093 -1224,1247-1248,1289-1598,1622-2211
  Gene Ontology: Mol. function=ATP dependent DNA helicase activity; Cellular component=nuclear telomeric heterochromatin; Biological process=DNA replication
aattagaagagaaaaatgatcatgatgaagttaaagagtttattgatgcgcggtatgtttgcccacaagaagcagtttggagaatttttgaattgcctatatatgatagaagccattgtattatgtctttgcctgtacacctacaaggtgaacatatttgttattttgacgagaatatggaagaagagattcgtgaaagaattgcgaatggttctgagttgatggcatattttgaattgaataagacaaatgttttggcaaaaaatttattttatcaccagatacctgaaaagttttgttttaagaaaggaaaatggacagagagaaagacatattttaacacaattggccgaatggtgaaggtgtcaccggctgagccggaacgataccacctgaggctgttgttgttaaatgtgaagggagcatgctcctatgatgatttgaaatcagtttttgatactaatggcaatgcaaaagtttgtgaaactttttcagccgcatgtttagaaagaggtttgattagaaatgatgaagagtggaaaagagcattagaagaagcagagagttttgagatgccatggaaattgagagagttttttgcattgattttagtccattgcaatccggccaaaccggaagagctttggaatatgtttaaagactcattgtctgaagattttagcaggaattttagaaaagaagtagcttatgctaaagcttatagagaaattgcacttagcattattaagactggaaaaacgcttgccgattttccaaccatggaacagataaatgttgatgatgatgttgaacaagtgtttgacctagccgaagaattggatttgggacaaagaagttatgctttgatgtatgatgaacaaaggaagattagtgatgaaattttgcatagagtatggaatcctataaatgaacctgcgttctactttcttagtggaccgggtggaactggaaagacacatgtgaacaagacaattgtacatatgctgagaggacagaagaaaaaagtttgtacaatggcttttactggcatcgcagcaactttgctgcctgctgggagaacattgcacaatagatttggactgactttggatatgagtaattagagtattagtccaagctcaaaagcttggcaagaattgaaagaaacagatttgtttatttgtgatgaagcgcctatgataaataagcgcgcaatgagaactttggatgagaaattgaaagagataatgaataatggaattgcatttggtggtaaagttatgctttggacgggagactttcgtcaaacccttccaattcagaaacatgccacgagagctgagatggttagttcgaccataaagagaagtgagtactggaggttggctaaaagatataaattgacgaagaatatgagagctcttgcaacagagcaagaatttgcgagagatttgttagagattggcagtggaaaatggaataatgaaaatgatgagataattttgcccgagaattgtattagcaatggcgatttagcagaagagatttttggtcaatgcattgtcttagaaaattggaatgaaatggccagaagtgccattttagcaccgaagaatgttgatgttagtgaaatgaacaatagagttttggatatgttgcctggagaagaagttgtgtatacgagcatagacttagctcaagatgagaatagacaaagagcagatgattatttggatgagtatttgaatgctttgaacccttcggggtttccgcggcataagttgagactgaagaaaaatgctattgttttgttaatgcgtaatttgaatatagaaatgggtctttgtaatggtgcgagaatgaaagtcgagcaattgcaaccaaatttggttgtgtgtcagattttgactggagacaaggcaggtcagactgtgtacattcctcggatcacgctttgctgttctgaagattacccttttgacctgcataggcaccaattcccgttggtgttagcttttgcaattacaattaataaggctcaaggtcaaacccttgagcaagttggaattgatctgaggaaagatgtgtttagccatggacaattgtatgtggctctttcgagagcaagggcttggaataagttgagaattagattagatgatggaaatttagagagaaaggtaaagaaatgttgtgtacagagagttatta

SEQ ID NO: 84239 - DNA, 854 bp, Heterodera glycines
  Genomic contig location: Contig_ID=SeqID_3328; Location=93..946; Strand=+
  SCN-specific regions: Sequence locations=1-548,571-713,736-828,850-854
ctacattgaccattccgtcattgaatttctccgttcaaacaagcacatttgggacagaagtggcaccaaattggagttgactgtgtattcatacaaaactaatgatgtccagcagatttgggatgctttgaccagtgaaatttggccaatttttgcaacaaacattcgcaatttgggctttaccagtgccaatggtttggacaattttcgtcgccacacttcaccgacaattctcaccgatctcaatcatctgaattcaatcaattccaattttctgttgcctgatgcaattgctgatgatggaccggatgcaactgctggccaagtgttgtccaaatggctgcacattccaacaactgatggtcaaccaaagcgattgtattgccatggttattatgatgaatcaaatttggaatggatcaacaatttgaaggaggtggccggtcatattttgactgatttgattgccttcgatttgcgttttctttttgtttaggcatttccccgtgccacttcttccgccagtttcattattcgaattgatcgtgagagagcaatgtcaaatgctgagccatttgaattggagaacgaacgaaccaaggaaaagctgacattggagaaagagccacgttctgctggttattggctgttgaagcgatgcccaattagtgaaaaggcggcggcgattcaatttgaaaattgggatgccaatttgaacaaaatcaaatttcatttgtggggtgacatcaacaaattcattgggtgagcagcgacagcaatttttgattttgtcgaaaaaatatattaattttaggccattatcgccaccaacggaagaaaaagcggacgaatga

SEQ ID NO: 84240 - DNA, 247 bp, Heterodera glycines
  Genomic contig location: Contig_ID=SeqID_3328; Location=2740..2986; Strand=+
  SCN-specific regions: Sequence locations=1-202,224-247
atgcatttcattttgtccaatactgtgatcactgatcagtcacttcttcaggctgatcgtgagtgatcaaaactgtagcaccaccctatgtgatttttggctgtgctaacaattgttcatcatggtaaaaaatgcacccaaataatatgattaatcatatacataatatatatacagactatcctattaccatttacagtagtttagcactaaaaatgttaatgtgattgaatgttgtctttttcaa

SEQ ID NO: 84241 - DNA, 348 bp, Heterodera glycines
  Genomic contig location: Contig_ID=SeqID_3329; Location=685..1032; Strand=-
  SCN-specific regions: Sequence locations=1-348
accgacggctgggccgagatggtcaaggagcacccgcgactcgtcaccgaggtggtcgccgccatgtcccaggagcagtcgcgcctctgtgagtgttgttttgttggcattggcattggtggtgtccctcctccgccctgctccaaatcgtcggcttctcctcctcctccgcatcatcagcaatttccgattgttgacggtggtggtggtgaacacccaattgctgctgttcccggtggtgttctcaacacatttttgttgtccattttctacgcgtttttcattttgttttgctttttccacgccctgttcaccaccctgtggcacaaatttggcggtgttgcttaa

SEQ ID NO: 84242 - DNA, 603 bp, Heterodera glycines
  Genomic contig location: Contig_ID=SeqID_3329; Location=741..1343; Strand=+
  SCN-specific regions: Sequence locations=1-420,444-577,602-603
aaaacaaaatgaaaaacgcgtagaaaatggacaacaaaaatgtgttgagaacaccaccgggaacagcagcaattgggtgttcaccaccaccaccgtcaacaatcggaaattgctgatgatgcggaggaggaggagaagccgacgatttggagcagggcggaggagggacaccaccaatgccaatgccaacaaaacaacactcacagaggcgcgactgctcctgggacatggcggcgaccacctcggtgacgagtcgcgggtgctccttgaccatctcggcccagccgtcggtctaaaaattttaaagaaatccatgggaaattggaaaggtgctaggtcgttatttaaaaaaccatcattatgattttatgagccccggggtcgtttgggccccaacccaaaaatagaaaaaggtacttttttaaaaattaagattctaaaaactaagcctgagggatccctcgccacttgtacactttctgtcgtcttctccgctagatgggaaggaagaattaagtgctcgacagaactcaattgacattcggatcagtgaaaacggaaacggcgacgggcgaacaattaaaaaatgcttaatcattttat

SEQ ID NO: 84243 - DNA, 1636 bp, Heterodera glycines
  Genomic contig location: Contig_ID=SeqID_3331; Location=314..1949; Strand=-
  SCN-specific regions: Sequence locations=1-166,188-540,562-1129,1194 -1290,1355-1488,1523-1636
atgtccaactctaacatttatacaaccttcagaaacccaaattattatttttttgctttaaatcaacagccacccgaggacactgacatggctgatctgtgcggaactccgatgcgcccatcggacagctggttggtagacgaactaatataaattcatcggaaatttaattttttgggagttgaaaattgcaaaatttcacattgactcccctgggtcccccagaatttgtatgaaaactgaaattttaacatgtccaattcactcccaatcctaagctgcacatggttattgaaaatttatctaggtattcgggatctttatggaacgtgaaattggcccgaatttgcggaaaatttcacgaaaatcccataaaaaaaattttccgatgctttcattgcgaaactgtctaaatttttttttcggtttccatggactaattgcataacattttcaggtcctccacggaagttcgaagtctccaacacactcacgtgtgtaagttttaccaacaaaaaaggaaaatatctaggtatttcgaaaataaatccaaattttttagggaccatcaagggcttcggtcaatgcgaagtgcgctacttggaaacgtccgtccgcatcaaagactcggtttgccatcactcttcatccttcgtacatctcgacttcacaaatcattcaaaaaatctatgttttctttttcgccaattaaaatatcggaaacctcggaatttaatcggcagcggctcgtcctccagttctctcaaccattctcaaccatcaaattttcttctctaatttttcgggtgtatcttcggtggcccggaccagtattagtgttcagaacggaaccgggacgggatttacggtgtaaaattccaatttcggaacccggattcaggggaaaaatctcgttacgggccccgcttccgtctagactttcaccctctatttctgagtggcgccgaaattccgatctccgacattttcggggatcggcacggccgatttctcaattttttttgggccttatctcccattttccagtgtacaatatcgcatgttacttctccattttcttttacagcacacgtcaagcggttgctcgtcccagtccaattcgttggttggcggcagtgccggcggcggactgatgggcggcggtgccgcggcagcggctgccgctgcggcggacaacgcgaactatttgcagttcaaaatacgtctccatccccagggcaacaaggagtcgaacaaggacttctgcttctttcaggttcatttccaaacaaaaattttcaaaaaaaaacaaatttttttttgaaaaattagtttttggtatttaaaaaaaataccgcgggaagcgatgccaggagtaaatgaagtgcgcctggaggggctcctcgtacatatccagtgagtgagccaaggggatatatttaatcctccacacacttcgttttctcaggtctccctctccacccattgaaaaaaatttttttttttttttttgaaaaatttactcgtaggaaaaccgcgttcaaatttaagaatttgttattctaaatgaaataatacctaattgtacatgtacgctcttttctgcttaaagttgaaatttttttgtttaaataaa

SEQ ID NO: 84244 - DNA, 665 bp, Heterodera glycines
  Genomic contig location: Contig_ID=SeqID_3331; Location=2528..3192; Strand=-
  SCN-specific regions: Sequence locations=1-406,428-665
atgtcaaatgctgagccatttgaattggtgaacgaacgaaccaaggaaaagctgacattggagaaagagccacgttataatgttgttaatttgttgttgaagcgatacccaattgatgaaaaggcggcgattcaatgggaaaacgacgaaaaattggacgacaaattgaactatgtgcaaattgagctgatgcgtggcagtcgttccattgggtgagcagcaacaaccaacggaatttgattttgttaaaaatgtaaacacttaattttaggccattgtctccaccgtcaacagaagaaaaagcgggtcaaagcaaccaaaatctcgtctgagtgcgcggaagtgaattaattatatttgagaaatggtcgacgatctcacaaattacaaatggatttgatgcttattttctctcaaaaatgcttttgttgcttcttcaacatttgcttgttttattagaatttttgttcaatatacttgagaaatggtcgatcatttttgagttggtcaattggaatttggataaatttttatcggaggccccaaaactcaaaattgctcaaaaccattttattggttttcttagtcggtgatttgataattggccggaatagagatgccagccagattcatgatcagaatggttacgcgttgtaagcattaaa

SEQ ID NO: 84245 - DNA, 120 bp, Heterodera glycines
  Genomic contig location: Contig_ID=SeqID_19515; Location=4..123; Strand=-
  SCN-specific regions: Sequence locations=1-27,49-120
atgctaacaactagagatcgacctggacctggatccaggcctggatttttcctggatccaggtccaggccatttttcggcaacctggatttttcctggacctggattttcctggattttt

SEQ ID NO: 84246 - DNA, 499 bp, Heterodera glycines
  Genomic contig location: Contig_ID=SeqID_19515; Location=1936..2434; Strand=+
  SCN-specific regions: Sequence locations=1-22,44-133,264-294,316 -405,452-499
atgaaaggtcggacgaatatgccgcttgaagcagtgctggcacttgtccatatggtcaaggctcgccagcaagaattacgcaatcacacgaaggtggggggggggggatggcacaaattcaacaaaaaaagcattaatttataatattacatttattttcataattaatataattatttcatttaattttcattattattttgtgttaaaaatattatttaattaatttaattttaaaacattaatttattataattaaagttgtacgggtctgggaattttggaaaaaccgggacttgccaggagggccagaaaggccgggagtcccggcccgggactggcgcctgaattttcaaccgggacggggtaccgggataaagtgggaattttacaaggaaaaaatccaaaatttaaatttaatattttttaggtgaaatattataaaattaaactttcctattgtttttcatttcataaaagctcaaaaattaataattta

SEQ ID NO: 84247 - DNA, 699 bp, Heterodera glycines
  Genomic contig location: Contig_ID=SeqID_19517; Location=23..721; Strand=+
  SCN-specific regions: Sequence locations=1-318,341-699
  Gene Ontology: Mol. function=ATP binding; Cellular component=integral to membrane; Biological process=glucose transport
gtgctcggtgatgctcagaattggcccgtcgcttttgccttctccggccttcccgcttttattctttgctgtgtgctcccattttgtcccgaaagtcccaaagtaagcttattcattaaattatattttttttcctaattacctccttcccctttcatttaagttcactttgttgtcccgtcgcgaccgcgtcggcacattggacacattggcacggctggtcaatgttcacgagggacagaccatgttcgaagcattgcaacgcgaaggacagagcacacaaacattgacagtggcggacggagtgagtgatttgaggggaaaagcgaaaggaatgcactgattgatcgaacactgataaagcctctttcgcagaacatcgatcagtccagcgcaatgtctgccgcctcaatctgccgactttttcgatcgacggaacttcggatggcatttctgatcagcatgtgggtgatggttgcccaacagatgaccggttgtgctgccgtttttgcctattccaccgatatgtttctgaatgccggattggaaccgtaagaaatgcaaaaaaaaaatgggaagaggcattagaatttatatttcaggtcaatcgcgcgttacagcactttggcaatcggaattatgtactttctattcgcttgcagctccgttttcttcatcgaacgaaaaggtcgagtttaa

SEQ ID NO: 84248 - DNA, 1195 bp, Heterodera glycines
  Genomic contig location: Contig_ID=SeqID_19518; Location=394..1588; Strand=-
  SCN-specific regions: Sequence locations=1-146,212-345,367-374,417 -581,603-838,880-883,914-1019,1042-1195
atgaagcgagttatggcagatcaaataaaaaatacaaaaaaggcattttccagtgtaaattttgaaatagcgcgcaaaaatttacgccaaatgcgctatttggcgttatgagtaattttgtctaacactgggcttgacccatagtgctcgctctctcttctctctctcctactctctctcttacgctcttttctctgtgtctcctccctctgtttaaatttatatttgtcgttttttctgtgttctcttccttttaatttggtccgttttgattttttaacttccgtttcgtacacaaatctctgttgactttaatcttctgaataaatttgtacataaaaatggttcttttttaacagcaaaatcacttctgatgtctttaaataattcaaatttgttggggaaacggaaggtggcgttgaatgagcgcagaaaaatttacatccaacgcgactacagccaagcattagttgtgaaattcagcacagactttcctgaagagctcgaacattacgtaaatgtttaacagtttggcccttcgtttgattggttattttcagattgacagggatatttggctgaattttgtcactgatctcaaccaaatttacgcggaggcggagaaactgacggcgattgcttacctcgagaacattctcggcctggtgacatgccatctttccatgctgtgcttcaaatcattgtggaagcggaagttggaggaagcgcaggcacttttatacgaaaccaaccaacagaactttgtcaggaacggagtctacgtttgcaaccccttggagaaggggttcagagtggtaggtcttacaaacaaatacaaaaacttgtttgaatattagtaaatttttaaaactttaaattgtcgaattataaaattattctatttatattttttggaacattaatagtattagtataggggagcagttcgtttacctcaccccgccacgaatcaaaattcttttttgtaggatttggcgtggagtttatttttcaatttgatgtccagctgatttaattttggaaaatctttgtgcaatattttgaaaaagtaaaattttgggactgtatttggtaagccaagatttagtttttcttccagttattttatctctgcgtaattttatttttattttaggcgctacttacaaaatggccacttttgaattttattaaa

SEQ ID NO: 84249 - DNA, 243 bp, Heterodera glycines
  Genomic contig location: Contig_ID=SeqID_19518; Location=2148..2390; Strand=-
  SCN-specific regions: Sequence locations=1-50,77-96,120-243
ccccacaaagtgtccaagccacgaaatgtccaaaagagtaaaaacccacgaaatgtccaaaatttttcaaaatttataaaaacaaaatgagtttaatttaggatttttagggttttcggggtcgctgaatacgaatataccctttatattaccccttgcctaaccttaggcccatctgaataataaaaaactcaaattcgagacttggacatttcgtgggctggacattttgtgggtcagcgg

SEQ ID NO: 84250 - DNA, 927 bp, Heterodera glycines
  Genomic contig location: Contig_ID=SeqID_19519; Location=1674..2600; Strand=-
  SCN-specific regions: Sequence locations=1-35,58-231,271-404,441 -602,655-927
atgcatcttctgaccaattctataagcagccaatgttttattttcttgcacatttcaggtattttttttgaaatcccataaaatgcattgttttaaaattgtttgattttaatttttagtcattttgtgccacgaaattcttccgttctttcctccatccttttcgctgcaaatggcacccaattagaggaccgtccaattgaaaatattcattcatacagtaattaacacttttttaatttaaataatttatttttaaaaatatattttctaggagattttgtcctattgaatggtacaacaattggctaccaagaacaaattgaacatgtagcatttgaaacgatcggcggtaattagtgatcgaaaagtcgcttaattgatttttcggattaattacgttgaaaaaattaatatttttattttaaaataaaattattccttttaaggcaatcgtgtgttggtactgatcaatccaaaagcaaatcccatcaaagtgtccgtggtcgatggccaacggcggtggaccattccgatgagtgccgagtcaattgtcagtgccatttggaaagcaaaataaatccaaaacgcaatataacttgattatttgtaatttaaatgtatttaaattatcaaattttattttttatatttggccataaaattcttttacaacaattagcaattcgtataaaaatgctaattaattaaacaagtgaattaattagtgagctgatgaggttagaaatatatgtaatataaatgaataagcaaacataagacgtggaaaaagtgttaattaggcataaacaattaatattagaaatttttgatcgagagaacggcacttggaaaaataattaatgaacttaaaataagagggcaccattaattagttgaaaattaatgctaaaataggtgaataaa

SEQ ID NO: 84251 - DNA, 287 bp, Heterodera glycines
  Genomic contig location: Contig_ID=SeqID_19520; Location=83..369; Strand=+
  SCN-specific regions: Sequence locations=1-287
atgtgccgtgcgctgatcgcccatggtgtcaacatcgaattggggacggactctggcgaatcgacgctgctctgcgcatgtttcgaaggccgttttgagattggtgagtcaaatgcatggatgatgctgccgtgtaattattgccaatgttttcccatttttcagtcactcttctcgtcgagaatggcgccaacgttaatctcgcggacagcgacggaatgacgccactaattgtcacttgttactttaccggaaaggttgtgaacaagttgttgcataatttgtga

SEQ ID NO: 84252 - DNA, 133 bp, Heterodera glycines
  Genomic contig location: Contig_ID=SeqID_19521; Location=120..252; Strand=+
  SCN-specific regions: Sequence locations=1-133
gacagcgcgtgaacgaaggggcggaagaccaactcgccgcagcagtcgactcagtgggcgacggacgatgagagaaagggaacgaacggacagagaaaagaaacaattcgtccgtctgatatgttttaattga

SEQ ID NO: 84253 - DNA, 1925 bp, Heterodera glycines
  Genomic contig location: Contig_ID=SeqID_19521; Location=284..2208; Strand=-
  SCN-specific regions: Sequence locations=1-440,462-741,765-995,1017 -1453,1476-1880,1903-1925
atgcattcattgtcaaggcaaaatgcgatcgatgcgcgtgttttattcggacgcggaacggacaagcggacaattggtgatcgccagcctcgactcgcagtacaaaatattccacttccatcacacggggttggacagactcaccgaactgttcgaacgatggaacgccgtaaaggcaaagtcagcgatcggaaacgaagtgaaagaggggcaaatggaatgtgcaaaggaaaaccgaataatgaacgcacatttcagtcgccacacacaaatggccaagaacggcatttgctgatcagtcccgggactgagttggccaggacggagttggacccggaggatggcctttacgagcgattgggctgggaaatgtggcggtcgtatgtgagcgcggatgggagtgtggaggacggattcaccatcagaaaggcaaataatgagggcgggggggggggggggcgagggttcgctcccaaagcaactgactgtccatttgccaatgccaactgtggcaatgaatggtgcattttgccctaatgagtgcccttctccgcccgttcagaccattcatttctcgtccattgagccgacccttcgcaaagaattgtggccattttttgttgcgcgtttacccatggaattcgacgacggaacaacgcgaaaacatccgaaacgaaatgtttgtgcaataccaaaagctgaaggggcagcgaatgcgcaaaacgaaaggcgaaacgacgcaccaaaaagaaaaagagaaacagcagcaaatggcgggggtggaacaaagcatagtgaaggacgtgttgaggacggacagacgcaactcattctttgcgggggaagaaaaccccaatttggaaacgatgaagtgaggggaaaagggggggagggcaatggggggaaggcgaattcggcattccaaactttgcaaaattggcatgatgaggagggggaaaagtggcggggattataccaaacaaaacacactcatttgtcaggtccatccttctcacttatgctacaaaaaatccggagatcggctacatccaggttggcacttctgccaaggctcttgtgttgtcactttatcttgtgccattgaaaatgccttcatttggccccttttctccccagggaatgtccgatttgttggccccacttttgtgcactttgcaagacgagccgttgacctattggtgttttgtgcatctgattgagcaaacgctgttccgaccttccaatggtggagaacagccttcggaaatggaagtccaattggacttcatccgtgagctgcttcgtctgttcgtgcccgacttccatgcacaccttgccaagctcggcggggacgcgcccggcctgatgttcgtccaccggtggattctgctcttcttcaagcgggagtttccctcccgcgactccttacaaatttgggaggtttcgaatatacttttggatattttctaaaaatatccgctccaaggcatgctggtcacgctatcgcaccaactacttccatctgttcattgcgtgtgccgtcgtttccatttatgggcccgacgttgtggaccaaaatctgccacatgacgaaatcctcttttacttctcttcgctgtccatgcacatggatgcccatctcatcctgcgcaaggcgagtgccatttcgaaatgaaggcttttcctcccaagcttttcatcttttctgttccatgcctcccatttgactgcttcaggccagaggtcttctctaccaattccaccgacttccccgcattccgtgcactttggccggcctttgttcgtacgagtcggactcggagcaatggacttcccacattgaaccccacgggcaattcgaatgctcacaaaagcatggagagaatggggaggagcagtgcccattcgcagtcggattcatttga

SEQ ID NO: 84254 - DNA, 171 bp, Heterodera glycines
  Genomic contig location: Contig_ID=SeqID_19523; Location=79..249; Strand=-
  SCN-specific regions: Sequence locations=1-171
gggtggaggaaaccctttacaccatcagcccggaaggatcgtcgtcttcttagaagagggaaagaatgatgttggtcattgatgtcatagtgaaagatgaaaaccggagaaattcccttctgatcccaacaaatccaatggaacaattttgatggaaattgaaaaagtgtc

SEQ ID NO: 84255 - DNA, 173 bp, Heterodera glycines
  Genomic contig location: Contig_ID=SeqID_19524; Location=1062..1234; Strand=+
  SCN-specific regions: Sequence locations=1-82,104-131,153-173
atgaaaataagtgttaaggggttttttgggtcgctgatcacgaatagagcacccatttttgccaatttcgaaaccctgactccaggaaatccaagtccaggtcgacatggaatccaagtccaggtccaggcttttttcaaaataccgagcaatgataacgacatagcaccggg

SEQ ID NO: 84256 - DNA, 736 bp, Heterodera glycines
  Genomic contig location: Contig_ID=SeqID_19526; Location=704..1439; Strand=-
  SCN-specific regions: Sequence locations=1-182,217-365,416-441,463 -712,734-736
atgaaatctgtccagccaaataacattctaatatttgaaagaaaaatagttgaagccgaaacatttgaaaccaagaaattgaaagcgctttatttttacatgcaattatttcgaaaaataattggacaattggaaaccccgtaccataaaaaatacatcaccaatgattatgtaacaaattgaaatattaaattaaaattactttaatttatttaagattaatcaatgccaaaaagaaagaaacttcattgtgttatgggtccgcaaaacattggaaaatgtttctgaaaattttgatgtgattgccaatggaccaaatattaatgattcctgtcaaaaggtcgtatttttaaaaagagaaaatgtatttaaattaatttatgtattttttataattatgaaaataaattaatttcagctttttgccgcaaataaactgaataaatttgaaacgataaaagaaatcattgtgttggcatattttggcatccgacaaacattggcactgatttatgaacagcagctagaaaatgttttaatcatgtcaaagcaaagtttggccgatttgttaaatgaaacgacaaaaaatgatttggcatgtttattgttgagccataaagaatcgctgaatttagagcaaattgtcaagaacatttccattttgaaaaacgagtaagggaaaggatttaaaaaaagccatttaaaatgaatattttttaacaaatagttaaataaa

SEQ ID NO: 84257 - DNA, 532 bp, Heterodera glycines
  Genomic contig location: Contig_ID=SeqID_19527; Location=682..1213; Strand=-
  SCN-specific regions: Sequence locations=1-52,74-76,122-195,217 -239,261-336,371-532
ggacaattcgtcattaatgtgccattcgcaaaatttgcaacaaaatcaattcatccccaattataaacattttccgtcattatcatcatcatcatcattatcactaccatcatcatcatcagaggctacaatgtttggagaggcacgtgaaaataaaattgaaaatgacatggaaattttaaattctaattggtcaattgtacaacaaaaaatgaccgagaaaagcaatgattatgaaaatgcaaacgaaaggcagcagaaattggaagaacaaatgggaaacagcgcattagacgagcagcaaatggaagcacagcaagccaaaaaacttttatgtattaaattttacaaatataatttaattttaaatggaatagagatgcatttttatgagcactttgattttctaaaaatgtgctctggaaaaagtggcacaaaatggatgtataaccaacaacttgagaccggcgggatcgggacttcccgcgagatttttgcgggaatctcgatcccgtgctttttccttgcgtga

SEQ ID NO: 84258 - DNA, 1667 bp, Heterodera glycines
  misc_feature (1020)..(1020): n is a, c, g, or t
  misc_feature (1044)..(1044): n is a, c, g, or t
  misc_feature (1070)..(1070): n is a, c, g, or t
  Genomic contig location: Contig_ID=SeqID_3333; Location=237..1903; Strand=+
  SCN-specific regions: Sequence locations=1-929,951-987,1009-1157,1179- 1667
  Gene Ontology: Mol. function=neurotransmitter:sodium symporter activity; Cellular component=integral to plasma membrane; Biological process=protein folding
cataatcgtggcaatcagaacaacgggcaatgtgtactcaatggaggcggtcgaagagctgaatttgaagcggaatcatctgaaggatttgttgacggacacgcccttccagaaaaaagttccataataaggaaaaagctttattttttcaattacccttttcaggacattattacactgcaggacccgcaggacttggacaagttcaacatcgaacagttttaccatgtccaattcgacaccaaaacaaaggcacaaattgcggaggaaaagcgcgcgatgcaaagcccaaattactttttgaaccgactgaacaacgaggcaaaagaggcactgcaacagttggagaagcaatatgtcaaggaggtggaaattatttaacaaatggaatgagtcacgtttaaatgcatttagggaacgaaaaaggcggatgatcaaacggcggacgaagtgaacgccgcccatttttcgcagggaaaagtcgcggccggactcacttcgacaacgatggaaccggtgactctgaacaaagcggcggtgttggaagaagacgtggtcaagttcgtttgtccaaaacattttgacaattgtatggcactgactttcgtatgttttttcaaggtattcacgcgtaacaaagaatggttatgtacgaattgtgacgaaccacggaccccttaacttggaattgttctgccgacacgcgccgcgcgcgtgcgaaaactttattgtgcactgccgcaatggatattttaatggcacgaaattctatcggctgatcaaaggatttattgtaagttgtcatatctctcccaatggaaaatcgttgaaatttcctttacttttttgttgtagatttttcaaattttaggataaaaacattcagacaatcaagaattttattgttgtgttgtaacaattattgcacagtttttagttaacaaatttaaagattgtctcgagctgttttttgaaatttttcgggtgaatttttaaaaacaataaattgacatattgggnggggggggatgggcttttatattngtaggtgaaaaaaagctgattgtgangtcattcgatgtgggtttcttttggtactgggtttaattacccgggacacttgttttaacactgacacaaaacgggtttaaattttctcaataattttgaaagctgatcaaaacttgtaagttataacacaaaaacagctttttcttcaacccttatagagatttttggacaacaactcaataatttacttggtaaaatttttatattcagctccaaggcggagatccgaccggaacaggcaaaggcggtgagtccatctggggcaaaacgttcaaggacgagatccagggcacgtacaaacatggcgagcgtgggatgttgagtatggccaaccgcggaagcgacactaacaattcccaattgtaagtgcagaagagaaccatttgcattttccaagagaatacagtttcatcactttcgccgcgtgccctcacctcgacggaaaacacacggtgttcggccgtttggtcggcggtgcgcaaacgttgtgcaatattgagaatttggagacagacgaagaggaccaaccgttgcggactgtgctgttcatgcaagccgaagtatttgtggacccatttgatgaggcaatggaaaaa

SEQ ID NO: 84259 - DNA, 2287 bp, Heterodera glycines
  Genomic contig location: Contig_ID=SeqID_3334; Location=729..3015; Strand=-
  SCN-specific regions: Sequence locations=1-423,445-538,560-589,611 -918,942-964,1001-1028,1050-1400,1422-1820,1845-1986,2008-2287
atgtacggaatggtcatatcaaaagaatcaccgatgaaggtgaattaaaaacttattattgaatttattaatttcccatttattattagacattcaatcctccgttatcgaactgcttggaaacaatgtcaggtgggacattgaacaatgctcacatacattattatcattaatattttaagcacaactttcatcacttgccctctcgaccctaagaaaaatcttggaattaaattgccttattttgtgatgactgtcaagaacctgaacaaatatttcacttttgaagttcaggtcgtaaaagctgaaatacctttgttaactaaaaatcgtttataaaaatgatttaagattttggacgacaaaggcatgaagcgacgctttcgcgcttctaacttccaatcgacgacccgcgtgaagcctttcatttgtacgatgccactaagactggacgagggatggaatcaagttcagttcaatctcgccgatttcgtcaaacgagcttacggcagcacttatgtggaaacactccgaatacaagtatatttttcaaaatatatcatttgtctaacaaccagcattatttcctacagatccatgcaaattgtcgtttgcgtcgtgtttattttgctgatcgcctttatactgaggatgagttgccggtggaattcaagctgtacttgccggttcggcatagccaaagcgggaggagaacgacagaacgccagcaagaagggacttccgcgttcatcacctgatctcggattgtaaatctttttgtgtactattcgttcttttaccctccgcaccccttggtccttaattttcgaaaaatacaataataaatatcctgcttctacaatttaaaaaaaattggtatgtgcgccttcagataattgatacaatttcagaatatcttgaggtggggaaggggtgaaaccaaaaaagaacaatattttctgtgtctatttaattattttttggataaatcttttcataaaaattcggcttgtttcattatggttaataaaaatgtccctataattctaattaataaaatgtcatttgctttcttaattttacttttggcctttgttgatggtttctctcagcgattgccaagctgtcgtttttgccggaggtcgtggaagtcgaatgccgtctttgaccaatcaaatgccgaaggcgttgttgcccatggccaatatgccactttattggttttcgcttaatttacttcgactgaatcgcgtcagaggtcaaacaatgcctttaggctttccttaatggttttccgttcattttgatgtactcattttcttcatcagattgccttttgattgttcccctggggcaaaaattgcaaattgaaaatgcgctgaaaacggacggcggtggacgatggccaacacttaagggaatggacatcgaagtggtggccattgacagtttggaggaggacgtggatgactggggaacagcggacgtactcaaaagactgctcgggaaattgaaggcaaaagcaaatgggacgaataaaggcatttcctaataggggggtcaaaactaatttatgcatgtaaaaggagggggtaatgagtcaatcaatccaattaattaccatccttttagagtgatcacattttgttgattagcggtgacttggtcagtgatgtccggctgcgtgacatgttcaagcagtacatggagaacaacgctgtcctgtcctgtctgctcaccgattcggctttgggtgggcctatccccgggcctaaagatcgcgttaaaaagtgtaaatgatgggaaaagaagattggttgaattttgtatttttagacagagattttgtcattttgggtccgaacggacaattgctctttttggtggacgaggacgattttgcggaggaggaaggaatcccaatttcattgtttgacaggcactgtcataaaattgttattgttattgactctcacgtgacaaattcttctttcagatgccccaaggcaaaagcaaccgcaaaatataaggacgtgcatttgtacctcgtccaacggaaggcattggacattttgttatcaaaaaagtgattgcatttgtctagctttctcaattaggtattcctcgattttcaaggtcaaccgctgcttccttttcctctgtcaaagccgatttggtgccacggattgtgcagcgtgccaattgcttcgcttgggttcccacagagtcggacttcacaataattgctcagtgcaacaatgtcggctcatacttcgaagcgaataaa

SEQ ID NO: 84260 - DNA, 161 bp, Heterodera glycines
  Genomic contig location: Contig_ID=SeqID_3336; Location=449..609; Strand=-
  SCN-specific regions: Sequence locations=1-161
atggcggacgaattcctgggaatgccaaaggcgatggcaatagaagctgacggaagcagccatcttctctacggcaccacgccaataacaacgcccgcgcaagtggtgggagaatcagaagacggcaactgcgaattggacatttttgcggaccgacgatg

SEQ ID NO: 84261 - DNA, 699 bp, Heterodera glycines
  Genomic contig location: Contig_ID=SeqID_3337; Location=1778..2476; Strand=-
  SCN-specific regions: Sequence locations=1-244,267-464,486-699
tcactggtgccacttccctcgtgttcggttacgtgctgacaatgccttctttggtctatgcctttctgtggtaccatcgtccgctcagtctccaatattccttcttcgatttgctgtgtgcctttggctattccttggctccgttcattcccgtcaccgctctttggcttctcttcccatttacgttggctcggtggactttggcagtcagtgccgttgtactcaccggttcagttttggttggttttttaaatatttaatattttcgtgatttttctgttttaagatcctttcgttatggccaactgtcagagaagacccaaacagattagtgagcattttggatgacatatttgaacattctgcacaacaaaatattccatggcacaataaaattcatttccaaattttagaccgcttttggcttcgtttttgctgtctttttggcacacgctcttttggcactttgtttaaaagtaaatttgagtgttggggtgactgttcgttcttttattgtgaattttcaaggaattttttcttgacgaggccatttctcgccctgcccaaccaccggttccttttgactcgtcctctaaatttctcaccaccacgccgcaggtgccaacggcgtctttccacggtgaccacccaaacgcgttgaacaacaatgggactgccacaattgctgtggtcggatga

SEQ ID NO: 84262 - DNA, 48 bp, Heterodera glycines
  Genomic contig location: Contig_ID=SeqID_19530; Location=1516..1563; Strand=+
  SCN-specific regions: Sequence locations=1-48
aaactgatcagaagcgcaccaaactttgcagggatactgaaaggaaga

SEQ ID NO: 84263 - DNA, 811 bp, Heterodera glycines
  Genomic contig location: Contig_ID=SeqID_19530; Location=1..811; Strand=-
  SCN-specific regions: Sequence locations=1-192,216-358,380-522,544 -686,708-811
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatattaaagcatcagagtgctaaaattaagttgtaaataaaatttggtgcgctttagagcactttctgaaaaaaatatttatgaaacaaaaaaatcgattttttcaagtgtccatttggggtactcaaacatttatggggagcaaaaatccaacgcagaattaaagtacaggctatagggaagctactccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaac

SEQ ID NO: 84264 - DNA, 927 bp, Heterodera glycines
  Genomic contig location: Contig_ID=SeqID_19532; Location=351..1277; Strand=-
  SCN-specific regions: Sequence locations=1-127,260-365,387-415,437 -495,602-602,625-898
atgagtgatcaacaatttggaatgaccagactaaaaaaagctgccagctctgcgaaaagcagccgcccttgcagccctttccttacggcggcgttcttcaacgcggtacggccgtccaaagtaacagtattaattattaatttatagaataattaagtaaaattactattctataaaaattgtgatttatctttgaaataaataaaatacttttacttatcccaaaaattagatgataaataaaattttttaatattttgtgaaaatgtggaccggaaagaggtccgatcgatagtattgtcgaaaaaatactcaaaaaatgttacctagaaaaaacaaaaaaattgaaaatttctctgcaaaataacaattagaaaatacaattccaaaattacaatgtaaatgtattaatattgaaagaaataaaagaaagagagtagatattttatcttttcttttctttttcaagttatgaaataaaatcgcgcgttatagtaaaaaataaaatttaaagattttgaatataaaaaatttattcaaattaaaaaaagctttattgaaataaaatgtaatatttatttttttaaagtttatatttaatgcttgtagtaaatactagagaaataatctcgcaattatttaatatgtaaagtcgaagacaagctcgtgaagaagcgtaaaaagcggttgttcatctgggacaataataccaaatttctttagcaaagaaaaaatatgtaaaattaaataacataataaaagcaaaatttctgaaattatgtaaagaactttcaggcgacgaagacttgccgtacaaatatcttcccaacttcaacacgtctaaggattggattggggatgactgtccggagggcatcgtaatctacgcgtttgaaagaaaatttaaaaataatatagaaaaataaa

SEQ ID NO: 84265 - DNA, 1308 bp, Heterodera glycines
  Genomic contig location: Contig_ID=SeqID_19533; Location=13..1320; Strand=-
  SCN-specific regions: Sequence locations=1-434,456-540,576-935,957 -1204,1234-1308
atgacgaatcgctccttattttttaccctttttattgccattatttggctgtgctttgaatgcgcaaatggcactggcaaagtgccaaaaaacattgacgagccttcttcagatgcaggtaaaaacagtttttttgaaatgataacataatcatcaaagacaaacgagacactgcaaatgaggaaaagcatcagcaggaagagacaaaaatggaaattggaaatactgtatggatgctcgaattttatttaagttttgtagaaagatagagcctgacgagacgctatcagtggaaaatttagctgaaatttttaaacaattttatacaggaatagccaattttttgtaaatgggttctaaccatatttaagcaaatgtccgacactaacagcaaagaaggcaaacaaataatcaatgccaatgaggaaaatcagaacaaagatgccaaaactgaaattggaaaaacggtagggatactcgggatccccagttcccgaattgggatatttttcgggggttaatttgagagaaacttgcgatttataaaaatgttttttctttcctttgccaaaaaagaatattgtattggcacctatttcccaatttttagcacctattttgggggtttttttttagataaacctgactattttggcagtttttagcacttataagccctggttatgaatttttaatggaataccggtaccttttttcaataccggcggtaccagtactaaccggtactaaagaatatagtgcgacattttgaacaaagcctggacctggattccgtgttggacctaaaaatccagatttgttatggctggatccagcctgagctttctccaggaaatccagattttcggtgcctaagaagtaaaattcaaattttgggtttttgccaccgaatttgccaaagggacggccaaggcaaattttttaaaatatattttctttctctgctgatcggtaatgaatttgatttttgattttttgttgttgttttttcctaggtcataaaaaaatttaagagatcttatttgtccttgtttttatggtgtgtgcttttaattcttcgccattattccttattgaaatgtaaaactaattaagattaattatgttttccaacaaaatgtttgggacgccaacgcttgtcacgtgaacctccaaatctccggtgacaatcgtgtgactgtcattaaaaagggaaacaaagaaagtaatttttgttcaaataataattatggccgtacgcttattcaagaaaaatcacaatatattcgcacataaaaatgcaataaa

SEQ ID NO: 84266 - DNA, 258 bp, Heterodera glycines
  Genomic contig location: Contig_ID=SeqID_19534; Location=549..806; Strand=+
  SCN-specific regions: Sequence locations=1-11,42-47,69-221,256-258
atgttccgttttgactcccaaaataaaaaaggggaaaatggtatgacaaatgaatttaatgaaattaagaaaaaaatttcccaaatattagctccctctaataagcccgtggaggtcactgatatcggagttgatgcgttcaagacaatgttggactttatttattccgatgatttgagtggactgaacggagacaatgcaatcaaagtgttttacgctggtaaattttgtggaataaaagtttatttaattaattaa

SEQ ID NO: 84267 - DNA, 1528 bp, Heterodera glycines
  Genomic contig location: Contig_ID=SeqID_19535; Location=1..1528; Strand=-
  SCN-specific regions: Sequence locations=1-20,42-53,90-146,381 -534,556-632,682-784,843-985,1160-1184,1206-1285,1308-1451,1522-1528
atttttatcattttttagatgttttgtaatatattattttctttaagagagggtaatttatttatttttttaattattattctaaatttccccttttcttaattaaaatgatttaaaattcaaaaccttatttgttccattttcactaataattaaattaattattttattaaacatttattttttaatttttatgataattttttcctaatgttaatctaagtttaatctcttatttttattattctaaatttactttcattaattagaactatttaaaattaaatcttactcatttttttctctatcttttcctaattgacaaatgaattatttaatttaaaaaaaaataatttattttttaaatttattttttaaaagtttcattcttttcggtacgcggcaacacggtgctgaacccattcccattcttgaaaccgtgttcaacaccatatgcagcgttggtggtctcgtccagcaatgtgctaatccggcacaactgttttcgcaatcaaaatgccgattttgaaattggtgagaaaaaaaaattctctcgaaacgaagagtttttttttttgttctaaccaaaaaaaagttttcccagttaatagcttttccgaaaaaagtcgcccatttaaaaaaaaaaaatttttttgaagaaatgttttattctgaaaacatttcaataaaatatgttttgcataatccacatcttataaaataggctggaaaacatttttttaaaatcacacatttctaattattttgacaattttaaatttcgaaaaaaataataaataactttctctaatataaaaataatttatttaaatatttaattaggaactgaactgatggaacacgcgaaacgaattgatgcgcgagaaaacaattggggcgatccgcaggcccacaattttatgcatcgaatttttgaccaattcaaccgttactcattggccaccattgaggcatcaaattttccatttaaattaattttattcaattaaataatagtttttcttcaacaaaaaaaaacttttataagaataaataaataccaaaaatatttgttatataattttataatttttttttaaatttttttaaactgcctgaaattaaaaattctaaaattaaaataaaaaattatatttaagatttaagttctcacaaatctaccttatcaaattgagctaaaattaactcaccgcattttatttcaaattaggaggggggaattttccatgaaattgaaaagtaaaaatttttttattttggattccttttccaaaactttttctgatcacagacagcgacggttctgggcccgctggaaaaatgtctttaagccattcattcggatttttttgtctttctgtaagaaatttacccccccccccccaccgatattttggtaaatttgcggttttaggctgtttaagaaagacaaaataataatttttaagatgaaatattttttattaattaatttaaataaagtaaaaaaatataaaaaatgttctat

SEQ ID NO: 84268 - DNA, 716 bp, Heterodera glycines
  Genomic contig location: Contig_ID=SeqID_19537; Location=1374..2089; Strand=+
  SCN-specific regions: Sequence locations=1-109,198-215,244-402,427 -470,532-642,664-716
atgtaccaaatatgtataaaaaccccgaaatatgtaaataggtatgtctaaaaatctcttcctactatttagaacatggagaagccaggaaaaaatatgtatactagtgataataattacttttttacaaaaaacttttaatattacataaagaaaatatttttttttataccaacaaaaaataataattaattatactgaaaaagtatcgcaacaataatataatttaaattaaaaaaaattcaaacttaattgactctaaaaaaatacgcccaaagaaacgaggcagagaagaaagcgattaaacttgtgagtgaacatgattatattcaacaacatttactttaaaacacattcataatctagaactttgaatattttgggattaaaaaaaatgtgaagaaattaaaaagatgattaaaaaattagttgaaaaatattagatttcaattatcattgaaattttcaagaataatttgttaaattaattaaattatttagtgtaattaaacttgaaaataataatttttagcgttccattggccgcaatgtccgaggcgcaaatgtcatataaccgttaatagggcttatatttatatttgctaaaaactttcaaatttaggatgtaaaatgacaaaatttattcaaaaaggtgaaaaattagaccaaatcaatattgagctaaataatttgtaaatcataaattcttgtcaaga

SEQ ID NO: 84269 - DNA, 654 bp, Heterodera glycines
  Genomic contig location: Contig_ID=SeqID_19538; Location=119..772; Strand=-
  SCN-specific regions: Sequence locations=1-58,80-236,258-325,354 -400,422-463,485-654
atgacacattttcaactggcacattttccggtcacggtaagacggcaaaaggggtatcaataatgaatttggtttctgtttggcattgttaagcgggtcgggcgggtaaaagcgccttaacaaagtgacaggcatgccgatgccacgctaagtgataacaaaatttggaaccctaattaaaaaaaggactttgacacaatttagcatgtttaaaatttaaaacaaccgtaggaagaagcagcgagctaatgcttttttcgaaaaatacattcctaaaaatggaaaatttacaatggtctaaaaggaatggaaattgcgtaaccagaaaaaaattaaaaatttattaaatttaacattactttaaaacatttcagcatcttttagatgcattaatgtgaatataaaagcaaaaaagcaaaggatttgttattcattttccttatttgaaaaatttatgaaaatgagaatttacagaaaattaaattgctttaatatttctcgaatatgcccttttggtaaccagacgaattttcttttttgtgaaaatagcacctgacacagaatttatttttttctgaaatatgccctctcgaatatgcacttttatgaatatatttttgtatgccttttcgaatatgcgcatttatgaataaa

SEQ ID NO: 84270 - DNA, 639 bp, Heterodera glycines
  Genomic contig location: Contig_ID=SeqID_19538; Location=1471..2109; Strand=+
  SCN-specific regions: Sequence locations=1-199,223-255,278-324,347 -398,431-508,530-639
atgcgcaaaaaattcttcgcttttacaatttttctgttcatcgttttgcaattaacggatgctgaaatgtcaaacggtaatgttgtttttaacaattaaatgaataagcattaataatctttttacgaaaatggctttaattaaaatgaaaatttttcaaatttttccgaattttataaccgttataatcggacattcacttgatccatttttcataaattttactgtatttccactggagttttttgattggaattataaaaacaaaattttatttgcttttcatggatttcaaaaaatttatgtcgtaatttggtatgttcaagattcaaaattaacattttgttcaattttcaaaatctcttccattttgaaagtatttgatatgtttagagaagaaatatatttttattaattaaaatttttatttcaatttcagaatacaaagaagcgtgcaatgacacatgtgctgctttaccaaagcagacttgcggtcgtggaaggccacaaagtaacagtaactcacagataacttgctactgtaaatggaagaccagcggatgctgtttcggagaagggtgtgtaccacgtgaacaaaccgcagatgaaattacgctttacggtcgcaccggaatatga

SEQ ID NO: 84271 - DNA, 751 bp, Heterodera glycines
  misc_feature (10)..(10): n is a, c, g, or t
  Genomic contig location: Contig_ID=SeqID_19539; Location=58..808; Strand=+
  SCN-specific regions: Sequence locations=1-365,388-751
atgaactgtntagcaattatggacagccacagacagaagcgattgatgtggcgtgatcattttgtgctaatgatgccaaaaaggcataaaaatttgacatttggcatgagaagaagtcaaatttggcaaaaatttaactggccaattcggaaaaagcgcaaaacaaaatattcgtcttcatcttcaacaacgacgacaacacaaattaacggtgctgctcgagcaaattttaaagagcaacggcactttttgagcggaaaacagccgatcagatcggtttggaggcgggcgaaagttgcacttggcatggaagtgagtgaacaaatcaattttaactactttttttaatgttttaattaacttggaattatttttttaaattttttaccagttttgggaataataatataaaaacggatttatttaagcgcaatagtgaagtgttggtgaaacagttacacgtaaggacgacagcgggtgtttttgttgcgattcgacgcccaattcgcccgcctccgccgccgccaattttcgccgacaaatttccccatgcttttacctatgccggtggaaggtgggtgatgggaggcactgttaaaataccaaaaaattttgaagattttaaattatgctttttctgtgtacctattagcaagggtgtctggcaactccaaagtaaaatgtgaacccgaaattccggaaatgggtcatttgggtgccaatgttttggcaacaaactaaaaatttaaaa

SEQ ID NO: 84272 - DNA, 646 bp, Heterodera glycines
  Genomic contig location: Contig_ID=SeqID_19541; Location=298..943; Strand=-
  SCN-specific regions: Sequence locations=1-33,55-126,149-513,535-646
atgccttttggcatgattatcgccggaccatcagggagtgggaaaagcacatttttaataagatttattgctgaatcttcggagttaattagttctagacctgcttcactgctttatgcatttggtgaaatgtcaagtattgttccaacactccaaaaatgcggtgtgaatgtgtacccgggagtgccccctgaggatttgattaaccgtctaccaaaaccattattgtttattcaatttggacccacatcaatttcctggatcacattggattgctttatttgtttatggaaacactccaaaaatgcggtgtgaatgtgtacccgggagtgccccctgaggatttgattaaccgtctaccaaaaccattattgtttattcttgacgatcttttgctttcgatcgatgaatcatatcttagtgctctattcaccaaaaagtctcaccatcagaattgaattttgcagttgtttttgtcacccaaaatttgtttaaacgaagaattaaagttgcgagacaaaatgtccaatatttggtgttaatgcgagctccaaattccgcattggcgattcggaacattggagttcaactttttccagggaaattggattatttcctttcggcctaccgtattgcgaccaataaa

SEQ ID NO: 84273 - DNA, 1297 bp, Heterodera glycines
  Genomic contig location: Contig_ID=SeqID_19541; Location=118..1414; Strand=+
  SCN-specific regions: Sequence locations=1-32,67-70,102-292,314 -678,701-772,794-825,848-949,994-1006,1028-1297
gcaagtaaacgaataaaatcaaaatttttatgtactattgctccaattttacaaaaggccattttttggaatgaaaatgatcttttttccttcttcttcatcgtctttaaatatcccactccttagtcgcaacagggggttagaagcagcgtgcatatcaacgaggagataaccatacggtttattggtcgcaatacggtaggccgaaaggaaataatccaatttccctggaaaaagttgaactccaatgttccgaatcgccaatgcggaatttggagctcgcattaacaccaaatattggacattttgtctcgcaactttaattcttcgtttaaacaaattttgggtgacaaaaacaactgcaaaattcaattctgatggtgagactttttggtgaatagagcactaagatatgattcatcgatcgaaagcaaaagatcgtcaagaataaacaataatggttttggtagacggttaatcaaatcctcagggggcactcccgggtacacattcacaccgcatttttggagtgtttccataaacaaataaagcaatccaatgtgatccaggaaattgatgtgggtccaaattgaataaacaataatggttttggtagacggttaatcaaatcctcagggggcactcccgggtacacattcacaccgcatttttggagtgttggaacaatacttgacatttcaccaaatgcataaagcagtgaagcaggtctagaactaattaactccgaagattcagcaataaatcttattaaaaatgtgcttttcccactccctgatggtccggcgataatcatgccaaaaggcatttttaatttaatttctttattggaataaaattgattaccaatcatattgaattttaacacaacacaacgaatttaataacttaaatagttttttttattctttacgactaattgacgcaatggctgctgcttcttcatcttctgcttccttcttcccctttttcttcggcaaattctggaatgtctttcttttgttggtttgagtttggttcgtctttcttctgttcaccactcattcccatcgtcgctgcagaaatcggtgaaaagaaatcggaggcttttggctggtgctgtcttggttttggtttgggcttgaggtggtccccactaattcccatagtagctgcagaaatcggagaaaagaaatccgaagcgcttggcaagtgttgtcttagtttcggtttgggcttcaggtggtcgccactaattcccatagtagctgccgaaatcggagaaaagaaatcggaggca

SEQ ID NO: 84274 - DNA, 486 bp, Heterodera glycines
  Genomic contig location: Contig_ID=SeqID_19541; Location=1078..1563; Strand=-
  SCN-specific regions: Sequence locations=1-81,103-419,441-455
tctatcacggcagctactacaggattggatgttcctcaaaagaagcatggagaagcaaatgaattttttgatgctcttacggcagcaacaacgggaatggaagtcgacgaaaacaaggtgaaaaaagcgcttccacaaccgcagagtaatgcctccgatttcttttctccgatttcggcagctactatgggaattagtggcgaccacctgaagcccaaaccgaaactaagacaacacttgccaagcgcttcggatttcttttctccgatttctgcagctactatgggaattagtggggaccacctcaagcccaaaccaaaaccaagacagcaccagccaaaagcctccgatttcttttcaccgatttctgcagcgacgatgggaatgagtggtgaacagaagaaagacgaaccaaactcaaaccaacaaaagaaagacattccagaatttgccgaagaaaaaggggaagaaggaagcagaagatga

SEQ ID NO: 84275 - DNA, 918 bp, Heterodera glycines
  Genomic contig location: Contig_ID=SeqID_19542; Location=86..1003; Strand=-
  SCN-specific regions: Sequence locations=1-283,305-918
atgagcattaattataacgataaaaaatttatcatggacaacattttgccggctgtagagatcagtcatacgaccaatggcattacactgatcagcgagaggattgcggtgcctcgaacaattccatttgacatcgttggcaagtgtcgagagtgcaaggccactgagtgcgagacggaatggtgcatttcaaaagaaggagtaacaatttggtgttctcgtttcaaaattagtcctcgattcgtgccatttgactatgtttatgagttgccgggctatacatttttcaaggttttaaaatattatatgccttttctttaaaataatattcagattcgtaacaaaggtcgagtttttaatgtcgaccacggtttccgctccaatgtttgtactcagaccgagactcccgtctacaatttaccgcccccaccgcctccgcctcaactaaagccaaagggaaatgagcaaggaacggaagagcaaactacacaaaaattttttgagtctatcacggcagctactacaggattggatgttcctcaaaagaagcatggagaagcaaatgaattttttgatgctcttacggcagcaacaacaggaatggaagcagatttttccaccgggcttaatgattcgctccaattgaatcagcacccgcttccgcttccatccgacatttttgtcacattaaatggtggaaaatatttcacaaagattgatttgtcggatgcgtatcttcaaattgaattagaagaaaattcgaagaagctgtgcactattgctacactccgcgtgcattaccaatacgaacgtcttcccttctgcgtcaaatcagcccctggcatatttcagtcaataatggacaacatgttgtcatatctgccattcgcattggcatatttggatgatctgatcatt

SEQ ID NO: 84276 - DNA, 267 bp, Heterodera glycines
  misc_feature (41)..(41): n is a, c, g, or t
  Genomic contig location: Contig_ID=SeqID_19543; Location=1..267; Strand=+
  SCN-specific regions: Sequence locations=1-116,150-267
aagacgaccaacgaaaaacgtggccgaaattgcacctttcncaagcgggtctctgctcagcccgtcgtcgccgcctcttccgctgccattggcacttccgccgcaaatgcgcccaatttggaaaggaaataaaaacatggaaattggggcggagagagaagggaaatgcgaacggagcaacaaaaagattggattattattttgttttccctgttgctcttaattgtatggacacacacaaattgttgctgtttttattttgtttcg

SEQ ID NO: 84277 - DNA, 1626 bp, Heterodera glycines
  misc_feature (1505)..(1505): n is a, c, g, or t
  Genomic contig location: Contig_ID=SeqID_19543; Location=747..2372; Strand=+
  SCN-specific regions: Sequence locations=1-141,163-505,527-820,895 -905,931-1061,1083-1221,1243-1626
ctaaaaaattttaaaatcagttttttggcaaaatgccgtcgtcggctgtccaacaacagcccaagtcgctggtgcaacaatactcccaaattgtcgccgccgtttcttcctattgggtctgctccattggccttgtgttcctcaacaaacacttgctgagcagtcccgatctgaaggtgccgtaggtgtcactgactgatcaatctgtgccattggccatgtgtgttctttctatctggtcacttttttgatcgggtattatcggtgccgttctgtctgatcactttccttgatcgggtgaacatgatcggtgccattgccatgtgccgttctctctgatattttttgacctggtgatcatcgatgccattcggcatgtgccgctctgtcctccgatcactttcgatcgttctcccgtttacctcaatatgcctctttctgtccgttcagttgaatgcgcctctgttcgtcacgtggtatcagtgtctgacttcgctggatttctgtctgttctgctctctcctctccaaatggttccctcgtctgatcaatttccccgacatgtctcttgaccttcgcttgtcccgggaagtccgttcgtccccttttttctgtcttcccaatgatcattgattttccttaaggttttgcctttgtccatcgttttcgtcgcaatgatcagtttcaacaatttgtgcctcaaatatgtcggcgtgtctttttattatgtaggacggtctctatctacagtgtttaatgtggtaagtaagcactctttatttttgctataaataaacgaaataattcctgtgcaatgtgagcaccgttggttcaatggtagaatgctcgcttcccaagcgagtgacgcgggttcgattcccgcacggtgcatcaactttttttccatttaaataattatttttatttttactaatttcccagatttgttcctacctcattctcggccagtccacctccaaaccggctttactctgttgtatgatgattattgccggcttttttctcggagttgaccaagaagatgtcgcgggtgaattcttcaccattttgtgctaaaattgtttacccaaacttttcctaattgcttttcgttaattggacatatttaattagcgtcccaaattcgttataattggcacatatgtctttaagactccggtgcctttttcccccttcgaatgcgcttttaaatgcccaatttcccctccctcccccaggcactctgtccgtcattggcgtcgtctatggcgttttggcgtccctttgcgttgcgctgaatgccattttcaccaagaaaacgctgcccaccgtcgctgactccatctggcggttgacaatgtacaacaacttgaacgcgtgccttctcttccttccgctgatgcttgttgccggcgaatttggcgaagtgccctactcgccgcacattgtcaagctgaacttttggggcatgatgacattgagcggcttctttggcttcatcatgngctatgtgaccggtgggcaccagtgccgttgtcattcaatggcaaaccaaaatggctaaacagaagcattcaggatggcaatccaagtgactcggcctgacgcacacatcagcggcacgca

SEQ ID NO: 84278 - DNA, 57 bp, Heterodera glycines; identical to SEQ ID NO: 78091
  Genomic contig location: Contig_ID=SeqID_3338; Location=402..458; Strand=+
  SCN-specific regions: Sequence locations=36-57

SEQ ID NO: 84279 - DNA, 589 bp, Heterodera glycines
  Genomic contig location: Contig_ID=SeqID_3339; Location=826..1414; Strand=-
  SCN-specific regions: Sequence locations=1-100,145-159,182-346,368-589
gatttttgtgaaaagtttgcctcgttggaattgaattcatcgcagcaactgtccatgattggggaactcagagcagataatgtgagtttaactgtaacacttaaatttaaaaataatgataaataatatttaaatgaatttattcataaaagatggaatgttttttaaaaaagccttttttcagaacaatcttcaagcagaattcgaaaaacaaaagcagatgacctctgaacatcttgtcatgctacaggccgagcttttcgtgctgcagaataaacaagaagaggacgagaaggaaaatgagaaaaacggtaccaaaactttggaatactgtagttcgcgcaattcttttgaaaaggattaaaatcctaataatcacaatctgtctcattaagcattgattggccagctttcaaggttgcaaaacgaacaaattgtacttttgggacggatcggtgaattggagaaacagcaaaaagaaaaggacgaacagcagcagagacaatacggtgggaaaattatgagagatcggcctggaccttggagcctagcttggattttccttgatccatgtgtggattttccttga

SEQ ID NO: 84280 - DNA, 1321 bp, Heterodera glycines
  Genomic contig location: Contig_ID=SeqID_3340; Location=71..1391; Strand=-
  SCN-specific regions: Sequence locations=1-283,332-394,416-680,702 -751,773-918,958-1321
atgcacgcaaaattgaagcagtccaaaaattttacaagaaaagcattcaaaaaagtggccttgttcccatgccgtatgaagaaaggttaaatatttatatttttctgactgctcgaaagttcagtctttaggcgtgcattttcacctctcgtcccaaaaaacgagaggtgagaggcgagagtcccaaaaatggcgagagttggcgaaagacgagaggcgagggttgtcccacccctgatatgtatgtacatttcatttatttcaattgattttggcaacaaagttaattaaaactttttaaataatatacaaaataattaacaatttttttgttgactttgcaagaaaaaattcattcggcaaagctattttttggtctttggtccgcgagtgaccctctctctctgcccatctgtctgatggtcactcactcactttcttccgctatttcttcagctgcattccctcgccctatgtccattccaattttcaatcaatgggcttttatctgtctctcctcctccaattagcacattaattgagaatattcattataatttgataccacggatactatgttaaatttataacacacatcttaaaaaattcaaaaactttcgtacaattaaaaaaacacttaaattttacaggaaaaccgattgaattcaattcactcaaaagttttgaaataaaatgcaaaattcgaccaaagacccagcagcagaaggtaaacaaagtagaaaatggacacaaatgtaaatatttttatggaaaatcaaaaaaatatatttaagtttaaaggaaattctgccgatgtgatttgtttgggtcagaatgagggggccaccaatgctgaatcatcatcagccagtgatccgcaacagcaaaacattttgaaggttcgattccccccggggccaattgctttttcctttaaattaaaaaatctctgaatttatgaagcaaaatcatttgcttatcttttattatcgaaatcataaaaaagatggcttattttctattttatttaatttaaccttaaattctctaattatttttttatttagccaaaattttgttgttttttttttggtaaactgtgatcaaatctcaccacttgtattccaaaacatttctcaggcggtgcctattggcggagtgaccatggggcgaccctcaaatttaagaaacaaaaaattgcggctaaaatattttatttagtaaactattcgtttaatcgtttcctgaaactaattattgcactaaataggggcgtggattactgttacaaggggggggggagtattattagctcaataaa

SEQ ID NO: 84281 - DNA, 708 bp, Heterodera glycines
  Genomic contig location: Contig_ID=SeqID_3341; Location=545..1252; Strand=-
  SCN-specific regions: Sequence locations=1-298,322-364,386-425,447-708
atgcgccgtaaaaaattatgcgaaaagcaacatattaagaacttggtaaaaatattattttttgcgtgtttattaatttatttaattcggtactgtgggcttattcttgttttcgaaccctcggtgtcccattattaacggatttagggctaaaatttcaagtcgtccatttttaacccatactaaaagcaataaatgttaagtttttatatttttgactctgaatcctgatcctgatttttcccaaaaacgatccgtactactttatgcacctttccttttaacactgataaatgaattttttgattacattcattctaaatgttatgtttagaccatcaaacgcctccatgaggaggtgtactccaatgtacaagaagatgcagctggagtctaccgcgtaactgacgtttacgtgggaactgaaccggttgatgtactgcccgaggacatagaagaaagaatggccgaatttgttgcgtggctgaatgaaaggagacggtggaggacatcaacttggtggcagcggaggcacatttgaagcttgtaaggggacaggggcgcagtggtggaaggatttcattaaaatacatgggtggacaaaggccatagtgagacaaggggagggtcgagtccatagtcagctatatgctttttctcttttgagccccaaagaaatgaaaatttcgaaaaaaaattgtaaataaa

SEQ ID NO: 84282 - DNA, 901 bp, Heterodera glycines
  Genomic contig location: Contig_ID=SeqID_3341; Location=1360..2260; Strand=+
  SCN-specific regions: Sequence locations=1-124,153-225,247-356,378 -661,685-699,723-724,746-749,777-901
atgacaaaggtggcaggtgtcaattttttggtaacagtaataaggtgaagcgcggtccagcgggctataggcaccaacgggaaaattttcacaattttcgggtgaaatttgcgattcaaatggcttaatttaattgaaatttatttaaaaatctttcggaaaatatttggcattctatccttgaaattttcaaaaaatgcatgcgagtcccgtgggatcacgcacaaaaaatcaaattttggatttcgctgtgggattagaacaaaataaaaagagtaaaaaaattttagtgcggatttcgaaattagtcgaaacaatgatatattcgtgatcagcgtcccacgtaaacggtagtctttatataaaaccatcaaaaagggcgttgtataaaaaagattaaatgaaaattttcaacaaaaaactacccaccataatttttgtcaaagtcaaccaaattaaactcttgatatcatcgataaccctatagagagagtactctattagctcacctaaattaaaaaaaaattcgtcaagtttgaacacaattatggccaaaagtacgccaggaactaggttttcaaaagtttttggtcattaattttttgaacttgacataatttttaaattttgcaggctagttgaaacctatgttaaagaatgatattcagaaattactttattctaaagaatgtttggagtcagaatttttgatgagcaaaattattttatgtctactgaaaaaattttcgttataaatattttagatattttattttcttgatattattcgatagctcttattgttttcaaatagtttgctaaatttaaaaaaagttatgaccaaaaatgtctgaaaccctgtttcattgagtacttttggtcataactttgttcaacctta

SEQ ID NO: 84283 - DNA, 1095 bp, Heterodera glycines
  Genomic contig location: Contig_ID=SeqID_19551; Location=769..1863; Strand=-
  SCN-specific regions: Sequence locations=1-758,797-799,824-1095
atggctcaacaaatttggcccatttttgcgccaaacattcgccatttggaattttccaaaatcgaatatcgggacaatttgcttcgcctcatttcatcaacaattcagttcaatcccaatctgagttcaatttatgccggtggtcagttctccgacatgtttgctgatgatggtgggacagatggaaaaattggcaaagcgttgtccaaatggttgcacattccgtccaccgatggtcgccctaaacgattgacatgcggaatgagttgttatagcaaaggaccaccaccaaacttcgaatggatcaacaaattgaaaaaggtcggcaaaatctccgtagtaaacatttttgtcgtggacaaaaattgcctttgaacaagtttataagcagtttttttattttatagttttttgactaatgactaggatttatacatattaggctctaaaaattgcaaaacaggtaggctttaggctctaaaaatccataaaatagtcattaaaaatggaaaataattctaaaaagcctgaaatttaaggagtaaatgaaaacatttttattcaaatagcagcagaaataagccaaaccagtattgagaaacatatgttaaaatcaaaaaattcttgtcatgaaaaataaataaattttgagatgaattttcgagaaatttttcatttcttaggattgggggagggatgagtcggcgtacggcttgcacatgtacatttatgaccggtacatgcagaagcaaaaggccaatgggtgacgtgtcatttatcctttgattcattaggcatttctccgtgccacctcttctgccaattacattattaaaattcaacttcgcgcattggcaccaattgtgccgtttgaagtggtgaatgaaagaacccaagaaaagctggcagtgaaaaaagaacgcgaatttggctgtgtgaatgattgggtgttgaagcgaagcccaattggggagacggatcagcataaagatgaggaagatttaagcaatttgaacggaatcgtctttcaattgtacggttccaattgcattggctgagtagcagcaacgctttatgattaatcacgcgaataaa

SEQ ID NO: 84284 - DNA, 818 bp, Heterodera glycines
  Genomic contig location: Contig_ID=SeqID_19553; Location=1271..2088; Strand=+
  SCN-specific regions: Sequence locations=1-102,124-666,688-793,815-818
atggacattttcaccaattatattgttgttgaagaaaaaacatttaccatttggaacaaaaattcatatttccaagactgtactcaattcgcaacactgtaacttttttgaattttattttgactgaattaagccccatttaaaaactccaatatgattaatttattttagtagtttcaaagttgatgcaaacactttttcattggtaatcaaggacaatggcaatgccaatcagtcgacggaagtgccattggcacaaattaccatttggggttggagtaacaagggggagcaggaggcaaaagaggtgagtgagtgcttaatgatcattgattgatcaataattcctccggcaaaaattaattatgtgaaaatgatgatgccaggagggtggctatattacagtttatggtcatattttatatcttcttacttgatcaatgcctaggttcttagtttcaaacgaaagcttgaagtctagagttttataaccaaattatactttttgctcttttcttgtatttagagattgccaagactttaatctttcgttgatacaaagaatatatgattgatttttgtatgaattacatattttataaaaatttgaataatacaattctctattatttccccaggtgaaaattctgaacattggagggaaggcaaattttggcaacattgggtgctcaaatggttctcagcagatggctaccattatcatcagaattctcaaaaagcgcgagaagaccgacacaaagtgagctttatgaaaatttaggaattaatcgattttttaaatttttcttatttctaaa

SEQ ID NO: 84285 - DNA, 692 bp, Heterodera glycines
  Genomic contig location: Contig_ID=SeqID_19554; Location=430..1121; Strand=-
  SCN-specific regions: Sequence locations=1-192,214-692
atgcattccaaaacagcacttaattgcttgctcatttggggtaagtactgacctccccattaattaaactcaattaaactgccgtcaatgttacagcattggcatttatcgttgttggctttgtccaagtgactgtgcagcagccgccgaacgaacagcagcgggaggaggacaaaggcatcttcgagaaaagcaaggacactctgtcgaacgcggcggaaggcacgaaggattggctggtgggggcgaaggactcggtaaggcggggaggggtactgtagcaccgaattctgtaagaacaaagagaaaaaagttggaagagtgattttgtaggttgccgatacgttttcttctgcgaaggaaacggcgactgacaaagccacggaaactaaggacaaagcggtgatttttttaggaaattctattattatttaaaaccggaattatataaccattagtccgattacgccgaatcagcgcgcgaaaaagcgtcggaagggtacgaaggcgcgaagcagggggcacaagagcgatatgagagcgcaaaggaatacggaaaagagaagacggaacagttgaaggagggcgggagaaaagtggcgggagaggccgaccggtgggcacacaattagcactaattggtcaattaggtaattgtaaagtaatttcagaaagactgagatctaaataaa

SEQ ID NO: 84286 - DNA, 617 bp, Heterodera glycines
  Genomic contig location: Contig_ID=SeqID_19556; Location=400..1016; Strand=+
  SCN-specific regions: Sequence locations=1-114,197-214,236-276,362 -449,509-563,586-617
atgccaaacatagaagttgagtttgccaaaacttgtttggcctcatttgtggcgatatgtgggatggccaaaaggaaaatttatggatggcttaagggttcgtaaagtaaaatcatattttaaatttaataatttttacataaaaagaaataaatgttgtaaaaattgaaaatagtttttaaaatttcttttttttcaggtaaaacaatgtgcaattactctttttaaaatgtgatgccatgcaagaaagtttaatgaaatataaacatcatacagaattaataatattaaaaatcatattgaatcttttttatttttatactcattgtttatttattaataattaattaattattattatgttttgttgtaatgatttttcactgcttttttatgttactcaattttcgtgttcttttcatttagttacatcacttcgttatgttttgttaattattttttattcctttttttaaattaattactacattatttgttaattttaaaagtaaaaagagccagaggcaattaattatccatattgatgttttattaaatttaagattcaaatatataagcttatttcaaagttgattcggtgaattaatatttttgca

SEQ ID NO: 84287 - DNA, 639 bp, Heterodera glycines
  Genomic contig location: Contig_ID=SeqID_19558; Location=790..1428; Strand=-
  SCN-specific regions: Sequence locations=1-410,441-478,500-526,549 -550,579-603
atggatggaggagtaaggttcggttcccacacgaagcgcctactaacattttgcctattttatttttcggatattaattcagcattcatttattcgtttgtccacttttttcagtgccaaattacattgtgcctaaagttggacaatggctgcgctggcataacaccgccaaagtgtgccgcaactgtgccacggcacaccgtcaccgagcagtacaccactcgaagacgcaagtcgaaaaggcagcgaaaggtgcgcagcgttgcacaagcacagcaaaacgaaagtggccaagttattggagatgaacaaaatggtggcacgaaggtggacgtgttcacaagaccaattatggtcggttttatgcaaattttaggcaatataatttattaattaagggataatatagcaaataatgaaactttttagaattcattaatatttagtgaacatataagcattaatttttttggcgatgaattagattaaaaaatgaaattaagcacaaagattaattagcgaaaagaaatttttgagattttaaatttccaaaaaatcaaaatttaaaaaatataaatgaaaaacctcttttcggtataatcgaaaaaatgaaaatatataacaaatttaaaaaataaa

SEQ ID NO: 84288 - DNA, 842 bp, Heterodera glycines
  Genomic contig location: Contig_ID=SeqID_358; Location=405..1246; Strand=+
  SCN-specific regions: Sequence locations=1-13,40-41,66-220,242 -345,414-842
atgaaaaggtaagataaataatatttttaattttatataccaaatttaacagagaaatattaaaagtgaatgattattaataaaattgttatattcctttatttatactttttcagtttaattaccttcggattcgctgttaaacagcagaacaaattcgatggaataattcttagccacaagggcacttattcatattataatcgtggcgatatttggattaacggaaaaggaaagggaagaaatggcaaatattcctacggtgttggcgataccgtaggaattggtgtcaatacggccactcgacagatctttttcactaaaaatggacttcgtttgggttggtaaataaataattaatttaagaattttaaatataatttttatttaattaatttttgtatttaaattatcaaaatcccataactttttcacagattcctctgaatttttcgttgctcaatcttttgctgatgattcatttcatccatttgtttctatttggcattatggtggccaagatcaaattgaggcaaattttgggcccaatttcaaattcgatttggcaactctctgaggaagaaatattcaccaaagctgatcaatctgttctttttactgatcaatttgttcgtttaatcttttttttaagagtattcttggaatcagggaatataaatatcggtatgtacatgtgtatgaggtagagaattgatgactttgaaatagggttcggtccggtgggaaaaatattggaaatttcaattgaatagtaaataagttagaatcaaaaattttactcattttaaaaaaaatttcatttcgacgcgtcgtggttatta

SEQ ID NO: 84289 - DNA, 6798 bp, Heterodera glycines
  Genomic contig location: Contig_ID=SeqID_358; Location=2597..9394; Strand=-
  SCN-specific regions: Sequence locations=1-242,264-1189,1212 -2081,2103-2279,2301-2637,2659-2961,2983-3209,3231-4026,4049 -4275,4301-5720,5742-6798
atggaaaacagtcgtcggtatatgacacgacaggagttgcgtcgtctgttagacaatggagttgcagtcgaaattgaggacaacgagataaacgtcgcacatcagcaaggattgcggacgaattggacggattatgcggcggagaacttcgaagcgtcgcggaattttcaaccggccgccgtttttctggaaaatcatcagcgcgaaatagcttttagctcacttcgggtcccaattcgaacttcaagtcccaataatcagaaccgggaccccgttgcaccaccggctcagaattttgttctccaaaacatgctccctcgccgtttagacaacgacactctttcattagcgggagaggaggtggagttggaccagcacaacgagaacgaactgcttggacttccgttggatggccgtggccggactgattcaatgttggaacaccaagtgtccgccattcacccaagaggttatattcggctaaatgaattgagagaaaatattcaacaaaacgaaccgagacacaaattgcctatgcctcacgcatacattcccaggcaacaacccccgcagcaaaattttggtcgcgaaattcagtacgggactcaaaacccgttcaatcaaaacgcgcttaaccctatgcattaccaagcggtaccggttgttagcagactggaaatggcactcattttggacagaattccggacctcacgggaagggaaggtgctgataaaattcgagcattttttcggaaatttgatatcagtaccgatgaatggactgaccaacagcgcctgcgtgctttgcaatcaaaaattgagggaaaggcagagagagcctttaactcagcgcttgcatcagaaaagataagtgcgcgcttggttcttcgggaaccaaaataccaaaaaatacgggcggaaatgataagaattttggaagagcttgacgccaaagaaattacggcatttgaccaattgttttcggggcttaagcgaaagccagtagaaccgatcgatcagtttgcagacagagtatcaagcgttgtaaggcgtgcctacccaggcctagacgaacagctaatcaatgattatgctatcaaacattttctgcgggccctagacgaccccgatattgcaatgtcattagaattgactcgtagtcaaggaatggacttcgatcaattcgttacaatggctgcgcgtgctgaggcgacgcgaaaagcggtgagaagctgtaacagaggacagaacatccgaacttttccaacattttctggacaagtacacgaaccacaatcaaattatcctcaacagcgacaagtccttacctgctataattgcaaccgaattggtcatgtttcacgtgagtgtcgagaaccgagacgcaacaaccaaacttttaacaatccgtccaataaatttgttcgagaaaccaacggagactctcaaatgccgaaccgaaactacaataccccccggttcccagcacaaccaaattttggcaatagtcagagaaactttttcaacaatgctcaaacgcaaaaagaagtcacaaaatcggctaattgcatacagcttgagaatgcaccggttgttaacaaccttgtggcctgtgtgaatgtgaatcaggaattggaaaaattgaaaattttgagtgtgagtgaagggcgtaaaaaagaattgtcttcaccaccagcagttggcaaacttgtggtcatggaatttgaagtttgtaaaaagaaggcacaaggaatggtggatggcggtgctcaagtctcgttaatttcggctcaatttttgcatagcctattcaaagacgagtccctcaaaatttccgaaaattgttttggtcattcaaatttgaaagtaagggactttaatggaaaaacaatcgatgtggttggagagattgtacttccaataatgcgagatggaatgcgtcctgttctgataacacttcaagttgctgcgtctgattttggttttgatttgatcatcgggaccaatgctttgaatcagttggggataaagctttttgatgaagtgcatcaaaaattggtgacatttgaaacagcagatactgaaaccaaaaaggaaactgcagttagagtagtgtacaatgtgaaaattcaaccgcgttcatcgacgataattgaagtggcagtaaacgacgagattgacgaacaagatgtattgattgaaggggcatcagaagtgtcggagctgaaaattgaaccgacattagtaatgcctaaatttggaaaagcgaccataccggtcataaatttttcatcacttccaatcgttcttggcgagaatgataaaattggaacaggagttatagtggagaagcaagtcaccgcggaaaattccttaaattgggattgtttgaatcattcagtcaccattagctccattcagtttttgaatgagcttgaagcaaatcatgttaaacaaattgaatctgtttggcgtgagcaagcaaacaccaactgtgcgaacgaaactgatcagttaggaaaactcatcatcgaccactctcaaatttttgctattgatgacaaagatttgactcagactgatttagttacacattatgtggacactaaagacagctcaccggtgaaaatgcgcatgcgttcaattccatatgcatttcgggaaaaagtctcaataatgttgcaagactatttatcccgtggaatcattcgtccttcttggtcaccgtatgcaagtccaatcgttttagttcctaaaaaggatggaacaatcagattttgcaccgattatcgcgcactaaatgcggtcaccgttaaagattcatttccacttccgaacattgacaacactttaatgatgttgggcaacaaaaaagtctttagcaccatggactttatgagtggctattggcagattcggatgcacccggattccatcgaaaaatcggcgtttacgactgaatttggattatttgagtatttggttatgccattcggaatgacaaatgcagtggcaacctttcaaaggttcatgaatcgactttttgaaggtgttttgaacgattttgtctttgtttacgtcgacgacattttggtggcaagtgaaaacttcgaacaacatttggaacaccttaaaattgttttcgaaagaatacaaaaagctggtttgaaattaaaaatcacaaagtgtcactttgttgcggaagaaattcagtttctgggacacattttaactcggcaaggcattaaaaaagatatggacaagatccggccgatttttgaatatgcggtaccaaaaacgcaaaaggaattgcattccttcctcggttttatgacatattatcgaaagttcatacattcgtttggaaagctggccgcacctttgtttcgtctgctgaaaaaagacaccaagttctgttttggagaaaaagagttggaagcatttaaaattttgaaagagaagattacagaaaatgtcgttttgtatttcccggattttaacgcggcgcaaaaaattccggaaagaatgtttatcatcatgacggatgcgagtaaagtgggaatttcggcgattttgagtcagccggatgaaaaccaaagaattcgtccgatttattttgcgtcacgccaatgcaattcggctgagagtcggtattctccaactgaattagaagcattagcagttcgttttggagttaataaattcgcacaatttattaccatgattccaacaaaagtgttaactgaccataaagcgcttattcccatgtttaaaacaaataaggaaacggggaacagtcgcgtcgacaaatggataatggaacttcgttctcgattcattcttcaagtggagtacaatccaggaaaaagtaacgtggtcgctgatgttttgtcaagaaatttcccgagaaacgaaagtttatcaatagaagaggaattagaaaatgttgctttactaaaatcagcattagttacagtaatcgaaaatgagacagaaaatggaaataatgaaatttgtgccgacgaaatggagtggaaagagaaaattatggaaagcgaatttggccaattaattgaatttttggaacaccgaattctccccgaagacccgaggaaagtacaacaaattttggcccaagcttcatttttcaccttcataaaaaataagcttttttactgcgacgaaaaaactggaaagttacgtttattcgtgccagaggaatttcgaaaaaagttgattgatcaaagacacgctggaatgtgtgcaggccatttcagcgccaaaaaattatttttacaaatgtctgaacatttcttttggccaaacatgcgagcagattgctcaaaagtagctctggactgtcgtatttgcgcctacacacgagaaccacgcgccaatcaaccgggaatccaaatggttagaacaaatgaaccattagaattagtgtgtttggatgtgcttaatatcggtcgaagtcgcgcaaaaaatcgatatatattagtttgcgttgaccatttttcaaaatggacagtggcagagccaatcccggataaatcggctgaaacaatagcacgggcatttgttgaaaatttcattcttatttatggggcaccaaaaagaattcattctgacagagggaaagagttcgttaattcgacattggagggaatcgccaaaattctgaaaacagggaccagcacaacctcaggctacgaccctcaatccaatggccttgttgaaagaatgaatcagactattttgaaattgcttaaaaggacgactccgtcatcttgggattgggatttgaaactcccattcgtcatttttgcaataaatgttacaccatcagtaacaacgggtttttctccctactctttaatgtttggaagagttgtgaattttccgacggatgagaacatcaaatttgaagaggacccacgttatactgtggaccaggaaacttatctccaagcttttaatgaaaatctgatggaaatcatgggacatgcacgcaaaaacgctgaaattgcacgcgaaaaaagcaaattggaatttaattcccgcccaaacgtgacgcgcgaaaaatttaagccgggggacagagttatgattgtcgtccattcaacgaaagcacaagcctcacaccgaaaattagcttggaaccattttgggccttaccaaatcattgaaatgaccggaagttcagctaaagtggtccctgctgataaattaaaagctgatccaatttctgtgccaatcgaaagaatgattcgtgttccccctgggatcccaaataattcaattttgccaaaaggaaaagccaaatttaagaatttaattggcttaatttgtgtctcggaagaaatcaaaaatggcgagattaattttgaaaatgagactgataaggaagtggtttattcattagggacaatgaatttttcaggggcggacggaaaagaagcggccaattgcgacgagtactgtcttggcgacggaacttgtttttggaccacaatttgctctggggaaggccatgagcactgcacgcagttggtcgttgccgattttgatgccgtcctaaatcgcaaaatcggaattggcgctaaagaggtgacaacgccgcttcaagcactgttctgtgcatttctgctcaaaaaatttggttcgacaacggcatctcgtcgtttggtggaaacgatcatggatggcacggccggccaggaatttgtgctgtttattggtgcccgtggcgacatggtgccttcggacatgctcccgtccgcagaaaatttgatggaagtgatcgaaatgcgcgttcgcacgtgtcggaaattgtggcgaactctggaggaaagcagctatcagcttctccaaatcgcgccgccaaaactgccattcggagaagaaagccaaactgaacaattggcatggcaagaattctttgcgaaagcgccgtgggcatttgaagtcattcgagcccaactcatccatcgccgacgtttgatcgagaagccaagagttgtgatgggcgattcaaccgccaagcaattggtgaatttcaccgagatgacggccgtcgaaatgctgataagtgaagaagaaggcttggctgggctcgtgcgcaactttgacaatgccgttctctccagcaaagtaaaagcattgctaattgtatgtggacgcgatgcactgctggccaacgagacgatggaaacgatttgcgaatgctttgagcgattgagggccatttgtgagcgctatggtcacgttttcatctactgggccgtgccgccgtacattcactcacgaaaagctcaatttctcgaactcgttcgacgcttggccaaactctgcgacgacactcacattcggttcggagctgtgacggaagaaggaagaagcctcatggaagtgtttcgctatggaggaacaaacgcgggaaatcgagtgaaccagtcgggactcttgactgaacatggagcgaagacaatgatggcatggatttacgaagttgggaaatttcctggtgagaaggaattgggccgcccgcgaccgcgttctgaagttgtgcgacctggtgctagtacttctgaagagcgccgccgtcccaacattagccgcgggtttggtcttgtcgaccaccgtcggcacagcttttctcgtccatctcttcaaacgtctaatcgtgaaggacaccagcaggaatggcgtggacgcgaccgctcggaatgggcttcggcgtcttggcgacgtcgtggttctgatcagtttcgtagctctcgacgtggacaacagtga

SEQ ID NO: 84290 - DNA, 676 bp, Heterodera glycines
  Genomic contig location: Contig_ID=SeqID_359; Location=1463..2138; Strand=-
  SCN-specific regions: Sequence locations=1-19,41-255,277-519,557-676
atgtcaacgaatgacgttaaggaagcggctgcctccactgttcttcctccgtcttcaagtcaaagcatttcaatggcttcttccgcggatgggtcaccgcttagagaggaaaacttcgtacattcattgaaatcgcaggtggacggagaaaacatcgaggaaatcattcaaagccagaaaaaagcgtaaggaaagatttatttctgggtttggaattgaccaaatttgggtcactaaaaattgatacataacatattttataaagaaaaagtttttaggttggaacgttttgagaagaccaacgaaatgctggcgacgtgttcttcgctggcagaaaagcgattggatcgggcgagaaaagactttgccattggaagggaaaagatttgccgagctaaatccgacttggactcaatcttccgacggatcgcctccttcaaacaaacattggccagcaattacccggccgaatttgtcgcagcgcaaagtgatacttttggcatttgcttgcgaccacacaattttttaaaattttccaataaaaaaatattttttagccgattcgcctcacaatcagaatagtgactgcatcaatgaacacaaaaagcaaacggatgactaaatgacgtaatttccgatatttaactcttttagaattatttttttcgaaaataaa

SEQ ID NO: 84291 - DNA, 148 bp, Heterodera glycines
  Genomic contig location: Contig_ID=SeqID_359; Location=1188..1335; Strand=-
  SCN-specific regions: Sequence locations=1-148
cgaggaactcactttttggctgggtcaattttcttcagtgcgctgacagttcattaacacttttttactgaacgatgaaaatcttttaggtttcctgggtcctttgggacaacagaaatcagcagcacaaaaggacttcctccgtgcg

SEQ ID NO: 84292 - DNA, 586 bp, Heterodera glycines
  misc_feature (536)..(536): n is a, c, g, or t
  misc_feature (547)..(547): n is a, c, g, or t
  Genomic contig location: Contig_ID=SeqID_359; Location=3338..3923; Strand=+
  SCN-specific regions: Sequence locations=1-52,79-108,130-263,323 -384,407-442,464-514,536-586
atgcccgggcacaatcctaataaaaatattagagctcggtattttgaaaaaagcctggacctggacctggacctggattccatgttgaacctggacctggatttcctggacaaaaatccaggaaaatccaggtccaggaaaaatccaggctcttcgagacctggatccaggcctggacctggattttttgaaactcatcttaaaaatcaaaaaaaggtttgaaaaaattaattaattgcctagaaacatctaaaaatatctacttaataataataatgtatttttaaattaatttaatctttttttgaaaattaaaaaaaaacatcggtcacttgaaataataaattctaaaattttgtccaggaaaatccaggtttttcgtgttttgcctggacctggacctggatttttttcacattggacctggaacctggatttcctggacaaaaatccaggaaaatccaggttgccgaaaaatgacctgggactgggacctggatccaggaaaaaatcaggccctggatccaggtccaggncgagctctaanaaatatatatgtccttattttttcagttttgttggttga

SEQ ID NO: 84293 - DNA, 79 bp, Heterodera glycines
  Genomic contig location: Contig_ID=SeqID_3343; Location=82..160; Strand=+
  SCN-specific regions: Sequence locations=1-51,73-79
cgtaaagcatccaaatttgtgttgttcggcgcattggccaccggtggcagtgtgttgctgtactcgttggagaatagcg

SEQ ID NO: 84294 - DNA, 462 bp, Heterodera glycines
  Genomic contig location: Contig_ID=SeqID_3344; Location=3699..4160; Strand=-
  SCN-specific regions: Sequence locations=1-462
atggagcgtagaacagaatcacacaaagcgtaagtttaagaattaaatcgatgtgaaccgaaacaataaaaaatgcacgaattcttcagcagcagaaaacgcaccttcatcgtcgtctgttcattctttttcaaattctgaaattaacaccagcagaaagaaggatgttatgcgtgttgttctcggaaaattagacaatttgacgcacgcgacatcaaacaaaaagccaaaaatgttcgaagaggaaattgagtgtgagaagccacaaatggaaggagcattccctgaagccgaggatttccatcagaaagtgaaccttatttccgtttgaaacagttcaaaattgattttgtcacgcaaaaataacaaacacggatatgaaaaacaatactcacaaagcaatctcccaagcaaatgcatttttcattcatcattaatcaggctcattttcttttaaataaa

SEQ ID NO: 84295 - DNA, 1934 bp, Heterodera glycines
  Genomic contig location: Contig_ID=SeqID_3345; Location=1484..3417; Strand=+
  SCN-specific regions: Sequence locations=1-221,243-847,870-1176,1312 -1934
tcgtacgttgaacatcatctgaccctcgacgaacttcgcgacgttcaccccgattcgttcattgacgtaatcagcccggagaagagcgacggactgtccagcgaggaggccaagtcagacacactttttataccgtaccctttcgttacggtaggaagcgccttttggacggaggggcaaatgttctggcgccgcccaagcgcatttccaacttgcagttgtttgccaaacagtttctgtacaagttttggcttctcctgatgggtaattagctttttctcatccctccctaattaattcccattaattgctcattaattatttgtcaggtgccgctctgtgcaccattttcacttatttgatcaatttgtaccacgggacggaagagttgctcaatttgtactgtgccttcattctgatcgtcatcgtcgtggtgatgtcgttcatgtcattttggcaggaacgcaaggccattcaggtgaaaaagagacgaacggaattggaaattcgaaattcaaatgcacaattattctcagattctttatgattttgggcttcacatgccatccaatataagtgccatttattagcaattaatccattcattaatcaactaattatttgttcactttactgctcggtgattcgagactgtgaggagaagagtctgcagccggacaatctcgtcgtgggtgacgtcataatcatacggtaagcggagaagcacagtccgtatacggtggatgaccctgggaggacggacatttcgccattgaaacaaaattaaacaaaatgtaaatgttttttcaaacagatcaggacaacaagtgcctgctgatattcggtaaggcttctctctttatcttaaattatctttcattttgtatataatttaaatttccctaaattgaaattcttaagcattctccagtccacaggggtcaaaattgaatcctccgcaattaccggcgaaccccaacccgtcgactacactcacgaacccgctgctgctcacatttcgctgtttgatgcacggaatgtcgcactgaggggatgttactgtacggaaggagaagctgtgggattggtgatacgagcgggaaagtatacggtgggcaactgtaatcctcctgtctgatcacttctcacttctgctcaccaatttggttttacctctctctttgcattacttttcctgtctctcactttttttgtccgatcattcttttctttctgttcactctttctcttcttttttcctttctgatcacttcttcttctcctctgctgctgatcattccttctcttctcagatgctcggcaatttcactcacctccaatcgaccgttaagctgaccgagactcttctgcagaaggaaattgccaagttcgtgcagttcgtttccatcgtcgccttgtcaatgggtgtcattttctttctgatcggttgcatcgttacaaagttagcagtcatttcgcttttcttactcagtcattgctcaatttttggtttgaaaatgtgctctaccatttcgtcaccggctttctcatcattatgtaaattgatggctaattgaaagaaggcaaacccaaactttcctccttcgacagagttgccaatgtcccccaggggcttccggcgatgctaatctcccaaatggcaatcatcgcaagaagattagccaaaaagaatgtgttcattaagaagttaagttataacagaatgccactaaaaccaaagtaagaagtgatcattttagttggacataatcgacgaattgggcgccgctacggtaaatcaaacacaaactgatcaactgatcagtatcactttcattcacctggaggtgatcgctgccgacaaaacgggcactttgactcagaacttgatgattctgacggacatgtggtcggttctgcacatcaagcattaa

SEQ ID NO: 84296 - DNA, 106 bp, Heterodera glycines; identical to SEQ ID NO: 66704
  Genomic contig location: Contig_ID=SeqID_19562; Location=1181..1286; Strand=+
  SCN-specific regions: Sequence locations=1-106

SEQ ID NO: 84297 - DNA, 693 bp, Heterodera glycines
  Genomic contig location: Contig_ID=SeqID_19563; Location=509..1201; Strand=+
  SCN-specific regions: Sequence locations=1-74,121-140,168-196,291 -434,527-585,607-619,641-693
atgcggcagcaaatgcacaccggcgcagttcgtccatggccgatttgggaggtgcaaaaataaatttgtgattgattaaaatttttaacatttaaaaatatttatgtaaataattttaaacggagaaaatgaatgcttttagcaaattttaaaaacatttttgtaaatttttcaagacttggtaaaacaatgaagcaaaaaaaaaaaattagacattcaaatttattaataaataatgctaaactgtttttatctaatttgaatatttttttaattattaaatttaattactttttcgctcgaatgaaatcggttggccatgcaatgaaaacggcggcggaagatgagttacggtatgaaatcattcgatttgccgcccgaactacagcacatggcattccgatggtaaaaatttattatttttagagaacagcaaaaaaaattaaaattttaaaattaaattttaaatttgaaataaataaaaacttgaaattctaaatttatcaaaatattatagaaaattaaagacaacgttcttaattttctggcaaatttgggcagtattttgaagcaaatttctaaggacaaatcctagttctattaaatgcatacaatcaaagatttaaaagattaaaagatttattaacaaaattttaaggggttcctgaaaagccgagtttaaaatgaatttga

SEQ ID NO: 84298 - DNA, 252 bp, Heterodera glycines
  Genomic contig location: Contig_ID=SeqID_19563; Location=1341..1592; Strand=+
  SCN-specific regions: Sequence locations=1-146,224-252
atgccaccagatggtacgccaaatggatgtggatggccatttctttggcatcggttggcattttttgctacaatgtgcacggggtgctgcaaaaatattggcgcaaggacaaaatcaccactgttcaggtgagaagaatgtaaaagaatatttaaataaatttgacattatttaaaaagtttaaattttatttttttatttataaaattatatttcaatttaaggaatgtgattaaatgtttttgtatttga

SEQ ID NO: 84299 - DNA, 439 bp, Heterodera glycines
  Genomic contig location: Contig_ID=SeqID_19564; Location=171..609; Strand=-
  SCN-specific regions: Sequence locations=1-155,219-303,326-398
atgcgccgactttctgacataaacatggcaaaggattggtaccattggtgtacggtagattacagtagccaatgtcttaaaatgtttaatttatgcacaatgtttataagttgatctaatttctatgtttctgtccttattttcgagtgttgaggattttttaactattttttttttacaaactaattaatttaatcttattaaaaattacaaaatttccaaaaattttccatgcgcccgaaaatttttttatcgaaaaattttacttttagggtcaaaatctcagatttacatttttgcttatttgggaaagaaattgtaaacattgtcatttatcgaataaaaaggaaaacaattaccattacaatctggacacattgattcgatccagcttcttgaaaaaatagtaaaaaaattaattaaaaattatttaaataaa

SEQ ID NO: 84300 - DNA, 460 bp, Heterodera glycines
  Genomic contig location: Contig_ID=SeqID_19564; Location=535..994; Strand=+
  SCN-specific regions: Sequence locations=1-78,114-196,359-460
acattggctactgtaatctaccgtacaccaatggtaccaatcctttgccatgtttatgtcagaaagtcggcgcatctgaattaaaaatatataatttaaatttaattttttaagaacatcaattactgtctgttacgaccggaaagactgaagcgaatttgggaaatccgagggcgcgcaataccagacgaaggtgtttatataaaatacttaaagaattaaattaatcatttaaaaggttaaatattatttagctattatatttaaaataaaatttatttaattgtttatattaaaattcaaatttattttaatgcatttaattaattgagtatttatttttaaataaaaaattataggctcaccgtttcgttctgatttcttggcccaattgaaggatcttggctatgaaaatatgactgatgaagtcgcaattacaacgaaaacgcttgaaaagtga

SEQ ID NO: 84301 - DNA, 1101 bp, Heterodera glycines
  Genomic contig location: Contig_ID=SeqID_19565; Location=2000..3100; Strand=+
  SCN-specific regions: Sequence locations=1-244,266-655,684-1101
atggcagtgcttagcaaattgacaagttcaacagttaccaaaaaggttgttttggcaacacttgtggaaggcattggccgtgcctcgggcgaaggtaaaattacggaaaataattctaagaaataaataaaaaagggataaagataatcaatgaaaatgaatgagaggtgcttttttctataccacgtccaactgatctcgttttttcggctgtgtgtcccgttggtttaaactaaaaaaattgtaaaaaataattttcatttaactgaattatgaacctcacccccccccccccccctacaaaaaaataaattaattaaccaatggaccgccattttcattatttttcccgtactaaaaaatagtataaattgtttatgggccaacaaaactgttgctgattgtgagcatattgaattatttcatatttaaaacaaaacaaagaaaatgggaaataaaaatattttccataaaattttccaaacaattaaccgaaattcctacaatttttcccaaaagtgtgcattgttcggcacggacatggccacgtgttccgtcggcgtcaaggccaaatgacatggaacagggccaaagacaattggtgggttttttgggctgctttcttgggtcatatcggtcagattttatcccggacaaaaatataaaaattaaaataaatatttcccgacggttgttcgaagcccgccatttttctatgcccgaaaaacttgctgaatggctatttttgtccgtttttgggtccaaaactgacttttgaggattttatggtcaaattcaaaacaattaattatttctgaggggaaataatgcgaaacttttgttaagcaaatcctttttaggcacttttacgttgtcggcatcggctttatcccctgcttattgaccattgtcttctgccatgtctattacggtatgtttcgttgttttttttactgtgaaagaatttacgggagtaagattttttgcaaatctgactgtgttttctggcgatttcgatattttaaacaaagcctggattggcccagaaaaaccaaggcttgtcctgacttggatttttgtgaaatttgttttaaaatgcaa

SEQ ID NO: 84302 - DNA, 1592 bp, Heterodera glycines
  Genomic contig location: Contig_ID=SeqID_19568; Location=66..1657; Strand=+
  SCN-specific regions: Sequence locations=1-105,192-255,334-337,360 -397,494-638,660-893,915-1199,1242-1269,1294-1349,1441-1544,1566-1592
atggacgaagcaccgatcagcagtgggacaagaggttttagcagctcgagcagatggtcaggccgacgaaggtcaagcccaagcccatcacagaagggggtccgcttaaataattaattaaaattgttttcatatttaaattaattttttaataattttaaagtttttatatttgaattttcaaaatttatcaaagcattttatatcttacaaataataaaatgtcatgaaataataatattttttctacgaaagttttatttcatttaattttattttttaaaaataatttaattttattttaaaaataatttttattttattttttattttcggcttttttaaaattcagttaaaataaaagatgaagctgactgaccggtggcttaattgaaggaaatatttattattattttgtttttttccttctaaaactttttaacataaaatttaaacaataaaaaaattataaaatttgtgtttatttatttatgctttagtcccgtactgcgttggacggtttagctgcttcgtccgctgcccaatcgcctcagtttgtgtccggcatggtcagctggcgcatgccggtcactgtactgctccaaacattgggcctcctttcctacaaagaggcatagtcttcaaattggctaaatgtggcaaaatttaatttattcctgatcagatcattagctaattaaaagagattcatttaattgattgcttttggtggcattttgatcatcaaatcaattagtcgatcatgcgagttttgatcagaccaattaattcctcgatcaattagcaacagactttttccgattaattttggccttttgctcagacccattagttgataatgccaatgttggtccgacccttaatcccctgaccaatttgcaacagacttatttaaccgattaatttttggccacttctgatcagatcaattggttgaccatgtgaattttgatcacaaacttaattacctgatcatttagccgatcaaagtgatttaattttgctctaccggataacaactgatcaatttaaacaaaatcgttttagctcagtgatcttcgacgtgtacacccgcattgggatgagttgtgcggacagttgctgaaccagggctattatcagttgatcggccgagcgcagtggttgttgacggatagccaacggaaggttttcgtgccaaaaaaatttaaaaataaattcaaaaattatttttaaaaattccaaatttattttcgcttatttcatttatggaatttgcaaaataaaatataacaactttttctaagcttttttaaaagattcaccataacaaaaacaatttcatgcaaaatttaaattaattatttaaattaaattatacattttaaatgcaattaaatattttcaattaaattattattttaattaaatttagttgaaccgtgagcctcgtcttgcgcagcccattcagctgttgacccgtctccatgttcatgtgttaaaccccgtggacgcaatgcgctcttttctggacgaaggtgacaaaacaaataaataaacaatttcactaatttattaattgaaaaatgtta

SEQ ID NO: 84303 - DNA, 1145 bp, Heterodera glycines
  Genomic contig location: Contig_ID=SeqID_19569; Location=1528..2672; Strand=-
  SCN-specific regions: Sequence locations=1-324,346-915,937-1023,1049 -1098,1120-1145
  Gene Ontology: Mol. function=metallopeptidase activity; Cellular component=extracellular matrix; Biological process=development
atgaatccgggacccttatccgatcaagaccaaccaattgaatttcgttttggtttcagttgtggtgatggtgttcagcgacgggaggccatgtgcgttcgtgagcctgatgggcaacgattggaagagaaggattgcgaaccaagggaacgaattgtggagaagcaatgccaaatggccgcttgtccccattggtcagttaattatggctaatccaatttcatttgatcagttttattatacaacaaaaatttattcaacattgatcagtccagtaagttttcgagtcgatctcattttgtatcgcaaaatgaacgggcatctaaattttttgaacattttctaaggaaactcggcacgtggagtccatgttccgtcagttgtggccaggacggcttccaaacgcgccttgtccaatgcgtggattcggaaggacgaaaagtttcggaccaaaagtgcatgggcatcaaaaaacaacagcagacggagaagccacaaagctacaaagtgtgtagtccggggccatgcccatattggtaagaaatgaatggtttgtgctgaactgggcgaactcgttggattttttgaaggcgtgccgccaaatggggccattgttctgtgtcatgtggcaacggcgttcgcatgcgacatgtcgagtgtgttttgaagggccaaattgtggacgattcgctgtgcatgaaggcgatgaggccgaaaaccagctttcgatgtgtattgttggcatgcacagtttggcatggagttccacaggcggcggcgactgggcaaatcggagagcgacgggtgggtttaaaaattaaattgaaagcgcaggaggggaggtgaatgaatgtttgatcatccaggtgcgcaagggtgtacgaggactccgtgccgtggtcgtaaatggccattcaaaaaattttttgcaaaatggacgcccatcgaatagcagcagcagtgcggcggtgtcgccgaattgtcagtgccgctgttgccatcgagtaagaggcgggaggcggcgtggacgcggcggcggcgccggtggtgcacatggaatcattggcgccgtttttggacacggtgaacgggacggcgggcgcggctcctctcctgggcagcagcatgcttatcaatcgcagaat

SEQ ID NO: 84304 - DNA, 505 bp, Heterodera glycines
  Genomic contig location: Contig_ID=SeqID_19570; Location=576..1080; Strand=-
  SCN-specific regions: Sequence locations=1-31,53-126,155-295,317 -397,419-505
caaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgattcacttcaaaaaataattccttacccaaaagttttttacaaccacttattgccaatctaatttcttgcagatttaaagctatccattgcctgccggttctcggcacagcaaagcactaatagggtgtttgactc

SEQ ID NO: 84305 - DNA, 297 bp, Heterodera glycines
  Genomic contig location: Contig_ID=SeqID_19571; Location=187..483; Strand=-
  SCN-specific regions: Sequence locations=1-133,155-276
aaaaacaaaactgaaactgggcctggattacgtgataattttttgtgtactaataaaacccccagcaaagtccatgttcaactccgttccttttctgccttgacttggtcatgtccatgtcgtccctcccctttttcttcagctgatgcaacttggctccaagtacaaacggctggccctcttcaacaccgaacagcgccaccaagcagcacaggcactgagcacgcacagcaaagtgtacagaacgttcaacagacatggacatgatggacagcaacaacaaaaacaatgaataaa

SEQ ID NO: 84306 - DNA, 1277 bp, Heterodera glycines
  Genomic contig location: Contig_ID=SeqID_19572; Location=380..1656; Strand=-
  SCN-specific regions: Sequence locations=1-246,268-312,334-347,370 -574,596-800,843-964,986-1029,1052-1159,1188-1277
gactcgatttaaatgatgagaaacggtcgggcgtttgtgtcgatgtgttcggcatttttcctgaactgaaagttgacgagctcaatgccgacaaatatccgaacattcacaagtttctctcaaacccttcaagcagaaaatcatttgacgttgataatttggttcgtttttttccaattttacaataattttccgggttgcaggcgcaaatttacgatccggcatttacgtatgagaaaaaaaagctttttaaccaatggaaaattttagaggatccaaagtggctactcttttagctctttgcagtcccataaacaaattttttccttaaaattgtgcaaccaggaaaaaactgccatttttggctcatttatccgaattttttttttttttgcttatatagatctaattttaatctaagagactggcaattaatgtttcgactcgaaaacttgtaaaaactccgaattttcactaattttcgccggttaaaatgctacccaatttcctcccattgtttggaatttgaaaaaaatggtaaaaataccaaattttcctaaacatttcagcagtcagtgcagcatgagcttgaggagttgatttcgctgaacgtcgactgccaaaagacaatccatggcgaaatcacttacatgtcgaccggcgattatccgaccattgacctgtccaatcggccaatgccaaagtatgaactccactcgaggcatggctatggcattcatcgcgaggcacggctgtgcagcggtgaacagagctcggacgtcggatcatttacaaatttgtaataattttatataaaaatttttgaaaaatttgtaaaaaaactgaaaattttggagttttttttgttgatcggtttaacattatcggattgaaaaattgtttaactcaatttttggcataggtgcaaagaattttttttaatttgatttcttttgaggcctgaaaatttgctaaaatttttatttggtcgtaagaaaattgcgatttaattgttaaattaatccgaccgaaaaatatttttaattttgtcattttccagtctcattgatcttggtcttttgtcatcgccagaggaggaggagccaccacacattttggacgtgccaagccgattttggacatgggcaaaagagtgagcaattttttattaacaaaattaaaaaaaacccgagaattacttcctttttttccttttttaagtgcaattaggccgaaacacaaattaaaacaaaaaaatttggctattaaaaaataaa

SEQ ID NO: 84307 - DNA, 744 bp, Heterodera glycines
  Genomic contig location: Contig_ID=SeqID_3346; Location=240..983; Strand=-
  SCN-specific regions: Sequence locations=1-487,509-744
atgcgacgattcgtcaactcagccaaatgccaacgattcgtcaactcaaagattcgtcaactcagccaaaatgtgacgattcgtcaactcatccaaaatttacttaaaaaagcaatcaaggtcggtgattaagtttttggatgaaaattttttgatttttttgcagggttccgcttcactcgctttagagggcggtggttccgctcgcggatcccttcccagccaacaaagactcggactcaactatctgttggaggcgtacgaaagccgttggcaggaccaaaggccgttcaatttctgattcgaacaccgacacgcggtaagaagaatcaaacaatggcacaatggtcggattgcttaacaatgcttcggtttatttagtaaccgattaactgatagatttacggcaacgcgatatgtctttcctggcgacaattgcaacggaagactcgaactaaacgaaaagtcagtgacccaaaaggaaaccggatttggcaaagcctttattttcccttttacaccttagattcctccttcattttttcaattgacttcgccactttggaccgttttaaggacaagattgcgcgaccagcatttggcccagtcgctattttttcattcattactcataataccggttaaatttgtttactctaatctcgcgatgatcaccatattgattcgttttgttgttttgatttttgtttagtaaaattagttttatgcaagtttttgaataaa

SEQ ID NO: 84308 - DNA, 868 bp, Heterodera glycines
  Genomic contig location: Contig_ID=SeqID_3349; Location=333..1200; Strand=-
  SCN-specific regions: Sequence locations=1-688,712-868
  Gene Ontology: Mol. function=DNA binding; Cellular component =cytoplasm; Biological process=protein-nucleus import
atggctcttctccgattcgcagagaccaaaacaaatcgcgggaaaagtcttctatctcgtggtggatatgactacactttcgaggttaaaaggctaatttaatttggtgaaaatgttaaacggcaaattctaaaggcggtttcaaaatagacccgttcaatctgttcttcaaaagcgacagaagcgtttgcatagcggcggagagagttttgtgggtcttttgccaaagttgaaggcaatttccacaaaacaggacataagtgtgtgttcagaataagttttttaaatttcgtttaaattttaaagttaacggtctgaaagagcttgttggcccaacgtgcttaacaaatgccgacaaattttaccttttacaacaccgagatgtattttgtacaaattgcgtgacttaacttctgaccaattgggcagccgacagattactcaagtcattcctggcttttatcattttaacccttaactaaccaattccgctatttcagggttcctgtcccgacatgtgtcctgagaaagagcgatatatgcgagatgcaaaaaagacagtgcacttttacgaatgcaatgcgcatggacaaatggtccatgaaaagatggtcaaggattacagccgatcggctgctgatccggtgccctttttgtaaattgaattcggtgtttggactgagtgatatttccaatctcttcacttttaccattttaggatactccactcgcccatgagcttcgtccgctgaaaatattgcaactgacaatggattatctcattttcaatgttcgcattgcatttcccaaattatttggctttaaaatgacagatcgcgggcgaaattccgacaacttcgagcaatga

SEQ ID NO: 84309 - DNA, 73 bp, Heterodera glycines; identical to SEQ ID NO: 56843
  Genomic contig location: Contig_ID=SeqID_3349; Location=1726..1798; Strand=+
  SCN-specific regions: Sequence locations=1-73

SEQ ID NO: 84310 - DNA, 372 bp, Heterodera glycines
  Genomic contig location: Contig_ID=SeqID_3349; Location=2979..3350; Strand=+
  SCN-specific regions: Sequence locations=1-106,133-165,187-372
atgatgaacacagagttcggggctccattcaaaaatgttttgggagaaattcaattgcttagccaagcggaaagagatggagaactaataaataaaaagatttcggtaatattaaaataatattatttaaatgtccggcaacatttttgtaggttaaacgaaaacggtataaattttttatgccaattatgccaagaggatttgaacccactgcatggcgcaaaaggagcacccgttccgttacagttgcaaattataatggcactgcagtatttggccagcaacacatttgaaattcatatcggaaggcatatggagtgggccaaacaacagtttcatctgttataaatagagtcttcgcatcaatagcaa

SEQ ID NO: 84311 - DNA, 66 bp, Heterodera glycines; identical to SEQ ID NO: 53774
  Genomic contig location: Contig_ID=SeqID_3349; Location=3844..3909; Strand=+
  SCN-specific regions: Sequence locations=1-66

SEQ ID NO: 84312 - DNA, 547 bp, Heterodera glycines
  misc_feature (504)..(504): n is a, c, g, or t
  misc_feature (541)..(541): n is a, c, g, or t
  Genomic contig location: Contig_ID=SeqID_19573; Location=80..626; Strand=-
  SCN-specific regions: Sequence locations=1-108,130-432,455-547
atgattcgcctgccctttctttcgttggcactcgccttttccgccgttctcctcgtcctctgcgacgatttgccatgtcccaccgatccgtcgtccgcgcctcttccgcccgggtgccctccgcccccggcggacggtaaaaaagcacccgccgacggaggaaaggtcacatcagcaaaactgcttataattagcgaatagattccttttgaaggatggcggaaacaaaggccgaaaaaaacgagacaacattttacgtgccaaaagagaggacaaaagcaaggactctgaacaaaaagcggacgacgacgaagcggactgtgcgccacccaatggcacccctccgcccggcgcccctccgccgggaactcctccgccgggcgcttcaccgccttgccgtcgtcagaggggtgggcccgccggaggaagggggaggagcagcgcagcacccgccgaacggtccgccgccgaccacgccgaagccattgagaaattggcaaaaanaaagagaaagagcggatgtagcacacataagcacttnggatga

SEQ ID NO: 84313 - DNA, 87 bp, Heterodera glycines
  Genomic contig location: Contig_ID=SeqID_19573; Location=2074..2160; Strand=+
  SCN-specific regions: Sequence locations=1-87
atgatatcaagattgtttgattcggtcaataacttcaagagttatattgactcaaagttggctcagacggagttggcccgttccgag

SEQ ID NO: 84314 - DNA, 877 bp, Heterodera glycines
  Genomic contig location: Contig_ID=SeqID_19574; Location=482..1358; Strand=+
  SCN-specific regions: Sequence locations=1-175,199-796,818-837,874-877
gccgtccaaccgttattcaaggaccgaactgtgccatgtccacaaactgaatggcgcgaaatcatcagacaggttatttgaattaaatcaatttctatataaattttcaactaaatattttcagagcattttatcatcggctactgtaaaaggacgtgccgacacttcgccaatgaaaattcaaatggcattgacagatcgatttccccacaacaaattttttgtgatttgttcaccgtttgagcaagacaacaaaaatccgagtgaaagtgctgttaacgatggacaccaaatgccaattgaagcgcaattaaggtaaaaactagagaacgggccggtcggttttttttttttggtttttttcgattttcggtttcggtttttaaccgagaaaaaccgaccgagatatttcaaagtttttcggttttaaaccgaccgaccgaattaatcaaaaaaccgaaacaattgaccgacttttttttaatgcgatttgttaacagattttgtccaaaaaatgaccaagtttgcgattttcagcaaatttttaagaaaattaaggatttttagggtccggcggtgccgataggcgccgccggggggaaaacttgaaaattttggccatatttttagcaaattttcatcaaaaaaattcccaaatttgtggattggatttgcggaaaaaacattgataatttcttgttttacaaaaacttagcaaaattttttggaaaatttgagtgaggtaggtcttggagagtgtactaacaagaagaatcaaaaaatttagcaaaaaaaattttcccaacctctagaacaccattcgatatagcttcaatagctctacaattttgatcaaaacaaattcttaaaaatcgaa

SEQ ID NO: 84315 - DNA, 225 bp, Heterodera glycines; identical to SEQ ID NO: 50965
  Genomic contig location: Contig_ID=SeqID_19575; Location=571..795; Strand=+
  SCN-specific regions: Sequence locations=1-225

SEQ ID NO: 84316 - DNA, 594 bp, Heterodera glycines
  Genomic contig location: Contig_ID=SeqID_19578; Location=97..690; Strand=+
  SCN-specific regions: Sequence locations=1-96,161-244,294-306,344 -423,485-551,593-594
atgtgtcgcagatgcaatgcgaattggacggaagagcacgacaaattgtcatgcgaacagttcgccaaactcaaaaattacaaagatgacccattgtaatataataaaataattaattattaatttaagtgtcttaaattaaaaaattattctttttttagtgataaaaagatagcagatgcaattatccacaaatgtattcaatgcaacattagctttgtaaaggaagacggttgcaaccatgtaaaataatatttataaaatgagaaaaaaaattttatttacaaatttttctacagttttaagaaataatgaattttgaatttttaaagaatttcatagaaaaatttgttttttttttctttaaattccggaaataagaaccctggacctatttcgtaagaactaaaattgacagccctgttaaatttttaatttttttttttataaattattttaaaaatttagattttttgtataaaatgcagaactgaacaatgctactgctgcagaaagtcaattgatttatttgatcattattgctggtcatcaaataaaattaatatttaaaaattagaaattaaattaaattga

SEQ ID NO: 84317 - DNA, 266 bp, Heterodera glycines
  Genomic contig location: Contig_ID=SeqID_19578; Location=839..1104; Strand=+
  SCN-specific regions: Sequence locations=1-62,91-146,169-266
atgaataaagttgaagcacaaaatgcagaacgcattcgaaaagtaaaaaaaaaaaaatcctgtaaatatttttaatttttttttaattttcagtgtcatgaattcaaaaagaaattttttacacctttttcaaaaaagtttgaccgaaaaatgaatgacaaattaaaaggatccaccagaatgaatgaacaataatcatctgaagaacattgaaggtcaatcaagcaaaaagcattttggtaaaaattatgaacgctaaaaaacta

SEQ ID NO: 84318 - DNA, 674 bp, Heterodera glycines
  Genomic contig location: Contig_ID=SeqID_19580; Location=83..756; Strand=+
  SCN-specific regions: Sequence locations=1-486,529-596,619-674
atgatcagtggaataaaattgacattcgtatttatactgagaattacatcggcgatgggtaagtgaataaattattcaacataaaatttactgtttttctatttttagacttctcgacgaaattcccggccctagtgatcagtagaagtgaatgaattgtattgttaagaagtgaccgaccaaactgaattgtggaattggaaattgacgtgctcataaaattgttttctttttttttgttgactgatcattgatcaactttggatttgtgttatgcgccattatgataaattcagtgatttcctgaaattggaacatttccgaccaaccgagcgaatgaatgcgttgtctgcctaagcttttggcttgcgcataggctttgtcttttatatgagttgccattgtctcgtttcttttttatttggttccaacaattaaaacagtttttctcatattttttcaaattttaatctttttgtccacggctaaatttttaaaagctttaaaattttctttatttttttttttgccaatttatcggcgtcggcgagttgtagtgtaccgtcaccccgggtaaaacaaaaaagtctcagaaactcctccccttaaaatttcactcttgaatgatttggattacaacaaacgatcatttgcccccgcattgggtcggggga

SEQ ID NO: 84319 - DNA, 449 bp, Heterodera glycines
  Genomic contig location: Contig_ID=SeqID_19581; Location=135..583; Strand=-
  SCN-specific regions: Sequence locations=1-211,269-449
atgaccttccttggcgtcgacggcattatggttgccaagtgagttgacataatttgttttttttactggtcggtctgcgttattctccgagccccccctcccccgcccccctccggttttcggaaaattcaccgacgcgttagccgcttttcccccgctctcccctaagctatgccatttatgacaaaaaagatgaacaatgcaattgatcaaaaaattttatttttattttcgtcagttaagaaataataattttattaaaattatacaatttctagcaaatccaatttaattcttccatttataatccccccccccttgaattcagaatgatgtgctccagtgctggcatgcagatgaccagcctggtcatgggccgtctgttgtgtgcctttctccagcaggacgacaacaaaactccgaatgaccagccaatgttgccagtttag

SEQ ID NO: 84320 - DNA, 614 bp, Heterodera glycines
  Genomic contig location: Contig_ID=SeqID_19582; Location=486..1099; Strand=-
  SCN-specific regions: Sequence locations=1-282,304-614
atggctggcgccgaaacgcgagcgccgaaacgccatcgccgaaacgcagtggacccaaatgtgaatccatttcattcccttgccttccccgttcagctcaacgagaaaatcttcctgatgctctacttttggttcattctgatggcatttgtttcgctgctcagtctggccgagtggtgctggactcttttgttccgctctcaaaatcgctttatcaaacggctgattgagctgagccttttgcaggtagcgtcgaaattgtttttgatggcttactaattttaatttattttccacatcaacagatgattcccgaccccgagttcgacttcggctatgccggcacccgacgggacgagagcgggactgatgagtgtggtgccgaaacggaggatggcgatgagttggaggagcggcaacacggccgtttcaccgcggtcgcttccggtcttactgctgcaaaagctgagaatgtgtgcgacgacaatcaatcgggctcaccaagcaacaactccaccgccacaatggaggaaattgaacagcacgccaagcaaatgttgcgcaattccgctgttggccaatgtggcgcgtcggacggcaaagtgaaggggtaa

SEQ ID NO: 84321 - DNA, 920 bp, Heterodera glycines
  Genomic contig location: Contig_ID=SeqID_19584; Location=100..1019; Strand=-
  SCN-specific regions: Sequence locations=1-20,42-275,297-552,574 -807,829-920
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaa

SEQ ID NO: 84322 - DNA, 1182 bp, Heterodera glycines
  Genomic contig location: Contig_ID=SeqID_19585; Location=1572..2753; Strand=-
  SCN-specific regions: Sequence locations=1-949,971-1082,1109 -1128,1154-1182
atggcattgctttcctatcgttttgatgttttggtggacacgcattttgatggaaaaagcgaattgacaatttggagaacaatcagaattgtaaaggacgaaggaccaaatgcaaacgataatggaccaaaaccgaaagtgtctgtacggatcgatggcagttttgtggattttccgttgtcggatcgtcaactgcccaacaaaatttgctttaagaaccttcagattcagtcagtcttaacttttgtgtacgctaaagcatttttatctttcttcagctacattgaccattccgtgatcaaatttttccgctccaagaagcgattctttgacaaaagtggcaccaaattggaagtgtttgtgcattcaattgatacgtatgtccaaccgatttgggatgtttttacccgcgaaatttggcctatttttgcgaaaagcattcgtcatttgggtcttcataatgccaatgctttggacaatttgcgtcgtcgcacttcgccgacacttctcactgatcttgatgaattgcattcgatcaattccggtcatctgtgcccagaaggaattgctgacgatggacccaatgcaactgctggccaagctttggccaaatggctgcacactccgacaaaaaatggacaaccaaagcaattacgtttccgtgcttatgtgagtccaccaaatttcgaatgggtcaacagcttcaaagaggtcgtctcgccagaattttcgtcaaattgtttttattttaccaattttgtttagacatttcgccgtgccaccacttctgtcagttacaaaattcaactttatttttgggtggaaccaatgccaattgaaccatttgaattggataacgaagtgacgaaagaaaagctgacactgaaacaggagatcgacgaattcgacttaaatgtgtataattggctgttgcaacggtgcccaattggggagacggcgacggcgccagttaagtgggaaaaccgcgaaaatccgagtgccaatttgaacaatgtcagatttgatctgtggagtttcgataaatccattgggtgagcagcaacagcatttgaattttatcgaaaaataaaatatttaattaattttaggccattggcgccaccagcggaagaaaaagaaggagaagaagaagcggatcaaagcaacaaaaatgtcgtctga

SEQ ID NO: 84323 - DNA, 1986 bp, Heterodera glycines
  Genomic contig location: Contig_ID=SeqID_3350; Location=95..2080; Strand=-
  SCN-specific regions: Sequence locations=1-17,39-981,1003-1367,1403 -1986
atgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctttttgtgagcatcctggtctatggccagccgagtaatgccatagaattgtggaacaagtacaaagaccaaatgtacaatccgcaaggcattattactctggcacagcataaagtagcagagcttgaagccctagccgacattgattggcggctgcacagctgctttaacttaagctgtgtgcattttagcctgccagacccgccaacttcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcaatgacaaagagctgctcaatcgtttgattctcgctccgcacattgacacgtgtgatgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaa

SEQ ID NO: 84324 - DNA, 3186 bp, Heterodera glycines
  Genomic contig location: Contig_ID=SeqID_3351; Location=43..3228; Strand=-
  SCN-specific regions: Sequence locations=1-3,42-1782,1804-2834,2857 -2978,3004-3186
atgccttctaaacaacgcaatttgaaaaagaagaagcaagatgtgtatcggcgacaggcagagcgatctgtcagtcgggataactcacccgtctcagacgggagtgcagatgggaatggagaggcatcggcatctctccggggcaccaccaccccaagcttaagtgctttgcaaataagcacgccggcgtcttctattggaagtaaaaaaagaggcaggccctcgaaagccggagcgaagccaaacttggctacgcaagaaagtatgtctctcattgacatacatcaaactgtgctcactcaaagtgaccagggttcgccgtgcaaaaaaaggggaaaggtcgccgagattgaccaacccatgtttgccaatgaagctattgctttaacacctgtttcgactcaaagtcgtgcagggcgacctgccaaaaaaattggaggcccaggccgaggcagactcagtgattccatgagcaaaagctctgaaatggatatcaatcttgtaaatgccccaatttcggcaacctcgcacactgtgcctgaaaaaataaatttcagcacagtgcaaattaatttcgcaaccacgcggaattttgcctgtaaaatttggagatgggcagcaattggcctttacgaacgtgatggcgaaacatcgcttgccccgagctctggcccaagatacattgagacctgttggaatgatctgactcagtttctcaatgacggttttgctgccacatatttagcatatttggctagcatttcacaacgaaaagtggtcgttgttgacccaatggtatggagaaatggcttggacagagtcatgccttacaaaaatatgacatttgggtacaaccctaatgttccggcagaagtcatacttttgccagtgcatttccctggacattggactctgattgtccatgatgttcagtggggtactcattttgccgattctttgcctaccccctatggcaggttggattggcaactgacggataaaattggaaagatcatttctgacattttgccgtcagcagtgttgaccgggatttttaatgcggtaaatcttacggtacaacacgatggaaatagctgcgggtactttgtgtgcctgtatgctgaatcctggcttatgaacaattgcacttttgttctgccggacttgaacatcaattatgagaagaagcgcattttatggcacataaatgagctttacggctctgatattgtgccgtttcatccaagggaaggtgtttcaacatctttcgctgttgtgtctcatcacaatggggatgtagcgcaaacttcctccaagcacatagtgccaattgaaggggatgattcagcagtacttccttcctcggaagatactgctgttcttgcgcaagcaccagtgatcggcgaaaatcaagctgacacccacggtgttgttgcggacacaattgtccagcaagaaccaatcgcgcaggctgatgatgtaattttcatcagacctaagacgccaccaaggcgatcaatgcgcgttcaaaaaaggctttcagcttctgttagccgttcgccttcaccggcgccgaaacgccccccgccagcaaattcgctgggagtggcaacgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtagcatttgctgccggaagggaagagttgtgctgccaatgcttaacccgcatcctgatgagctcaaacagctgattgtggggaataagcaatcccgtgaagggaaagaatttgtgcgacacatgtcgcgttataacaacctgttccaatttgcgagcgtttccgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaattgcatcatcctgctgcgcaggcatataagcaggcgcgtgagcagctcactgagcttctccaacaacaaactccggaagagcttcgcttctttcgcatgactttgttgaatgagcgcagggctccagctggtctgaaagacccaaaattgcacccacaccaaataatcaccccttctacgggtgaagggatgttcgctattcatgcggaccccactggtgctcctccgcccaaaggaatttgggtagagaacaaacaagggcaattaaatgaaattgctcctttcagtccgtggactgatagtcttacgtatccattaatcaagccaatgggcgatgatggatacacaactggcattaaatatgctaagccaccatcgcgtaagcgaaaaggtgctcagaatgcatctggcctatttgactcggaagccgagtcagataatgagtcgtgcgagactcagtcaattgcatcatctgatgcggggtcagtcgcagattcagatgctgaatctgtagcatctgtttcatcgcagcaccggcggattgacaaatccaaacaatttatctccctgcgagattattgcaagtattatctcgcaataagggatgaaaatgtggagttgcaataccaccacatcctttcatgtggtggaggacttggtcagcgctggatccttgaccaggctgcaaaaattgattggcaaatagcaacatttttgcgtagacctgacatggatctgcggatcagcactccaaaaaatctgctgcagtatttggtcaaccaatacaacaggcagcaagcacggcaaaaccccaatgcacaacagaaaactgttgatgacattggcagtgttgttcggctttccgaacacaacgtaaattctctccaatattggaagaaaatgtatgaagattgcaacaccgtttttgcacggtgccatgacgcgaagaaagcgcgtctcttcattactttcacgaacaacagggaaatggcctga

SEQ ID NO: 84325 - DNA, 439 bp, Heterodera glycines
  Genomic contig location: Contig_ID=SeqID_19586; Location=127..565; Strand=-
  SCN-specific regions: Sequence locations=1-74,98-439
atggatgcatacaatttaaagtcggattctgcggttcgttttcgactttcgcgaaaccaagcctattttctggcatttgtgtctctgtgcttggttattatcaccgggctgctaatcgccgtgctcgtcatccaagtgaccacacaaaatggcgagaaacgaaaagaatttgggtcggaaggtagaaaaatggaaaaaataaaaatacaaaaatgaactgatttaagatatccgttcgtccatcttcgccaatatcaattcggataaaatagcggccaatttggaggcattcgctgagaagccgcacgtcgcggggacagaagcaaacaaaaaggtggccgatcggataatggaaacgtggaaggccaacggactcgagggtcagttgagggacaaaaagcaaaggcatttcgagaatcagtctcgaaaattcatataa

SEQ ID NO: 84326 - DNA, 1601 bp, Heterodera glycines
  Genomic contig location: Contig_ID=SeqID_19586; Location=1831..3431; Strand=+
  SCN-specific regions: Sequence locations=1-5,43-52,74-88,135-243,291 -817,846-1469,1523-1601
atggcgcaatttcttaaaaactttttgtttgctatgattttgttcattgaatttgttgttgttgttgttgttgaaagggaagagaaagtaaaattaataattttaaaatattaaaaaataatttaaaatttaatgacagaacaaaatcttcgaatgcccaaaggaaaatgcacggcctgaacagttgagggaattggacaagaaagagcgaagtgaaagaggtacgaaggaaaacaatgaaaataattaattaattaaaccaattaatttattaattactttatttattatgttgttttattttcgaaaaaatcaaaaatcatttgattttgctctaacatatacaatataagaaaaaaaataataattcaaatctgcttaagaatttgaacttttgtatgaaatgcaagaaacattcaaaaaaatgttttctgaagattcaacagttacttacaataatccaattacaaaaaatctgctcaatcgccgaataccaaaatggcacttcgaatttattgtcgaaaaagcatttcaacttttgagaagaataaaagtaaagcttaatttgtatatctattaaagatcagagaaagcattacattatctgctgatatagcatatcagcaccatctttaacatgatatcaccaaatcggtcgaaacaatttttgcatttttggtttttgaaatattttattattttttagtttgccttttttgacaggaaattttctaataatttagttctcattttaccataattttaagcttctgttccatattttccactgtgaaaaaagaagagaacatttctgctgtttaaaaataatttgtttttttaattaagcaaattgatctaacaaattttgaaaaatggaatcaaacccaagaaaaacatgaaaaagaatggcaaaaaatatcggaaaagggcgaatatttccatcgcaaaatatgccttctgcagggatttgcgcatcgaattgtacgcgacgaaacactgaaggaaaactcagaatggcaaaagtttcatatttcagtggcctccgaaatatttggcatcggagaagaaagcgaatttgaagaggtaattaacgaatttgaagaggtaattaattgatacgtaaaaaacagtggcaatttggggtaacgccaaggcatacggcagcttttatgtgccaatgcaaaaaaccatccgaaatttgttctgtttggccccaacttaggcaatttcgtataaatattcttaacgcacgaataaatacaaaacaaattaacttttacaaaacattaattttatttggaaatgccttttgattttaagaataattttgcaattttaactgaagaggaatacatggaacatgtaaaaaaatgtgaggaatcggaagaatattcaagaaaaattggagattatatgctttcttcgactttgaacaaatcgttttatcggtaagcggcgacggatttgggaaaatttaaattattttaacatttttattttgtattatcaaataattaaaatactttagaatgtgtcttcataaagtaatttcaaattccgaagaattccaacactttctgtgttatcacaaaagcatttga

SEQ ID NO: 84327 - DNA, 1888 bp, Heterodera glycines; identical to SEQ ID NO: 19589
  misc_feature (1793)..(1794): n is a, c, g, or t
  misc_feature (1806)..(1806): n is a, c, g, or t
  misc_feature (1867)..(1867): n is a, c, g, or t
  Genomic contig location: Contig_ID=SeqID_19589; Location=1..1888; Strand=+
  SCN-specific regions: Sequence locations=1-162,184-608,630-1382,1405 -1622,1644-1888

SEQ ID NO: 84328 - DNA, 582 bp, Heterodera glycines
  Genomic contig location: Contig_ID=SeqID_19590; Location=837..1418; Strand=-
  SCN-specific regions: Sequence locations=1-79,102-106,130-236,259 -305,327-582
atggcaaaaaatgtacgaaaacacacaaatttgagatttgcacaaaataatcgacaaaaattgcgggtaagactatggatggtggtgggcccccttttttcgaatcccgaacccgaattcgaacaaaaagttcaaaattaaattttttgtaagtcatgaaaatacattttcaaaggttttcggggacgctgatcacgagtccgtcatccatttcggccaaatccgcggattcaaacaaaaatttaaattttaaaaattcacatttgtaaattgttgagcttttaactatgttttcagcgcttaatatacctaaatggctgtattggaagagtttcaaaattttacattgaaaaaattgcatgaaaaactggctttgaatgacaatgattttgtcgaatggcttgagcatttgggactcttgcattcgcgtcgctcatgtccttgatgtggtggaaatacttcgattgtagcagttggtggaaattggcgttgcactacaaagaattgtcgggcaaaaacaggttcttggttcgtagtgcgacttttcggaccactatttctcgatagaactgtctaaataaa

SEQ ID NO: 84329 - DNA, 375 bp, Heterodera glycines
  Genomic contig location: Contig_ID=SeqID_19590; Location=2012..2386; Strand=-
  SCN-specific regions: Sequence locations=1-2,24-133,155-270,294-375
atgaaaagtctacttttgaaactttttgttggcctctgcttcattgactttacgtcaaatataaagtcaaaatttgaggactttcttgaaaatcaagaagcaatgaagtcgatccaaaattaccaagaaaagcgaatcaaaactattaaagaattacatgctgaactaacaaaaaaagggattaaattggcagaacgtagtttgaggctatatctttgtaaaattaagagtgccaattctgatacatcaaaagaaagtccaaacataccagaaataaaatttgaaaaacaagatagagaggaatatttttggcagatttttactcccaatatggatcattccgtaaaagactaacattaatttttataaaataaa

SEQ ID NO: 84330 - DNA, 447 bp, Heterodera glycines
  Genomic contig location: Contig_ID=SeqID_19591; Location=496..942; Strand=+
  SCN-specific regions: Sequence locations=1-400,427-447
atggtgattagaagaggtacaaaagtgattagaacaggtgaaaaagtgattagaagaggtacaacagagattagaagaggtacaacagagattagaagaggtacaaatttgatgaagaggtacaaagtgatttaaagaggtacaaactgtgattaggagaggtacaatggtgattagaagaggtacaaaagtgattagaacaggtgaaaaagtgattagaagaggtacaactgtgattgattagaagagctacaactgtgattagaagaggtgcaacagtgattagaagaggtgtaacagtgattagaagaggtgcaacagtgattagaagaggtgtaacagtgattagaagaggtgcaacagtgattagaagaggtgtaacagtgataagaagaggttcaacatggtttaaaattatataaataaggaaaagttttttattaaaga

SEQ ID NO: 84331 - DNA, 635 bp, Heterodera glycines
  Genomic contig location: Contig_ID=SeqID_19592; Location=285..919; Strand=-
  SCN-specific regions: Sequence locations=1-87,109-564,586-601,627-635
atgccctctggaagtgtgatttggcaaatcgggctttataaaaaaagcaacaacaatgatttcgagtacgaatgtgccgaatgttgtaagaatattatatgtaagaaaggcaacacctccaatgctataaaccaccttaaatctaaacacaaaaacagcgaatatgaggcgaaatatgaagatttgttgaagcagaagcgaggtgagaaagggacaatcgaaacacacttggtcttaggaagtggtacgttatattaaatgtgcatatgtattggttttttttaatttttaagagggtctttcatcattcgacaaaaaagtaattcattggatcgcatgcacccaatcatctttctccgatatcaacaacccgacaacaatcgcacttttcatgggaaacaatccgttgcacaaattgaaggatgagtcaatttatcgtaaaaaaattcttccaatggtctacagaatgtcaaatcaaaggtccaaaatgaattggacgaatgctcaaaaattgcttttacgtcggatatttggtcggacacttcaaacgcattgataaggttgtgtcttcaatttctttcaatttttgtcgtcaaacacaatataaatattaaaaacattttactgttaataaa

SEQ ID NO: 84332 - DNA, 1147 bp, Heterodera glycines
  Genomic contig location: Contig_ID=SeqID_19595; Location=1..1147; Strand=+
  SCN-specific regions: Sequence locations=1-25,47-271,293-446,468-1147
atgcaaagtttaagcccagaaaatcaaaaagaaattgaaatatttgccaaacattgctttgccgcgttgaaattgtttcaacaattcatcaccggtatttctttatgcaaataattaagtttcagtcagaagcaaaatattcatcaaaattgctaaaaacgcttattctgggctctattgcactttatgaatataaagttacaaaagaaattactcaacaattacttaattaatctaatcttttttggcaattgcctaacgctgagattttatatatatttgcttcttaaagcttttcgttcggatgatactaaaaagataggggtttgttcgaataggacattacggtggataatcgatcaaatgatgacagatcgcggcaatttgaatccgcgattcgcacgcggtttttctcgcgctccaccccttgttttacagcgaaagatttgagaaaattcatttttcctactaatgaaaacaatatcagcagcttactgttttatacaacaacaaattaagatgagcggttgtctcagactttgctcgctggtggaggacagacagtgtctgatcaaagctcagccttatcagctcaaccggcgcccactcgatctgatcggcaacagaaagggaagtcgtcacggcgaagaaaaaggggcgattggatgcccgatgggtcgagtaaatggccaaaatgcgttggtgccgttttgttggccggcttttccggctatatgtgcactttgttttggatcatcttggcccggagtcatattaatccattcacttacttttctgctgatgacctctctgttcattatcatcctcatattccgttgggaacggcggtggtaattgctgtgtacatgtcctttgttgtttgcttggtcagcatctttttgggcatttatcattgctttgtcaagcgttcttattagggaaacgatttttagggttttactttttttactgagctctctatggtctgaaacacaccaaaaacaagttttttttttctttggtgactgtagagctacttatagtgttattagcacctattttctaggtttttttttttagaacctaaaacctaaaagaaatttgaattattttggcattttgccaaaaatttagtaacaaaaatgca

SEQ ID NO: 84333 - DNA, 305 bp, Heterodera glycines
  Genomic contig location: Contig_ID=SeqID_19595; Location=2359..2663; Strand=-
  SCN-specific regions: Sequence locations=1-21,47-147,183-305
atgacaggttaatgcgacaacaaaaaaaatttaaaaaatttttttagacattataagcgattatttcctaaaaaaatatctcgagtccaatatttggattgccgaaaaaattggaatttctaacgccaaatggaccaaatcgcctatggataataacaaataaaatgaaaatttttggaaattctatgcgtgatcgctttataaaacggtatttttaaaaattttattggctatcatgttgtaaaattctatacgattttcacggggactgaagaaagtcaaaatcagtgattacattaaataaa

SEQ ID NO: 84334 - DNA, 801 bp, Heterodera glycines
  Genomic contig location: Contig_ID=SeqID_19596; Location=88..888; Strand=-
  SCN-specific regions: Sequence locations=1-44,69-82,104-303,326 -328,385-395,417-557,583-801
atgaaaaagtaagaaatttatttatatatcagaaatcaaaaaacttaattattgttattattattagttaccattcgtttattataaattttcattttccagtcggattagcttcggattcgccgtcaatcagcaaacaaaatttgaagggataaatcgtagccgcaagggcatttgtgcatatgacagtaaaggggagctttggatttacggagagggaagaggaataacccaattttcctacggtgttggtgataccgtaggaattgccgttaattttgcctctctgcgaatcattttcaccaaaaatggacaatgtttgggttggaaataaataaataaataatttaatttaaaaattcttaaattatattcaaattaattgccttttttcacagactgctatgattttatctattctccatttcttgttggtgattatcttcatccattcgtttctttgtacgacactggtgacaaaattgaggcgaattttggaccgaaatttaaatgggattttgcaactttgtgggataaatgttcactaatactgatccttttattatttttaatgttttttatgcatttcttcttcaattatgttatggttgtttgattttttaaaatgtaagcaaaaaaaaaaatattccgcgaaaaattttccatccctattttacttttctatgtaggacaattgctagagcagacctaactccactgggctgctaaaattttactttcagtcaccctgggggcatgatctgatcatgatgatgcaattaacttttttacaccaataaa

SEQ ID NO: 84335 - DNA, 448 bp, Heterodera glycines
  Genomic contig location: Contig_ID=SeqID_19597; Location=271..718; Strand=-
  SCN-specific regions: Sequence locations=1-42,65-168,190-258,318-420
gatcggatgatgatgagtttcgtctagacgatgaagatgggcgaaagaaacaagaaagagaaacgccaacaaacgcaggtaataaaacattattataaaggagaaaatattatttttcatcattttgaatgaaattgttttatagtttaagctgatactgaagaacgattctcacaattacaaaatgatcagaagaaacttttggaaaaaattagtgaattggaaaagcaacaaaaagaacagacaaacggcgaggagaaattaaaacaaaaataaaatttgtcaatattaaataattatatttaaatttaaaaattgattcgatttttaagctactgagaatcaattgtcaaaaatgttggaaaaaatcagtgaattggagagagtacagaatccgagaaaggtaaaaagggaaaaatgaattaaaatttaatttctaaaaaataaa

SEQ ID NO: 84336 - DNA, 672 bp, Heterodera glycines
  Genomic contig location: Contig_ID=SeqID_19598; Location=21..692; Strand=-
  SCN-specific regions: Sequence locations=1-11,33-69,92-232,254-672
atgaaattctgtattttattatttttatttttgattgccctaattattccaattgaatcagaaaagaaaaaacttcaacaaaagtcatttgatgcaatatttggagaaaaatggcaagaaaaagaagaagaaaggcgaaatgaactcaaaaaaagagaaataattgcaaaattttataaaataaaagagaaaatcaagcaaaaaggaagaaaatattcagcaaaagaatggaataaaataaacacgaaaatagcgaagaaattggggacgaatcgacacaaaatttatgaatggattaaagaaattggactttataaatatcacaaatcaaaaactgatgaacaaaaacgcaaaattgtgcaaaaattcattgtaatgaaaaatgaatttaaacaaaacagaaaatattcgcaaaaagaatgggagaaaaattatgccgaaatttgtaagaaaatcggaattagccgttcaacaattgaaaaatggaagaaacaatttggaattcgctgtaaaataacggagaacgaaaaaatggaaaaaatgaaaatttattggcaaacaaaaaaagaaaacataaaaatgactgacaaagaaattgcaaaaacattacaaaaagatagaaagagcatttcaagatggaagaaccaatctagtaaaaaattgaagtattaa

SEQ ID NO: 84337 - DNA, 153 bp, Heterodera glycines
  Genomic contig location: Contig_ID=SeqID_3354; Location=432..584; Strand=-
  SCN-specific regions: Sequence locations=1-153
atgcgtgcggtggtggccagtcgaattccgccaagtgccggactgagcagctcttcggcattggtctgtgccgcggcattggccacgctttgtgtgcaaagtgccgactttggtggtggtggtggacagcaaatttttgaacacatttcgaag

SEQ ID NO: 84338 - DNA, 2132 bp, Heterodera glycines
  Genomic contig location: Contig_ID=SeqID_3354; Location=1424..3555; Strand=-
  SCN-specific regions: Sequence locations=1-615,638-658,682-745,767 -936,962-1258,1292-1649,1673-1947,1972-1976,1999-2005,2039-2132
atggtgcacaaagacgaaaataattgcgacggcgacttgcgactgttcgctatcgtcggtcggtcgcatgtgctcggcacggaacccaacgcgaaaacagcggcagtgacggaggtcagcagcagaatgggacgaaagtggggacggggaaatcgttggaattttcgcaaaatcactgcaaattttgcagttttaagtggagcaaaacaaatttagaacgagttgccacagtcgtattccgcgacattgccaccgccccaattggacgctgccaccaactttttttccacctccaacagtgacaacgacgttttgcccccgtttgatttggtggcatccgtcgcgcttccgcccgcggtgcaatgccgcaaattttttgccgaccttcgcccgttggacagaattttggcacggattgtgcgtccgggtgttgccgtccttcacgtggagttggtgtgcatgttgagccgatttcggcgcactttgctcacctttatgaagggccgattggtgggcgcgtttctcttttctttgcaatctccgaatttttgggaaattcctgcaaatttgttctagctacaaagataattgcaaatctggcaacccatttgattggctgttttttctatttgtttttgtgtcgagaaaaccaaaaaacaaaaaaattattattattattttctaatggaaaaccgaagccatttttgcagtccattctagaaaagagcttattttttggcttttgctcaataaattgctaacattcggttaaaacaaatccaaatgccccgattttgaagatttttaaggaaaatgacgcctttttatccgttttttccgttttgtttttcataaatttctttaggtccccgtcccatttgaccggaccaagcgcttttacaacatcagcgactacataagcagtaagtgtttggtggtctctttcctctctcctttctgtgcgccggtgcggttgggccccaaaatttcgtttcccccacccgtttgagccaccgtcgtgtccattgcgcccgccagcgaagagttggaaattgacgagaacgaggtacgtgggtggacggggacggacatttgggcccaactttaggcaatcattaagaattggtgtcccgacgaaaaaaaatgttaaaaatttgtagggtattttttctaggcttaaaaaatgcgctgatcacgaatctgagctcagattttgaaaatcattgatttttatctaagattttttgtcaattacttgattttatctatttttaaattatttttaaaaaaagtttagcaatgaatttgggttaaaaaatgcgctgatcacgaatctaagctctgactatgcatgaaccttcattttgtctgattttcatcaagtgtcataaaaaaaataaaccgcaaccaagcggactcgaaccccaggcccccgtctcatacgacccctagggattaataattaatttcaaaaaatcgtaaaaattcaaaacttgacttctccatacatttaatagatctttgaaagctgtttttagtatcagttttatgtccgactaattttcttaattttggaaaaaatcaagtaattgacaaaaaatcttagataaaatcaatgattttcaaaatctgagctcattgtcagattcgtgatcagcacattttttagcctagaaaaaatacccgacaaatttttaatattttttttcgtcgggacaccaattcttaatgattgccaatttggcaaattgaattcggcacattcgttgtacggctttaagaccattttggaaatgggcaaaatatgggtaattttgtaaggctgtcccaccctccatttttgataaaacctaaaaatttggtcataaaaacattcttacaaattatggggggtttcatttcgaccaaaagacaaatgatccatcccccaaaaagccatgccattgacactattttaaaatttaaattttgctatctttccaaaattattccccttttagaagagtgtcagtaaaaacatcgacgatctgaaggagggcgcagttgtcgcgcagaaattggtgaaggcgaagaatgcgtacgaggaaatggtagcgaaggcggaggcgttgctggccaaagcgaacaaatga

SEQ ID NO: 84339 - DNA, 1632 bp, Heterodera glycines
  Genomic contig location: Contig_ID=SeqID_3355; Location=1244..2875; Strand=-
  SCN-specific regions: Sequence locations=1-509,531-829,851-1632
atgcgcgtgtgcattgaccagcagttttttgtcggccaatggcacaccgttttgggccgtactccgaccactaaaatgccgcaaatttgtcgcaacatggcattggtggatgaccaatcggagcccctggtaccgaaaattccccaaaaaacaaaaaatttgcttttttttttacagattagtgcttttgacatcgcgatgacaaaaaccccgctcaaatttccgaatttggaggcggatgagtcgggcgtgttcccagcggacatcccttgtcgattcgagctggacgtaggggcattggtccaacttttggtgatcaaattctttcagttgactttctcataaccattcctatgcaaaaaacggcaaattttttacggagcagaacaattttaagagcgaattgtcgccgccacatttggacgccgctgacagcgacaacgtcgttttgggcagagatgccatttttatttttttatggattgactttttggaggacgtcaaaccgtaaaaattaaaatgaatttgtgctaactcgctcagaaaattcataattttaatttctcactcaattactttgtctaaacattttcaattgcatctctatagtccatgcatttccctcatttcttccccctacctaacattcaaaattagaatttttctgcttttcattttttccacttatccttttgtgcatttaagttgtatctgccatttgtgtacacgcatctaacgattatgagcggcggtcgaccaattaccacacttgcagaggctgtaagtatcttagctagagttggcaaaattgaggcttggattttgtaaatgtttttccagttttaagtggtctgattttgggcctaattgtaaacatgagagtatcatgcattcttccactaagtaaattggcgattatgaccacaattcacctttcccatgacctaattgcacacaaagtgcccattaatggggttggggttgagaaatatcagtttttcttccataaattagtcatccacaaaatggtacaaaaaaagaaaatcctacccctcgaattgctttttgaattgaccaacgcactccgtttcgatgtccggtggggcgtctgtcgagttttcggaaatttttgacactttttgctcaaaaaacaattcgcctggattcgggttgaattgacttcctgggaaacccttcgccagatggtttatataatccaagctttaaaccatcaaaattttaatctgatatgattgaatttagagggctgactttggcagagctaagggccagtttaaacgtgctgtcatggcacttccaaaccactcactggacggtaccttcagctgtaagccatcggggccgcagttctttttttgtcgggcagaggaggggaagggggcagagacgactgattcgctatttcaattctatgctttacatgcctaatttctgcagttgaaattttagctttgagcgcctatttcggcttggactcgagcgtcggtgttcagattgttcgtgacttggggctgaccgatccagcagccatttttgaaaaacgggtggaccatctatgtgagatggtgtcagaacactgggacgtccaaatgtttgggcaagcgactcgtt

SEQ ID NO: 84340 - DNA, 977 bp, Heterodera glycines
  Genomic contig location: Contig_ID=SeqID_19599; Location=335..1311; Strand=+
  SCN-specific regions: Sequence locations=1-130,166-780,862-921,943-977
atgcttcactatcaattggacggtgatcactatggcagtgatcagttggcaatgaatcaattggaagggtgattggggaggaggacagtccaatttaaccaattacagtattccaaatacataaaatcagttaattattacaaaatttataattttctaaaaaatgggtgtccgaaagctgtaagtaactttttaacatgccaattaacttttaaagtgttgcaaaaacctacacttaaattagaaaacttaatgagatgagaatttggctgggtgtcgccgaggatccccgtttagaatttgttccaagttgcccgaaattcaattttttgcgacctgaatttttttaaaatccaacccgaaacacgaaattttgaaaaggagggacaaaatgcaagttcttaaagattttggccttattatttcgattattcgaactgctgaaaatgttccgctcgcaaatcagcaagcaatttcccattcattttgctaggcccaaaatttggttggaatgctcggacgaagctcttcagtggcttttgcaaaatatgccgcacgttgttctgaagttaaaaagtgtttgagtgtgaaggaatgaaaagaaaatcctaaaaaaatgccaaactgaccgtccaactgctcttgggcttgggcccggacttcctcagattgacccaaaggtggcaagtcgaattcctggatggtggccccgtcggaactgtgaaaaagtatggtgtacaaaatattttggcgttgggtgtaattaattcctacccagtcaaatttaaaataatttaaaattgaattttaaaggaaaattttgtgttaaaaataagaattgaaatatttaatttaatttttgaaagttctagcatttgattttacaagaacctgggcatggatataaatttatgaaaaattattccttttaattcaaaataaggtggaaattttttttaaataacttaattttgcta

SEQ ID NO: 84341 - DNA, 1554 bp, Heterodera glycines
  Genomic contig location: Contig_ID=SeqID_19600; Location=720..2273; Strand=+
  SCN-specific regions: Sequence locations=1-239,268-270,312-648,689 -740,762-991,1032-1032,1055-1155,1177-1554
atgaacagttccgttttggttgaaagcggcgtccaattcgaaatgccaattttgtttgctttgtccggcatcgaaatgctgctaaatttggtcgagttgcccacctccgggatgaacatctatctgatcggacgaacaccgatgatccatcgcaatttgaagtttattctgctctaccaaagcgcatggatttttactgtgacttatttaattttaaaaaatccaaaataaaaaatgtatttttgcccaaattattttggaattgatttcttataattacttattaattaataattaatttttcattttatctcttttttaattggcttttccttttcctttttcagcgttccttcgcccgcttttccatttgtctgctcaaatttctctctgccaatgctttggtcagtgagcagctccaacccttcaaatttgcttatcagctgagtgcttacaatcgcaattttgtgccgcacattttgatcattgagcgacttatggccaccttttggcgtaaaaattatgagcgatccgtcggttggcacttttcgctcggatggagttcattcgtggtacactttcattacgcaccgtttgaatttccacggtcttttttccgtctctaatcattgctttaatttggaatggaaaataaatttaaattttggtccaaaagtttgtccatttctttggctggaattttcgcttgtcccctttgtttccaattccctgctgaagaggtccaatttctggctttttctaatcccggcatttccctgtgattacggcacttcgtttgaccacttgccaattgcgtctaattgttgttttgcctttacgctcatttctttttgccagttcatttggttcagtttttcgtcgctttgtacaattcgttgtccacaagcacaaaaaacacttcactctccggcttaatcaccacatttgtgctgctgcttttgggcttcattgaactctttgtaattacccctaattaaataataattaaaatgaaataactattatttttaggtttttatttggctatggcactacaacaaaaaggcgtatatgaaaagtttggcaaatgtgaaattgcactgcttaaccgagcgataccaagtgaaagaagaagcatctcttagtcagaagcaaaatttaaaactgttaagctgtctgagaacattcgcattggcaagcaactgatgccaacagtgattcttcagcttgtcaatgtgttggccacctccgtttatttgtccaccacaaatttcggcatttccgtcaacccaaacatcagtgccatggtggtggtcaccgtgacaacactttgtggtctgctcattgaagtcacaatgattacgtaaatggagattaaattatttctttcattaattaaaattacgaaacataaaattccatttataattaaaaatgcgacaaaatgccaaaatatgcacagggaacaaatacataaaaaaaaaattcattttaaagtccaaattttgaccgggcgcccgcctgggacgccttttttcaaaatttgtggaacta

SEQ ID NO: 84342 - DNA, 56 bp, Heterodera glycines; identical to SEQ ID NO: 52733
  Genomic contig location: Contig_ID=SeqID_19601; Location=1519..1574; Strand=+
  SCN-specific regions: Sequence locations=1-56

SEQ ID NO: 84343 - DNA, 216 bp, Heterodera glycines
  Genomic contig location: Contig_ID=SeqID_19601; Location=312..527; Strand=+
  SCN-specific regions: Sequence locations=1-65,95-216
atttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagcca

SEQ ID NO: 84344 - DNA, 349 bp, Heterodera glycines
  Genomic contig location: Contig_ID=SeqID_19602; Location=893..1241; Strand=-
  SCN-specific regions: Sequence locations=1-251,274-349
atgcatagggcgagtgctgaagcggcgcagcgacgtgccgaaaatcgacgactggccaatgcaggttaataaaaaagaaattcgtgaaaatttgatgttcggcctttaaagcttagaatctcggcaatttataagtacaagacaagagcaaatacttgcattaaaaaaaaaataatatactaagaaacgggggttggtttttgattgaacgcttaaattgcagtagagcccaaagctttcaaactcctatttagtttattattaaattctaggtgcgccgccgattaacgttgatgagatgacccctgcgcaacttgaagcggcgcaaggagggcttgacgggaactga

SEQ ID NO: 84345 - DNA, 160 bp, Heterodera glycines
  Genomic contig location: Contig_ID=SeqID_19602; Location=1..160; Strand=+
  SCN-specific regions: Sequence locations=1-22,44-105,127-160
agttcgtttcaaagtagtcaaagttgccaacacgtcattgctcgcacttttccgtggaaagaaagagagacctcgttcatagaaactgacttcgcatgataaaggatttttcctttcattgtttttgttgattgcgattccgaaataaattgttgttgaa

SEQ ID NO: 84346 - DNA, 1858 bp, Heterodera glycines
  Genomic contig location: Contig_ID=SeqID_19603; Location=96..1953; Strand=+
  SCN-specific regions: Sequence locations=1-196,232-578,600-737,759 -845,896-1071,1118-1334,1356-1525,1550-1769,1791-1858
atgagttcagccgacggcttcttcatctccatgattaatttgttggcttatggtcccattgtcccttttgtcttcgctttgctcattggcattccgtccgccatactgtactgcttggaagtgtgggtcatcatcgccaactttgccgattttaactcggcattttttgttcttgtcgttgtccgcgcaattttggtattttttcataatttaattaattaaaatatttttccagagtttggccaattggatttgccaattttttgagaatcgtttcggcaaaattggcttatttctggcctttttccatcaattgcccgaatgtgctttgtctttcctttattttgctgtcaattttgcatttcatgtggaaaatttgttgacagtatttctgcttttgaatcggttcagctccattttgttgcccttcacttacaataaggtgccaattcagagggggcgcagtcgttatttaaaaaacctccaaatgatttgatgaaaaattatttataacttagctcttaagcaaccaaatttttaattcttcatatcatttgattcgattgctctaagtattctctaccagaatacaaaaaatttcgttaagtttcaaaaaagttatggctagaggaactcaaaaaacccttgttttttgagcatctgtggccctaactgttttgaaacttaacgaaattttttgaaattttgtacactgatagagaacacttttggctatcgaatgttctcaagaattataaatttatattgcttttgagctaaattataaataatttttcaccaaatcatattgatggttttttaaataacaacatagccccattcagagggcattaaatgcaaaaagacttaaatatagtttatttttaattaatttccaattttttttgtttcagttgtggcgttgtgcattggtccccgctttgattgtctctttcgtcctcccacttccgttcactgtgccaattttcagcttacaaatgttcattcacatccaaaatgacaatgtcagcttcacaattgaccattacaagaatgaaaatgtgcgttatcaaataaatatataaaatggaataatttttttttaaattaattttttgaatggttttggtatatttatagagacacctacaatatttggcccatccatctttatttaaaccttgtacaaattctgtaaattccttcttttcaaaaattcttggaatcacaaaaatttaatgatcaaataattgattttgtcaattatcgccattctatcgattggttttccctaattaggcggtgaaaagcagcaaaatctccgcttggtctgccattttctttggcatcatttgtcttctgttgaatttggcctctcttgttgcgtacaaatttcgccgccccaaaagtgttgttggccaagtgcaaagcaattacagcactaataattcaatggtcgagcggaaaatgaccatttatacggtggtctcttttttcggacaattaattatggccattttcatggtaataataataaattaattaattactgttatttgccatgattatgacagataattgtttacgtcacgtccactcaatttgttgatgaacccaacaaatgcaccaacaatggccaaccggcacagtttggcctcagcgcagagcaaacgcagacgcttttcctggccaattacaaccaatacccgtgggtgaacgacctgagcaccatcgccatccccgcgtggttggtgcactcacagatgaacaaacattaatttcaacaaattaaatgattatttaggctcttattgtgggcttcaacaaaaatgcgccaattcatttccaaaaaatttca

SEQ ID NO: 84347 - DNA, 1514 bp, Heterodera glycines
  Genomic contig location: Contig_ID=SeqID_19605; Location=1460..2973; Strand=-
  SCN-specific regions: Sequence locations=1-13,35-118,141-506,528 -783,815-886,908-960,990-1034,1056-1237,1298-1311,1333-1459,1482-1514
atgaaaattgacatattattactattatgcctattcatcatcaaaaatacaattgatcagactgtttctatgaaaataaaacaatcgaaaggatttgatcaaatatttggcgatggatgggagaaaaatttggaggaaaatggaatggatcaaattgatcaaaatggaacaattggacaaagacaaaatgacgacaaaaataggacaaaaaatggcaaaaaaagtgagtcaaaaatattggcaggacaatttgatcaaatatttgatcaaaatttggaggtgaaagaagaatcgggaagcgaatgtgatcaaatggaacaaatgccagaaaatattggacaaaattgtgatcaaattcgaatttcaaatgaaaaacaaaaaagagaaattgttaaaaaattccataaaataaaagagaaaattaagcaaattggaaagaaatattcaaagaaagaatggcaaaaaattgaaagaaaaattgcaaaaaaattaggtgtaaatcaaaggaaaatttacaaatgaaaagagaatttggaatgatgaagaacaaaaattattcagttgaagaaaaaagaataatgttaaagcaatttgatcaaatatatgcaaaattaaaaatgaaattaaatgaaaaattggagggaaaaagagaaaaatgcaaaaaaataatagcaaaacatttgggcattgaaataagcaccatttataaatggaagaaacaattaaaaagtggaaaattggtgcaaaatcaaaaaaatgatgagcaaaaaaaagaaattgtggaaaaatattttaaattaaaaaatgaatttatgcaaattgggaaacattcacgaaaggaatgggaagaatttcatgcaaaaattagccaattatttggtttgagttataagacaatagaattatgggccaagaaatttggcattattcaaaagaattcaaaaggttaaatagttaaagaatttaatttaattaatttaatttaattttttttacagtgttaaaagtttacacaaatgttgaaagaatggaaaagatgaaacaatattatcaattgaaaagccaaaatccaaagctcactgatcgaaaaatgagcgaaattttgaacattccaaaacgatcattacaaagatacaaatcagaaaccaaagtaaaagcaaacaaatttagtatacaatagtcggtcagtcattagcccgcttatacggtaaaatggagtcggaaattgaaaaaatccaaatatttttatgtatttttttttgtaattttttttcttacaaattaatttgtttaaaatgttctactgtttacacaaaattataattgcttttataaacattcagtcttattaccaaagctcactgatcgaaaaattgacgaaattttgaacattccaaaacgatcattagtaaaaagcaaacaaatttagtatacagtagtcggtctagcctctaaattttccaaaaaattttgttaactttcaaaaaatttatggccaaaaatgttcgaataaa

SEQ ID NO: 84348 - DNA, 329 bp, Heterodera glycines
  Genomic contig location: Contig_ID=SeqID_19606; Location=2418..2746; Strand=-
  SCN-specific regions: Sequence locations=1-329
aatgggctcaaccggatgccgaacaagctgaatgccgacggtactttgcctatttacttcatggcccgcaaaaaatggtagtgacttgctcttaatgtataacaaataaatgacatttcgatgcttcttttctttggttgttcaggagactccaaaaactgggaagtgaacccttaatgatttcagttttgatttctagtctttttaagacaattatattgtctcattttgtgtcatattaatgttatatgcccattccatgctgtaatgttgttgccgaatctggtgtcgtttcgagcgcggttttcacgaccattcggatgtggaga

SEQ ID NO: 84349 - DNA, 736 bp, Heterodera glycines
  Genomic contig location: Contig_ID=SeqID_19608; Location=148..883; Strand=-
  SCN-specific regions: Sequence locations=1-156,181-270,295-354,376 -556,580-665,687-736
atgaatatgaaaaattcaaaaaatggtattatgcgaattataataacgggtttattttaggttagtttaaaaatttttaattgaactgtttaatattttagaagaaaaattggatgaatattgttctaatgacacggatattttgatgaaagcgcttataaaaatgagaaaaatatttatagatataacacaagataaggaaactccaaatgggattgatgttttgagaatatcgacgacaattgcgtcttcatgcatgaagtagggaccaaaataaatgaaaataaatattaatctttttagcatttttcgggccaaatttttaaaaaacaatgaaacattacctataattcctgagagtggctttgagccgaaagatagtcagagcaacatagcgataaaatattttgaatggattatgcatcgggacggggttaaagcgaggcatgccggaaatgggggagaaatatcgcttttgggcgacaaaaaattaaaaattgattgtataattggggcgcaaaagagaataattgaatttcaggtaataatggaaatgaaataaatattaaaaaatttttagggatgcgcttttcatgggtgccaaaattgttataaggggtatatgattcaagcgaatggatttacggcagagcaaaattatgaaagaacacaaaataaaatggagagattaagaagtgtagggaaaaagatggggtatactgtagaagaagtttgg

SEQ ID NO: 84350 - DNA, 1731 bp, Heterodera glycines
  Genomic contig location: Contig_ID=SeqID_19609; Location=74..1804; Strand=+
  SCN-specific regions: Sequence locations=1-63,100-254,278-290,312 -1057,1080-1083,1115-1150,1192-1464,1486-1551,1573-1731
atgactgtcacggcggagccttctgacgacaaaaagtcccttccaacagaccttgccactgcggagcatcctccgcccgtttctgttcctggaatcactgcgcctcaacaccctgtacgaccaatatacaactcaaaattggcaactcagaagaaacgagcggcgatagagcgcgaccgactgaataaattggccgaagttcaacgaatgaagacggaactgtacaccaaacttgttgaacaacagaaaagtttgttgaagaagctgcagcagactgaggacaaggaagcgaagaagaaaatagtgaaatatttgaagacattcgagcttaaagtggatggagtgaaaaccgagctggaacaattagcactgaaaatgcgcgaaatgcaaatgcgacaaccgcctaccaagcgaacgcgtactggtctttcgatatccgaacaacaactgttagacaatggggcagaactgggctcgcaattggaaccaagtggaactagtcttttccaagataataaccaacttatttttaaattaagacaaaattcaccagcaatcgcccagtaaatacagcatttccaacaagaagttattgaagtgagttaacccattatttctgttttttcttttccatttttagactttgtcgtgttgtttacgtctcggcttgtccccaggaatttagtgaaaaattaattcttcatatggaacgatttggagaacttttcgattacgatatcaatgcaacgcctcaaattttcacatacaaggagccacttgatgcgcaaagagtattttctgaatttagtccatttaacctttgcgatccctgttttcaaaattgttattatttgaggctgtgaatgaagcggtgggcagttttgaactggcaaaattgaaagtggaatgggcaccagtggcgaagggagtgaaggatgacaaggacatagtgccagacggggagaggaaaccatcggtgttgcatttgttttctttgcctaactaaattatagtaacctaaattggaaggattatataatcataaattttagatttcaaacaaaaaagtattttacggtcttgtaaaattaatttttaattttttttaaatttaggagcaggtcgctgcaaaggatttgatcgctttgctggaatacgatgaggaagaggaagatgacaagaaggagggagacgaggaacagttgtcggacaaggagggaaatgactgattcatccagaccaaaccgactttaacatccaatgatgggtagtgtcgttcagttcaagctatcatgacattaaattcttccaaatcacctctgtattccgtagttcagtgacgtacggtcggtcttacacgtaaacataaaattagtttttattttttcccaatgacttttacgtctctgctttcatagtcgttaaacatgcaaatcctatgtaaaatcggtagaaacttcgatctgtgtgatcatttcatttccagttgttttgacaatataaagtcccactttagcattttccatggtttgcacccttttatttgtcttgtttcccccacccaacatttttcatacaaatgggactgccagtcccttttcatttacatttttggttaatctaagcctatcatgaaaaagatattcaaagattgaatcatcttaaagaatgaagccaaagaaaagacaaactgacaatgagactcaatgttcaattgtgattgttttttta

SEQ ID NO: 84351 - DNA, 387 bp, Heterodera glycines
  Genomic contig location: Contig_ID=SeqID_19611; Location=19..405; Strand=+
  SCN-specific regions: Sequence locations=1-15,37-85,107-126,148 -174,226-328,377-387
atggggaaaattaaacaagtaaacaataaatacaaaaagagtccaaaaactgcgcaagaatgcaaaatttgtgaaagggctacacttttcaagtattacaaaatacagagctgtgatggtaagccaaaaacataaacaaaatgaaaagtttattgccctaatagaacaaattacataattatttttaaagcaattaattagagaaattaaattattatttttttagcttgtaagcaattttttcgtcgtacaatcgttgctcagagaacattcatttgtccgaaatcaaatttatgccccataaataaaggtagctttttcacatatgtaaatataattttaattaaaaataaaaagtttaataaaaattaaaattcgaaataagaa

SEQ ID NO: 84352 - DNA, 944 bp, Heterodera glycines
  Genomic contig location: Contig_ID=SeqID_19611; Location=674..1617; Strand=-
  SCN-specific regions: Sequence locations=1-41,65-103,125-154,177 -300,329-330,389-437,460-796,819-908,931-944
atggtcgaaaaaccgatgaaatttgcattactagtaagttcattttaaaataatttaaaaaattgatcatatttctttaataaagcaaaaataatggcgacacgaaaagtgaaaaattcaaaggaggatcttggccttttgatgctttatgcggtcaaaggagaaggaaaaccagagttgtttggatgtgcatgataattttaattttgcaggctaattaagaacatttagacctaccaatatacttttgtcacttcggctcaccatggttattttctagcaaatataaatattatgcatgtatattttcttttaaaacatttcctatgcatataaaaatattttatgaatcaatataataattgatattttaaaaaaatatttaattcaaagagcttttttatgaatgttgctaaaatgaattttatattatttcttccttttctctatgttttttataataatgcaacaaaattaaagaaatcagaaaaaagtttggaaaattgcaacgtcaacaaacaaattaatgagcaattatttaatacggacgaaatgcaaattgccatctttctaagagactttgcaaatgaatcgaatgaccaaggcaaaggaaaagcaatggaccaaaatggtggtgaggaagcacagacaaatcagcaaagcaatgaattaattggtagtttagaattatgccgactttcgggggtcaattaggatttccatcagcataatacaaaatgagggcacgttcatgagttcaaagttaggcaaaaaataatattggccagttttatcaaaaagcatctttatcaaaaatatttttagctagacttttttcacattaggctggtaattttgcataaaagtggaatatgtaatgaatccttatatatttcaattaacgtgaaaatttttataaaatgcaatcaacataagaaattaaa

SEQ ID NO: 84353 - DNA, 1581 bp, Heterodera glycines
  Genomic contig location: Contig_ID=SeqID_3356; Location=210..1790; Strand=+
  SCN-specific regions: Sequence locations=1-250,272-388,413-429,452 -759,781-816,854-907,929-991,1013-1171,1210-1339,1397-1581
atgttatggcttaaggcatctgctgattggcggccacctcttggttctgtttggaatccatcacatcctttggtaagtttatgaaaagtaccaaaaaatctattttttgagaattttttactttttaaggcaaaatttgaattttgcgaaggaaacccaataagtcaatcttccagagctagataaagatttatgccaaaaaatattgaaatgcttgtaatatgtaataaaaaattaagccaacagcggaagtacaaaaattacgacaattaaaaccccctaagaatggaattaaaaattttcaacctaaaaatcggcttttcaaaaaacctaatgacttttagaagccctaattatgtagaaatttatcactatttaaaatgtacccaaattaattatttatatattttaactagctcgaccggatttttcctggatccaccaggtccaggtcatttttcgacaacctggatttttcatggacctacattttcctggatttttgccaggaaatccaggtccaggcatgaaaaacctggatttcctggataaatttttttctttttatggcgtaatgtatttaaaacgaatataaaatctgcaaaatttttccgccacccttataaatccttatgctcttaaaaattgactcaaaacgaaaaatttggacaaaatttgttagcaattcgcattaaaaattacaaatttttcccggcgacgcctataggcaccgccggactctcctcggttccccctgggaaattttttttaaaaatttttgcaaacagaaatttttcaagaaaaaaatcttagaagttttttaataaggaaattataagaaaaacattttttcaaaaaatttctcgggggggagggaacgagatgctccccatccctcacacattcccaaatagttttttggaaaaatgcgccgaaaaaattgttaaaaatctgatttttgattttgaatgcactgaaatttacaaattgcttattgtttcccaaaattgttaaaatcgatttacctataaacttagaaaaaaatgagaaaattttttatgaaaaaatttcaagattaaattttggaaaaatttttcagcgattttttctgaaagttcgaaaaacttaattcctataaaaaattgaaaacccgtttcaaaattttttcaacttttttttttttacaaatacatattaaaataattttttggtgtgattaattttattatttcaagtgaccgatgttttttcaagttttcaaaaaatgcttaaattggttttaaaatacattctcattataaattagatatttttagacgttcctaagcaattaattgattttttcaagcatttgtttgctttttaaaacaaattttaaaaaatccaggtccaggcctggatccaggtctcgaagagcctggatttttcctggacctggattttcctggatttttgtccaggaaatccaggtccaggtccaacatggaatccaggtccaggtccaggtccaggcttttttcaaaataccgagctctagtaaagactaatcaatttatatatacaaaatgacaaattatatta

SEQ ID NO: 84354 - DNA, 993 bp, Heterodera glycines
  Genomic contig location: Contig_ID=SeqID_3359; Location=637..1629; Strand=+
  SCN-specific regions: Sequence locations=1-84,118-220,264-288,310 -367,403-564,586-749,790-937,959-964,987-993
atgttcccatgcaaagattgtccaaaatggtttctgagtcctgaaaaactgaagacacatcagcgttattcgcacggaagtgcgtattttatatatttttatttcatattttaatttctatacgttaattagttcgtttattaaaaatttcaattttcagaatgtacttttacttgtcacaaatgttcgagagtgttcaccgattcgtcaaattacagggtaataaatgtaaaaaaaataattaattcttaatttttttttttgggtggttttagccctaatttgtgatgttgtatttctgtttattttaaatgtgtttaaaatctatccaagaacagttaccggaccagccagtcaaaatatgattaaattcatttaacattttaaaattctgttaaaaatatgcaattatattttgcctatttctttttgttttgaatattttttccttttcggataagttttagcaaatattctcaacaaatttattaaaatcacatattttccccacgacacctaaattctttttttctataaattggcacaaactgaaataaattacgcatcaaatttaacaaagagagaaatctcgacctgccgaatcaaaaaaataacgtcacttttgaaaaaatgtttaccaactaaattctttgaaaaaatcatgccgcaaaaaaaaaagaaaataggttttggaagtaaaaaaagttttcgtcaataaaaacgatcgaagcattgactaagactggggcaataaaataaatttttaaaatcaaaaataataaaataaaacgatttagaaacattattatcgcgtccactttgggggacacccgttccattgcaaaacttgcgggatggaaatctctaaaattgtaaaaaaaatgtaattaatgtaaattatttttcaaccatttagcgccagcttaagaagcatgaagaacaatgttcacaacaaaattaatcttttgaacatccaaataatattattaaata

SEQ ID NO: 84355 - DNA, 480 bp, Heterodera glycines
  Genomic contig location: Contig_ID=SeqID_3359; Location=1771..2250; Strand=-
  SCN-specific regions: Sequence locations=1-289,311-480
atgtgctcgatattggcacgtttggtgaacatatttgcgctaaaaaatgccggtaatagtggctattcagcctaacttctgctcaaaaataagcacaaatatttaacacgtttagacagcctgaatttcataaacaaatattggttggcattcattactacgaaaaaattcacatctaatacgaaaatgttccattttaaacattattgaaatttaaaaattggtccgatggtgctgtaaagcgctgtcggcgaaattgggctatttaaactaaagttaacagtaacattagttaagaaaattttagactcgataaatcatttatattttgagaaaacatttttaattttaatatcaatatggcttttggcgagagcatttggaattatcttcaactaccaacacaaaaatgagagtacacttaaattatattttacaatgacattcgagctataatagtttacaatacgattaaataaa

SEQ ID NO: 84356 - DNA, 565 bp, Heterodera glycines
  Genomic contig location: Contig_ID=SeqID_3359; Location=3075..3639; Strand=+
  SCN-specific regions: Sequence locations=1-343,365-393,416-540,562-565
atgcgctgcgatttttgtggccacaaggccaaaaatccactaaaaaatttatctgtccgtgtcgaattgagagattgtgttgatcctgagatcacacaaagcaccacccgcaccaccctcttctccaatacggccgaaaatttccttcagttgaaggccaaagaaattgtcgaaataggccaaaaggaaccggagaaacttgccagggtttttgaatcgaaactagaccaacaagtgttggtcaagctgaacataaaggtcgatattttttttgttaaaaccagcttaaacaattcatgttatttaaatttaggaatcaaaaggcgattttgagggaagtgactttgattggattgtttccagagtgttcactgaggacaaagttaaggtggaggaggagaaagaaaagaaaaaacttacggaggaaggagaacttgtcgatgacaaaaccaaccatggagaaattcaaattataggcgaaatgttggccggaagtactgagttcgggagtgctttgtggcatttgcaaattgccaattcattatttttaaacttaattatctga

SEQ ID NO: 84357 - DNA, 706 bp, Heterodera glycines
  Genomic contig location: Contig_ID=SeqID_3359; Location=4199..4904; Strand=+
  SCN-specific regions: Sequence locations=1-706
atggccgagctcgacaaacttggccaaagtgatggagacgatgctggaggtgtcgaagaaggagcgggaatggacaagcgctcacttttgttgagcgaagcagttcaagtcacagtcacttgctttgcgcctcctgttggcgctcgacctcggcattttccccatcaattttgggggtacaacgagaaacatcgtatacagatctgtaactgggatgacaattactgtcttttctacgcattaattggctcacgtgcttatcacgacccggtactgttcaaagaatggacgcaagcccgacaaccgccgcaacaaaatatggcacagctaacattgctgcaagatttttgtgaaagccaagaagcatttcgtctactgttaatcaatcgggcgctgatgcgctcatccgctgagcgtttgttgaatgcagctggcattcgagaagctctgaatgcttacggcattgatcaactccaacctattcaagactattgggtgtgtgtgtatgtgtgtgttctccacagtttgaatggacaattacattacactatacatttttaggaccaacgatttcctggactttatcggattttgttgtttgaagaccggcctgaggtgctgcccaaacccatggaaggggccaactggccgtcgttttgatgtcacattgtttctctcaaatagacattatgatggaatcaaaaaa

SEQ ID NO: 84358 - DNA, 613 bp, Heterodera glycines
  Genomic contig location: Contig_ID=SeqID_3359; Location=5196..5808; Strand=+
  SCN-specific regions: Sequence locations=1-46,69-175,197-613
atgtcttgccaatcagttgcacgattgccaggtgagtgttaaaaaacatcatcttcagcagcatcattatttagcgtatgtatgaacatttttcgtgctatgtcatgaaaaaagaccaattggccatcgttcctgaggctggttatgagcgaaatgaccgagccagtattttggtgaatgaaaatgtatttaatttgcgtacacctttgatatgcattaaggctattaaatacctggattagagagccaaaacagaaggagtattcatatagcatgctggaaacggccgtgaaaaagtcataaaaaactttaagcttgatggctggattgaagagcggaataaatgtatcgaagtgttaggatggtaaagataagtcgtctatttagaaaggactatcatcatcgttataattaaagcttttggcacggctgtgaacgttgatatgatccaaatgacaaattcgttgatggacgaacgtgtcgtgaacttaacgagtcaacccaggatcggttgactcaacttcgtgaaccggacgaactgggtcattgtatagaggtggaggaaatttgggtgcgtacacctattttttatttaattttccgtattttaaaa

SEQ ID NO: 84359 - DNA, 59 bp, Heterodera glycines; identical to SEQ ID NO: 52421
  Genomic contig location: Contig_ID=SeqID_19613; Location=61..119; Strand=-
  SCN-specific regions: Sequence locations=1-59

SEQ ID NO: 84360 - DNA, 59 bp, Heterodera glycines; identical to SEQ ID NO: 52422
  Genomic contig location: Contig_ID=SeqID_19613; Location=191..249; Strand=-
  SCN-specific regions: Sequence locations=1-59

SEQ ID NO: 84361 - DNA, 59 bp, Heterodera glycines; identical to SEQ ID NO: 52421
  Genomic contig location: Contig_ID=SeqID_19613; Location=321..379; Strand=-
  SCN-specific regions: Sequence locations=1-59

SEQ ID NO: 84362 - DNA, 59 bp, Heterodera glycines; identical to SEQ ID NO: 52421
  Genomic contig location: Contig_ID=SeqID_19613; Location=451..509; Strand=-
  SCN-specific regions: Sequence locations=1-59

SEQ ID NO: 84363 - DNA, 59 bp, Heterodera glycines; identical to SEQ ID NO: 52421
  Genomic contig location: Contig_ID=SeqID_19613; Location=581..639; Strand=-
  SCN-specific regions: Sequence locations=1-59

SEQ ID NO: 84364 - DNA, 59 bp, Heterodera glycines; identical to SEQ ID NO: 52421
  Genomic contig location: Contig_ID=SeqID_19613; Location=711..769; Strand=-
  SCN-specific regions: Sequence locations=1-59

SEQ ID NO: 84365 - DNA, 59 bp, Heterodera glycines; identical to SEQ ID NO: 52421
  Genomic contig location: Contig_ID=SeqID_19613; Location=841..899; Strand=-
  SCN-specific regions: Sequence locations=1-59

SEQ ID NO: 84366 - DNA, 59 bp, Heterodera glycines; identical to SEQ ID NO: 52422
  Genomic contig location: Contig_ID=SeqID_19613; Location=971..1029; Strand=-
  SCN-specific regions: Sequence locations=1-59

SEQ ID NO: 84367 - DNA, 655 bp, Heterodera glycines
  Genomic contig location: Contig_ID=SeqID_19615; Location=49..703; Strand=-
  SCN-specific regions: Sequence locations=1-655
aaaaaatcgattttttcaagtgtccgtttggagtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatcggggcgcatcggttcggggggactgccccgaaaac

SEQ ID NO: 84368 - DNA, 269 bp, Heterodera glycines
  Genomic contig location: Contig_ID=SeqID_19616; Location=547..815; Strand=-
  SCN-specific regions: Sequence locations=1-104,136-247
aaatgcttgatttgttccggcgttggtgcgacaattccaatcacttattctcacaatgatgatcctccattagtgtcggcaactccatcaattagtggtggtaaataattaaataattacattcattttttcttatgtatgttaattattgtatatttacaaagcaggaagcagcaaaactgtgagtgatgttgaacgtcgtcattttttgcattacaaatgcgcattggaaaatggtgcgcggattatttacatatataattaataaa

SEQ ID NO: 84369 - DNA, 817 bp, Heterodera glycines
  Genomic contig location: Contig_ID=SeqID_19619; Location=89..905; Strand=-
  SCN-specific regions: Sequence locations=1-102,124-297,330-363,385-817
atggagttcaacgttgatgctggtgggcttggcaaagagtttttctgtgaacacatattcgtggagaacgcatccatagtacgataaaattttccgcactctaaaaaataatgaaaagcaaagggtccaattttagataaataaagaactgataaacgaaaataagatttttttgctcaaaaaaatgacattttgtaagaaactgttcaaattaaattaaaaatggtgatttggggttgggctgagccgattggttaatgctattaatgttcttctaggccataacttttttgaaacaataaaaaaaaaaaatttttttttgaaatttagccgttaaatattttgtaaaatgatgtagaaatcaaaacaatattaaataagctaaaataatgggggaaaaaaatttatgaaaaaagaggattacgattcgatatcccccaaataaggacaaaatctttaaaaaaaaaggtcaatataattaaaagcaaagggcagaatcgaagataaaataaggaattcatgggacgaaacataaggacattttgtaagaaacggttcataattaaatttatatgaaaaaagagggttacgattcgacacctccaaataaggacaacaacacaacccgtctttggattaacaaaaataatttacatttgaggtgacccgtcaaggacctgtccaagaaaactcattgaacatattatcaagaagagcgttatcactgaaaattctgatggcccaggacggtttctatggtcgatcatatggcgaatacataaaactgtgcccatatttttggacaatatattgttaa

SEQ ID NO: 84370 - DNA, 1189 bp, Heterodera glycines
  Genomic contig location: Contig_ID=SeqID_19623; Location=717..1905; Strand=-
  SCN-specific regions: Sequence locations=1-123,145-162,194-207,237 -466,497-548,570-733,770-924,946-1152
atgctgggtcattctgagtggatggatgcgcaagaaatgatggccaatttcattgagcaacattcggtcggttcagttctctcggcatttgctggtcatcatgtgccacaacatattgcaaatttgctcaatgagaatgaagaatccacgcagggtcaaatctttaaaattaatatttagtttattaaaatttgacgcttttacagatattttttaagcaaaattattcattttattacaaattcactacgattttttgcagatctttttttttgtataattatttttaaccgaatgctttcttttaatttctataaaaaaagattctaattaaaattgtcaacctaattttttaatcttttttcaacaaaacaatgcgctaaagataaaacagatccaaaaagtataatcctaataaaattcgttatttgctaagaatacataatttaattatatgcctaataacttattttaaatttttaatataaaaattttagtcttaaaaaactggggaatacatccagaaaaaatgactattgaaacgagcatcattttctcaaaagaaattactcctgcgcagaaagaaaaagtactttttttcaatttcattaaaattttcaaaatattttcttttttaaggtattttccactcttgacagcttccttaaagacaacaatatacgaacggaaatgtgaaattaattaatggtcaggcaattcataaattcacgggaaaaatttaaaaaattttcttattaaatgaaaaaatgggatttttctgctttccacatgaaattctatgtttgttatgtttctatggtattcaatttgttgaaatgatttttcgataaactttaactggcaaatttaattttaaatcaaagtttttttttgtgcaaattttgccaaaattggcaattttcggtaaaaatgtaataattaaaacttgatatcttttttcattctaagtatttttaaaaaattgtacattagttttgacacattacaaattttttgaaattttttaagttaaatgaaatccaattttttatttatatcactattctcaaagcattttaagaagaaaaaaaacagcaaaaaaatttcaaatttttttcatttcatttcgaatgtgcatttttcgtcaatgtgaaatatatttttttgaataataataattaataataaa

SEQ ID NO: 84371 - DNA, 1256 bp, Heterodera glycines
  Genomic contig location: Contig_ID=SeqID_19625; Location=107..1362; Strand=-
  SCN-specific regions: Sequence locations=1-235,264-1256
atggaagccgaactttgctggaccatttggcaaaattattttgaaaatgtacgtggatgggtgtcgacttcgcttacatttgattttctcattttagggcgatccttttctgatatttttcattgccttggctttcacccggggggtccgtgaggagcttttgcaaatgaaagcgcgtgatgacatcatcgccctgctgaaaagcgttcccggccgaatgggtgggcaaattttgataacttttctttctttctttttgatcgcatttcgttgatcagtacgcgaagatgtcaacgatctattggaaatttgctttgtgcacctcaaattaacgccaatttccatcagagaagttaattcattaaaaaaattcattaatattttcgtaataattttccggtaggactttcattgtatgcttttcggctcaaatctcatcgacgaatacgccgaaattcctctgaatcggctcatttgcttgcccatctccgtccacgagctgtacagacgtgccattgacgtgacgacgctgaacagcacgagctttggctattttgtaattgacacacgcaaccaaaagcacttcaacgccggctccatccccggctcatacaatttgagtgctgaaacggtctgtaagctgaaaaatcggatgaaattgtctgttttttctttttcagcttgtcgatgacccagaaaagtttggctatgcgatggattcgctgatgaagttcaagcaggacaattatccgaatgaacacatttgctttttgggctttggaaccaccgacgacggcgaccatttgatgaacatggtgatcgccaagtttctgcaacagaattttgagcacatttccttcgtggacggaggatatcggacgctgcaccaaatgctaaaggatggagggaacttgaccaaactgagcaaccactacaggaggaacgactgcacggaatgcaaagaagggggcccaaaggagggagaaaacggcaaagcgatggtcggtccgcaaaaatgccaaataaaagttccaattgcggattgctctttgtcagacgcacgtccccttttagacgtttctcaaacggttgaaaaaatcgctgccgaagagaaaagaatcaatggcgccgcgggaaacggtcggcccgcgaaaggggacggacatcgaagagaatgtgaagcacgtgagcagcaccgatcggttcggcaagcgctaccgcaacgtgcagtcggtgttcagcatcaacaacgatga

SEQ ID NO: 84372 - DNA, 1497 bp, Heterodera glycines
  Genomic contig location: Contig_ID=SeqID_3361; Location=256..1752; Strand=+
  SCN-specific regions: Sequence locations=1-467,489-1078,1100 -1181,1207-1497
atgtccctaaatatagggatttgggctgaagaagaggacgatcaacgaccgtcgtttcagcacgggaagaaacggccgaacgattctgcaccagtctcttttgtctctgcgggtgttaaagtcggaagcaaaactcaactggcggatgtgagttattttctgactatacatacaattttcgattattccagggcaatcttcaagaagatgaggaagaaagcgaaatttcagctgttgaaactccgcccgaaaagcgtcccactccctcaacatttgtcccttctgtgccttcgaccagcgatgttggcgctcaagtttttgcgggaatgcgttcatccaaatttcaatcaggcggaggaatgaccgacacgacttggataaaagcgggaaaaggaagcgtcgtaatgcaaatgatgcaggtgaatcatacatggatagggggggaaaggggggccattttccttcaaaactggttgataaaatacatttaaaggaatggtttacaaaaaatcagaaacagcctctttgtggaatggcatttggtgattggtttgggatggatcgaacatttggccatagtgttttttaaagtcaaaaacccatgcgttataatacgcggaatagtcgaaatccatttttgaatttggtcagcaaagaattttgaagaatgaacgtggaaatgaatagagccgcattaccccgcttaagtttgctcctccctttgccgtgccattgcgattggctcctccctcagcacggctgtgattggctccaccctcagcccgccacggacagcaaacaataatgtgaatgattgatgggggaaatttgaatatgattttgtctttctgtgccatccctcccccatcatcgccactgttgggagtgggcaaaagaaatttttttctcaatttcgttggatgattgatagggaaatttgaatatgcctttgcatttcggtgcgcttctcccctgccaggcaccactccgttattgcccactgcgatgggagggcaaaaatggactgaaagaaaatgaaatttcttcgcaagtttagttttgattgacagttcagtgtcataaaaaagaaaatttgaaggaccaaacggaattgtcataaaattcaaatgcgaaggacgaaagaattgcgattgcaaaaaaaccaaaaatagtaacgatggacaaaaaatttttgtgtgtttgtgcacaatttacgttgggcaaaaacgaatgagaacaaaaaaacttgttcgtttgtgcacaagctatgttgggcaaaaaatgacgtttgtatatgattgtgttgtgtaaaacataaatgataggaaaaaatttgcgtttatgcacaattgtgaggcaaaaaataacggagcaaaaacttgtggttgtgcattttgtgggagaaaagtgacgaaaaaaaggaataatttgcaggagatgtcaatcaaaaaccgaaatgagaaggttattagtcaaatgagcagtagatttgtgtaa

SEQ ID NO: 84373 - DNA, 634 bp, Heterodera glycines
  Genomic contig location: Contig_ID=SeqID_3361; Location=1847..2480; Strand=+
  SCN-specific regions: Sequence locations=1-105,183-301,323-634
atggacgtaactcttcccgtcagcaactcggcaggtgaatggatcggagaggaacggagggatggtgttgtgctctatgcgccgtggacggacgagtggcatgtgcaacagcaacagcaacagcagcagcatcaacagcaacaacaccaacaacaacaacaacaacagcagcagcaacagcagtttgtccggcgaacaggcacggggtggacgcggtttccagcatggaacgaaccgctcgttgccaacgattggcgagagaaggaggaaaatcggatccaaaggaagcgactacagcgtgaaaacccggagtattgggcgcaaatattggaggaggaaaagcgagccggtgaggagcgccgcttaagggatttgcggttagagcgcacatgggatggctacaaggaaggccacttcgagcgtcggcacaatgacggctcgttttttgaggccagaaaatttcttggttcaaatcgacagaatgactttttttcattttcagtttgttgctggggtcgggaagacagtggttggaagttctggaggagggctttggtgaatgatgttggcatgggattgaaagtgttaagattaactatgattggggatggtatttggcattaatcgctgataa

SEQ ID NO: 84374 - DNA, 803 bp, Heterodera glycines
  Genomic contig location: Contig_ID=SeqID_3361; Location=3455..4257; Strand=+
  SCN-specific regions: Sequence locations=1-418,448-529,551-578,603 -670,692-803
  Gene Ontology: Mol. function=protein binding; Cellular component =centric heterochromatin
atgcccgtcgatttggatgattcccttctatcattggatgtgtcaccgacgaactccttccctattgatcctcccctggccgacgtagattcgtttgtccctgatttggtgccagaactgggcgacgactcggccgagtatttgtccgactctgaggaattcgaggttgagcgaatatgcggccaaaaaatcgaaaacggccgacagttctttttggtgaagtggaaaggatatccgaaatcccaaaacgattgggaaccggaggaaaatttggtcagctttgatcgttttcgaatatttttgttgcccataccgttaattttagctcggttgtcagcccaaaatattacaatattggcgtcgtcgccaatacgataaggagtaccgggcccggacaaaggacgacgagaaatcggccagaggggggaagaagaagaagagcaaagcgtatgaagaaaaaccaaaggccgccgtggatgtggagccggatccggtggaaaaagcaaaagaagagatgggcgctacccctggggaggtgttggaggaagagaccgaaggtctggaggaggaggatgtgtgtaaaaaagggaaaccggaatcggcagatgcgggaccagaggtcgaacaattgaagaaaatgctacgtgacagtggccaaatgccgatggataatgccccactacccctaccccgctgggtgcggggtagtggggcatttaaaaaaaggtacaaaaaattgtacgacgcaatgactaataatatgggatgatgttggatatttatgtattgcttgttgttgcata

SEQ ID NO: 84375 - DNA, 811 bp, Heterodera glycines
  Genomic contig location: Contig_ID=SeqID_19629; Location=433..1243; Strand=-
  SCN-specific regions: Sequence locations=1-139,182-238,273-692,731-811
cattttgaccatcacttttctgcttttctcctacaatgaagttcgtcagggcaattgcattttgttgtgtttttagaatttaatgttttttcaggtgatgccaagagtcagttatttgaaaggtaaattttcttggttgtatataaaatttaaaaatttcaaaaaatttacttaaatttttgcagctttggacatttggttggctgtctgcttcatgattgtgtaagacgtttcggtattataaaacaataaaataaaactaggattttattgttaatataaaaaactagagtgccacgggatcgggaattttgggcaaaccctggaccgggaccttttcgggttgaaaaaccgggaatttgttggctgggaaaaccgcgaaaaaaccgggactagtcccggtcccggtcaaaaccgggaccttggtactcagttggactcagttgtccgctaccaggtcccggtcccgtggcactctataaaaaacccaaatttttaagtaaaaaataaaggggaaaaaattaaaattgaaatatattctggaaaatatatggaatacgccgaatgaaaaaatttctttattttttttttgtcttttttcagctttttgtcgttgatcaaacttgccctcatgaaatatatgcgacaacgaattcgcattgtgactggcggcgcacagtaaaattttttcgaatttaaattaaaaaaattttttaaatttatttttaaaggagttctccgtctgctctgcttggcggaatgttgccgatcatccaactcagcaccggcgctggtccaatgctggattacg

SEQ ID NO: 84376 - DNA, 1178 bp, Heterodera glycines
  Genomic contig location: Contig_ID=SeqID_19630; Location=1..1178; Strand=-
  SCN-specific regions: Sequence locations=1-440,477-567,593-643,666 -758,798-954,978-1121
  Gene Ontology: Mol. function=glycine-inhibited chloride channel activity; Cellular component=integral to membrane; Biological process=cell surface receptor linked signal transduction
attgcgactaaaaatccgcgcgaacagtccatctcacaccgatcactgctcatgtgggcgagagcaaaattcaaaattacaaaaattggaaccgggaggaacggaatttggtttacgagagagataaggagatttaaaaaaagattatgattggcgaaagctgaaaacccgagagtatccactcaagaaatttctatgagtttttacggtatttttgagagcaaaattactgattttgacgatctttcgataattttggtacagtaactgaaacttatttggttattattgaaacgatttcttgaaagaaattacggcaaactaataatttttcgtcataaaaattttgggcaattttttgtaatataattaaaaagttgaaatttctccggcggcgcccttttacacaaattttcttcagaagtttaaaaagtcaatacaaaaattatttcaatttaaattttttaaaatttttacattccttcatttgtccaattttcagactacagtccaatggccaaattctttacagtcgtcgcctttccgttgtggccgagtaaagcaatgaattttttaaattttttaaaattttctccttttttaggtgccccatggatttaactttggcaagacccaattagaatttaatgagtttaattttcaatatttttttcattctctttacagtttccattcgattcgcagacctgcaagcttggcattgaaagctgtaaaattttttgcctgatttttttaatgggggtatacaattttacaaaattaattgttttaatgaaggcttttttcatggtgttaggggttgctcaccgaaattttttttaatttctctaaccttctccgacaaattttttcacagaatttcctccccgatccacgacttttctctccctgaatgtcggggaaaaccctaattttgtcggaacctcgaaaactattttaaaaaattgcattattttgccagatgggtacacctcggaccaggtgtcctacggctggtccaagggccaacgcgaggcactgaaactgcacaaaattcggctgcccgacttccgaatcaaagaagcatttgtcacttcccagttggaatcatatgcgaccggtaaaaattgtttaaataatttttttaaattttttttacattaaaaaataatttaaat

SEQ ID NO: 84377 - DNA, 750 bp, Heterodera glycines
  Genomic contig location: Contig_ID=SeqID_19634; Location=496..1245; Strand=+
  SCN-specific regions: Sequence locations=1-43,65-81,103-247,269-750
aaaacggtgcaaatctgagcagagctttgcataatttgacaaatgaaattggccaaaatggaaagtgcgaattgtcatacgcaattcacaaaaattatattaccgaagctaacaaaaagaacaacaaattcgacgcctcaaattcgcactttatgtatgaattggacaaaatcaacaaaatttcaattgaccaatcaacgaacacattgccaactgcattgatatggattaatcaattgcgcaccgatttcgccacgttggtgccagaaattgggctggtggacatttggcaaaacgttgacagttacacggaaacccgcgagttggtggtgaaattatgtgaaaaaattgctacaattcaaacagatgtgtcttacaatggcagtaatttggttaatcagatcatcagtgaagcaaaagataaattggaggacttcaaagaaaaaagcggtgggtcaaattgagtcgggcgcaaatttgtcactggttgtggtgttcgagatacggtattgaaccttaacgaattttgcagactaatagagaacactactaatatccaatgataacaagaattaaaatcttagttagatttgagcaaagttatgtgtaaaaacctatgattatagcacaccgcgcttcgtctcgggaaatattgcccgccatcaaaacgattaattagggaagggtacaggatggtgacaattagatgggaaataggacggggcgagagttcgtcatgaaaatgaggaa

SEQ ID NO: 84378 - DNA, 1278 bp, Heterodera glycines
  misc_feature (49)..(49): n is a, c, g, or t
  Genomic contig location: Contig_ID=SeqID_19635; Location=53..1330; Strand=+
  SCN-specific regions: Sequence locations=1-195,231-545,568-568,604 -687,709-868,897-1249,1271-1278
atgacaaaggaagtttttgaacaattccgtcaaaaaattgaaatgaatntaagtctttctgacttaattcttcggaaatgggcattaattgccaatagtaaacttggcgaaaatcaaataatcgggttccaagcttcaaatacatggactaacaggttcaaaaaaaggcaccggattgtatcgagaaaggtctgcaaaataaaattattaaaaaattaaataaaaattaagatcacaaaatttatttcaaaaaaacattttgtgaattatgaaaatgtaaagaaggaagcctctgaatttgttgaaaatattcggaaaattatcaaagatgagaaattttctgaaagagatctgcttaacgcggaccaatccggcttcgaacttgaaatgcatgccaagcgtaccttggcaccacttggaacaaaattagtcgaatgtgtagtgcaatcggtggaaagtactacacacagctataccataatgccattaataacggcgagcggaatattgctgtcaccactatttatagtcattgcagaacgatcgggaaaattcccgaaaaaaggaatattccaagtttttaaaaaatatattaccaaaatattggcaattttaaggcaaaaaacatttattcggttgctaataccagtcatattatgaccaaaacattgatggtcgaatgggttgaaaatgttctatacccaactttgcgctcaaaccaaaaaactatgcttttggttgatagttggccaggatggaatgaattcgagaccaaagaaggggtagaattaagcgtaaaacaaatacccaaacatggaaccggaatttgccaaccacttgatgtctacatttttcggtagattttttgtgtaaatattttaaaaagtttaaatttagtatgtggaaagaatttacaaggaaagtcactcaatttgttattgtttgtgaaattgatttaaatttgcacactcgggacaatatcattaaattgcaatcactgatacacaaccagctccaagcaagccggtttaatgcttggataaatttcgcgtggcgaaaagctggattttatgggaatgactccttcccaatttttacgcacccagttaaatattgttttgatgcaaaaaagcagccacatcaatgccaaaagaatgaatgtgccaatgttgttttaatccggtgcgctcattgcgaaatcttcctatgttttgaacatttttttgtcaattaccatatgtgtactgattaaatgattttgatttagagaaaattaaa

SEQ ID NO: 84379 - DNA, 1473 bp, Heterodera glycines
  Genomic contig location: Contig_ID=SeqID_19637; Location=281..1753; Strand=+
  SCN-specific regions: Sequence locations=1-171,212-224,248-349,371 -627,649-741,780-788,812-833,863-1000,1033-1228,1250-1321,1351 -1370,1415-1473
atgttggccaaaattcggacagttgtgcataccaaagcgatggccaattttggaccaatgggtcaaagaattttggaatgccgaacttttctcgtggcgatttcgtcggttgtggcattaatttggccactcggcggattatcttcacaaagaatggccaacctttgggtcttttattttattttaaattatttttatttgaattatttttcagatacttccgatttgttcctttcgcctccttttggttttccattgtttccgttcatttctttgaatgattctggcgatttgattgagacaaattttggaccacaattcaaattcgaccccgcaaaagtaaagagaacaaaattatttaatcaaattcagtgcagtttttctcggcagctattttttttatcaaaatttatgaaattgcacgccgaaaaaagttattgccgagtattgttgtgtaaactacaacagagccctaaattgtttggcctgaacaaaatggacattagtgccgatggtagcccctaattgcattatcgtaaaaacatgttataggaatcgctgatcacgaatttacatccatttagaccaatcccggacctgaattcaaacaaaaagtcgaaagcacattttccaacacatttatacaactaatcactccgaatgcataagtgtgtttcgtgaagactgtgcctataacatgttttacgacttaaacgggggctaccaacagcactattatcacctgaccattttttcaatttttaattctagcttcttttaaccaatttaagaacaaaatcaatcattttttcaaggactccaaaaacccaaagaaaatttttaaatttttttgtaaaaatttcttcatttttaaaggccgaagctgagaatcgaaagctgaaaaatgaaattgagaaaatacaggaaaaatttgacaagaaggaggagcaattggagaaggatttgggggaattgcagaaaaagttggtcgaaatggagcaacaacagaacgaacaacagaagagcaatgaacagatgaaaaaggtgggaaaagaaatatttacggcacattttgaacgatttcggcagaaggcattccaagaagagcttgagaaaaaggtcacggaacgaattgtggcagtgcagtcgaaggttgacaaaatggaaatggcacatcaacagcaaaagggtaagggaaatgagcaacgattactgtacctaccgtaacattgttttattactgtcaattattaattgaatttgttccaatttaagttgtcactgaaaaggcaatttttgagcgaatcggcgaattggagggacaacaaaaacaccaaaaacagcaaggggaaagggagacaaacggcgagaatatattttcaatatattattagttttaattatatttttaaatctaaatgcttttcatcttttaagaaatacggtatacgacttttgaaaatatcaatttga

SEQ ID NO: 84380 - DNA, 1274 bp, Heterodera glycines
  Genomic contig location: Contig_ID=SeqID_19640; Location=1089..2362; Strand=+
  SCN-specific regions: Sequence locations=1-51,74-110,132-361,383 -412,449-513,549-685,708-795,842-1274
  Gene Ontology: Mol. function=cholinesterase activity; Cellular component=synaptic junction
tacttcaattttacatttggtgaccaaaaataaggcacgagtatgtttatgaattcaatttattttttaaattctatgtatctgatacaatttaaaatagggacaaaactcaaaagttgaaaattttcccccgtgcgtttgacggcggcggttttagtgattaataaaaaagatggattactccaaagatgtctcctctgtcactcattacgattttaagagccacaaaaatgaaaaatatgggccagcagcagatgtgcatcagaagaataggctttgtgggttggttgacagagattgatcggctgatcagatggagaattccactgatcggcggaactgatcggaataatttaatcccaaattataattattataaattcggaattcattttgacccttcaccattatcaattatattattatttcaacaatttattattttttactgagcaagtgaatgtcagagaaacagaaataattatcgattcaaattcgcggaaaatcaaaacgatttaattgaaaatagattttatttttatttttttctctgccgatgatcggaccacaagtgattagtcgcctttgtttacgcaacattattcactcttccgtcattgctttgtgcgtcattgttaaccttatgcaagtcagctcatctcataattttaaatggagacacagaaaaaaggggaattttaattggtctaattaaaaaaattcaaatttctaacttttttgggcaaattgttattttcacggaaatttgttaccataataaaaatactagtattcaattttataattataattaattattttaaaaatacattttaaaaatggaagtgataaggaccagcagcttcatattctgtgttctgttcagtccgttttctgttctgtgccctacgtctctcttcgggacggttctccgcttttcggcatttattcccaggcaccgaccggcaaaaccgtcacccaattccttggcgttccgtttgctgagccgccaatcggtaattaaatctcattaatttttgtaggttttttctgctttaaggcaaactccgatttcggcgtcctgtgcctaaaaaaccgtggcgtgatcaatggaatgccaccgctttccgcgactcgtgcgttcagtcgccggacacttattttggcgacttttacggtgccacaatgtggtaaattgtagcacttgtttatttttggatagtttggcaattaattcaaaaaaacgaaatattttatttgtttattttaggaat

SEQ ID NO: 84381 - DNA, 75 bp, Heterodera glycines
  Genomic contig location: Contig_ID=SeqID_19642; Location=104..178; Strand=+
  SCN-specific regions: Sequence locations=1-75
tcaaagtggggaattgaacccaggcgaaaaattatgaaaggtagaaagtttaaccactacaccacatgtgcatgt

SEQ ID NO: 84382 - DNA, 118 bp, Heterodera glycines
  Genomic contig location: Contig_ID=SeqID_19644; Location=1174..1291; Strand=+
  SCN-specific regions: Sequence locations=1-57
atggactcgctggaagcggagaagcgtcgcttgcagggtcgcctcgacgagttggaggggggcggaacggcggcgaccgttgcgacgacgacgacaacagtcgccgacggcggcggcg

SEQ ID NO: 84383 - DNA, 1166 bp, Heterodera glycines
  Genomic contig location: Contig_ID=SeqID_19645; Location=118..1283; Strand=+
  SCN-specific regions: Sequence locations=1-90,147-466,516-643,677 -863,885-1166
atggtaataaattagaatggaacattgattaaagctgaataagagatttaaaaatgcataaatatttcattattatatgttttgttttggaaatttaatataaaaatattgtttttctttttttcattaataaagaaaaattatttgtttgccttttcaagaataattgaatgtataacataaaaataacacacatataagcaattttaacaaaaatatgaatgaaaattaaagcaaaaatatattaaaaacaaacaaaatatatattggaaaaaattggagctaattaaggtaagttaatcgttgcattaacaaggggggtgcaacgtattttaaaaaggttttgtgaacagattgttggccgataaataggttgtggtttttgatcattaattgttagcatccagtgctttgttggccggtaaatgtgttgttagaaaagttgtcgcggtgttttcttcaaaagtaaataaaaacaatttttacattaatacatattatgttaaataaataaagttcattcattcttttctttaaaaaataattcaaatggatctttcatttaattccgagaaagctcctccaaagcgtgccaaacgttcaccaattcagcgattaaaagctggagaaacgatgatgtgcgtataaaaaatataattaattaataaaataatatggttaagtgatataaaattggttttgattatggccgattctatgcggattgttggagaaaaaagcaaagtttggacgattattggtagcgatggagatgattacatcaacataacaatgtgggacaaaaacattgaaaggctgtctcgagaaatcgggaattcttttcaggcaatttttttatataaccaaaaaataaattgtttttaggaaaaaacttacattctcaaaacttgggctgtttttaaagttgccgaaccatttaattatggtagcgttgagttggaattgcgtgcccaagaaggctcaactgtaacaattgttaccaaaactgattatgttataaacggcatcaccaaagaaatgtactttgattttttgggatcaaaactggcactcaacgaaacaaatttcatgccatcaaaaattgaaaatttacggaaagggggagaaattcattgtaaaataacacaaaaaatacaataaaatta

SEQ ID NO: 84384 - DNA, 719 bp, Heterodera glycines
  Genomic contig location: Contig_ID=SeqID_19649; Location=680..1398; Strand=-
  SCN-specific regions: Sequence locations=1-719
atgccgacttttcctcccaatcttttaaaaatccatggttcactccagcaaaaattatcagcaaaacgtactgcggcacacttgacaacatcgcctctctcaacaattccaacaaaacgacaacagtttcttgacggcacggcgcatttggacatcacagcactgctaacctgcactgaagtgtcagagccagtccgtgcagtcattctccaactggacgcacttctcaagctcgcggtggacatggttcatgagacgtcgacccaggacactcgcgcggtactggaggaggaccgacgagaacattcggtcgttctgatgggcgttccggaatcggacagtggcctttcctctacacggcgcgcgattgctgaccaacagcaggtgttagacattctggacgtttgcgaaatgaggcaatgccgaccaagatttaccggatgggccaaagaaaggaaggaggccccgacttctcaaagtggaaatgtcaacccgaaagattacacaaacatttctccgcaataaaacccgtcttaaaaactccaaatttcaagctgtctctgtccgtccatctctctcccctgaacaactcaaggagcggcataatttgatcaattgttgcaagacagcccgcgcccaatttcctaatctcaatttcattgtttatgctggacatgtcattcaccgaaacgatgtctctgtttttcgtgatgaccctg

SEQ ID NO: 84385 - DNA, 78 bp, Heterodera glycines
  Genomic contig location: Contig_ID=SeqID_19649; Location=1407..1484; Strand=+
  SCN-specific regions: Sequence locations=1-78
attaatgaatttcatattttgaagccttaggaatgtaattttaagactttttcgctaatttttatttggcgggatttc

SEQ ID NO: 84386 - DNA, 627 bp, Heterodera glycines
  Genomic contig location: Contig_ID=SeqID_19651; Location=1391..2017; Strand=-
  SCN-specific regions: Sequence locations=1-244,266-332,354-449,472-627
ccgcgggcaatcactccgtccaatttgtcagcaagtgactttggtgcagcatcaaattctgctggcgttgtgtcctatttctccagcccttcggtgttcccatcgtcgcatcgtccatactcttcaaattgggcaccgaattcaaattgcatcagcagcaccaccttcggtaacaacgacagtaccatttcgaccattgagtcggcttggtcaactcgtcgagtacagacatttaacgcatttgttggtggtggtgctggtggggacagcagcgacgaggagccgatggtggcacgggcacgacgtcaagtcatggacagcatggagccaatcggagatgggggcagcgggggaggtaggaatgttggcacggatttgccatggcatggaaggcaatggcagcaacaacaacggcgaatttcagcatctgctgaagttgatcaacacgccaacaacaacaacaacaacaacttcaagcagttcgagcaccgttggtacaacaaggacaatcagcacagcaacggcaacaacacattcaagcagttcgagcagcgttggtacaacaatgaaaaagaggaggagcacagtcgtggaagatcgctgcggtcatctcaccattacagcacg

SEQ ID NO: 84387 - DNA, 439 bp, Heterodera glycines
  misc_feature (393)..(393): n is a, c, g, or t
  Genomic contig location: Contig_ID=SeqID_19651; Location=34..472; Strand=-
  SCN-specific regions: Sequence locations=1-21,43-306,328-439
gtttctgacattacactgctaaaatggtattatttttgttttgcatagtcgcttcatgaaatttgcacttttccttaattaagggcaaacacaaaaagccgttcattgaccgcaaaagtgcagtgaattattctttacacaacaaacatttggaggaggcgcagcggaccagtaatcgtaaaagtgttgcgaattttcgtccctttgataaacactttgaggtaattcaaaatgttgcgatgaataatttaataaatggatggagcaatgcttataggatttttatgagggatatgcgaatgaagcggaggaggacggagcggaggaaatgcatgacggagaagggcaaattgagaccgatcctgcgcttttctcttctctgctggcggatgngcaatcacagcgatgtggcgaagagcgttttcagcgggaggtgcct

SEQ ID NO: 84388 - DNA, 912 bp, Heterodera glycines
  Genomic contig location: Contig_ID=SeqID_19652; Location=14..925; Strand=-
  SCN-specific regions: Sequence locations=1-27,49-338,361-912
gagtttccatctccgacaaaactgttcattgctcaaaaaatggaatgtttgggacgttcaaaagccaaatcattgtgcgaccaaaatgaatcagaggcaccgcagccaaagataaagcgaaagcatttgaagaagcgcagttggatgacactgttcagaacggacaacagcattggggagggacggtgggaaatggcagcgaatggagtggaggagaaacgcaaccgaacaacgccgacaacaacgatgtcgccgaggatgagcagtttcagcgccaataatggacgcaccgccaaatatgggctgggaccacgtcgtccctatgcgagagcggtacaatggactgaatttattcaaattgagaaaagagggggcactacgttcctccccccctcccccccaaaaatttatgaaaattttttcagccattcaaaattttatgatgagttactttgtttttctaaaaaaaatttcctaaaattcactgaactaatttaatttctttttgaaattttcttataaaattcctagttattttttttattaattctttttgcagactccgctgctttcattgactgcacgagcgccatcacatttttcttcgcctttttcgtcgaccattcgccaccagcagcagcgaaagtccgtcgcccccggccgcaacagaaacagcattagcaatgacgacgaatgggttcgcaaaacggaacgcttcatcacacggacgagcggatttgtcgacaactcttcgtcatccaccgctttctcccgtgcaaatcggctggacacagcgatagatgcggaacagcgcagttcgatgcgattggaacgaaccgccggcgccttcgacgggtcgtggcgacggactttggcaccggcggagcacagcaaaacacagccacagcagtt

SEQ ID NO: 84389 - DNA, 1046 bp, Heterodera glycines
  Genomic contig location: Contig_ID=SeqID_19653; Location=1075..2120; Strand=+
  SCN-specific regions: Sequence locations=1-70,92-227,249-252,274 -293,316-377,399-658,701-1046
atgtatgagcatcttttgtccgttcattcgagcggcggccgcggcattaaaatagacgaatatcaaacgacagaaaaggagaaaaagggacagcaacagacgacgataatgcgaaaccatcagcaaacaccgccgatgagcgcatccgcaccagcgacaccgccaacaccgaacaacgcaagggcattccattgtgaggaatgcaatttcaagtgagtgatcagtggcggaggggaaggaagggcgatcactgactgatcaatcagagtgatcacagaggaaccgaacaaaaatgtagtgatcagaataaaagaaaatgactcctcgggaaattaagacaattttactttaggggacgcacattggtggcattggagcagcacaaagtgcaaaaacactctcaacgggcacggaccggcactttcccaaacataacgccaaaaatgtcgggtctgactgcgcattttgaaccgatgatccctcaacagaacggaggaaggtaagcggagtcggagagcggatgaaccatcattaaattgaatagaacgggataaattacggtgaaaagggggtcgtaataacttcccggactgaaaatgtagggactgaaactgactttcgctgccttatctttcatccaatgatctcaaagccatcagtgccttttcccctcaatgcttttcctctgtccccttccatttgcaatggtttgtttgttcagaccgctcaacggtctgtctcttctatctggcgttttgtccgccgcttctctgcccgactcgccgctttcgccgtcctccgtcggcggcggactatttccgcccgcctttccgtcgtcccttcttttcggcactgtgccgtctccgttcttcgctcagtcggccattgttgctgatcagcaacagcaactgatcgcccagctgatcgccgcccagcaaaagttggcctccgcgctgctcggctcaccgcccgccgcgcagcaaaacgcgacgcaaacggcgacaatggccgaagtcggcgactccaatcagcagaaaatgttctga

SEQ ID NO: 84390 - DNA, 124 bp, Heterodera glycines
  Genomic contig location: Contig_ID=SeqID_3365; Location=6843..6966; Strand=+
  SCN-specific regions: Sequence locations=1-124
atgaaaggtcaaaaacgatcgggattaaaaagaggaagtaatttaattagcaaaaaattcataatatttttcagatttaaaaagactaaataatttggtctaattcttttatgaaaaaccaaca

SEQ ID NO: 84391 - DNA, 705 bp, Heterodera glycines
  Genomic contig location: Contig_ID=SeqID_19655; Location=3..707; Strand=-
  SCN-specific regions: Sequence locations=1-54,90-100,123-374,462 -482,504-569,593-705
atgcaaattgatcaaaggactcgattggaaaaagtcagtcaatttgataaagaacagaagcagaagagaaaggtgaattaggggtaaaatatatgttagcaattttattttaattattttaaggcacttttaaatttgcgacaaaattattgggatgccaatgtttgtcatgagaatctccaaatcattggcaacaaaagtctcattgtccattataagagaaatttttctgctggtattttttcataatttacttttctcctcaaaaggttgttgttcgtctgtttttgctaaacatccgattttgctgaataataataattcgtccgagattttttactacgaaatttcagttaaaaataggaaagagtaagaattttttttatttttgaatataaaattaatcataaatattaaaattttatttatttgttattgttatttctttattattaatttttcagttgggtcatcagcatcggattcgtactcaaaaaacagaaagaattgaaaggaagaatgggaaatggcgcttttgcgtatgtaagcaatggcgaaatttggattaacgctgaaggaaaaggaaaaaataccgaatattcctacggtgttggcgataccgtaggaattggcgttacttctgccactcggcagatcattatcaccaaaaatgggcttcgttttggttggaaaagaaatatataa

SEQ ID NO: 84392 - DNA, 1122 bp, Heterodera glycines
  Genomic contig location: Contig_ID=SeqID_19655; Location=1004..2125; Strand=-
  SCN-specific regions: Sequence locations=1-46,68-129,165-224,246 -525,548-610,632-721,745-924,965-1018,1051-1072,1094-1122
aagtgaatggcaatgctattaatttgggcaatgatggacaattatttgatggaaaaaacagtgaacaatcgatcactgatcaacaacagcttaaggtgggcaaaagaaaaacaaaaatagacatacctaaacaatggggtgggagaaaaataatttaaattatgcaatatacaaaagcaattttgttaatttaaataggaatttcgtgaaaagtttgccagaatggaaatggaattgaaaatggccaaattggaactcgaaaatgtcagatttaccttaaaaaataacgagtaaaaatttgtcaaaaaatcttaaaaatttagaaggaacaaaagttaaagtaccaggaactgatgggagaacagaaggcattgaaagaaaaagtggccaaaattgaacaggaaaaggagaaaaatggtaaaaaacgtaatagtgagagctcccggaaaatgcggaaattagggatacagtatcaaaattatactgtcataaaaatagttgtgaatttaattattaggaatatcgaaaatcaaattattaaaacttaggcaacactcaaaaaattgggcccattgaataaaaccaaaggggagaggaccattttttctataaaattatgtttatgaagcctagtcataaaagcttcccatgtgtttttggaatgactaacggatcagtgatcacgatttcgactaatcctaattccttaacccaaattctaaaccaaaaatttaaaaattgataaaactgatttttcaatcttggtttcgaattcgggttaggaattaaaaattgtataaatggatgcaaagtcgcgatcacaatccacaaaaattactgggtacaaatttacgaagtaaaaaatatgctagccaaaaagttgtcataacgttctcagtccattttggtcggcattaaaacattttttaatggataaaatatttttaacgtccattttaagtaataattgggtttatattttaagctagtgttgaggaaggattctcgcaattgcaaaatgatcagaagaaattttggcaattattttggaaaaaatcagtgaattggaaaagcagcaaaaagaacagtcaaaaggcgaggacaaattaatatgaaaataaa

SEQ ID NO: 84393 - DNA, 742 bp, Heterodera glycines
  Genomic contig location: Contig_ID=SeqID_19658; Location=1161..1902; Strand=+
  SCN-specific regions: Sequence locations=1-254,305-319,341-488,517-742
atggcgacatccgttgtctcattattccttgacttgttccgttggttggcactcggatttggcattttgttcaatgccattttaatccaaatggttgttcgtcacactccaaaaccaatgcgaatttacagcaaagtgaacatgttttatcttaatgattttgaactgattaaaacatattcttaagatcctattgcaaacatgtgtgactgacctttcattacttcttatgatgttttttttctttccggtgcattttttatttaaagttgaaaatcaaatttattattttttatttatttaagtgcaattttataacggaaaagggcgaattcgcggcaattttgtacggtttggtcacaataaaaggcgtggagaagggaatttggaatttgttggcatttgtctgctttgtttttcttgtctatgtgtcaatgtttggctatgtgtcccaatttattttccgttatttccttattgtccggtactttaattaaaaataatttatataattaagcaaaattaatcaacgtaattaagcggcaaaaccatttcggctctgaattattttttgctgttttttctgatgcttctgttcccatttgcttattgcgtccatttgttcaattgctattttccgcctgctgaacacggactaatggaggataattatgttgcggaaattctcggcattaatctcgacgaacaaattccgttggcagcttttcctttaatgtactga

SEQ ID NO: 84394 - DNA, 541 bp, Heterodera glycines
  Genomic contig location: Contig_ID=SeqID_19660; Location=33..573; Strand=-
  SCN-specific regions: Sequence locations=1-298,320-413,435-541
atggttctcgtcagcgaattttgtgctcaatttctctcctgcccgacaaagtcacttcgcgatcgactgaaccacccagaggaccgagtccgagttttgcagcaattgattgggaaaaaggtccagacaacatacaaggatcggaatggaatgtgcaagtgttttttcgttggtggaatgactgaacgaggcgcggcatttgaacccgcatatggacgtctgcgtaagccgttcaacattaacgtggcagcgcatttttacgctcgtcaccgtgtcaaattgcactacccctatgtgccatgcatcattgaaggctttacgcgtggtgaggaccgttattatccgagggaactgcttgaaattgtcgacgacaaaaagggagggcgattatttggtcgattgttcactgaaattgaggagcgggaggaggaggacaccaaaagtgaagcttcacattcttccaactcttcctatttacaatttaacggtaaaggctgcaaatggtatgaaagcattgacgaaattgccaacactgggcgtg

SEQ ID NO: 84395 - DNA, 308 bp, Heterodera glycines
  Genomic contig location: Contig_ID=SeqID_19662; Location=947..1254; Strand=-
  SCN-specific regions: Sequence locations=1-308
cctccaagatgggacagagtgcggcgcaaggctcaaccatgtcaaattcgcagatgcccggtttgtcgacctacgcaggtgggagagaagggcgtcgattttccttgcttttttcactaactctcaattttaggcgttgcacaatcgccaactccaattgaagtctcggcctgggcggtgagttgaaaatgggctgggttttgacttctctaactttcaacttcacatttaagcaacctccgaagcccaagtgaattgccaagaagtcgatgaacggacgatgtgcgctctgcgaagtacaacatttg

SEQ ID NO: 84396 - DNA, 1244 bp, Heterodera glycines
  Genomic contig location: Contig_ID=SeqID_19663; Location=1367..2610; Strand=-
  SCN-specific regions: Sequence locations=1-25,56-345,391-632,655 -657,683-856,879-901,933-1012,1034-1202,1242-1244
atgtcaggtattttttgcttttaggaaatttttttaaattaaatttaaattttttcgaaatttccaaaatcccgcaatcccgcgcgggatcccgcaaattttaaattcgggatttgcgggattaatcccgcgggaccccgtcccgcaaaaaattttgagttccaatcccgcagcgggatcctcaaatttgaaatttccggtctctagttacaatacaaattatcagtcgcccgctcattcactaaaaaataaaaagcaacggaaaggaaaaaagccaatgttagcatattattcaccagcattgtatttgataatagttttctgagttattagttgaaaatgaacatttaaataaattataaattttacttaaaattaaataatttatttcgcagatttgagtgcaaattgttaacagattttgtccaaataatgaccaaatttacgatttttagccagttttttaagagaaataaggatttttaggtgccggaattttaaacaaattttcttaacaaaatcattaaaaatcccaaaaaaaatttccccggcggcgcttatcgggaccgctggcgcccccaaaaattgtaatttctcttaaaaaattgttccaaaaaatcatttctcgcacatccctaccccctctccccgcccagcttgttccccaaaatttttgaaaaaagcacgccacagccacaaatggtgtagctgatttatactaattagaaaaaacatttttatcatatataaaaaatcaggacatctcgattttttattaagccaataaatgagaaaaatttgaatttatggcatttaatagtttttatattttttaatgtttttgtaattgaatccggcaaaatccgacagaattttgatgaaatatttggcgacggatgggacaaaaacgaaaaagaagaattaatgataaaaattgaacaaaatgagcgaaatgagaactcacaatcagcagcagttgatcaaatgggtgaagaaatgggaaatggtccaaatgatcaaatgggaaattataccgatcagaacctttttaaaggtgatctgaatataaatgatcacaaaaagagagaaataattaaaaaatttgaagcaattaaagaaaagttgaaggaaaaataaaatacaaaagcaaagattatggaaaaattgagagaaaaattgcaaaattattaggaacaaatctgcaattaatacaaaaatggaaaaatgaattaaatctaaataaa

SEQ ID NO: 84397 - DNA, 320 bp, Heterodera glycines
  Genomic contig location: Contig_ID=SeqID_19667; Location=630..949; Strand=+
  SCN-specific regions: Sequence locations=1-103,125-320
atgcttttttcgtgcttatccgttcgtattaagtgcgcaaaaattttaggcatttgcctaaaaatcccagccctattaataattgattgcatctttattttgtcaaaattatgcagaacaaagtggaagaaacagttgactgattcgcttcgacagctgtgccaggaccaaatgtacggaagtgttgccaacggaggcaacggattgggccaaattgggatggacgaagacggcaattaattaacccggaaaattttgctttttcttttacctatcgaaatcctatcattcttctacattaaattcaaatgcgtttgtta

SEQ ID NO: 84398 - DNA, 782 bp, Heterodera glycines
  Genomic contig location: Contig_ID=SeqID_3368; Location=785..1566; Strand=+
  SCN-specific regions: Sequence locations=1-311,333-338,360-431,454 -577,599-708,776-782
atgcgtctttccgttctgcttgcctatttgtttctgctcctccccgggcccggtggcgcccaatttggccaattgccaataggcggcggcgctttacccggcggcgccacactgcgctcaaacccgctgattaatggtaaaaacggcgcggcgaacattgccccgccgggtgatgaacaaatgtgccaacaaccgctccaacagttcgcccttttgcccccctcccaaacgtcggcacggcgagaggagcgatgtgagtgatcggaaagtgattagaaaaggctctaatcaatttttgggttgtcttccgcaaatattgacgccttttaaaaatgacgcaaaatttcaatttaaatttccctgggttttctaaattttctcccattgccttaggctgttgctgttgttgcccccagcaacaaaatcaaatgcctcctccacctcggcctccgtcatgtgaattttggaaatttatcaaagccacaaatatttttgaaagaaaaaaagagagaaaaaagggcattaatcacattcaaaaataatttaaataatgctggtctacccacaaaacaggctgctgtctctgttgttgtcctcagcaacagcaggcgccgcctccgcccccgccgtgctgcgtaatttgctgctgcgaagaggtcgaaatttttcgaaaattttagtttttggattttaaattttcagcaaagaccgccacctccgcctccaccgccgattatccttcagcctttgccgcccccaccgcccccgccgccgcagggtaa

SEQ ID NO: 84399 - DNA, 2452 bp, Heterodera glycines
  misc_feature (184)..(184): n is a, c, g, or t
  Genomic contig location: Contig_ID=SeqID_3369; Location=901..3352; Strand=-
  SCN-specific regions: Sequence locations=1-77,100-103,125-232,254 -439,472-673,697-1089,1112-1235,1262-1422,1445-1574,1596-1906,1946 -2015,2037-2089,2111-2353,2384-2452
atgacgacgacgagcagttcaataacagtgacggcacaaaaattaaacgacgaaaggcaacggggaatggcacaacgccaacaacaacagcaacagcagagaggggcggaaaggagtagcggaggagaagcgcaagatcagacacagaatgccaaattcagcagcaacgaaccgatggaagtgnccggaattggaaacggcagcgaaaacaatggcacagatagaagtgagcaaattaattaaaaattaaattgtcattttcttttgaatagagttggacatctaaagcggaagaatcggctgaaattggcagaaatcagctgaaaccatgcaacaagttcaccggggtcagcggcgacgttggcgttgcgaccgtggcgccaaattcaaaccattcactgtccaatgctgcgcttaaaaatggtccaaccgtgggccaaggaaagcaacaacaacaacaaccaccagcacattttgacccggtttttggcactttacccccgggctttgagccctcgtcgcccgggttcgcttttcccgaagagtcggtgctgaacaacaacaaattgatcgaattcgacgtgccatcgcaaacgcaacaaccgtcggcactgaatatcattaataatagcatcgatttgagcaccaccgataaaaatggcatgatcattttaaatgaaattttttattgtaaattcgaatatttgaaggggttgggccgtccatcgaaacgtcgacaatctctgcaaaaaacagcccaggacggaatgacactgatctgccaaaatattggagtgagtttttatcgtggacagataaatgaaccaaaatccgtaaaaaatgaactactgtaattcggttattgtaagtttaatcggtaccaattgaggcttaaactttgaattcattcatcatactagcctttcatttcaagcaatgatcactaaatttattttgcactgatccattttcccgtcacgaaaataatggcctttcatgggataaaaattgaaaataatccttttatttcaaaattatttttaaagcgaatttttattttttaaaaagagatttactgattttatttgacaagtttaattccctttattggcttaattacatgcaatttggcatttgttaacttttttagctttcactcggcttccctttatcaatcgcacggaattggccaattccgcgccgccgtcggtgccaattgtgccctcctcctcctccaacaacaacaacaacaacaacaacaggccaagggaggaggaaagttggtcggcggtcgatttggagttgaagccgccccatcttggccaagccgattttttcacgcccaatgaagccaatcaaagcaaaaagcaaaacaacggttcattagctgaaaggcagcagctaattttggacataacaaagtgccaaagggagggccaaagtgccgacgacaaagtgccaacggaaaaggaagcggagcaaagtaccgtagcactagtggcaccccaattggtggacaccgtatatacggaggtaccggaggccattttgccggctgctgtcgatctgagcagcagtggcaacaaggccgaaatgttgcaattggcaactggaaatggtacggtaacggcagcaccggttcaaacagaatttaaaaaagcggccaatacagtaatcgaacgacaagaattaccaacagcagcagcaaatacagaaatcgaacagcaacagaatgcgattaatttcgatgcgccgacggaatgcaacaaaacgctggagggcatgggaaacgagaagcagaatatggtgggagacgagaagctacagcagagggacgaacacccgaagaataaaacggacaaatttgtcaagacaaaaaatggaggtaaaatggaacaaattggacaattaaacataaatttataaaattaattaatttaatttagaagatacttgctgcaatttgttacgcttattaaaaagcaacagtgacaatgtgacgactgaatttgctgcatcaattgatggaattggaggaggtgagccgccagaattgcttcccgtcactgagttgagggtaattaggggtaattaagagaaaaataaaaagcgattattaattttaaggatcaacagcaaaagccggagaaaaatgcccttaatggaatcaatgacaataaattggacgactcaatacgccaaacagtggcggacggagaacatgaagcagaagtggcaaatgaggagagcggcacggtcaaagcgaattggaaagtgatcgaagagggtgggcaaagagagaaagcggcacaatgccaagggaaagcaaatttaaaatttaaatttagcatccacaacaacggcaacaactacaacaacaacacagaacgggggactggaaattcttaaggaggacctgcgggaggagaactgtacgaattataataataaa

SEQ ID NO: 84400 - DNA, 340 bp, Heterodera glycines
  Genomic contig location: Contig_ID=SeqID_3370; Location=238..577; Strand=-
  SCN-specific regions: Sequence locations=1-215,334-340
atgctcgccaaccatcgccaacttttcctccattttctgttcgcaattgccatttttgtctttgtcattgcgccactgatggccgattcggagcacgaaatccacgctgatcagcagtgagtagagtccataatccttattaaaactgatgccaaatttggttaaaagtaaatttaatttgcttttcagaagtgccataaatcccagagaaaaacgctggggcggcggatggggcggcggttggggacgcccgtggggttggggcggcggatggggccgtccttggggctggggcggcggatggagacgcccatggggcggctggggctggggacgatga

SEQ ID NO: 84401 - DNA, 245 bp, Heterodera glycines
  Genomic contig location: Contig_ID=SeqID_19669; Location=117..361; Strand=-
  SCN-specific regions: Sequence locations=1-64,105-209,231-245
atgggcgttagtcaaaaaaccatcaaaatgaaaaatatcgatttttggtcgttaagaattttgcaaaaaaattataagaaaattaatattttacataaaaaattcccaaattaattgtttaaaagaattaatcataaaacacataacttaattctcttttctttttcatttcatatatttcagtctgcagttggtattggatttaaaattgcttcaaaatggccacttccatcataataaataaa

SEQ ID NO: 84402 - DNA, 470 bp, Heterodera glycines
  Genomic contig location: Contig_ID=SeqID_19669; Location=910..1379; Strand=-
  SCN-specific regions: Sequence locations=1-470
atgtctgaagcctacggttttctcgacaggttaacaaaaagaataacgcgacgcagaggcaccactcctgcagcttcgggatttggagcggacagttcgatggatggtggtgggtgacttttgactttgtttctccaattagctcaactcgtccctcccattttcctatttaaggcggtgtttctaaggtgtgcatcggcttgtgcctctgcattctgattctcgtgattctgttcgctattctccttttggttgttgcgcttacgcctgaaagtttccaaggcgttgctgtgctgggaggcctcgcgagtatattcggcaattaaatcgaaatgcgatgttcttcgatctctgttgttgtcccataaggcataagcctaagtacttaattctcgagttgttcacttatcgtacatttgctcgatgtatttttattttgttgctaatttcactctgagtatgtaaataaa

SEQ ID NO: 84403 - DNA, 322 bp, Heterodera glycines
  Genomic contig location: Contig_ID=SeqID_19670; Location=485..806; Strand=-
  SCN-specific regions: Sequence locations=1-7,29-37,64-87,110-298,320 -322
atgtatgtaatgtttttagaaaactgccattttaaggtaatttttattttgtttaagaaaacaaagttttgaaaccgaattatgtacataaacaaaagggaaaaaggaattgacaaattaaagtgcacaaatcaataaaacaataaagcaacgaatgtgaattatgtaattgataaatgtgtgagaatatcattttaaccgtaaaatccaaaatatttggtgtagctatatgcttacattaacgaataattccttatttgtcataaatagacacagctaatttgccaaaaatttcatcatcaaatgaggcaaggcaattaaa

SEQ ID NO: 84404 - DNA, 45 bp, Heterodera glycines
  Genomic contig location: Contig_ID=SeqID_19670; Location=1191..1235; Strand=+
  SCN-specific regions: Sequence locations=1-45
atgtttgactatgatcgagatttgaacattgcccagcagttggct

SEQ ID NO: 84405 - DNA, 2041 bp, Heterodera glycines
  misc_feature (109)..(109): n is a, c, g, or t
  Genomic contig location: Contig_ID=SeqID_19672; Location=100..2140; Strand=+
  SCN-specific regions: Sequence locations=1-680,709-737,760-1203,1240 -1483,1542-1548,1570-1639,1662-2041
  Gene Ontology: Mol. function=anion exchanger activity; Cellular component=integral to membrane; Biological process=regulation of pH
tacgcacgggattcgatgcagtccggtgtccatttgtccgcttcgtcgagcagcggatcatcgaccgagaccactcggcacgaaaatgtgttctactgaaaattagtgnaataaatcggctttatcattcattggatatccttttatgttgcgctttttcacgtgtttaggctgatgagcgacttttgaagaaattgcctccaaacgtcgaatcggctgcccttttggtccgttcgtcccaattcgatcagtttttctctgatctccagttttcttcaggtggctaatgtcagtgctttggaccgtcctttgagtgcttttgtccgtcttaaatacccaaccgtatgttttgttttactcattagtggccaatttgtcacctctttcagttgcttcatcccgaattgcccgatcacccaattcccgtccgtttcatttatgtgttgctcaacccaatggacaattacccaaatgagacaataaacatcggtcgggcgatgggtgcgcttttgtcggatgaggttgaaaatgaatagggcaattagcaaagaacggacgcgggggaaaatagaaaaattatatttccaaaaataaaaaacactaatcgaatctgtgcaagttaccatttgtccaccaattttcactgatttggcatcgtctgactttgttttttcagcttcattaattaaatataattaattttattttgacccaattaatctcagcattcggctataatttcgtaatttgaatacttttgccaaatttcgtcagattttccaatcggtcgcctttcattgtttggagcgccacactttgtcggatgcggtcgacgaatttctgtcccaaattgttctcattccgccaggcaattgttcgctcgaaacacgatggaagccggcggacagagacgcgggaggggcggtcagaaaaagggcgaaaaactcaaaaaggaaaattggcgcgcgtttagacggtacgccacgtcggaatgctttacgccaattacacccaatcagtggacgaattgccctcctcatttgcaccgtttgtgcccagtgaatacagcaccagcaccaaagaggcggcagccgcctctcggcacttgcaattggcccacctcaacgcggacgcacggccttaccgtaccgggagacttttcgggggactgatggccgacctacggtgggattggggaaaaacaaaaataaatattccaaaatataaatatataattatcccaaaatataattccccccttcttcatcaggcgcaaattgccttggtttccgtcggatttctcggatttcttccgcggccgtctcagccaatccctcgccgccaccatccttctgttcttcgccaatctgtccaatataatcactttcggcgccattatggagcggtctttccaccaccaaattgcttccattgaaaatacgtttgaaaattacagaattaattactcatagttgttctcctaaattaattaatccaactaattaattaactaattaccccaattaatttgttaattaattgtctctctcttttcaaatataatttgtggcgctctgtccggccttctctttggcctattcagtgggcaaccgctgagtttgttttagctaattctgccaatgttctctcccatccttcagatgttctgtccgccaccggtcccactttgatctttgagaaaattctttttgatttttgcacgtaatttttcaattttttttttaatttccgccatttccgcccttccctttcagtaccaaccattgggagtttctgccctttcgcttttacgtcggcctttggatgagcttttatctgatcattttggtagccaccgatgcgtccgcgttggtcgcactgatcactcgcttcactgaggaggcatttgccactctgatctcgatcgtgttcatcatccaagcattcgagaagttgttcgagatcagttacgaggcaccgatcacccgacagccccagggggagggatcaaattgagaaaagaaagaacattgttgaagga

SEQ ID NO: 84406 - DNA, 382 bp, Heterodera glycines
  Genomic contig location: Contig_ID=SeqID_19673; Location=80..461; Strand=-
  SCN-specific regions: Sequence locations=1-164,186-252,310-382
atgaagctgattgaatccagcgacatcgtcaaattcccagacaatgtcactttcgcgctcaacaaccgtgttgtgactgtgaagggaccgcgcggtacgctcaagcgcgactttcgccacttaaacattgaaattatgcgagaaaacccgaaggtattctgagtaacaaacaaacaaaatctgaaatttatagagtgctcttttcatttctaattgttgttgaaatgattgcgctttcgtttaaaatagtctcaaatttaaacttttatttttccaactttcaaaatgctaaaatggtgggtttttagctgctccgtgtgcggaaatggtttggcatccgcaaagaagtggcagccattcgcacagtgtgctcacacattga

SEQ ID NO: 84407 - DNA, 316 bp, Heterodera glycines
  Genomic contig location: Contig_ID=SeqID_19673; Location=2114..2429; Strand=-
  SCN-specific regions: Sequence locations=1-316
tgaaaagatgagaacaacaaagcaattggtcaattcaatacccggtaaaggtaacacccgagatccttcgtcagagttccactgggatcactggccgggcaacttggcatccgtcgccttgaaagttaaaaacattgactggattttagagtataccagtaagctgaatatactttgtcagaagttccgagatggcggtcaatgctgtcaaggcggcgctcaagaagcgctcgaaggtcagcaaaacggtcttcaagacggctttcaagacggcgctcaacgtcgccaacatgttcgttggtccgcagggtcatag

SEQ ID NO: 84408 - DNA, 743 bp, Heterodera glycines
  Genomic contig location: Contig_ID=SeqID_19673; Location=1722..2464; Strand=+
  SCN-specific regions: Sequence locations=1-719
atttgctaaaaaaatttagttacctaaaatgcctgtgcgacaaattctctcgggtacccgcagaattgcgaccaaaagtttgtgttagtggtttttcaaattcgataatcatccgttttccctttgacagcgtttggaattggttcggcgaggttggccgattacgtgagtgatttaggattttaaagcattcaaattgctttattcaatcttttccatttagggtgtctttaaggccctcctcgagcccttagtggtttccaagtttgaagagctatcgcgcattagagtcgaaaaaattagtaatttttttcacttttttaattaacacagagtcttaaatttagcgatcttttttgggatcctcgttttcgtctcattggctgacgttgctatgaccctgcggaccaacgaacatgttggcgacgttgagcgccgtcttgaaagccgtcttgaagaccgttttgctgaccttcgagcgcttcttgagcgccgccttgacagcattgaccgccatctcggaacttctgacaaagtatattcagcttactggtatactctaaaatccagtcaatgtttttaactttcaaggcgacggatgccaagttgcccggccagtgatcccagtggaactctgacgaaggatctcgggtgttacctttaccgggtattgaattgaccaattgctttgttgttctcatcttttcactaaagtcgtaaaaataaagttttaatgtaaaatg

SEQ ID NO: 84409 - DNA, 789 bp, Heterodera glycines
  Genomic contig location: Contig_ID=SeqID_19677; Location=12..800; Strand=+
  SCN-specific regions: Sequence locations=1-182,205-370,392-594,617 -685,709-789
gaccccggcataagcgaggacctcaaggcgaagagacatgattgtctctataaagaaagacgtacggtaaaggggatacttgaaaatagaccacagaaggtagtgattgagaatcatgtacccggtccaaatgttgcaccatatctgggcctcaataaccaatccaaaccacaggagaccgaagaaccacggaaaataattattcctaggaaaagacttaaagagcaaactcctgatcctgaatcagataatgatacacttgaggagttaagtccggaacctcaaacaacatcaatactcaacccacccattccgatcaaaactattatacacccgacccttttaaatggtctttttaggtacgtgaaagaaaacaaagatttatttaaaattacggcggccggaaaggtacagtcgaacatgaatttgccgattgaaaacagtaattatagagatgttttgttgtatctcgcagggaagaaagatgaaacaccccggggtgcaaaatttctcaaagatcggttactgaaggatccaacagtaaaagacatggttgataaatcaaaggtcatgtggggacgtggaaggaaaaaggcaataaaatctataaaaacacccggcatagcacgagagaagaaacccttcaaaccactaatatgggccagactgtagagaaaatgttatcaaaaatttattttaatttaaaatctccggcaagttttgctggaattcaaaaaattttaaatgaggccaaaaagattgacccggaaattacgaccgatgacatta

SEQ ID NO: 84410 - DNA, 464 bp, Heterodera glycines
  Genomic contig location: Contig_ID=SeqID_19677; Location=866..1329; Strand=-
  SCN-specific regions: Sequence locations=1-99,121-228,250-464
atggtcgtgaaaataataagtcggagattattggcgctatcaactcaatatttccgcaacgcagttagagtttatatttagatgataattagctgaaattttgagaatttcacaaggatggtcgtgaaaataataaatcagagaatattattaacccgatccttctacaatattgctgcagtatttatttagagattaagtagctgaaattgtgagattctctatttacatttcattatcactttgaaattctcaaaatttcagctcattatcatggaaatataaattgtataggcgtcgcagaaggatcgagtcgataagcgccaataattttccatttattatttcagcacgtcgatgcataccaacagatatttgtaaccgtcgttatgctttttcaactgatcaaatatgcacaaatcgcactgccaatcggtatggaagccgctcggtaccgtctttag

SEQ ID NO: 84411 - DNA, 684 bp, Heterodera glycines
  Genomic contig location: Contig_ID=SeqID_19677; Location=1370..2053; Strand=+
  SCN-specific regions: Sequence locations=1-44,68-144,166-244,266 -373,395-503,527-577,601-684
atgtatctgtataaatttgttcaagtaaattgtaaatcggaaattattagcgtttatcaactccatacttccgcaacactttatacagtttattttgagggggtaatgagctgaaattgtaagaattatacaagctggccaaaccaaaataataaatggaaaattattggcgcttatcgactcgatccttctgcgacgcctatacaatttatatttccatgataatgagctgaaattttgagaatttcaaagtgataatgaaatgtaaatagagaatctcacaatttcagctacttaatctctaaataaatactgcagcaatattgtagaaggatcgggttaataatattctctgatttattattttcacgaccatccttgtgaaattctcaaaatttcagctaattatcatctaaatataaactctaactgcgttgcggaaatattgagttgatagcgccaataatctccgacttattattttcacgaccatctttgtgaaattttcacattttcagctcattttcctccaaatgtatctgtataaatttgctcaagtaaattgtaaatcggaaattattagcgtttatcaactccatacttccgcaacactttatacagtttattttgagggggtaatgagctgaaattgtaagaattatacaagctggccaaaccaaaata

SEQ ID NO: 84412 - DNA, 759 bp, Heterodera glycines
  Genomic contig location: Contig_ID=SeqID_19678; Location=64..822; Strand=+
  SCN-specific regions: Sequence locations=1-466,490-759
  Gene Ontology: Mol. function=protein tyrosine phosphatase activity; Cellular component=extracellular; Biological process=regulation of cell cycle
agtcataattaatcagctttggcgtcacggcgatcggagcccaacgggcacatttcgaacggacatttaccaggaggacttttggccgcaggggtggggccaattgtcaccccgggggatgagtcagcaagtcacgcttgggaagaagttgcgcaacagatacgtagagcaactgggacaaatcagcggctcttacgacagtcatgagctgtatgtgcgggcaacggatgtcaaccgaacactgatcagtgccatttcggtgggggggggggggaggacaacaaagaaaaatgattggttgtttttgcagaatttcatcggcttttatggcaagggaaaagctggccgtgattacccaaatgaaagcgattggcccgccggctttgttccgatcgcaattcacacggtcgatggaaacaaagatttcatttctccgagtggttcgatgcttttccgtctcccacttcccccccccccccccccccctccgcaggttcgttgtgtccgcgttacgccgaattgtctgatttgattgggaacaccacggaatatcagaacacttatcaccaatattccgtatgagaagggaataacacttcgattgattcaaacattcgaaggttcttttagagtcttctgaaattcttgaacggatgaagccgaaaagaaaggtgacattgtcgacatttggctgtttcaagacactttctttgtcgaggtgaacaatatttgaaatggctttgaattgggaaaaagtgg

SEQ ID NO: 84413 - DNA, 385 bp, Heterodera glycines
  Genomic contig location: Contig_ID=SeqID_19679; Location=163..547; Strand=-
  SCN-specific regions: Sequence locations=1-309,331-385
atggtcaaagcaaatgaaaatcggacaaatggtggaaagaaaagaattgcctcaatggcactttcacttttggaaaaggcacttcgaagagaagacgaatttggggacggaacgaagtcggagataaaacgagaaatgttatcgaaagaatgtgatgaagtgaacattttttatgttcatgggattaaagaggagaaaaaatatgcgacggaaaagcgattctctgaagaagcaaatcaatcggaggaaagaatgaagaagcgggggcttttagtttgatggatgaaacttcgaagaatggggcaaaggaaggaacagaggagtggggaaaacacgtctttaacagcaatttgaaaacagacaaaataatgaacagacaaataaa

SEQ ID NO: 84414 - DNA, 1032 bp, Heterodera glycines
  Genomic contig location: Contig_ID=SeqID_19680; Location=338..1369; Strand=-
  SCN-specific regions: Sequence locations=1-241,263-406,428-1032
atgccgaagaagttccagagaggaaatccgaccattcaggccagacgacttttacgacgcaaggatgttatggccaggtggctaaacgaggacacgatgcaaatcttcgcgtgcgctgagttttcaatgcaaaatgtggaatatcaagcagtcaacaactgttaccgctacattccggtccaaatccgcattgacaagaagacgctcaacgcattcctggatccggagcttcacatcctcacagcgtcatcaccattcgcagattgtggaaatttccgctaccattatctgcaactgagccagagcaattggatcaaaatcgacacacgcaccgctacgatccagaaaatcgactccagcagcatctctgagatccacgaagcctctggagacaaatcgttgttggaaatcacgccgcttgtttttcatcgatggacgatcgacaacgaaacaggcgaagggctattcgcgcacttggatgaatggctgcgtttggatcaatggaagtcgaaggagaaggagcacaaaacggcgcgtgcgctcacactgggagccctcccgagcggagtgattggcctcaccgaagaatggttcatggacaaacttcgactgctcgtctcctactggacaacggcatgctgcatttacgtcacattcatttttgggcgcgatgtcctgatacccttggtatgggtctacttaatggggcccgtcatcgttaccatccgcaatttggtgacgggaaatcagtggacgcagcggaacagagctactcgaggcacacggcgagcaccggcaatttcaaggattgaagcaattgagctggtaccgccttcaatgccccaggaaatgagagcgaacgaaacgtcaagttcacatcaagaggaccccgagccgtcaccgctggtgatggagctgaaacgacaaatggtcgcattccgttcgaagcgacgttttcaaagccgtgggaatgtcgcggctgaacgacagccgcgaatgtccgttgagcggacaaatgaggatgacgggtag

SEQ ID NO: 84415 - DNA, 716 bp, Heterodera glycines
  Genomic contig location: Contig_ID=SeqID_19681; Location=860..1575; Strand=+
  SCN-specific regions: Sequence locations=1-121,143-260,282-431,453-716
atgttcagctttcgaatgataccaagattgttagatttgatcgacaacaaaaaaagttatagtccaaaaacaagggctggcgccgaaacggcggcgccgaaacgatacagaccccagagaaataagttgtacaggaaaacatttgttggaacagagaaagaaaatataaaaatagtgcattcatataattcagaaaagaaacaaaacaaaagagagagtgagggtagaaaagtcttaccaatttgatttctctgtttctcatttaaacccatattttttatcattttcactagacacacttttttcccttcttcgttatccgcagccgctcgttacaccgccgccgccacgtattttactgcgccggaatggcgcaaatttttggctatataattcagcaagaatttcggaataatgatatagcttgaaggaaaatgtgattgctaatcagtgatcgcagatcactaaaatattcccaacaaattgatcaatcggtccattgcaggccaagcacgcgctgtaaaaaggagtagaaatcaacgagttcatcaatctgaaacaatgatgaaaagcagaattttcatggaattaaattggatcggcagatgttagttttaccaattttgcggtcggtgtgccgacaatctcgtgcccctggtccacccgtatctttgccaacacgggattccgttgccaactctcagcttgagtgcgca

SEQ ID NO: 84416 - DNA, 121 bp, Heterodera glycines
  Genomic contig location: Contig_ID=SeqID_19681; Location=1849..1969; Strand=-
  SCN-specific regions: Sequence locations=1-121
ccttcaatttgctctcgtaaattaatctgcgaatagatccttccttttttgctgctttattgagtattctgcagcctctgcatgatcacaattcatttactgtcgtaataaacagaaagaa

SEQ ID NO: 84417 - DNA, 723 bp, Heterodera glycines
  Genomic contig location: Contig_ID=SeqID_3371; Location=1993..2715; Strand=+
  SCN-specific regions: Sequence locations=1-624,646-723
atgtacgtggacatgggctaccggacgaacccggcacggactgacaccaaagtgccgtcctcgccatattcattaccaagacaagaaaaggcggcagatacgcgaaccaagcgggatcagcagcagcttaagccgaatagagaaaggtgggacatattttatagaattgggaaattttaatcaaatgccaaaaaaactgatcagcgggcgggggagggaatgatcattgctgtcaattgatacgaggatgatcaactgacttttgatctgatcagcggtgaccacgataatcatttgaccattgttgatcaactggcactatcaaaatagtgaccaagatgttcaattggtaccaagatcggtcaattgaatctccgttaacttatcaatctaacacggtcaattggtctgatcatgttttaccaaactgatcagtgggaaggaattatttgtcattttctgatcgtaattttgtatttttttaattccaggataaccgaggaggaagtgcggatgttcggcatggatgtgactgatcagatggacagtggtgatccgacggagagtgatcaggaggggaaagccgagaatttattgcccaaaactggggttgaaaatcatcctaatttggcggtgaataattgcgccattccgtcaatggcattcgatgaatgttcacttttgtaattattgtagtttttttcaaatttttatattgaaata

SEQ ID NO: 84418 - DNA, 282 bp, Heterodera glycines
  Genomic contig location: Contig_ID=SeqID_3371; Location=3067..3348; Strand=-
  SCN-specific regions: Sequence locations=1-2,24-124,146-160,182-282
atgccaactgaaccatttgaattggtgaacgaacggacgaaagaaaagctgacactgaaacaggagatcgaagcattatccaacgaaataatttataattggctgttgcaacggtgcccaattggggagacggcgacggcgccagttaagtggaaaaaccgcgaaaattcgggcgccaattttaactatatcagatttgctctacggcatgccaattattcggatgccaatttgaacaatatccgatttgatttgtggggtgcaaatgatcccattgggtga

SEQ ID NO: 84419 - DNA, 671 bp, Heterodera glycines
  Genomic contig location: Contig_ID=SeqID_3371; Location=3456..4126; Strand=-
  SCN-specific regions: Sequence locations=1-671
atgaaccgccggtcagcaaatattttgaaaaattacaaaattttcatttaaaattacaaattttcattttcccccatccattttttccatgtttcagttggctttgcagcgacgtgtggatggacattctgccatcttttgaccgtcctcaactcggactcaaaatggcattgctttccgaccgtttcgatgttttggtggacaaacatttcgacagaaaaagcgaattgacaatttggagaagtgtcgtaattcgcaaggacaaaggaccaaaagcaaacaatattggaccaaaaccgaaagtgtctatattaattggtggctatggcaaatttgtgggatttccattgccggaccatccgttgcccaacaaaatcagctttaagaaccttcaaattcagtcatccttaacttttgtgtacgctaaagcatttttctcttgctttaggtacattgactattccgtgatcaaatttctccgctccaagaagcgattctttgacagaaatggcaccaaattgaaagtgtttgtgcattcaattgatacggatgtccaaccgatttgggatgtttttatccgtgaaatttggccaatttttgcgacaaacattcgtcatttgggctttgacgatggcgatgctttggacaaaacttcaaagaggtgtgtctag

SEQ ID NO: 84420 - DNA, 278 bp, Heterodera glycines
  Genomic contig location: Contig_ID=SeqID_3372; Location=74..351; Strand=-
  SCN-specific regions: Sequence locations=1-278
atgccaattgaaccatttgaattggtgaacgaacggacgaaagaaaagctgacactgaaacaggagaccgaagaatcatccatcgaaataatatataattggctgttaaaacgatgcccaattggggagacggcgccagttaggtgggaaaattgcgaaaattcggatgccaatttgaactaaattacagatttgatccgcggtatggcaataatgcgtgtgccaatttgaacaatatccgatttgagttgtggggtggaaatagttgcattgggtga

SEQ ID NO: 84421 - DNA, 378 bp, Heterodera glycines
  Genomic contig location: Contig_ID=SeqID_3372; Location=1153..1530; Strand=-
  SCN-specific regions: Sequence locations=1-305,327-338,360-378
atgccaattgaaccatttgaattggtgaacgaacggacgaaagaaaagctgacactgaaacaggagaccgaagaatcatccaacgaaataatatataattggttgttgaaacggtgcccaattggggagacggcgccagttaagtgggaaaaccgcgaaaattctgatgtcaattttaattatatcatcagatttgatccttggcatgacaattattcgggtgccaatttgaacaatatccgatttgagttgtggggtggaaatagttgcattgggtgagcagcaaaagcaatttttgattgtcgaaaaaatataaataattttaggccattgtcgctgccagcggaagaagaagcggatgaaagcattgaaaaataa

SEQ ID NO: 84422 - DNA, 864 bp, Heterodera glycines
  Genomic contig location: Contig_ID=SeqID_19682; Location=73..936; Strand=-
  SCN-specific regions: Sequence locations=1-414,455-864
atgggaatgcaccgtattcctctattaattagcattccctccaatataagcaccaacggcagtccgaacggctccaaattggcacattggataccacaggtgcgctcaaatcgcagtctgaattttcacagaattgtagtgtgatccgaagcttttactctgatggcaaaatgatcaatttggcagttttggcattaaaatttggtgccaaaattaaaaaaaaagaatggatccgcaacacatacaggataggctttccggatggaaaaactatgttttaccatactttatccgatacggtatttttaaataccagaacaaaaccatttgagattgttggaatccctgaggatgagatcacattaggccccgtccgaatatagcaaaataaaagaacgttatctttgatagaagaattaattaaattttttttcgtaaaattttttttaaaattcctttattttagaaaaccgattttttaacagaacaaattgatttgaatttatttttgttaattcgatgtatagttattttaagtttaaaatattttaatgccctcaagcgatttgcgttgtatgggcgggcgacattgaatttgcaaataccgaacagtaaaatgaatttcaattctgttggtggtaccaataggccgatggaagcgccggagggcattctcaacggaaaatccattccgaccggcaatcatcaatttcacatatttttcatcgggattgatttgtatttgtcaaatcatttcatgactgaatgaatcattcgatgatcactcatttttgttcgaagtgctttcgattactttttctaaatttttaaaatttttcaattccttttttctgttttattaaa

SEQ ID NO: 84423 - DNA, 1987 bp, Heterodera glycines
  Genomic contig location: Contig_ID=SeqID_19683; Location=131..2117; Strand=-
  SCN-specific regions: Sequence locations=1-59,109-191,259-298,351 -413,435-499,544-811,843-1048,1079-1084,1107-1151,1174-1348,1408 -1564,1619-1638,1660-1793,1833-1987
  Gene Ontology: Biological process=reproduction
atgccggtggcacaaaatggcggcatttttggcacaccgccgttggcacatgaagttcaagcagtacagcaacagcatcagcatcatcaacggcaacagagcagcagcgaagctgaaagtatcgtccatcaaaggaaacagtccatggcggaccatgaggaacaatggaaagaagtgaattattttatgagtttttaattttttaatttgtatagaataattttcttaattttaaaaattgatttattattttttaaagttcaatctttagcttgtaccatttgatctttatgcttccaatatttttattttttatccaatttttagtaaattattatttaatattttttcagattgatgaattgttgcactcccttcaacacgattcccaactgattgcccatgctgatcagcaaaatcaaaacccttctttactgatgaaaaattcgtcaaaaaattctatttcatcgtttaacagcagctctgtaaatattttctctataaaatttattatttttttgtttatttatttttttataaattcccattttccaattttcagtcacctaatagttgtgccggcgccaatggcgtcacagcttgtgcctatcaacccattgttcgatggttgagaatccaggtcattagtattctctaaatgatcaatttagcgttcataagctttgttttgttcaatggacaaatcaaattttaaaaaaatccgcaattatgaggttttagggaaggattcgggaattacaaaatttaaaaaacacgaattggtcaaggtgggactaagtcgggagcatcgtcatcaccagcaacagcagcagcaacagttgaacaacaatggttgcagtgcgcaagcgcttgccgaactgcttcatcggcacggctttgacacagtccgcttcatgaagggatcactgaacacggcactgatggacgaaattggggtgccacgacgagtgcaactgcaaatatgccgtttcctcaacgacaacacagtgccggagcacattcgcagtgctggtacaacaacaacaacaaattatttaattatatttttgaatttaatcggaaaattttgatcgcattttttaaaatttgagactgtataaaatttgttcaaaccctgaggaataaaattcgattttagattttcagtttttcccgagattttaaaacatcccaacaactcgttttagagcaattcgaatttgtgtcggattggctcgactcattggaccttctcgaccatttgggctcatttgcgttggcaaatctcacatccacaacggatgtgatcgctgcaaagctgagcagaggcgatttggaagtgcggttgattaaattttgatttaaattcattaatattttatttaaaaaaaacattttttttttaaagtacggtaataagaaaaattatggtaattggtaatcattttattcctatttccagaaaatgaatgtcacccaacttggtcacatcgctcgaattatgcggtccttggatttggcggtgcaacagcgaaagaaattgcataaatccagaacaaattcgtaaaaattttttttaatttaaaataaattttaatttaattttcaattttttaaagaaattcttccggttcatcgtctcctaatgtttctgtgaatggttcatcacgagaagcttgttcagcaatgcaatttatgtcgagcttaaatcaaaatggacaacaaaatttgaggcaaaatattttcgggtaaaaataatgtttttttattcataaaaagtgattaaacattccataaaataaattaattaataacaaaataatattttttaagtgtgtctccccaatctccaattatgaatattgctgagctgagggtgcgtttgaaggaggacagtgcccgattttctgcacattatttgggctccacggaaatttcgaatgtcgaaggcaccgaagactgccggagggcaatgcaatcggccaaa

SEQ ID NO: 84424 - DNA, 1143 bp, Heterodera glycines
  Genomic contig location: Contig_ID=SeqID_19684; Location=726..1868; Strand=+
  SCN-specific regions: Sequence locations=1-196,222-231,253-321,343 -347,377-852,874-1143
atggactactggtttttagtccgtaagtccgtatggatgcctagtccgtagtcccgtcctgatccgtattttcgcaaaatgccgatctctaattttttgagttattagggccgattttcttggtttttaggtatttttattactaaaagtttaaaatttgaaaaaaaaaattgttatgctgtacaatttatttacaaaatacaaacaaataaacaaaaatatatctctgacaaatgagaatctagctaaaagtttcaaaaatgcactcctaaaaatgaaaattttctcaaaaattcctctacaatttattatttatttgatgaaaatttttggttttccaaattatatatctccataaataaataaataacatatgtctttttcctgtaatttaaagcaatgtttttgggagctcgttcaactcttttcattgatcgtaaagatgccggccaaaaattggctaaggctttagcccatattttgcctcaacgtgataacattgtaagaatgagggctcttctgcagtttagtttccgatatacttttatgtgtacaaaaaaccctgaaatgttggagttcaatctttcaaatgctaccaaggatataggcatatgtattaaccaagtaagaaaaaaactatggcctaagaaaactgaggatggtcattgattggatgcgtaaactgcagtaacgccgaattgggtgccaaaacgatagtattttgtggtttaacaggtggttttggcacttccgcgtggcggagttccagtggcttgtgaagtcgctgatgcctttcaggctcctctcgatcttctgatggtaaatgcaaaaccatcggcactattaccatgatttttacttcataatatatattttaggtaagaaagataggtgctcctggccatgaagaatatggaattggtgctgttgtggaaggaaatccgcccgagctcgttatggtgggcagaagaaattgttgcctaatgtaaagttcaattctaagaatgaggaggctgtcagaattacacgaccatctgaagcatatgtgcaacagcaaatgcagaagcaactcaaagaaatggagagacagcgaaaagtgagtcatttaaaacacgcaaaaatggatttaaccgaaaattacta

SEQ ID NO: 84425 - DNA, 254 bp, Heterodera glycines
  Genomic contig location: Contig_ID=SeqID_19685; Location=71..324; Strand=-
  SCN-specific regions: Sequence locations=1-254
atgattttcgggccattcccggcgaatatcgcgaaaagggcgaagctggcgatgggctccttctctgctggttagtttggtcttcgtttccaagccgattcgttcccgtttccagatgaaaagtccgataataatcagactcagtttgagattgtctacgtttgtcgtcggtctccatcagaggttgcaaatccaaggagtttgactgttgagttgttttcttgagcgatttgaactgatccgagtgaaataaa

SEQ ID NO: 84426 - DNA, 2018 bp, Heterodera glycines
  Genomic contig location: Contig_ID=SeqID_19687; Location=72..2089; Strand=+
  SCN-specific regions: Sequence locations=1-232,254-517,540-1519,1541 -1599,1627-1901,1923-2018
aacacaaaattgcgtccgtcagcaaacagttggacgagaagggcacaaagctcaaggaagcgttggagcagaacgcgtcgttgaaagacagaattggcacactcggtgagtattttgtgcccttaaatttaaggacatgtttcgaggacggatgagaaatttgtacaaaaaacaatttagagcaagaaaaattggaagtctcgcttctcattgaaacattgacaaagagtcgggacagactgcttcaggaaaaggtcggtttccgtcgacaaataataatttacagtttttgctgcccaattcaaattattaaaaccggggaaattgccaaaaaaaagtggcttattgttcgaaaatcgagattttcgaactttacatcataaaatgttaattcaattcgtcgtttttcaccttttttaatctaattggggtcggtgagccttttgctttactactggtattgttgcattcatttaaccattcatgattcgggtttttgaatttggtcacggcccaaattatgtttttcttgacctcaatggttaaaatattcgcacatttttaaatgattgataattgtcaattactttccttaagacggacctccgaaatgagctgcttggcctcgagaagcgcaaagatcagctcgaattgcaagtggccaagttgaacagcgaaaaacaccgccatttgggtacacaatccgctggttttctatcggttttaatttggcctaggatctgttccattttccccaaaaaaaaaacaaatttttcttttcagaagacatcagtgaactgcgccaaaagtgtgacgaattgtggggtgaacggaccgagttgcagagccaaattgacgacttccaaagtgacaaggcgctaattgtggtaggattttcttctctttttttggatggaattttgtggattttttcatgtttttatttttgaccctaacatataaacatgaaacataaaaaagcagtaaatataaaataaatgtctaataaacatttcaatgtccacgcctttcccttacatttccccccccccccatttttcaccatttttggttcaataacctcctttctctgcatattaataaaatgtacagcttctgttaacaaacaacaattttgttgtgtccctaaacctcccctcttcatctctgcccacacttctgtgtctctctggcattccccccccctcccccctctcaattgctgcacaattaaatatttgtttatgagccaaatgaccccttcgcagttcgacatttttgttcgcgcttttcaacacaaaccagcactgattgaaagtgtcatttgattgtttatttgtgtgcgtttgtggtgtgtctttgttgggtggtttctgctcttttttgtggtcacatcgctttgccccaaatttcgtcaaattccgcgcccctttttcattagttgcacacacaccccattttccagctcctttctgtaacaaaatacgcttcttttcctttgttaaatgtgcgcacctcccattcccccctcattttgccattgctttgtttaagcaaccgattcggacggaatggaatggtccaaaagttgttcaacaccagaagaagatgaagacgaagaagaaggtgtttcatgggttttcaatgtgtgaaaattgctcccaaaatttcctaccaaatcagtgcaaagtcccgaaaatatgtggcccaattggtaatatgccgctgccgacattggccagtgtgtgtgccaagtttaatgatggagctactactaatcctttgttggcggataatgttggcactattgaaattgatggtgatggtactgctggtgccaatgttgatgctgtgcgcccgtcaatgtcaaagtcggaaaaaagggcacttcgtagaagcagtaattaattacccaattaattgttgacgcaattcaacaaaattttttttccacagggaaaaaagctttttggaggaagcaaaacaattgtttgtccactcaacaaacaaacaaagaa

SEQ ID NO: 84427 - DNA, 488 bp, Heterodera glycines
  Genomic contig location: Contig_ID=SeqID_19688; Location=1282..1769; Strand=-
  SCN-specific regions: Sequence locations=1-281,391-425,457-458
atgtctcattttacgaatatgaaaattgaacttttagcatgcattttaattaacggtaaagcacaggcaaaacttgaaatcgggtggagacacaatgccaaggcggggagccaacaaaatgtgccgccatttttcagcccatttccggctttacccattcatttgcttgcgtagtatgaacgaacgcgcaaataacgctaatccggcacattttgtatttataaaatgtatgaaaataatagaaaattgaaaaatgaattttaaaaaggaaaaactgaaactttaatatagatttatacaaatttttaaatggaatattgaaaaatatttaatttatcaaatgaaaatatgaaattttgtataaaaaaacttgaaaattaaaattttttagggtaatttagaattctaaacttgaatttttaaaattggggaatgaaaattttttaatttggaaaagcatttaaattttttttaattttataaataaa

SEQ ID NO: 84428 - DNA, 152 bp, Heterodera glycines
  Genomic contig location: Contig_ID=SeqID_19688; Location=2774..2925; Strand=-
  SCN-specific regions: Sequence locations=1-152
accacggccaaaccgattcaagaattgctagggaacttattgaacaatttcagcctttcatttcatttcgtattcattaattagccgataaaaatgtgcgacgaagaagttgctgctctcgtggtggacaatgggtccggaatgtgcaaggc

SEQ ID NO: 84429 - DNA, 927 bp, Heterodera glycines
  Genomic contig location: Contig_ID=SeqID_19689; Location=664..1590; Strand=+
  SCN-specific regions: Sequence locations=1-243,266-927
atggtttgtgactaaatttagctttttttggtcaatttaggaacaaaagtgaaaattttcaaaattctgaattttcgacttttgttcgaattcgggtccgggattcgaaatagggcaaaatggatgtcagattcgtgatcagcgaccctgaaacccccgtaaacatgtttccacgacattttagaacaaaaaaattttcttttaaaaaagggggggcaccatcgatagtattaccgcaaccttatttaaacttttttgcatttaaggttcttgatgtaaacaaaacccaacaagaaccaaaggtggggtaattttttagaaactttaattttcgtcttttaaggctcctcctgatgaagtgaaagagacgccacagggagacaactcggaagaagttccaactgaagccattgttgttgatgttgtcgacacaccaaaggaagccgatagtgaaaatggaaaaaaagaaagtgaaactgcggagaaagatcagccatcgtcacagaattctcttggaaacgaccaaaagaatgaaaaagtaagagttgtttctcgatttgattttgttttatgtatttgcttcaattcagacttctccggctcaaggtggtcttccaaaatggatggtgcagaatgccaatgctccgccatccccttctcccgaggttgatgggcataaagagcagcagcagtcgtcagcatcgcctcaaaaagtgcgtggcagaggccgtggacgtcgtccggcagcggagaaaacagcagcacccaacgataaacgcgtccaatcgcctacggtattttgtgaatttccttttttattggtatacaaaaaattactctgttttattttcatttcaggatgataagacttcacaacgtccaagacggtcgacccggactcgtaaaagtacgcaaatcccgatgctg

SEQ ID NO: 84430 - DNA, 103 bp, Heterodera glycines
  Genomic contig location: Contig_ID=SeqID_19690; Location=2379..2481; Strand=+
  SCN-specific regions: Sequence locations=1-27,49-103
ataaaagtcaacgtagaagcctaaaaccaagtggaaaatgtgttttttatgcttaatatatcgaaactagcgcgcagaaaaaaaaaggcatatgcctcaaaat

SEQ ID NO: 84431 - DNA, 941 bp, Heterodera glycines
  Genomic contig location: Contig_ID=SeqID_19691; Location=729..1669; Strand=+
  SCN-specific regions: Sequence locations=1-339,392-941
atggcacttcagcagagactgaccatatttatcaaaatcagaagcattggacaacgacattacgaaaaaatagcactggtgaaagaaataaatgaaaaatatgaaaagaaaaagtaaaaatggaatttctaataatttaaaggaaaattggtaattaattaattgattcatttcatgggctttgacgtttttcccttcaagggttttctgagtttcgcgtcacagaaatgctaccgcatcgtaatgccataatcgcaacctctgagtctccaattgttgttgatgccactaaaaaagattctctgacaatgccgctaatgattgaacggcttgaatttgttaatattttttaaaattatttaataattaattatatataatattttttaaactaatgactaaaagacactttttaggcgcgaaaactgcgtgaggaacaagtgaagctggaaatgttggaagcgattcgccgcgaacagcttggcaccgatgacccggacccgaattgtattatttgacaaaaagaccatttaaggggtaaatctttagtggagagacgaagacaagcaattgagaaaaagttgacacaactcgcacaatcggaaagaatccaccgagaaatgttggcacacaatcagcaaaggcacgagacggacaaagtgaatttggcatttgataagggaatcaaaatgacagaaggaacaaatttgaggttgcttcttcaattcgctcttcattcttagcgatgccatgcgaaacaatgcgacggttcgtccgttggtttcgcgtggacagcccccgggaatggattcgccaaaattgccaattggccaaacgccactttcccaatgccagctgtgaacagattgaggcattgttaagcaaatgcgtacgataattgcatatgcaatttccatatatttatatactttttctgtaaa

SEQ ID NO: 84432 - DNA, 431 bp, Heterodera glycines
  Genomic contig location: Contig_ID=SeqID_360; Location=9..439; Strand=-
  SCN-specific regions: Sequence locations=1-50,72-281,312-431
atgtctttcactgtcactgtttatgcaatacgagtttattaccggaaaggtattaaagtttgaaaattggacatatgaaatgatttgttataaaaggtaattaaataaatcgaaataaattttgaaagtcaaacttttttgcaattgtctaaaaaacggccattagccattgttttgctgtttttaaaatcaattctgaatttttacacaattttggcatttttgagggttaaaaacctttttttggcagttttaaggcacattttagtgcatatttgggcattttattttatattattttttcaattaaagatactgggtccaatgtcgagaaagtgaatcttcgcataccgtatttgctcttttttatgtgccatggtatattatttttcaaccttctcagaaaagggtacataattggagactggtag

SEQ ID NO: 84433 - DNA, 372 bp, Heterodera glycines
  Genomic contig location: Contig_ID=SeqID_360; Location=1010..1381; Strand=-
  SCN-specific regions: Sequence locations=1-30,59-158,180-186,214 -216,244-306,328-372
atgataccaagattgatgggatttggaagacaaataaaaaagcttttgtggaaaaacttgctggcgcccaaccgtgcgcgcccaaacgtaagcgcctacttgagcgattccgaaaaaatttcattttttattgacataatgccataattttaatcaaaatattgttgaaaattacagatttctcaaatttctttgaattttttaaaacttttccagctgctcatttccaaggacctccttggcatccaaggacgaatgggagccctgctctaattgtatgcagcccttgccaaaaacccaaaattaatttatccattttgatgactattatttctaattctacgcatttctacggtagtgtttcgaaataaa

SEQ ID NO: 84434 - DNA, 1242 bp, Heterodera glycines
  Genomic contig location: Contig_ID=SeqID_361; Location=1735..2976; Strand=-
  SCN-specific regions: Sequence locations=1-103,125-330,352-448,470 -748,770-782,813-949,971-1151,1183-1242
atgcaaaaattgattgccaagaacagtgagtgtctaatttcaacttagtttcaatttgtcattattgcaaagattaaccaaaatctgtgtcaatccaaaccgctcaaaatgaaattttaattttccaaccttcactgtttgggcattccaaaattgtgggtaccactggtgccagaacaacgaattgccgatcagctgcaccggtttgccgtttgagccgaccaaattggtgcctttgacggacaattggccgaacggcggtgcggcagcatcgacaaaagtaatgccaacgatggcaaggaggacgagttggacgaacatttgtgatcaaaccaaaagcagctaggaatgattatttatttgaagagtatttttttattaagagaaattttattggattgccaaaactgattttggaaagagtatttatagggcgacgaaacggaaaaaatttgacaatttaaaattttgatgaattcgccaaacattttgattgttcagcttgcgcatgcactaatgatcatatcccgttcatccaaaaagcttatgcgcttttctgttcaatattttacttttcaaattttttggctaaattttgtttgttcagcttacggtgagtgattttgacagctcagagacgtaaatctccaacattttgaatgcgtttttctattttttttattagcacagcctatgaaattaattttcatttttgagcaattcatttttaatatgcttattaatgaacttttgaaatgattgaaaaaatttatacatgtaagtttaataatttgttattttttatatataaacctcaccaaattcgacaaatgatttacccgaagcctctcggtcttctctttaattatctgacgccttgagacataagcctgactgataactagaccttttcaaattgaatttattctgctttaaaactatacaaattacttctcccctatgggcaacacctaaaacgaattagactgctggttaatgcccattaaatttattgaaaatgaatactcaggcaattttctaaatcagagctcggattcgtccttgaatggcaaggacgtcctggaaattgggccctctcacttgaaaatttgaaaatatccttgaattcaagatgtccttgaaaatgagcatataaagaaacaattcaaaaattttaatttttgacttttataccaatttttattaacttattgcattactggtttaaaatctggtaataaa

SEQ ID NO: 84435 - DNA, 1213 bp, Heterodera glycines
  Genomic contig location: Contig_ID=SeqID_361; Location=2656..3868; Strand=+
  SCN-specific regions: Sequence locations=1-197,219-391,419-437,460 -782,810-1213
atgttcgtccaactcgtcctccttgccatcgttggcattacttttgtcgatgctgccgcaccgccgttcggccaattgtccgtcaaaggcaccaatttggtcggctcaaacggcaaaccggtgcagctgatcggcaattcgttgttctggcaccagtggtacccacaattttggaatgcccaaacagtgaaggttggaaaattaaaatttcattttgagcggtttggattgacacagattttggttaatctttgcaataatgacaaattgaaactaagttgaaattagacactcactgttcttggcaatcaatttttgcatattttgtgattctttttcgggtttgagttgctaaaaatgggctgatcactcacgccaggcactcaaatgcaattggaaaatttaaaaagtgaaaagactgagccgagatttggctaggcaaagcagctttttggatgaaattattaatcgagtccgatgcttaaattaaagactccgaataaaaaacaaacaaagtttttggctcaaaaagaaggcaatttttaaaccaattaagcctaattgcatttatgcttgtaggcactcaaatgcaattggaattccaatgtcgtgcgcaccgcaatgggcgtggaacagggcggctatctgagtgacgcgaacaccgcctaccgactgacggcagctgtgattgaggcggccattgcacagggcatttacgtgatcgtcgattggcacgcgcatgagccgaacgcggacaaggcggtaattacataatttgattttgcataatatattttaaaaaatcagagattataatttagcagtctgaaaaagatggtttagccaaaatatcaaacatttcccctttattggcccacaattattcatttaatttttgaaatatttacctctgatttaatttttatgaaactttaatagtaggaatcttgggttctcgagtgttagaaatttcgattcttgagcacgattcattgttttgcttcttgagattgaattcttcaccaaaattgcgaaagcgtacggctccaaccctcacttgctttacgaaacgtttaacgagccattggatgtgtcttggaacgatgtgcttgtcccttaccataaaaaggtaattcgctgggaaatgaaaattgctaacattctcccccttaaggttatttctgcaattcgtgccatcgacaaaagaatgtga

SEQ ID NO: 84436 - DNA, 1336 bp, Heterodera glycines
  Genomic contig location: Contig_ID=SeqID_362; Location=499..1834; Strand=+
  SCN-specific regions: Sequence locations=1-392,414-437,485-696,718 -811,862-1336
atgaaggatttttggctaggtcaggtcaaaaccggtcaaaatcaccggttccgggccgggttgacatttcaagagaaccgatttccgggcccagtttctcaaaagccgatcaaacatgcgaaaccggatttttccaaaaaaaaaccacggttcaagtttccaggacaggtaattccggtaccgggcccggcccggtctttactaaaaacccgagaataagacaaaaaaagactagcgtttcgagtcgaagtgggcgaagtacgaaaagtgtaaggttcggcgaagtacgaaaattgaaaagtgggcgaaatacgaaaagtaaggtttggcgaagtacgaaaaagtgccgaagtacgaaaaagtgcaaaatgggcgaagtacgaaaaagcgcaagtgaacaaattaaaagcaaaataattagtttaaaaacgaaaagcaaaatattattttaattaaattaattataatatttattatttaaattccgctacataattaaaatagattttccaggttatgaagacttctttaaaaatccataagaaacattcattttgattacaaagcggatctcgatggtggattttctctttccttttcagcaattggttttgctttcctcgcaacactgcatgcgggattatgttggaaattgtcgattttaagtttttggaattaaaattagcgtaatataaaaaattatttgctgtgtttatttttaaataattatccattaaatagtatagatttagtgaagctttggctcaccacatatatgattaattcaaaaacatttcttaattgtgtagcgaaatttaattaatctatatatattcaaattaaatttaattaacataattagagtgctcattttgcagcatatgctgtttttttttttgctaacttggggcgtgataataggcatgaaaaacgcatttctaacttggttgaggcttctaagtccacttctttcatgctgatttttgctgatttcttgattttttaatttttgtgcagatttttggaggttttttataatcagggagcaaacaatcgttttttgacgccttttttcaatttttggtgcctttaatctcttaatttttatgcttttttccaattttttgtttttgccttttttgtgcttttttcatgcttattttggaatttggtgctatttactgtggtgcttaatcggttattttttgtgctgaaaacgagcactctaaacataattattttgcttttcatttgatcgcttgcacagtaccctttgtatataggctaattgccaaagctcttagttttaaaaattcatcatcggaattttattcaa

SEQ ID NO: 84437 - DNA, 199 bp, Heterodera glycines
  misc_feature (14)..(14): n is a, c, g, or t
  Genomic contig location: Contig_ID=SeqID_362; Location=1..199; Strand=+
  SCN-specific regions: Sequence locations=1-83,108-111,135-199
aagtgcaataatantggacaaataataattcacaggtgtgaaatgctaaataaagtctgaagtccggatgatcaactgaaactgaagaaaatggaaaatgtgaagattgcgaaaaataaatatatataaaatttgcatgcgaatgtttatcgaaattccgattaaattgttttttgagcgcagataaatcgcaaagcat

SEQ ID NO: 84438 - DNA, 1294 bp, Heterodera glycines
  Genomic contig location: Contig_ID=SeqID_362; Location=3450..4743; Strand=-
  SCN-specific regions: Sequence locations=1-197,219-306,329-392,420 -438,461-783,811-1294
atgttcgtccaactcgtcctccttgccatcgttggcattacttttgtcgatgctgccgcaccgccgttcggccaattgtccgtcaaaggcaccaatttggtcggctcaaacggcaaaccggtgcagctgatcggcaattcgttgttctggcaccagtggtacccacaattttggaatgcccaaacagtgaaggttggaaaattaaaatttcattttgagcggtttggattgacacagattttggttaatctttgcaataatgacaaattgaaactaagttgaaattagacactcactgttcttggcaatcaatttttgtatattttgtgattcttttttcgggtttgaattgctaaaaatgggctgatcactcacgccaggcactcaaatgcaattggaaaatttaaaaagtgaaaagactgagccgagatttggctaggcaaagcagctttttggatgaaattattaatcgagtccgatgcttaaattaaagactccgaataaaaaacaaacaaagtttttggctcaaaaagaaggcaatttttaaaccaattaagcctaattgcatttatgcttgtaggcactcaaatgcaattggaattccaatgtcgtgcgcaccgcaatgggcgtggaacagggcggctatctgagtgacgcgaacaccgcctaccgactgacggcagctgtgattgaggcggccattgcacagggcatttacgtgatcgtcgattggcacgcgcatgagccgaacgcggacaaggcggtaattacataatttgattttgcataatatattttaaaaaatcagagattataatttagcactctgaaaaagatggtttagccaaaatatcaaacatttcccctttattggcccacaattattcatttaatttttgaaatatttacctctgatttaatttttagtaggaatcttgggttctcgagtgttagaaatttcgattcttgagcacgattcattgttttgcttcttgagattgaattcttcaccaaaattgcgaaagcgtacggctccaaccctcacttgctttacgaaacgtttaacgagccattggatgtgtcttggaacgatgtgcttgtcccttaccataaaaaggtaattcgctgggaaacgaaaattgctaaaatcttacacattctcccccttaaggttatttctgcaattcgtgccatcgacaaaaagaatgtgatcattctcggcactcccaaatggtctcaagatgttgacgtggcggcccaaaatccgatcaaaggattcagtaatttgatgtaa

SEQ ID NO: 84439 - DNA, 1121 bp, Heterodera glycines
  Genomic contig location: Contig_ID=SeqID_362; Location=4939..6059; Strand=+
  SCN-specific regions: Sequence locations=1-231,253-518,541-651,674 -839,861-1071,1094-1121
atgatcatatcccgttcatccaaaaagcttatgcgcttttctgttcaatattttacttttcaaattttttggctaaattttgtttgttcagcttacggtgagtgattttgacagctcagagacgtaaatctccaacattttgaatgcgtttttctattttttttattagcacagcctatgaaattaattttcatttttgagcaattcatttttaatatgcttattaatgacttttgaaatgattgaaaaaatttatacatgtaagtttaataatgtattatttttttgtcggaaagcactttgggtcaaattatggactgaaatgactgattagaaataataatttaggtgacaaaaaacacttaaaatctctttcagattttgaagtaggaagaaggaaatgcgagggacgggcgaagctcggcttagcactcgaagccgaaggcgaagcccaatttttttcaaagcacgaagttcgaagccccaaaaacccgaagttttcaaagctcgaagcacgaagtttttgagaaaataattttcttccctatcaaaattttaatgggtggtaaaaattatttgtaacaaaaaatcatgatcaaaattaggctgttcgagaccgaaaattcctgagactgagacttctttctataaattaaaaaacaaattttcatgcttttcgaacagatttttttgcggcaccggggtgacgacaagcgccgcctgggaaaatttgaatacaatttatcaatagattttgtccaaaaaggccgatttttgcgattctgagccaattatcgaggatatttttattttatttttcacaccgcttttttttgcggtgtatttatttaaagcttttttgtgggggagaggggggggggggggggtacggcggtgccaataggcgccatctgggaaaattttgaaattttgagcgtactttgttaacagaattaggcgaaaaatgaaaaaatttgcgattttaaaaattgggggtttaggcgtcgggggttaattttggacctatatattaaaaatatacgatttccatcatgtttttcaaaatgttaatgtttaaaaaattaaaagaaaaccactacttggaggggaactgatcaaaa

SEQ ID NO: 84440 - DNA, 951 bp, Heterodera glycines
  Genomic contig location: Contig_ID=SeqID_3373; Location=228..1178; Strand=+
  SCN-specific regions: Sequence locations=1-32,62-69,106-137,167 -209,260-275,314-371,462-464,486-508,555-555,587-610,723-951
atgcgcgccattctcttcctggccatggtttgcttggtgatggctgttattcttgagacaggtggccacaattaattaaaaaattaaaaatattttattattttagccaactcaaaggcagtgaaaaataagaaaggtataaataaattgataataaatattaattggaatatgcttttaaaggagcaattacaacgccagcaaaaggaaaagcggcgccgaaaggagcagcgaaaggaggtaaagcagaaaagagagagggactaattaatacaaattaattaattaactaattaattaattaaggaattaaaaaagacgcaaaatcaaagggaaaaggaaaaaaggacgccaaaggcaaaaagggtaagaattttaatataaaaagaaatttaaaaagttaatttttgaattttagacaaaaaagctaagccagccaaagggaaagaagtgtctaaaaatggtaattattttaattttaaatgctaattaaaattgaatgaatttagacaaaaaatccccaactgccaaagcaaatgacaaaaagagcccaagtaaataatttaattaaattctaattaatattgtgccaaacattgccaattttaagccaaaccaatggcagcagtgaaagccgtgccaaaggcggcggagaatgctcagaagggaccgtcgagtgcggaagtggtggcggaggaaaacaacttggacactgaggcgatcgacgacttgggggcggaagagtcggactttgaccaattggcagaggacgaactgctcgaggacgacgccatggacggcgaggcggacgaatgggaaggcatgggggaggagacggagatggacagccaaatggcactctgatggccaactaattggacaaatggtaaacggaacaaaacgggacaaatgacacaaaatatcatttttggcatttcattttcagcaaaa

SEQ ID NO: 84441 - DNA, 88 bp, Heterodera glycines
  Genomic contig location: Contig_ID=SeqID_3373; Location=6922..7009; Strand=+
  SCN-specific regions: Sequence locations=1-88
atgctgatcaaaaaaggtagtaacaccaagttgatcagatcactccttcatggtgatctgatcagcccattttggctgggaacgaggg

SEQ ID NO: 84442 - DNA, 838 bp, Heterodera glycines
  Genomic contig location: Contig_ID=SeqID_3374; Location=1025..1862; Strand=-
  SCN-specific regions: Sequence locations=1-12,34-195,241-390,441 -585,608-716,740-838
  Gene Ontology: Mol. function=electron transporter activity; Cellular component=cell; Biological process=embryonic development
atgaaagagatattttattttcttctcattttactaaacatttttcattgtgcaaaatttgacgttttcactgcaatggtcgacttggagaatttgttggcaagtgaagcggcaagaacaccagaacttctcgagcagtacatccaaacggagaagaacaggctggaacagctgagcaagtcgggcaaattgagcaaaacaaaaaaaaaaaaaaaaaattaaaattagggaaaaaacaaatttaaatgtttaaattattttgatctttatttagccttgccgaagaatacgcacggggattatctgaacaaaaacaacagaaacaagccttattgaccaaagataaagtaagttaatgcaatgcttaaacaaaactttgccatttttggcattaattttaaaacattttaaattattttttaaattaattcttaatattaggaagaagcatcggtgtcaaatccggtcagcgcctatttgctgatcaaacggatggcgcgtgattggaaaagcatcaaaagtttgatgaacgcaaaccaaggcgaattgttcatcaaaaatatcactgatgaacgaatggaaaatgcggtgctaaaaatgaaaattgaataatagaatttgcttttggaattaaattcagataaaatatccggactctgaggatttggaaggagctgctcaaggactgctaagactccaggcaattgaaaattctcaattaaattttttaatataaatactgattgtcttggaaagcagaagggttgcgatttgaacgaaaaagggcacaatcaagaaatcggtgccgagtcgttactcaaaaaaccatcaaaataaa

SEQ ID NO: 84443 - DNA, 637 bp, Heterodera glycines
  Genomic contig location: Contig_ID=SeqID_19693; Location=2163..2799; Strand=+
  SCN-specific regions: Sequence locations=1-69,112-197,233-315,342 -364,386-439,506-637
atgagatcgtcgtaagtttcacaacagacgaaatcacctacagagaccaactcctcaaacattttccgcaataataaatttttcatattgagtaaaaaatataaatattttcatagttattctttaaagtcttgataattttagagaattatcattttattttctgattacattatatcgtggtgagccgaagttacaaattaaatttaattatttttttattttaaataaacaaaaagttatatgcaaagaataccgaaaatttagactataactcaattaaaggaaaattaatcaaatgattattaagtagcgataaatttttttttattattaatttacattagatattttagacttgcaattttttcaaaaaacttatcttaagattatatccataggttctcatttttttacattttccattaatgtttcaaagaaattttaatgtttattataaataagaaattttttaatagaacaaaaattataaaattatttttaagctctacttttaattcaatattaagaatccatttgaatgaactctcatatctattttgaattatatctgactaataatttcttatatccatgatcaaaaagccttcaaaataattatgaaattaaaaactta

SEQ ID NO: 84444 - DNA, 1034 bp, Heterodera glycines
  Genomic contig location: Contig_ID=SeqID_19694; Location=503..1536; Strand=+
  SCN-specific regions: Sequence locations=1-439,461-899,923-1034
taaaagtcaatatggcttaggaaattgtgtggctggtgaacatgacattattactaccacagaggagccaatcgcctcaaaaccgcacagaattccatttaagtacagggatgaattgcagaagcacattgaccaacttcttgcgtcgggagtaatggtagaatctgacaccccttgggtatcaaatattgtcctagtacagaaaaaagatggtgggcttaggccgtgtattgactttagaaagctgaacgaggtcacagtacctgatcactttccattaccaagattggaatcgattttggaaatagtgggcaaatgccgttattatacatcattggatttagcgagtggctatcttcaaataaaattgagcgagcgtgcctcccgtaaatgtggggtgataactgagaacaaaatttatcaaatgatcaatcttccatttgggttaaaaaatgcaacaagtgcatttgcgagaataatggcacatgtgttgactggtcttgaaaatgtcatagcttatgttgatgaaattttgatttttactaaatcagaaaattttgatgagcatttggattgtctcagaaaagtttttgagagatttaggagattcaatttgaaattgagtccgaaaaaatgtacttttgcttcggcagacatggagtttcttggatatgtcgttagtgagaagggatacacacctagtctgagcaaagtagaaacaattctaagcctcaaaaacccgtccactgtgaaggaagtgagacaagtggtgggcatggcaagcttctttaggaaacacattccagctttttcgactattgttgagccattgacaaggttgactaggaaggaaaaatcctgggtttgggctgatgagcaacaaaaagcatttgaccaaattaagaaaattctttctgaaaaacctgtccttatttttccggactattctaagccatttcacatattttgtgacgcttcctcggttggtcaaggaggcgctctcatgcaatgggatgaagagaacaaaatttata

SEQ ID NO: 84445 - DNA, 1816 bp, Heterodera glycines
  Genomic contig location: Contig_ID=SeqID_19695; Location=84..1899; Strand=+
  SCN-specific regions: Sequence locations=1-340,362-444,466-494,526 -639,668-737,759-1110,1151-1194,1223-1539,1570-1646,1668-1758,1781 -1792,1815-1816
  Gene Ontology: Mol. function=RNA binding; Cellular component =cornified envelope; Biological process=larval walking behavior
tcgctcacacaacgacatgctgcgtcgtgcttcgtcggaccgggaccgtgccgtggcccacaaccgtggtcgcaacagtcgaagccgttcgcccatccgacgctcgtccactcgctctgacaaacacaacatttccggctcctccaccgccacatggcaatcgaagggtggctcttcgtcagcatcgtcccgttacgtgggcggcggcaagcagcgcgacggtggcagcggcggaacgggccgtagcaattcgcgtacccgagccggaatgtcctcctcatcatcgaatcaccatcaatcgtcgtcgtacgatcaacaacaaaagcaacagtttggtagcggtggcggcactgccgcgctgaatcccttctcccagccgcaacccttcgccggtggttcctccgtcggggcgctgtcctatggcaaacagcaacagtactcaattggcagcggtggtggtggtgggtcgtcacggatgacgtcggcaacttccactgtctctgctgctggtggtggtggcggtggttatgaacggcatggccaaatgcaaggtggcttttcgcgttttatgtgttggcactcaaaaaatccagcacttttttctataagattcaaggaaatataaaagattttcttgcgatttttaaaaaattttaaaacaaattttcggtttcaatttttatttggtcgtaatcaaactgtttcaaaaattcaatttcattttttggggattcttttgtcttttcaaatggactttttaaacgattttcaaattttttcccgcccaacaggacgttcttattataacgatcgttatgccgacacaacaactgctacgagtgcgtacgcctcgcgcaccgacccgtcatatggccagcgcattggccaacagttttccagcggcggtggggcgcgtgacgaaatgtacggtgtttcgagtggcgggggcggtgcgttcggagacagcggttacgccacatcctcgtaagtttttgtaagttgcattgaattgagtgcaacaacctatttgttttgcaataatttatgtatttgtgggaataattaatgttaaaatcccattagaaaacttagaaattttttttaaacttcaattaaaaaacaatagcaacactttaattaatgtaattaattgctttttcctccagggcgcagttcgcttcttcccgtggccaatcctccggcggtggtggtggtggccagccctcctcctcctattacaacagtcagtcgtcggcatgggcgaaccctgctaatagccgtgccacggaaatggtcaattcgcgcgcatttggcacgagcgccggtggaacttcagccagtggcaacggtggttggagcagacaaactgatgacattctctctggtaatagctgcttgagcttggcggatttttttatgaatttgaaatccggtaaatgggtcagggtgcacttcaatttttctccccctcctttcaaacccctgatttttttttacaagattagaaattcaacataatattttgataaaaattgctggaaaattttcaaacatttttattttccggggaggaaactacctgcttcggatcaatcaagatttaaactatgaaaaatttatgccatatcaatcatagttatatatttattttttgttgtgctttcagaatggaacatgtacggctcgccgtcgaagatgaccggtgcttcctcgtcatccggcggtcgctaccatcagcagcaatcgatgtcctacggtggagcaggaggccgatcgggcggttcactgtactcgggcggtggtggaggaggaagac

SEQ ID NO: 84446 - DNA, 1286 bp, Heterodera glycines
  Genomic contig location: Contig_ID=SeqID_19697; Location=10..1295; Strand=-
  SCN-specific regions: Sequence locations=1-212,234-505,528-773,795 -939,994-1286
  Gene Ontology: Mol. function=endodeoxyribonuclease activity; Cellular component=nucleotide excision repair factor 1 complex; Biological process=nucleotide-excision repair
atgtgtgttgctactggctacactcttgcgcagaaaagagcatttttaatgaaagcaatttcaattaagactccgggaatggcgacgatgatgaaattgacatacaaagcgaaattaatgtggacgaacgggtgccggtgcgcaattattgctgcattgagcctggaacatctgctgaaagagcaaagagtactgacaatgaggataaagtgaaacaaaccattaaattcaaccaaacattggctcttttttaaagactttacaattgcctgaagatgaagagaatacactcaacgggtcatcgttggcaaacagttcaacctcaacatcgtttgtcagcacaattcattcgttgctcgtctttctggagcagtccaacaacaacaactgttaccggttgatcaactgtttggaaacaatgcgacccaagcatctgatcatgtacagttccgatttggcatcaacgcgggccattgaggtgaaagggcgaaacacccaaaacgatttatggcaatttgtaactttttaggtgtttaaagcggtaaacaaagaccaccaaatgactgtccattcgtttgtgtgtgccctgagcagtgaagaggaacgctttctttcgtccatccaaagggaaacggacgcaattgaaatgctaatcagagagcagggcgtacgtttgacttaaatcaacgaaaaagagaagggctcaattttcttttgtgttttaggtgctgatggtgccgagagaatttgacgtcagtcgggacagcgtttcgcagttgcgacgactgacaatgaatcggacggactcgcgcaaacggacggcaacatcctccacacaacggatcgtagacgaagagtttgaggaacaattacgtccattggtcatttttatatcttttcaggcggtgggggaaggtcaccctcccccgaaaattcttcatttttaatatacaatttcaaaaaaaaattcattttatttaattttaaaaaaatccgttttatttttcatttttccaattggattaaatatctttgttaatccgatcaaattacaggtcattgtcgacatgcgcgagttcaacagcgaacttccaatcactttataccgtcgtggcattgatttgcacgccgccactctcgaagtgggcgattacgttctcgcgccacagatttgcgttgaacgaaaatcactggatgatttggcccaatcgctgctgaacggacgcctcttcaagcaaatcgaacaagtgaaacaaaagaaatggcaaattaatgaaaaacaataa

SEQ ID NO: 84447 - DNA, 1148 bp, Heterodera glycines
  Genomic contig location: Contig_ID=SeqID_19699; Location=1..1148; Strand=-
  SCN-specific regions: Sequence locations=1-89,111-207,229-242,265 -595,621-759,781-785,807-815,880-935,957-1080,1102-1148
ccgtttgggcacggccatctccacccgtaccaccatcgctttttgcggatgctgaatttgcgcttttacgaggcttatttgacctttctgtacatgggcatcaagctgttgtttttgagcaatgtttgcatgcaggtgaaaaattaattaataacttcgagcacatgggttattttcggcgctattatcaaagttaccgattttgaattttgttaaaaccaaagggggacccttttgggtttgtctagtttggaattttgttccctgccgtttttgttgtccctgatcacgcatctgacatttattttaactaattctgagttcctcttctttatttcaaaaaaaaatcaaaaaacaataaacttgaattcgacttttatacaagttcggattagggtttaaaattagtcaaaataggtgttagattcatgaaggacctgaaaaatactcgagaacaaattttcacaagttattatcacaaattgtaagaattattttaagaatttcagatgtttttgatgaattggtttttacaaaccagcaattatcgctattatggtctcggcgtactgcaggatttgtttgatggacggcgtaattaaatataaaatattttaaatggtcagattaaatgcaaatcaatttttttagcatggagtgattccggcaattttccacgcgttacctattgtgacatggacattcgaatattgggcaatgttcaaaaacacactgtccaatgcgttcttgtcattaatattttcattgaaaaagtatttttaattcttagaaaaattatttaaaaaggcatacggatatattttaataaaattactgaaatttctatttaatcctttttaaatttaaaatattattttagatttttgttctgctgtggatttggtatagtttgctggttgtagtcacaattttcagcttcattaattggctgatgtcatctttgccctttgaggcgagaaaacggtgaaaaacattgaacaaaaataaaatgatttttttttgtaagatttattgcgcgtcgattagaacttgcggacgtcgaattcagacaaaaggattttgagggtgaacttgacgaggtatcaaatttagcattattttttctgtttttttgcagtcccaattat

SEQ ID NO: 84448 - DNA, 1173 bp, Heterodera glycines
  Genomic contig location: Contig_ID=SeqID_19702; Location=811..1983; Strand=-
  SCN-specific regions: Sequence locations=1-301,323-597,619-633,655 -972,994-1173
tccacggccactgtcaacaacgcctatcaggccccatgtccgcacgcgtccaacaactaccgaccaaacaactggcaccgattttcgagcaacagtccagtcaacccaaacggttttagaaaccgccgatggtgccactcagacagaaacaggtaaaatcagtgatcagattttctaatcaattttatcccccataatttcattttcagagcaagggccaattcaaaggctgtgcacggagctgaacaaggcgaaacgcagaattgggacgctggaacgccagctgcagaaaaaaactgaagaggtgaaactgctcaaaacccgaccaacagagcaaaacggacacaggatcaaaagagtgagttcagtggaccacttgtcaaggcagagccggacaaaacgtgctaaggaaatagcgcggaacctcagccatctctttagaccagacaaattacttcttaatttttttattttaacaataatgccgcattttcaggcactccagtacccgaaatcgacaaagttgtgcgccaggccgtcaccaggccaatttcatctcgcccaaaaaaccgcccggaaaatggaccaaaaggggccgaacaaggagacaagaacgaatcagtccactcctggacatccaagtcacactgatgttgggattcagttggcgacaaaggcagcagcttcgacaatttctcaaataaatgctcatccattcatggctatttcaaggcaaagatactttttttctcattttccccttttcaagaaactttgggaaactcatccggctaaattcgacacaaacaatgccgctggattcaccccaaaattacactggcttctcgcccatggtccagactttgccaagcgttgggggtggttcgcatggatcagtgaacagggaatcgaacaccttcaccacgttttgaacaagcaggttggacagactcaatttcacagttcaaaaacctattttttgttttagtctgagcgcttcatgcggtacaagggcaacgaactgctgctgaagatcggagaacatcagacattgctcaattctattttcgacagataaaccggtttcctctgatcaacaaatgttaggaatcattaattttattatccggttttgttaaatattgttacttttaatatttttaatcaaataaa

SEQ ID NO: 84449 - DNA, 667 bp, Heterodera glycines
  Genomic contig location: Contig_ID=SeqID_3375; Location=42..708; Strand=+
  SCN-specific regions: Sequence locations=1-63,85-320,343-578,603-667
atggacatcggagagatgactccaccaccgttggtcatcgacgaccgatcagagcgcatcgaacagctggagatggagctcaaggaccgggatgacaccatccaatttctgcgggagcaggtgcgcaaccgtgatgcgctgatcactgccatgcggcgccagcgcatttgaacaccaaattgaggagttccgtggttttctggcccaagaacaacggatgcgcgacttcctatctcagaaaccgaaggcccacttattgctcaatcatttcgtcccatttgctcggcaacattctttcctcggcttgctggacgagcagggtgggcagcaaaaattaattaactcaaattttcaaaaacattaggggatgaggcacttcattcggtttggagaagactggagcaatggtggaaatgcatgccggacgcggaccaaattctacaacaattggagcaccattttgtcagcaattggctcctcgacaccggcagaattgctgagatgaagcaggcgagttttgagtggcgtgggaaggggttaattttcccagaaatcatttgaattttaaacattttagaggctggaagaacaaaaagaagacgacaatttttcggagcattcggatggtgaaaatgatgaagactcggtcatcgatgttattgggtga

SEQ ID NO: 84450 - DNA, 114 bp, Heterodera glycines
  Genomic contig location: Contig_ID=SeqID_3375; Location=821..934; Strand=+
  SCN-specific regions: Sequence locations=1-13,35-114
ctcaggtgggattgaacctgggactccctttttggtggcaaactcacagaccactaagacaaaaaatcaattagtttttgaactggggactcaaaattgactcggtgtgtaaac

SEQ ID NO: 84451 - DNA, 1430 bp, Heterodera glycines
  Genomic contig location: Contig_ID=SeqID_3376; Location=1499..2928; Strand=-
  SCN-specific regions: Sequence locations=1-825,922-945,980-1016,1146 -1182,1312-1430
atggcaaattttgcagccgccgcggcttccacgcagcaaagtgcgaccgcagctgagcaattcgctggcggaggtgcgcttttcgtccgtcgccccaccgtatgctttttcagatgccgaccctccgccggtcgcttctccgtcctcgtcgcttccgtctcacaatcagtcaaactcacgcaaattcatcacttctcaaatggccaacgacgacaaaccgccaaattcggccaatttccgcccttttcactcattcgaaagcgaacgaacgaattcaatcggagaaggagaaataacggaaaaggacaaaagaagtggaggagaagcacaaaacaaacaacaacaacaggtggggggatgccatgttgagaaagagagggaaccagtgaaaaaataaagagaaaattagggaaacaaaaataaaaatgggggtacaaaagaattttttagacatttcgcaacattttatgcttaatttgtgttgttcttgggcagctaatgaatcactaattagttaattgcatttgttaatgagctgtctcacatcggccttttccgcaattcagcagaagcaattcaacttttcggacattgcctctctcgccgaatgttctcgcggtggtccgtcgcgcgtgccctccccccctcctccgctggcgaatgttcctccgccccctcccgccgctttgtccgcttcttcctcggccctttccgtgccttcgccagcgttttttaattcgccagtttttgaatcttctaccaatgcacccgcttttctgcaacattatttgcaacaaattattggaattcagcaaccgatggtgaaaaatgaaggagagaaaagggaagaggaagaaaatgggagggaaaggagaaaaaggaagagagacaaagaggaggaagaggagacgaagaagaagacaaacattgagggatgaaaggaaagaggaggaaggaggaaaaggaggaggaagaggagacgaagaaaaagacaaatattgagggatgaaaggaaagaggaggaaaaggaggaggaagagagacaaggaggaggaagaggagacgaagaagaagacaaacattgagggatgaaagggaagaggaggaaaaggaggaggaagagagacaaggaggaggaagaggagacgaagaaaaagacaaatattgagggatgaaaggaaagaggaggaaaaggaggaggaagagagacaaggaggaggaagaggagacgaagaagaagacaaacattgagggatgaaagggaagaggaggaaaaggaggaggaagagagacaaggaggaggaagaggagacgaagaaaaagacaaacaaaattcgctttttctctccctttttgtataatattttatttttttagttagctccaatttcttttgcctctcattttcataataacaattacataataaa

SEQ ID NO: 84452 - DNA, 1081 bp, Heterodera glycines
  Genomic contig location: Contig_ID=SeqID_3378; Location=1107..2187; Strand=-
  SCN-specific regions: Sequence locations=1-368,390-547,569-579,601 -1081
atggccaaacccccgctttttgcgcttttcccccctcacgccgctcttcttgggcccgtctcttccgcgatttactcgtccaattctcttccaaattgtgcacaaattcctgaagatcaattgcaacagataaaaaatgtcaatgagaaaaaaatgacggcatttttggagaaaaatgaacgacggggaggagacggaaaggaaactgcgaattcatcgaacaaaagcgcaatggatggagacgaaacggcaccattgaggggggaaggggcgatgagcaagttggaagcaatgccaacccaagaaggaggggatacggaagaaagagaaagaggttgattgggaggacggagtgggcacggcacattgggggcgggggagggagggatgccgaagaaatgcaatgtcattttgctacttaagtgcatttacggcgcatgtccaccgtttcttcctccggttactctcccgatcgccttacgaagtcggcactttccccgtccatcgccgattacggcaacggacagtcgccgttgaatggcatcagcggaaatggcggcgatggcggaggggaggacagcgggggcggtggggaggaggacagctgcaagaggggcaagcagagacggtaccgaacgacgttcagtgccaatcaactggaggaattggagagggtgagcaggccaaagcggcggggaactgctaacacgggcaaacatgttcagatgttcgccgtcactcagtacccggactgtttccaaaggtaagtcatttcggcaccgattgggccaaaaacaattaatccctgttcgttcaaattcaccgtccattttctgtccgtctttcactctccgcccccgcccattttctttcatctttccttaatttggcctatccaaccaattttctcgcttccgcagtcccccgagggtacctcttttccgcagggattggcttttcccctgaggggaaattattattgcgccttcaaatgtttctctctctcttattttctttttctattttcttccgccattctccttcgatttctccaaaatgaaggacaaaatgagcaaataaa

SEQ ID NO: 84453 - DNA, 553 bp, Heterodera glycines
  Genomic contig location: Contig_ID=SeqID_19707; Location=534..1086; Strand=+
  SCN-specific regions: Sequence locations=1-83,105-184,234-246,276 -349,440-553
atgcatttggctcgccatttaaacattttagaattcgctgatgttcttttttatagcaatatttttgtaatttttaatttgcaaataaatggtaattattttttctttgtgtgcataatcaattgcacaactcgtgccccaagtgcaaacaaaaattaatgtctcctaagagactaataaacgcatattaaataattttaaataaatatcatttataagtatcatttattttagcagagataattcttttaatttcatttaaatttttatttatactgctttaacagtaatgtatattttgccaaaaaacaaaaattaaattaataacgtttttcttagtaaaatttcgaaaattataaaatgtttattttaggttttatttaattatgataaattattttttcttttcatttttggcattaaattattttatttaaatctcatatgacagatgaaattttttgcatctgtaagaattataactgatttaatattgttattattgcgtttttaaacgttctttaattttttcattttttatgaatttgacgaa

SEQ ID NO: 84454 - DNA, 414 bp, Heterodera glycines
  Genomic contig location: Contig_ID=SeqID_19708; Location=475..888; Strand=+
  SCN-specific regions: Sequence locations=1-180,205-242,270-331,364-414
atgattttattattaaaaccgcttattgttcaaccaatgttcggtatcattcgttttttattcgtacctctcgcctctataggtgtttgcctaaagaggcgaggttacttaattccattgactttgctaaacttcttgacacctatgatgttgattctttacttttgaaaccacctcatctcattcagtgaccaaatttatttatattgttatttatgtcggtgtcacgcttttgcgtataaattgattgattgattgattgattgattttgcgctattaatagcctaaaatattttttgttagcatttttggaatttatttgattttgggaaaatttaaaaaataataatgaatattttttaggttgttttgtgttaatgaatattttcaattttagataaatgccctcttaa

SEQ ID NO: 84455 - DNA, 762 bp, Heterodera glycines
  Genomic contig location: Contig_ID=SeqID_19708; Location=942..1703; Strand=+
  SCN-specific regions: Sequence locations=1-143,179-186,208-322,345 -349,371-614,636-675,697-762
atgaccaaatggttcgcgactgtccgaaaacgtgcaatgtttgcccgggagtttgtgaagatttgggcaccgaatgtcccgaccgacaaagggcgggttattgtgggagagcggtgagaaaaaaaagaaaatcaaattaagactaattaacaaaatatttaatttctttaaaataaatgtctgaaacatttgttactgtttttgttggctttataattttttttgcgttagctgtacaatgatttgatgaattggcaatgcccgcgaagttgcaaccgatgcggaaacagaaggcgaccacggggaagaatatacacaggcagaaaaagaagacaaatttaattaccactaatttatttattgaattattcacttttccccttccaccgaattctaattggttattggcagggctgccagattaaaattttcaaaagcctcatttggcatgcaaaaaacctcattttgtgtcaaaaagcctcatttttgcagatttattcaaaacacgtttaaaatgatcaaattttgtatttttgattgagcaattttttgtttgaaataagcattttgtgaaattctgagcatgaaaaatcaaagttgtttttttgcggcgctttttacaaaaattttttgggaaacagagggtcccggcggtgccgataggcgccgccggaaaatttttgtaatttttaatgtgatttgttaacagaatttgtccacaaaattgccaaattttgcaacttttagcaaaaattttaagaa

SEQ ID NO: 84456 - DNA, 446 bp, Heterodera glycines
  Genomic contig location: Contig_ID=SeqID_19709; Location=520..965; Strand=+
  SCN-specific regions: Sequence locations=131-146,169-169,210-210,273 -273,367-446
atgagcgagggaattgaagctgcacaaccttctcctgctcatgagcagattcagcaacaatccgttgataggcaaagcgaggataacgagcatcaaccgtcagatgtttcacaagcacctcagcaattgtgattttcttttgcatgtttataattaataaatttattaggtttgatgcgcgtcttccgtttccacctcatcaaatgcgtcctggatttcatcctcgttttccaccatttccaccgaatggcatggggggaccaccaatgcggccaccttttcgtccgcctccaaatttctcgcagcaacccggaggcactcaacctgataacttcccaccgtttttcaacagtcctgctcacagaagtgatttgtttttctttattctgactgtctcttctatttctacgggatttcttaatctttcttcccctgtctatttaaag

SEQ ID NO: 84457 - DNA, 153 bp, Heterodera glycines
  misc_feature (139)..(139): n is a, c, g, or t
  Genomic contig location: Contig_ID=SeqID_19712; Location=737..889; Strand=+
  SCN-specific regions: Sequence locations=1-18,120-153
atggagcaaaatgaaccccaacaacaacaaggacaggaacagggacaaggacaacaacaaggacagcaacagggacaggaaccgcagggacaaggacaggaaccgcagggacagcaacagggacagcggcccgagatgngcaaaaccccatcg

SEQ ID NO: 84458 - DNA, 595 bp, Heterodera glycines
  Genomic contig location: Contig_ID=SeqID_19713; Location=143..737; Strand=+
  SCN-specific regions: Sequence locations=1-265,302-382,404-416,439-595
atgcataatgatattcatttaggcaacggaggaggaaatcactggcggcaaaatgcgcccggacatggaggtcattttcattggcgttttatttttcgtttttaaaatttttctatttcgttcagtgcccttcggtggagcagtggcaaacaacggtggacaaggaggctatgggcaaaacatcgtacctggtctaaacggtggtcagggcggctatggacaaaacatcgtacccgctcagggtgatttactcaagactattcagtttattatttttatttaagtgtaaatttatataaaaggtaaaaaaaaacattttttgaatccaaattttacttttttgcattttagctggcgctggcggcgttggatactttccggcggcctaccagcagcacggagggcaaaatgtgccgggtggaggtcctttaaaatcaattaaatccttcacctgaaaaactgattctcattgtgttttaaattaacaggccagtagtgttgttcttcggatgagactgaatgtatgacgaaagactccgtcgatcgcttttattctcattctgtcgtcgtttttcccgctttattttggatgata

SEQ ID NO: 84459 - DNA, 570 bp, Heterodera glycines
  misc_feature (273)..(273): n is a, c, g, or t
  Genomic contig location: Contig_ID=SeqID_19718; Location=515..1084; Strand=-
  SCN-specific regions: Sequence locations=1-15,87-352,378-570
agaatgtagccagcagacggggacgaggaggaggaggaggacggacggggaaaaaaggggagaaatgagcgaggggaaagggagggaccgactgatcacaattaaggagggcttacaaaaaacaatcataatgcatacatacatagacatataatatttcctttttacaatacaacacattatgataaatgattcctttctagaagcagaagaagcagcggagggagacaagcagcggcaggtggtaaagcaaaaaaaaaaaaaattgcttgnctgtgttaatgggggtatttatttattatgattatgaatagtgtcttggaagagatttgaacagaagagaagcaaatacatattggaaaagggtaaattgttgttgtcgggcccaattatggtaatgtcaaatacaattaaaatcttacaatagaatggatattgaaaagtacaaacatccggcaggggtacttttgttgcagtttaattggactcgatgataaaccatagggaggagaggaccattttgatttggaatctttcatcaaaattaaatcagggatttgtcggaatgcc

SEQ ID NO: 84460 - DNA, 2613 bp, Heterodera glycines
  misc_feature (1310)..(1310): n is a, c, g, or t
  misc_feature (1315)..(1315): n is a, c, g, or t
  misc_feature (1321)..(1322): n is a, c, g, or t
  misc_feature (1376)..(1378): n is a, c, g, or t
  misc_feature (1393)..(1394): n is a, c, g, or t
  misc_feature (1536)..(1536): n is a, c, g, or t
  Genomic contig location: Contig_ID=SeqID_3380; Location=679..3291; Strand=-
  SCN-specific regions: Sequence locations=1-231,253-297,319-562,588 -618,645-781,844-880,902-965,1010-1042,1064-1190,1341-2070,2119 -2255,2331-2503,2534-2613
atgagtctctcccactcggaaggacactttgccctctttgtacgcctcgttgtgtttgtcaatgaactgtttggcgctataaatattgggtatttcaatttcaaattaatttagtattttcagctaacctcaaataagtcagcatccgttcgttctccacttcttggtccgcgtatgctttcccttaatttttatctcgtttattttccaattccttatgacttgccatgcttctgtttgtaagcattccaatcggaaaagccgcgttcgctacatcattcttatttttaatagatttttacataatcatttttcattattatgaccattttgtccatgccactcccatccctttttacatcatataacgaagacccgacattcgccctgtcgttcatctaacatccgaagcacgttgtccaatcataatcaatacgatctaatcatccgagtcgttctcatctattcgctgcacttcggatccgagcttcggaattgggcaaatccgagttcaggttcataatcggcaccctcgaaaacccctaaaaactgggtttgacccaaaatttaaaaaataataaaaattaggggcacacattcttcaggattacctagtttttatatatatttcattttcaaaaaatttgtcactcctatattttagcatttattttagaattataatggaacataaattgcatacagacacgcttgcggtttttgagctttcatcacgtatctgttcagagcggaatatgaatctgatcaatccggaaggtcgtaaaaaaacttttttaattaaataattattttttaatttttctttaattattaaaatttaatgacgagtttttatttgctgaatatgtgacctaaaacataaaaattaattttattggaacactttggaacttttgttggcacagtaattatctatcatttttttatttaatttattggcacagtaattatcatttttttaatttaaaactattttataatttaatttcttgtaaactatgattttcaaatataagcaagctaaatatttatttattttttagtagttcttcaacagtttggcatgatcgagaagctacagcacaagttgcgcttctcattgcaggacaatcaacggctttccgaattgaacaatcgcctgaagcgacagattgggtaaaaatgggtcgaattaatttttttttttgaacattttattataaaatatttaaaattttaaatattaaaatttaatattaatttattgaaccaattttgttatttcattattaaattttttgtaaattaancgaanttttannattattattaatttttatcattcaattaaaacgcagaattttctattgtttaannngattatttgtaattnnatattgtaattttcagaaatatgagcaaatcttgtatgagaacaaatcaaccattcatcagcttgtgtccgatttggcggcagctacgcaaaaaaaatgagtgcttgacagctgaacttgagcaacatcgtcacatattganctggcccaggatgagctaagggtgggataatgtgaacagtaattagcctaattgattgggattaacacttaattatgggttacaaaaatttatgaaaataggcgaaaaaccaatggtgagacaagacaccccattggtttacaaattttaaagatgatatatatctgtttcataaaacaaatttttggcatcgttggtcatcaatctgacatcccgaacccaaattctaacatcgggtcggtggtattcaaacaaattgaaatttcaaagttttggtttgggttagggatttttacgaaaggatgttagcaataaatatttatcgaggattttcaagaaattttatgatttatttgaattcttaattttatttttcgggatttcgaattatgcatttcggttttgtcttttaaggtttcttttttttaatctgtattataagtatctgagcatttgtccagggacttaatgtaatgatcaggcggcataatctggattcaattaattcatcttattttgaatttgttttcattcaaatataaaatcaaaatttgaattctatataattttttttttttatttcgaataaatttgcagaatgtgactgtcagaaaatcgacacttctgcgggacaacaatgatgatgtgtttctttccggtgacagaacagtgcagaacattttcaatcagcacaaaaatgggttaatacatcaatttacataaataaaattaaaacattttatcgaaaatttctatttaaaattttattttttaaatatatttttattttttaagcgaaaagaagcgttcaaagcgtcgttccagttcacatcatatgattttgtcggacaaacggtcaagactggcgtttaacagacaggtgatataatagggtcagagatcctgaatttagtccttatttacaagaactgtccttttttatggattttttcaaacactacaatcgattttttaattttaaaaatcattaatttttgacttatttttatactggttttttccaatctttcaatttttgtttctgcctttatattaaatctaatttcattgaataaa

SEQ ID NO: 84461 - DNA, 2535 bp, Heterodera glycines
  Genomic contig location: Contig_ID=SeqID_3382; Location=688..3222; Strand=-
  SCN-specific regions: Sequence locations=1-116,139-193,300-309,331 -370,417-707,730-911,1037-1072,1094-1118,1170-1230,1253-1765,1808 -1814,1836-1863,1895-1974,1998-2103,2126-2178,2217-2535
gaaatgcgcaacaaccacctaccgtatacacagtacgcatagatggccgagattatgtgacttcgggtcaacacgccacgcatttttcattccgaggaagtaatttgtacatcaacaggaaatattatgaaaatcatccgccaccgatgaagcgaattggcagcagagcgacagacttggaaaatgaagaaagtaattttttataaatatttaattgccaaaagtatttgtaactaaatattttaaaaattaccaaaaatgatttaatttctatcaaaaaataataataagttttttatcgccagcgcaaattttaatatctttatatttctatttttccattttggctcttttgttggcccttttcaacaaaatatttatattttataaataaaaatatataaaattatttaatactttaagatgcgaatcgtctgaaacaacagcaatcattaaataaagcatcatcatcaaaaaatactgaagaagctggaacatgttcagatgatgagacttatttttcactctcagagtcagaggacgaagaaagtttggcgcaattaattttacaaaaatacccaaataaaagttaaatatgtttaattaaggaaatcctgggacttatgtgtatgtgcaagcctccgaaaatgatcaaagtacgcgctaaaaacactataaaatttgtgttagtcctgaaaattttgccctggttaattaacaaatgtatttaaattaattgttacgaaatgaaaagttttcatatctctttaattgaatatcaaaaaatcataaatgcaattcagctggtgatgggtactatatttttgtgcccgatgaaccggcacagggcaatgtttccgaaatgccacccacgcatccgacaacatcgacgtctctagcaaacagtgaactaaatattaattttttaaatatatttgtttaaaaatatttttaaaaattattctaaaagtttttaagattgtgcctaaataattattttttatatttttcaaaatattaaatttctttatttaatgacgcaaacgaattcaaaattatgcatttaaaaaatccatcaatggctatgtaaacaattaattgacgatcaaaaaatgatcaatttaaattagttatatacataaatttacaaaaatttaaattttaaaaaacaactaactctcttaaaaaattacgaaaaaaattttaaggaaaatgctcaaattttttttattgaaaatgaaaacaaccaattattgccttaatgtagtgcattatttttgaattcaaaatttattcatccctttttcttacagtggaaatatcatcggatgaagagcctgaaaatgaagccccagactcggaagatgaagaatatatcccatcgatccagccgataatgccgccggcatttccaacacatagtgaataatttatagggattccatttaatgataatttaaatttaaggtgatgatggttaccatatttttgtgcccaatgaacctgcacagagtaattttcttaaaatgccatcgatgcggtcaatgccatcatttctatccttgccgtcattgccttccttgtcatcacttccatccttgccgtcattgccatccttgccgacaatgccatcgatgccgacaatgacatccatgccgagaatgccactgacaatgccatccatgccgagaatgccggaaatgctgccgacaacgtcgacatttccaatgcatagtgagttaattagtcatgttaagtatctgcctaaaaaaaatttgaaaatactattgaaaaatttttaaaatttgccaagctcaaaatttataatgaatcctcagactcggaagatgaagaaggtacgtgataaaaattttaattattaaatttattttttgagtttcttatagtggaaaaatcatctgatgaagaaactgataatgaatcctcagactcggaagatgaagatggtacgtgataaaaattttaattattaaattggcttaggtaggaccatattcaggcattttttccgttagaattcttaagtccggcaattttaaaaactcatgaaaaattttccaaagttgtgcctttaaattgtcctattttggtacaaactctatatttgattgaagcatttagcgttagcttacaattcggcattagcttgcagttaacaaaaaaatatttaatataaatttttaaaatttatttttcgacattaaaacatttctttatatttagccaaagtttactttaaacaaattaaacgtgaagttgacgaatatgcgaaagaattaccgcctcaaatgaaacaagctaaattagatgcagaaaaacatatgaaagaactaaaaagtcatctggaagatgcaaaaaacactgtcactggatatatgaaagggttaaaaatggaaatgagtaagtctaaaatccataaaataatgccaacaccggaaacgccgggattgccgccattgtcatccccgccggcattgccatccatacaacaactgacatccgtatcgacaacag

SEQ ID NO: 84462 - DNA, 638 bp, Heterodera glycines
  Genomic contig location: Contig_ID=SeqID_3382; Location=1814..2451; Strand=+
  SCN-specific regions: Sequence locations=1-157,180-240,292-316,338 -373,499-638
atgccggcggcattatcggctggatcgatgggatatattcttcatcttccgagtctggggcttcattttcaggctcttcatccgatgatatttccactgtaagaaaaagggatgaataaattttgaattcaaaaataatgcactacattaaggcaataattggttgttttcattttcaataaaaaaaatttgagcattttccttaaaatttttttcgtaattttttaagagagttagttgttttttaaaatttaaatttttgtaaatttatgtatataactaatttaaattgatcattttttgatcgtcaattaattgtttacatagccattgatggattttttaaatgcataattttgaattcgtttgcgtcattaaataaagaaatttaatattttgaaaaatataaaaaataattatttaggcacaatcttaaaaacttttagaataatttttaaaaatatttttaaacaaatatatttaaaaaattaatatttagttcactgtttgctagagacgtcgatgttgtcggatgcgtgggtggcatttcggaaacattgccctgtgccggttcatcgggcacaaaaatatagtacccatcaccagctgaattgcatttatgattttttgatattcaa

SEQ ID NO: 84463 - DNA, 740 bp, Heterodera glycines
  Genomic contig location: Contig_ID=SeqID_3383; Location=636..1375; Strand=-
  SCN-specific regions: Sequence locations=1-62,99-226,248-337,370 -411,445-469,558-715,737-740
atgcacacatttctcttttccgccctagtttggatagttttggtctgctttttgcacaatggtaaaataaatttataaaataatttttttttttaaatcggtgttgtaggaaatgcgcaacaaccacctaccgtatacacagtacgcatagatggccgagattacgtgacttcgggtcaacacgccacgcatttttcattccgaggaagtaatttgtacatcaacgggaaatattatgaaaatcatccgacgccgatgaagcgaattgtcagcacagcgacagacttggaaaataaagaaagtaatttttaacaataattatttgactaaatcctacatattttaaaataataaaaatattttaaaaaacaaaaacaacgcgagacaaattaattcatcatttatttctttatgattctttgcttttttattttaattaaagtcatgcaaattttgccctggttataacaaatatatttttaaattatatttacgtaatgtaatatttaacaataattatttatttgataaattttattagaaaatattatttaattctttaaggtgaaaatcgtttgaaagagcagcaatccctaaataaagcatcatcctcaaaaaatactgaagcagctggagtttgttcagatgatgaaagttatttttcactctcatcagagtcagaggacgaagaaagtttggcaattaattttactaaaatatccaaataaaatataattaaa

SEQ ID NO: 84464 - DNA, 640 bp, Heterodera glycines
  Genomic contig location: Contig_ID=SeqID_3384; Location=1257..1896; Strand=+
  SCN-specific regions: Sequence locations=1-73,117-209,231-391,413-640
  Gene Ontology: Mol. function=histone deacetylase activity; Cellular component=histone deacetylase complex; Biological process=chromatin silencing at ribosomal DNA (rDNA)
atgcctatcgatgaaggaaatgatgatcaaactaaacctgctgtagacgttgaaaaatcagttggacgcaagcgaaagaagaactttgaagatgcaattaattttgtaaataaaattaaggtgctcctaattaaagacagagaaaatgttaatccgccaattcaaattcttcacttaattaattgctccccaaatttatgaatcatagcattttatttttattttacaacatttctaataggctgtcagccggtccaggtccccgatgttttaagtggctctaattcctatatccagaaatagtttagtctagaaatctgagagactcggctataaaaattttcgtaaaagccgaaaatttcttgaattttcgatttttatttagaaatctcataaatattatatttattttgttcataaatgatccatcattattttattttaaaccaatttcagcaacgattcattgaccatgaagatgtgttcaaaaattttctgaacgtttggaacaattatcgacgaggcaatttaaaaaacaaaaacccaaatgaagttttttggcaagttgccacactttttcatggccacgatgacctggtcaaagaatttgaagactttttgcccgagcaaacaattcgac

SEQ ID NO: 84465 - DNA, 520 bp, Heterodera glycines
  Genomic contig location: Contig_ID=SeqID_3384; Location=1692..2211; Strand=-
  SCN-specific regions: Sequence locations=1-241,263-520
atgccaattttgtaggtttaagccgaatataagaaagtaatataaattagcgtctaaaattaattttttaacgataaattattggaccatgtgtccttttttcaagaacctataaactttttgtactttgatttctaaaaaatgccttaagtatccaatgaaatcctagaaaaaagatatattctacaattttaattaacaatttaaaatgaatagattttaatggccattatatcattttatctctatttcaatgtcatctgtccaactttctctgacatttaaattgggcgtcattttaagcgttcaatttacgtcgaattgtttgctcgggcaaaaagtcttcaaattctttgaccaggtcatcgtggccatgaaaaagtgtggcaacttgccaaaaaacttcatttgggtttttgttttttaaattgcctcgtcgataattgttccaaacgttcagaaaatttttgaacacatcttcatggtcaatgaatcgttgctgaaattggtttaaaataaa

SEQ ID NO: 84466 - DNA, 1354 bp, Heterodera glycines
  Genomic contig location: Contig_ID=SeqID_19723; Location=627..1980; Strand=+
  SCN-specific regions: Sequence locations=1-301,361-376,398-747,975 -1354
atgtccgtgttcttcttgaccattgaccgaatttgtatcatacgctttggacacaattatggctatcagatcaagcgagtgttgaagctgtcctttcttagcgctttgtcggttggcattctgttcaacttcatcggaatgctctcggcaatgccagtgccaaccaagacgggtgggtcaggatgggtatttaagcattcgggttgcggtatcggccccaattttcgcgattcttcacattgttagatatcccatggcatttgaacggtgccattcccgaacctcccgcgtcttttcttccaatttaaaaaacaaaaattaattattaaacaaaatagtttagatttgttttttttaataccctaatattcgttttttaatttagaatgtgaaattttcggctgcattcttggcactgccgtccaattgtaccttggatggcgcgccttttgtgccattttgaacacaatcagtggcatttggttttttgtggttttttatcggtccaatcgtaaaatggcgtcaacagcaaaaatgttaaacaatgctggacaattgcaaattcgtcgtgccaatcgcgcggtatttacataataaagtgatttcttgaaaaactaaaatattattagaatttctttagaataatttgctgacatccgttgcaattgtcagtgaattgttcctctcatttttgccgcattttcttccatttatttgggaaagagtaagtagagaaatatatttgtcataaattattttaaaaatacatattttcattttaataaatgaattaatcgtgttttattttaacaatttatattaaatacatattaaataactgtaaatgatatttcgttaatttagtttgaattttcaatttataaaatataattgctttatttttataatatgatttataactattttttaaattgttttaaataaaatatttatttttttcattttttttaaatgatttttcgcagatttttggtgccggctcatcgcttggcactggccctttgtccgagttgatgagctcgatcgaagcattgctgttctcctctatatattcgcacatgttttcggcacgggacgccacttcaatgcatggcacgggaggaacattacaacagcaacaacagccataccatatggaaatgaattacagtaggcagaatatggaacgaagacggtctgaccgtgtggtaccaatggcaccgggacaacatcagccggtacaaatcctggtccgccaagttacgcccgtcgagaatataaacaacaggcctgggacctcgatggcacgctactgagaagaagcgagaaattttaagatgaatcacgatttcaa

SEQ ID NO: 84467 - DNA, 327 bp, Heterodera glycines
  Genomic contig location: Contig_ID=SeqID_19724; Location=290..616; Strand=+
  SCN-specific regions: Sequence locations=1-76,101-136,163-192,217-282
atgaagccgaagcaattcctcaaaagcagcatttacccacatttgaacgattttaggtagggcagagattcttcagttaattataaataattaaattttagaaaattggccgacaatttggacccgacgcacaaattcagaaataaatttataaatgaaaacattttcgaatctgaacaaattgacgattaaaaatgacaacattttcagtttgttattctattaaagttaaagaataacaacatttaaaaaaatatttgtctaaacaaaatctaatattctttttgtccattttattcatttttcttgataattttttataattaa

SEQ ID NO: 84468 - DNA, 483 bp, Heterodera glycines
  Genomic contig location: Contig_ID=SeqID_19725; Location=421..903; Strand=+
  SCN-specific regions: Sequence locations=1-398,423-438,462-483
atgccgccgagacggaggagggcgaatacgacgtgaagaatctgatgaacaaattcctcaacatcgacctgacgccgaaggagcgggccagcaaattggacgagttggaggcgttgcgggtggaggccaagaacctgacgaagaaggtcacaaccgaaccgccgagggggggggggctcgaaaaaaaaactttttttgaaaattttgcccgttttacagttcgagcaggccaacctggactcagtggaggtgagcgaggacaagcggcgtcagctggaggcggagttcgagcagttgaagggtgcgctggcgaggggggcagggggcaaacctaaaaaaaaaattttccggaaaatttacaaatttccagaggacaggcatcgggcgcgccaggagtacgagcaggagatggccacggcggcagcgcaaggtggcgaaaaggaggaaattcaggtgtggccaattcaaaatgacccatcctaa

SEQ ID NO: 84469 - DNA, 1110 bp, Heterodera glycines
  Genomic contig location: Contig_ID=SeqID_19726; Location=373..1482; Strand=-
  SCN-specific regions: Sequence locations=1-1,38-128,157-406,459 -605,659-812,834-925,999-1110
  Gene Ontology: Mol. function=protein binding; Cellular component =focal adhesion; Biological process=cell adhesion
gggacagaggaggacgaggaggccatggagcagctggtgctgaacgcgcagaatttgatgcagtcggtcaaggacactgtacgggcagcggaggccgcgtccatcaaaattcggacgaacagtgggacaaaaattaattaaaaaattaaaattaaacatcatgaaaaaaaagagaccggaccggccaactcgggttggagtcatctcgagtcgggaaaccgaccgaatccaagataaatcccgaagcttttgaaaaacgaccgtgacggatcccgagaaggggataccgaccgaatcccgaagattttgggaaaacgattgggccgggcggactccgaggtcgggccggagcaggacaaaacgtcacgtcgccgccgaaacgtcgccgggacaaaacgtcgccgccaaaaaaaaaattataaaaatttttcaaaatttcaagaaaattaaaattttaagcttttttgaaaatctaagtcttaataaaaactaattttccgaatttccaaaaaaaacgaaaaaaaaaagtttttgtttccttgtatttccttaatatttttttttctaattttttctagaatttttttcgtattaggctagccaactaaaattttttataattttcttgattttttttatagaatttaaaaaaaaatttgcgacgacgttatgtcccggcaacgtttcggggccggcgacgttttgtggtgtaccgaggtcgggttcctgaatttaatcccgtgggttttccgcgaaaatcccgcggtatcccgaccccgcccttgtctctattaaggtatcgggaatttttcatttttgccatttaaaaaccagattttcattagttttgaatttaatatcagggcattttgaaaggcttggaatattattagaatcaaaggctattttttaaatttctgtgttcaaaaaaaaatttttttttaattcgtattaattagttaaattaaatcggaatttattttaatttatttaatttacagtatttttttcattgaaattctaagtttttttctcaaatttaaattttcaaaattgatttaaggtggcctccgtctgcgatggattcgcaagccgatgtggtccaactac

SEQ ID NO: 84470 - DNA, 435 bp, Heterodera glycines
  Genomic contig location: Contig_ID=SeqID_19727; Location=640..1074; Strand=-
  SCN-specific regions: Sequence locations=1-101,126-414
atgggtgtgacaaaaaataggcatttttggctctttaaaaatattttaaggggtataaaaagaaccaaatttagtgcggtgtaatggtcataatcgtttcttattaaacaaaactttaaaaaattcaattgttattgataaatattccttgcacaaatatttctttgatcatttttgtcgccaattttttgacgaattattttttggccaaaattttgaatttaaaaaaatgtagccgattttaccattaatgaaaaaaaaatgtttcggttaataggccttgccaacgttaaaggatttttccttttttttttttgcaatcatttcaataacactgacaaaaagcaattgctgctcgcatcggtttgtgattgtttggacgacgaaacgacgcgcgagattattaaggaaatgtttattaaaaagtaaaataaa

SEQ ID NO: 84471 - DNA, 514 bp, Heterodera glycines
  Genomic contig location: Contig_ID=SeqID_19728; Location=313..826; Strand=+
  SCN-specific regions: Sequence locations=1-104,126-305,329-398,420-514
atggggataaatcctcagatctgcgagccctgttttaatgtaggtaaataaattcagttttattcagatcacagaattggtaaatttaaatggcaacgcaaagtaactttggaaaatttcaacagcgttcaagtcgacaatccagtaaattagtgttaggagtttgtttagtttagggaattaatgtattaaaggtcggatcatttctcaacaacccacgaaatgctttgatgaagcggctaaacgacggcgcattcagcaacaattggagtcacttgagaaagtccgtttattggcggaaaatgatgcatttcacgtttttcaggataatttccaagaggatccccacgcgaatatcacatggcacaaagcggcaccaaaatttgacgatgaaatggtttttggagacaaagaaaagaaaaggcgaaaacggaaaatcgcgtcaccctcaaaagtcagcggagcggagcaagcaagtgaatggaagtcgggggaagagaaaggaatcatttga

SEQ ID NO: 84472 - DNA, 648 bp, Heterodera glycines
  Genomic contig location: Contig_ID=SeqID_19729; Location=473..1120; Strand=+
  SCN-specific regions: Sequence locations=1-158,181-252,276-346,368 -393,416-648
acgatgaagactacgacccatccgcgcaaatggcggacaaaatcgccagcctcggcttggacgacgtcattcggcaacagcaaccgaaaggggaaaaagtgccgacgcaagcgacgaataacagccgaaaagagggcacagcgaaagagggggcgacggaactgagcgaaagggaaaagagagaggcgcaaatgagggcggacggaacggcggcgatggatttgttcggtttggaattcgaaacaatccgaaaaaggggaaaagccaagccaaaggaaagggaaatagaaaatactcgaaataaagttgcaaaactcaataaatatcgaactcacattttctggccttatttacaacaatataaacggtatttagagtggtaacaaatgggaaacaccaaagaaacagtttaaattctgggaaattgaatggatttcacttttaaattctgggaaattgaatggatttcactttccctctttttaggcttggccgtcgagcgcaaggagcccacctttgacgaccttcgcacgaaggacgactttcaggcatttgcggataaattgggcgaacaaatcggggcgaggaatgaccacgcgaattactcactgtttgtcagtgctttggttgaccatatgacaaagccaa

SEQ ID NO: 84473 - DNA, 1910 bp, Heterodera glycines
  Genomic contig location: Contig_ID=SeqID_19731; Location=293..2202; Strand=-
  SCN-specific regions: Sequence locations=1-274,296-592,615-649,671 -683,712-931,984-1092,1170-1486,1509-1585,1608-1910
  Gene Ontology: Cellular component=integral to plasma membrane; Biological process=cytoskeleton organization and biogenesis
ttggtcgctgccgcgttggattcgctgcgcgaaatttatttcaagcggaacatttcggcggaacagcagcgcgacgcggcactgctctcgctggtggcccatcccaagcaaatgctttacgcggcacagaccggcacaatcgcatgcgaatacctttcactggacaccatggaccagtggatcatttgttggtggttactatttatatacaaacacatttttgtggggacagagtgcaaaaaaagcaacaattttaacgaatccgagctcagcttttttcaaaaccattgatttggtctacgatttttcattgggaacttgactttttctataattttcagaaaaatttgttggcggtaaacccaatattctgcttgaatgtagttgttcatgaatgcttttttagaatgagcttttaaataaatgagtggagaagtcaaaaaagctatttttgagttgtgaaagaacaaaaaatttggaaaattttgaaaatggccacattattcaacttaaatgccggaatttttatgactcaattgacgaaaaagagtgaaccatgaaaaaacatcaatcttttttcataaccaattgataaaagccaagtttcaaggttttgttttgaactgctttagcactattccaacaaatttgcatatttatttaaatgttttttatccaaccaaatgtctatttttaatataaatttggatgaaatgccgtggcatttgtcagcatatcacccaccacatattccacgatttatttatagtcggtctgacggtgtgccatcggttgctggtggacccggcacattcggccaaccttggcccgctgtaccaacgggcagttcagcactgtttggtggttcatttgttccgtgacgagtgcattgttgtccaaccgttggtgcacaccgtgttggagcacatcaagcagcagcagcaacacaaccaccaatcgcaacagcagcaccaacaacagtacggcatggtcaagcagttggtgggcgagctgaaagatggtcagtcagtgtttcattgtttgaattattgtgaattattgcgcgcaggacacaatgttgttcttaatgccaaaaaattttttttttaattcaaaaaattttattatgtattattagttttttgagaattttttttttgataaattttcgaatttttttacgatggtgcttgatcgaattagatttttaaagacctaattgaaacgcggttccggcatggtttttctgtggactcagtaccgtttttgtgggaaaatgccgagaaaattgtaaaataatacacattttgcctgctgtccctgatttcttcccatttcctaagaaaaccagaagacttcccaagaaaaagggcctataaatttttttttcaagagatatttctttttttttaaatgcattttttagaagaagactttgtaaaacccgaaatagtggtaaattcgcagtttttaaagatttcatttgtttttaaattttttttatttatgcttattttagcgatcaaaaaattcttagaaaacccatatttttcaaatcttagattttggtaattgttttgtgagataaatgaagttcaccaaaaaacatgccatccctactccccccccccccctccaggtgtgcacacgctgcacgcggctggccacctgcatgcccatcgacggcactttttgcggatggcactgcgcgagctgtgcctgctgattggcgaccagcccgggctgcttgggcccaagtgtctattcgtttggatgggcttggcctacgcccgggacgaggtgctgtggctgttgcggcacagcgaactgtggcctcagctgatgcaagccgcattctccagcaaaaaggcgatggccaggagcgggttggccaccattgtggtggacaa

SEQ ID NO: 84474 - DNA, 647 bp, Heterodera glycines
  Genomic contig location: Contig_ID=SeqID_19732; Location=166..812; Strand=+
  SCN-specific regions: Sequence locations=1-338,366-538,629-647
atgccattggacggagcaatcggacagcatttgaacagttacgggtaccgaagcgatggctcatttggctgcaatggtatcagtcggccgtataaaatgggatttggcaccatgccaatgccattcaacgcggcgattggacaacagagggaccgccgctacgttgggagtgccaattggccatttccattggaatttgtgcccgtgccaatgccatcggacggcgcattggcattccaatcgccagcattttccaccggagatgtggtcggatgcggcgtttgtttggccactcgacagatctttttgacgaagaatgtccgacgaaccggtgggccaaacacaaaacaaaaaagcaaataatttaaattacaatttgtcagatgactcctcttttttcactacaactcccatcaattctctgtttccatgcgtttctctgtggactggcgacaaaattgaggcgaactttgggccaagtttcaaattcaatttggccactctttgaagaaagccgaagaaacaacggaaagggcgattactcatttaattaattaattaattcattatccattcatttttcactttatttttttcacatttattttcagttttttatattatttatcatgcgtatttgttaacaa

SEQ ID NO: 84475 - DNA, 1264 bp, Heterodera glycines
  Genomic contig location: Contig_ID=SeqID_19733; Location=349..1612; Strand=-
  SCN-specific regions: Sequence locations=1-597,619-651,673-870,892 -975,1015-1264
  Gene Ontology: Mol. function=microtubule motor activity; Cellular component=spindle microtubule; Biological process=anterograde axon cargo transport
ctgtacaacgaggaactcattgatcttttgtcaccggaccgggactcatcctccatcaagatcatggagaacccgacaagccacgaaattttgctgatgggtgcatcatcgcgaagtgtcaattcgcaggaggacattctgtccgcgctggccattggtgcccaaaatcgaacaactgcagcgacaaatatgaacaaacagtcatcacgctcacatgccattttcaccttgaacatcaagcagactcgagtggtgccggttgatgtacgggatttttttggcggaggggcaaaatgataaagaaacattggttcacgaaattttttaatttgagaaaaattcttagggggtaatccgaggcggtgaacacgcgccttgccttcttgtggctcaatatcggcgcctcgcattcggatttgaatatttttcgagctatagggtgccaatcatttttcgggaccaatgttttttactattaacatttgggcgggtggtggtgtgacattttattatacttacaattagtgttgcataatttaggacgattcggacgaaaaggagaacaacacagcggatgaaggtggtgatgatgaggaggaaagttctgagaagatgggcacaggaggaactgaattggaaacattgcatgccaagttccattttattgatttggctggctctgagcgcctgagcagaacgggcgccaccggtgaccgagtaaaggagagcatcagcatcaattccggactggtaagcgaatgtggggggggggggaaagtctgggtatattcaaatccagagctgcataattctgtttacaattaggctatttgatatggtgaatttgaatgcccccctctataaatgtactcatattacagtatttttcaagataatgtaaaaacacaaaaaaataagcattaacatcataaatttcggcaatttttgccaaaaatagaaatttgtttatgcgcagcaattcaatattttttacacttcacagcttgcacttggcaatgtcatttctgcgctgggcggtgcaaaaggtcgaattggtactgtccacgtgccgtaccgcgactcgaaactcactcgtctccttcaggactcacttggcggtaacaggtcggcaattttgaaattttcttgttaaaattttgtttttttcagtcgaaccctaatgattacatgtgtcaacccgaatcagattgatgccattgaaacacttggttctttgaattatgccaaccgaatcaaaaataag

SEQ ID NO: 84476 - DNA, 262 bp, Heterodera glycines
  misc_feature (239)..(239): n is a, c, g, or t
  misc_feature (262)..(262): n is a, c, g, or t
  Genomic contig location: Contig_ID=SeqID_3385; Location=151..412; Strand=-
  SCN-specific regions: Sequence locations=1-157,179-262
atgccaattcgtggataccaattcctacacactggtgagaattcggcttagtctttgtgaaattgcagaagtaaaaacaatatttgcagaattaaatggtaattctctttcgaaggtgattttgcctgaagagaatgagaagtctcccgcccgtttgatccttcttgacatgctccgaaacacctgtcctaaaggcaacatcacaacgcttcagcgtcgatatttcaacgactcattgngaaatcgattggtgacccaatan

SEQ ID NO: 84477 - DNA, 774 bp, Heterodera glycines
  Genomic contig location: Contig_ID=SeqID_19734; Location=5..778; Strand=-
  SCN-specific regions: Sequence locations=1-71,222-232,254-490,545-774
atggccatcatatgcattcagagcatcggcggtacgatcacaggttaatgaattgttaaattaacatagactaaatattattaattatttttaattaatagaagaaaagctattaattaatggttaaattaagaatatactaaaatattattaattctgtttaaattaatagaagaaaagctattaattaattgttaaattaataaatagattaaaattatgtttagaaagcattgaattattaaattatttttagcgaaaggcaccttgactaagaaattacaaatagatgtgccatttatagaagtaattagagtatgaaattccgcgcaaaatgcgcgaaaagcagaaacatttaagcgaagcgacacaaagcgaaagaaaaagcagtgggagaagcaaagagaaacaacaaacagaaaaaaacgccgcacttccgccgactaattagttttaatttccgtccgttaattagacaaatagtgtcgtgtcacttcagtaaaaagtgttttattgtttttattttcattatttataaagtggcagtttctttcacatatgaatttattatatgaagggcttccttttttaggcaaatgcctaaaatttttgcgcacttaatacgcaaagataagcacgaaaacccgttttgcgctgggtttggggtgtctacgatgacttttataatgccaatttttgcctatttcagggttttagtgccttatgtgcctattttaggatttttgaaaaagtcattaacaaaaatgcaataaa

SEQ ID NO: 84478 - DNA, 604 bp, Heterodera glycines
  Genomic contig location: Contig_ID=SeqID_19735; Location=259..862; Strand=+
  SCN-specific regions: Sequence locations=1-335,440-564
aaattaaccgaacaatttggtaaaattctatgcgaaatttgccgaggtaattagtggaaatactaattgattaattagttatttaatttttcattccaccacttttagaactcgtaaatgatgttgagctgctccgccgtcttcaagcagaacactttgacgtcatacttgccgaactttatgatccgtgccccatggcacttttccatcggattggcgccaaaacgaaacttggcactttagcgttgccgttgtaccaaatgactgtccgtccatttggtataccaacgctgagcagttacgtgacaagtgagtgaatgtgccaaaggggagggaatttaattaataaatttaatcaatttggttaattataatttagaataaaatacttttatttaaaaatattacataaaaaagtacaaaaaaaaattgttaaaaagatgtgatcacaccaatgaatggaggtcacaaaatgaattttgtggaacgatttgtgaattttgtcaacgatttgtgcgattggttgtttttgtcggatttggtggtttcatatgaggtcagcacaaaaataaaaataaaaatgtcaatttatatttaatttaaa

SEQ ID NO: 84479 - DNA, 522 bp, Heterodera glycines
  Genomic contig location: Contig_ID=SeqID_19737; Location=5..526; Strand=+
  SCN-specific regions: Sequence locations=1-522
aggtccatttggcaaattttggcgctattgagaacgcccatttgagtattttaatacagaatttaatcgatgtgatcaggtcgagaaatgcacgacaattagtgaaagagtttggcgacaaatatttagaggaagtgatgaaggcaagttaaattgttccataaatgggcgagggcaggagcagtttaagcagcaaattattcgtttggcaatacagtggccgaaattgtcaatttcgtttttaagtttctcgacgaagcaatggcagcgtcaaatgagtctctcccgcttgccaaaattgtgcctgttttatgcgacgcctttgccaaaattggcaccgtttctttcggctccattttccattctttgctcagctcaacggaattgcacagattcactctttttgtatcggaatgcagcaaacgcgatgatttgttcgatgcaaatttaaaatgaatgatcaaaaattggtcatttttgaactgtccaatttataaaacaagtataactttttatgtgcaa

SEQ ID NO: 84480 - DNA, 1334 bp, Heterodera glycines
  Genomic contig location: Contig_ID=SeqID_19737; Location=963..2296; Strand=+
  SCN-specific regions: Sequence locations=1-28,60-460,482-1181,1204 -1334
  Gene Ontology: Biological process=nucleobase, nucleoside, nucleotide and nucleic acid metabolism
aggaatttgatgcgagaaaaaaagcgattgttaaaatttgctgaatatttgggacattgttcacgagaagtgagcctttctcttatttcgcatttcattctttcgccataggcgacagattacggaaagtgtgtggcaacgaacgcggagagaattcggaaaggcgactgttcgactgagttcgaccgactcatcgcctgtttaaagaagaggcgtaagttgggacaacatatttctgttgtttcgggttctagtagtttgctttatcatcagtttgtcctttcctttcggcattttgtccctttcattttgtctttgtcggcattttgtcctttcctttcggcatttcgtccctttctttttttctttgccttttgcgcccattccatcctttgactgttttctctttttagaagtgcgtctgtaaatcgctgctccgatgaaagtcaaacggcttaagcgtgccgctcacattttgactttttaccgttacaatttccattttcttcccccattttccgtccttctcgacggaactttttgccaagcggcgcttcagtcgaaaataaatcttcgagaacaaatgctaaaatatttggcgcaatccgtggaaatggtcgtcacgaaatgcgttttgaatgagctgcatcagttgggaaaaccactccacggcgccttggtcatctgcgaacaatttcgaattgccttttgcccccacaaaccgatgaggacggcgtcggaatgcatcgctcatttggcgagacggtcacgagaagaaggaaactcaaaacacattgtggggacgcaggtgggcgagcagtgacacagcaaaaaggggtagagaaactaataggccacgaaaagtcggactttggacccgaattcgaacagaataataaaactcattaatctaggaaaattggcaattttactgattgtgaataacaaaagtttaggatgaccaactgatggagaaattacgaaaagttggcggggtgccaatcatgtcaattcgcttcaatacaattttgctggaaaaggtaaaaaaatagtgaaaacgattgaattttcgcaaattgtttagccttcagaggaaagtaaaaaaatggcagaggaaaaaccatcgaaggaattggaaagagtcaaagaattaaaggacgaagcatttgcatccggagaaaaaagaaggaaacgcaaggccaaagggccaaatccactctcatgcaaaaagaaaaagaaaagcggcgaggggaaaaaagacggaaacgcggggaaagtgcccggggcatttggacaggaagagagcgaacggaaagggaaaagcgacgaagtga

SEQ ID NO: 84481 - DNA, 1288 bp, Heterodera glycines
  Genomic contig location: Contig_ID=SeqID_19738; Location=213..1500; Strand=+
  SCN-specific regions: Sequence locations=1-689,711-815,837-1244,1266 -1288
atgcttggcccaattttgatggctattcgattcccactaatggcacaggatgaatttgtgaaaagcattggtgagtgtgtgtaagggtgttccggagactcaaaaaattaatgaaattttgcccaaaaacgctccgactaacggaatccgatcctactcttgttactgtagtcaatttatccataataattatttacactgctttgtgagtagtaccacgacttgattgatgcttctccatagcgcgaattgaatttattaaattcacaagacacagtattttcttgttttgactactgtttttgggtacagtaagactattcgtttattgattttgcctataattttgacagttccgtccaaagtgttgactgtcgaagaaatgttccccgttttactgtcccatgcgacgacttatactgaaaatctatgaattttctaaaattcttaaaatccgttcaattcacagcaatatcgtaaagataaagggattttcgtggaatttgagacggcaattccggaagaaaaacaagacggaattcaccagttgagtttctcccttcaattaaattggaatttatgtggtaagcaattaaaaattgaaagaaaaaattttgatttccaataatttttaaaattcgcagaacccaaaatattaaaatttttgattaaacataactgttgttcgattttttaaagtttcacaaaatctcgatcatcacaaaatttgacccccgtccaaatttcatcctttttttttgtccttcgcacagaatttgaatcgatctgttactgcttggcgacattgcgaattgtttcacaaaagcaagataaagcggaccacattcagacccaacgccatttgttccaaaaaaatccatcgatttgtcacgaaagtacacttttatgcaaaatgccatttcagggtaacataaattgtaaatttagataagaaaaattaatttatgatttgatgagttccgagaatgggtggcacgacgaggagaaggacattctgacggttactgtggatgtcattgtggaaaatggtgggggagaggggggggggggggttaaaaagggtggaatcggacagactcggcacgggtgctggactttcctcaattggcattttgtgcattaccatttgttgcgattctgacaatgcaaaatttaaaaattcatccccaacttaaaatatttgatgctatttttagcagaaactcagccatcagtggacaacaaattggacaaactcaaaaacagcagaagtgaaacgcagctttga

SEQ ID NO: 84482 - DNA, 455 bp, Heterodera glycines
  Genomic contig location: Contig_ID=SeqID_19740; Location=1366..1820; Strand=-
  SCN-specific regions: Sequence locations=1-400
atggtgattaaaagtgctacaacagtgattagaagaggtacaacagtgattagaagaggtgcaacagtgattagaagaggtacaacagtgattagaagaggtacaacagtgatcagaagagttacaacagtgattagaagaggtaaaacagtgactaaaagaggtaaacagtgattagaagaggtacaacagtgattagaagaggtacaacagtgatcagaagaggtacaactgtgattaaaagaggtacaactgtgattaggagaggtacaatggtgattaaaagtgctacaacagtgatcagaagaggtacaacggtgattagaagaggtacatcagtgattagaagaggtacaactatgattagaagaggtacaacagtgattagaagaggtacaacataaattcaaattaaaaattgtatgaattataaatttattaaatttaaaaataaa

SEQ ID NO: 84483 - DNA, 936 bp, Heterodera glycines
  Genomic contig location: Contig_ID=SeqID_19742; Location=211..1146; Strand=-
  SCN-specific regions: Sequence locations=1-615,639-796,827-936
ttacatcgatcactccgtcatcgcttttcttcgttcaaatcaccaaattttttgacaaaagaggcaccaatttagatttgtggattccatcatcacgagacatggatggccagcagctggtttgggatatttttgttcgtgaaatttggcccattttttctgaaaacattcgccacttgggcttttacgatggttatcatttggacaatttgcgtcgtctcatttcgccaacaattctcaccgatctcaaccaattgacttcaatctattcctgtggtttgtttcccgctgcgtttggtgatgattttgatgtgccaaattcaacaatttctgctggccaagcattgtccaaatggttgcactctccgagaaaagatggacaacccaagcgattgcgttgcataggttacaacaaacaaacgaacttcgattggatcaacaatttcaaggaggtgtggcccaacatttttgtgatttttgtttccaaattgtttagcaatttctccgtgccaatgccatttcttccgtcagttacgaaattcatttttatgtgcaattgtcgtcaatgccaatggtgccattcgaattggtgaacgaatggacaaaggaaaagctgacattggccaaaacaaagggatgggacaaccgatggataatgaaacgatgcaaaattattggggagaccgcggcggttcagcagcagaagaatgatgaaaattgggataacaatttgaacagtgtcttcgtttggctttttcgtaccactaattgcatcgggtgagcaattaaaaaaggcattttattttgtttaaataattaaaattttgcttaatttagcccattgtctccgccaccagcagaagaagccggacaaaacatcacaaaagggccgtcatctgaactgacaatgagtgatggacaaaacgaagaaaaaca

SEQ ID NO: 84484 - DNA, 555 bp, Heterodera glycines
  Genomic contig location: Contig_ID=SeqID_19743; Location=1..555; Strand=-
  SCN-specific regions: Sequence locations=1-229,253-372,396-477,500-555
ggccgggtccttaaatctttaccaaataaaaataatacttcaccggatggtataaatttcaggttaataaattcttttgcgccttatgttaccgaacttttcagaatctcatttgataccggaaaattaccgaccttttggaaaaaatctataataattcctctctttaaaaaaggggataaaagttgtcccaccaactatagaccaattgccctcacatgttcactgtgtaaaatttttgaaaaatttgttgtcagggcaattactagtttccttttaaaacatgacctaatctccctacaccaatttgggtttgttaaaggtcgttctactgttacccaacttattttaactcttgaaaattggtttgacggtatttacaatggaaaaaatattgactgtgtttatattgattttcgtaaaagcttttgatgttattccccatagcttactttatataaggttcataaaattgggtttaaaggtaaaacccttaattggatttctgattttttggccatccgctcctttttaattcgtgttgaaaattcgttt

SEQ ID NO: 84485 - DNA, 156 bp, Heterodera glycines
  Genomic contig location: Contig_ID=SeqID_19744; Location=22..177; Strand=+
  SCN-specific regions: Sequence locations=1-156
gtcgtaaaacgtattcgcgagaagtttacaagcctacagaatgaccaacagttcatgttgaagcgacagcgacacactgatcttcatgcaaaattgaacgccatcaaaaaggcactggaggagtggaacaaaagggaggaaaacgatctctattag

SEQ ID NO: 84486 - DNA, 64 bp, Heterodera glycines; identical to SEQ ID NO: 76326
  Genomic contig location: Contig_ID=SeqID_19745; Location=1025..1088; Strand=-
  SCN-specific regions: Sequence locations=1-64

SEQ ID NO: 84487 - DNA, 171 bp, Heterodera glycines
  Genomic contig location: Contig_ID=SeqID_19747; Location=129..299; Strand=-
  SCN-specific regions: Sequence locations=1-138,160-171
atgccaaaaaattgtgccgaatttgattttgttttcctttgcctaataaaggtgtcctcggtggacggcaaggaggacaatgctacagtgaatgtgtgcagtgacggaactgttactgctgctgctgatcatgacggtgcagcattggggcaaaaacagtcggacattcag

SEQ ID NO: 84488 - DNA, 99 bp, Heterodera glycines
  Genomic contig location: Contig_ID=SeqID_3388; Location=2598..2696; Strand=+
  SCN-specific regions: Sequence locations=1-99
ggagtaggacaaaacgtcgtcagccgaaacgtcgtcgaacgaatttttcgaccataacttttttctttctcagctcaattaaacattcttggtattatt

SEQ ID NO: 84489 - DNA, 116 bp, Heterodera glycines
  Genomic contig location: Contig_ID=SeqID_3390; Location=134..249; Strand=-
  SCN-specific regions: Sequence locations=1-69,91-116
atgccacaatttgcattctttgttcacttccgacgattgaacggttttggcttcgcagttcagaagacaaaaattgaattgaattgttcagagtcgatgaaaacgttctatttttg

SEQ ID NO: 84490 - DNA, 1232 bp, Heterodera glycines
  Genomic contig location: Contig_ID=SeqID_3390; Location=749..1980; Strand=+
  SCN-specific regions: Sequence locations=1-44,66-465,487-709,734 -793,844-1027,1052-1165,1188-1232
atgccccaaaattgccaatgtttgtcgtctgcacatccgccaatggggggaggcggtggcagcgatcaacagcagcacaaagacggacagcggaagattaacggaatgacacagcgatgcgcggtgaaaagcgtgggaagggtttgtgttctgcgggggaggaataaaatgccaacatttgtgccaaaagtgaaggacgacgtggcacacttcggctatcccatggaattcacgctgaattacgacggcccaccggcaaacatttccgaagaagcggagacaaagcccaacaatgtttggccaagaatgaccttcacggtgacagcggaagacagctggggaaggattttcgtggaaggtgttggcatagtgccaatttttgggtatttatcagcgcgaaaacagtgccaaaaaccgtccgataaacggcaagcggacaaaatcccgactaagcaaaatctcaacttaattaattgatttaaaaaactctcgacttccaaacctcggcttactgccttttttcacatgatttgtgttttgtccattttttgtgtgttgtcctttgtcaactcatatacagacattccaccatttgaaaatgcctttgccatttgtccctcaaaagggtttgccgtctttcctctgcccatttcatttggcccttcgcccgttcacttttggctcaattgcgtccgcccaatttcgcctctgtccaaagtgtggacacttcgccaaactcacattggccaagcggaggaattggcacagctcagaacaatgggcgaacaaatggtaaaaattgttctttattcgtaatttaatttaaaaaacaaaacaatcaaatcgcagttttgtcaagagggaatggccacggaattgggcggaaaattggaactcacagtgcgaactgtgcaccaaagccgacaatacatctccagtgacattttacaatcgcttaaatacaacgcaatgatgcgacggattgggtgggaattggcggggaaagatgaaaggataattaatcacactaattaacttaattaattaatttcccaatcaaaaagcgaagcaaacggaaaagcaatttccaggatcagtgagcaattgcagtgtcgcattgccaaagtgttggaggagttcgatcgggtgaagcgacagctgatcaaagtgcggaagggtcgaagcattgccaacgcataaaaaaggaaatttattttaaattttgctattaa

SEQ ID NO: 84491 - DNA, 478 bp, Heterodera glycines
  Genomic contig location: Contig_ID=SeqID_19748; Location=271..748; Strand=+
  SCN-specific regions: Sequence locations=1-140,162-434,456-478
atggtcaatctcgaggtggcacaaatcaacgtcctttctaaagtggatttgctaacggacaacgcgccttttcgtctggaatatttcgaggagctgcccaatttaacgcatctgaccgactgtcttaatgtatctttgaatttaaagtttaatgcatatctttttatttgtttttcaggatcatcctgccttaattcgttacaaaaaattgaatcagtccctctgcgaaatgatcgaaagttatgggatggtcaattttgtatcgctggacgtccaaaacaaagaccggatgggctttttgttgagattagcggacaatgcaaatgggtttaatctcgcaaatgttgaagatttccggaaagttgtaatgaatgattttagttgaaattgtttgctcttaaagataaaattatttttaactcaataattatgagatatttttgggaaacactttgtcagttggttgttttgctcggaa

SEQ ID NO: 84492 - DNA, 1064 bp, Heterodera glycines
  Genomic contig location: Contig_ID=SeqID_19749; Location=25..1088; Strand=+
  SCN-specific regions: Sequence locations=1-138,160-277,300-417,441 -862,954-1064
atgcttttcggactttttctcattcataatatgcaattaacctcagaaaaaggggaaggaaagcggaaaagagaaggggaagagagtgatgaaggtcagtggagagacgaggcaaagaaacgtgagaaagtccgtgaaaagattggggaaaatgagcaatttaaggccgaaggtgagcatacggtggaaagggtacggtgggacggaaagggtacggtaaaaaaagtgcaaaagaaacaaaaggggaaaccaagtgtatatgtacattcattgagctgaataaccaagaaacattggacattgtcaaccgtttgctcctctttagactgccctctttttgctttgccatttgccaattgccttttcatccaccgacattgacaacggcgttttgggtaattgctgaaattctgtccttttttggtctgttcacttattttgtgaaattctttttgtaaaggaactcccgaagttatttgtggtcgagattttgtccattttaaagtcgtcacaaaaaaggtaaaacaaaaggaaaacaattgaaatgaaagcaattaagcctttcggaggccgtgtttatgtcaaaggcgaattcggcaatccgaagtgcgtggagagtgcggggacgacgagggatggcacggaaagggagggagaagtcggcatcggacgggagggagtcgggaggaaaaacgcgccgaagacggaatttggtgggaagcggaggaatgcttaatgggccaagaataatcactccgttaaatccttcagatgctccggccaaaagagaaggtctgaaagagaagaacgaatactttggacaatccgagcataatccatggcgaccaatcggaacagtgccggaaggggaggaggaggagggggaagaagccgcgggcgaagggacggcacgcggaggagcgaacgcggcggaggaggcggcggacgaagagacactgcgacagctgctgctggtccgagccaaacaatggcaaacaaagtgccggaaggaatttaggagctgcagaagcgccacaaccacaacaccaacggctcccaactga

SEQ ID NO: 84493 - DNA, 396 bp, Heterodera glycines
  Genomic contig location: Contig_ID=SeqID_19752; Location=752..1147; Strand=-
  SCN-specific regions: Sequence locations=1-203,236-360,382-396
atgaacaatttggcacttatgtatagtaattgtagagggtgggggggggggggggggtgttgaaccctgcccaatcattgactttgtcaatatttcagtctgctgatcgcgcacatcagcgcattgaactgcgctgttctgcgacagcatcgcgccgttaaatcgggcggttctaaacctgaaccgtacaagcaaatgccaggtaaataaaatttatattaaaaaatatataaaactgagaaccaagaaccggaaatggatggtggaccaaaagaaaagaagcatgaacaaacggatgtagcggccaaaagaatgaaacgcggggcaaaaggaggcggctcatcaatcggaaaagccctcgtaaaaaaggagcagagattgtggggtctgggttaa

SEQ ID NO: 84494 - DNA, 210 bp, Heterodera glycines
  Genomic contig location: Contig_ID=SeqID_19754; Location=2158..2367; Strand=-
  SCN-specific regions: Sequence locations=1-155,177-180,203-210
atggtccgctttaacaatgaacgtgacatcggcccttacacaacgacaaacaatggccaccaacagcaacaacaacaacaatgaagcaattacaaatggactttttaagaatttaatgcacagcgaatgctcgatattaataaaataaagttacaaagagatattttaataaatattaacccattttaaacaaatacatattaatgtggt

SEQ ID NO: 84495 - DNA, 368 bp, Heterodera glycines
  Genomic contig location: Contig_ID=SeqID_19755; Location=304..671; Strand=-
  SCN-specific regions: Sequence locations=1-258,283-342,365-368
aaaatagagccctcagcaggagtcgtctaattcagtaaatacggtatgtattgcaaataaaaacataaataggtaatttagaattgcaaaaaaaatttatttcctcggttaaacaaacatttttcactcataaaacaattttttaatccgtttttttctttttggcatataaaagaatttgcaaaaaaatcattccgttaagcagcgaagagagcacaaacggcgcaatgatcagccaatcgccggcagtctcctggacggaagtgaacacacgcgcaacacaaccgccgaattgcatggagacggagatctatatgttatgttctcaataaattgacataaattggaaagaaaagaattttcttcaa

SEQ ID NO: 84496 - DNA, 1255 bp, Heterodera glycines
  Genomic contig location: Contig_ID=SeqID_19758; Location=388..1642; Strand=+
  SCN-specific regions: Sequence locations=1-154,178-822,845-1012,1049 -1255
gatttcgttttacacaccactcaggaaatcgctggagatgcacaaatcgcagttgctcagcatatataaacatcacaaacaacggcgaaaccggagctagtggaaccttgagtcaaaaagaacacaaccacctcccagcacctcagaaacaacaagtttgtataaatttaaaaccaaataattaatgctttgttaaaggcagagtcaaggcgacagaaaatcaaagaaagtgtcctggccgagccgtgtctgaagcccacacgacttttggctaaagtgaggcgatcagcaacggatgaagcctttgttgccatgagctccaacaatgcgttgactgaaatgatgcggcgtgagaagaaaaagttgctgggaaacgtcgacgtgcaggacccactggcctttgtcattccagcaacgttacgcgaaaaacgtggcgaagacatcgtcttgtatgacagtcgcaatgtcaggcaaggcgaaaaggacgttgtccttattttcggcagtgttaaggtacattttttggctataaaattctgtttgttattggcattcctttagactctggacattttgcgccaatgtggcacgtggcacctcgatggaactttcaaatgtgctccagcgatgtgggagcagtgcttcgtcattggtgcttcagtgcatcagaggatgtgcatcagcatgtggtgtctcctgcctggaaaacagcgacgctactacgaagaagcactgaattttgtccgtgaacgcacctcaccagaggtcccaggcaaaggttaactcttcgatttacggaaaaggaataaattgaaaaattttatttttagttctttgtgactttgaaaaagccgaaatggcggccgtccgcgcggttttccccacggcactgattaagtgctgcatgttccactacgggcaaagcctgtacaggaacttcaaacgacttggtctcgtgcatttgtacggcgagaagacagaatatggtgaggcagttcgcaacacattcaggtaaaaaattaaatttagatttaaatcataattttttccagaagggttctctctttgccgcttttgcctcccgacattatcagaagagctttctcaattatcgtggcgtcttctcctcctggaatgccagtgttcttcctttacttctctcgaacatacatcggcttgacacagcgccagttgttggatggtgttaacgcatttggagataatccactcaatttttcacccattggcaatcatt

SEQ ID NO: 84497 - DNA, 1334 bp, Heterodera glycines
  misc_feature (27)..(27): n is a, c, g, or t
  Genomic contig location: Contig_ID=SeqID_19759; Location=589..1922; Strand=-
  SCN-specific regions: Sequence locations=1-329,365-460,495-614,636 -767,853-971,993-1334
atggcaactgtttcacattcaatgccnacccgggacaaaaatgtgttgagtgaacgagccgggccaaattatggtaaaaatgcgtttcaattaaaaaacaaaatgaaaaatgccatttaagaaatttgaaatctttgcaaatatttaggcctccgtttccaagtttttgtcaatgtcagcgactatttgccctcgacagaagctgccggtgttcgcattactgtgcataagtcaatgcgtggcgtactgtactttttgatttcaattcttgtttttagtcctgaagaacagccctttccggacacacatggccataggaatgaatttgcttattttcaaaaaaattaaaaataaattatttttagtgctccaactggcttcgttagctcatttggcatccgtttgaagtgagtaataaaaaaacatttaattattttgaaaagaaaacattagcttaatgatttaaaaattaaataaaaatatataataattttgaagatgtgttaatcggttgccaagtccatacggcgaatgtgttgagcaaggcaaaactgatgaatatatttatcgggacaaggaatattccactgaggtaaaatcttgcaaaatcctgtaataatcaaaagttatccaaatgtgacaaatccataacctaaattagcgaatttaattattgaaaatccccttctgctgaaggggtgccaacgttcgtgcatccaacggatgctggtcagaaagtgcgggtaagaagaacagtcgggaaacagattataataaatgaaataataattaataaatattaattactaggaataaaatttataataataaattaataataataaggataattaatctgcaaatattctatttttggcaaatcaacagatgtggcgacccgcgttttcctcgctatttgaacttcagcaattgtcccgtgggcgacccgcggctgagttagtgttaatcttcaagaaattatttaaatgataacacaaaaatggaattcatacgcataaaaattctatattttttagaaaattgtaaatgagaattgcttgaaataatgaaaaatcagctgaaaaagattccgttttaaagaaacaattatcattttaggaccagcaataaagtttttttagcaaaaataattaattaattactaacaatgcatttaaattcaaatttgcaggagagtgtctccgtcgtgaaatgcacagcggctgcgcggtctgccactcagcccgactgcgtgtgcagacagccgtgtcggtgcgatcaaataaaacaattaattttgattgcatttaattagaaaattaatccataataaa

SEQ ID NO: 84498 - DNA, 1161 bp, Heterodera glycines
  Genomic contig location: Contig_ID=SeqID_19760; Location=933..2093; Strand=-
  SCN-specific regions: Sequence locations=1-134,156-342,365-425,448 -634,658-882,908-1161
ggctccgatgccgtatttaatcggaattccaaaagaaacattccaaactcagaacaaggcggaattgggggatgttgttataatggacgtggatgagaagcttcttacttctccatatgatgacaaactgccgttagaagctttcaattttttgcggaatcgtttaaaattctccagcgatatttttatttctgattcactggcaagggcctttttgcagacgaacgcgttgatttttggcaactacgtatctggtcttgttgtgggtatgtctgatcagtttgagtttgatcattttcaattgcttttaatagacccgcatggttcttacagctgggacaggaaattgtttactgaaaaacaacgtcctagcctccggcaatttctgtcttccttgatcggaaaagatggggtgcaatatttcgaaagatttattgatgaaaaattgtcggaattgaatgagaataggacaaccattgacgaatttgaaagagaggctcaatcgatgggagttagaggccaattggacaagaacggtgctgttacggtaacttaaatattttatttgtgaaattatatcttttttcaaaacaagactacggatatgctgcaacaagcagtgtcttctgtaagtaattaaatatttgattttccatacgagaacctcttcaagacaaaacctttatttccctgataaaaaccaattcgtgggttcttatatagaagcaccagttcttatttattggaaaagtgtcaaataatctaataaaaaaagttttcttacttcataggtgaaaggaaatgcaactgatgtaattggtgctttgaaggatcaaatccattcgttatcagtgtgttgaaattttataagtgttaaacaaaaatctaaaaaagttcaggtcagaaacaaactgagcgtaagacgaaaagaggatgccatttcttcagtcaaaaagagaaggctgagttcgtctgttgcccgttctcggtcgaagtacaaacagaaattggaccctctgacgattgacacctcacaatttaacctggataaattttctccctcttccaaaacgcgttctgtttctccaccatccatagaaagtgctcattctgtcggtgatctcattgatttatccgatcaaaataattcgacaattacaa

SEQ ID NO: 84499 - DNA, 516 bp, Heterodera glycines
  Genomic contig location: Contig_ID=SeqID_19761; Location=739..1254; Strand=+
  SCN-specific regions: Sequence locations=23-204,368-516
  Gene Ontology: Mol. function=transposase activity; Biological process= DNA transposition
gaagacccaattttggtcccccgacccaacctgcaccaaaaaaagcgcatgttgtgtatcttttggtcagtacatggtccactgtactgggaactgctggcacctggcactattttggacagtaatagatacataaaccaactgcgggcggtggatatcgcttaccgcatccggcgccagcagggccaatttgacggtcccctactctttcaccatgacaatgctccgccacaccgttctcatttgacaacccagtacatttcccagacattgaattggaatgagttgccccacccgccttatagccctgacctagccccctcggattaccacctttttctttctctcaaaaactttttacggggtaggcgcttcactgaagacgccgaggtcgaggaggcggtggggcagtacctgacctcaaagatcggcacagattttttccgtcgcggcattaggaaacttccttctcgttggagaaaggttgttagggtccagggaaactattttgttgag

SEQ ID NO: 84500 - DNA, 2855 bp, Heterodera glycines
  misc_feature (2822)..(2823): n is a, c, g, or t
  Genomic contig location: Contig_ID=SeqID_3391; Location=2671..5525; Strand=+
  SCN-specific regions: Sequence locations=1-335,357-648,697-758,782 -1966,1988-2055,2077-2230,2257-2855
atggcacgaccaccgccagcagcattatcaggcagaaaagcggtgccaatttcgtttgtgttcggctccagcacaccccgcgagatctcccaccatgtcaacgaatgtgccaagaaggggctgaaggccaagttggaccagggcggtggggacacggcgaagcgccggggtgacatcatctactacatgaggcaggcaaagtccactgacgcgaaaggtccagcagagcaggcaaatttcaaatggagtggagtcatttttgtgctccgtaaatacgggtacatccctaaatctcgccactcgaaagctcgccgagacaaaatctggctgacttgaatatttttttttataaaattgaaaatcccggactgctaatttgaaattacatggtttttggagctccgtaattacggattacggcttccgtgtcgaaaaatagctgtaattacggcttcgcgtaattggaaaatccagttacgtacagccctggataggacaaccatttttggcactgtgtgccaatggtcgagagcagaaaattattggcattgaccagggctcccagatcaaaattttcaaaagcctcatttggcaggcaaaaaagcctcatttttataaaaggtattctaaacacgcttaaaatgttcaaattttatatttttgattgcccatgatcaatttgagcaattttttgttcgaaataaacattttgtgaaattctaagcatgaaaaaccgaagttgatttttttgcggcgcttttttcaaaaaacttttggggaataatgggggccggcggtgcagataggcgccgccgggaaaaattttgtaattttcaatgcgatttgttaacagatttgtcgacaaatatggccaaaaacattatgccattttatcaaaattaatcaaaatttaaaaaatctgacgaattttccccaaaaatcttcaaaatttctcaaaaaaccacaaaaagcctcaaaatttctcaaaaaccacaaaaagcctcaaagcctcattttgaaaatttagcctcattgacctatcaaaaaaccacaaaatgaggctaaagcctcgcatctgggagccctggcattgaccaggccagaactaagaaccttccccaccgaatctctggcttagagaattggacaattttacatggacacgagagagggttgaaattggattttttggcataatgccattgggccgaaggtgcgaggttttaaattggaggattttaggtaagaatttcttggcacggtgccagggttcaagttccgccgatccgaattgccgatttaatattttttgccgtttgcctaaatatccatggggaccgaacggtgtggcacagattttctgctttgtccttccttacttggccctcaactagttttgccgggatttgagtcccgacaccgaaattcgagtcccagttttgtcggaatctcgatcctcccgttttccaatagaaaaaacggatcggcgtctcgggaaatcctaatgggatcccgatcccttcccgtttatagtctcgaattttcggaggtcaatctcggtccgagtcttgccgagtctcaaattttccatgcctaattttctgggcctcaatgcgcggctggccagcagcagcccttttccaaaacagtggtgccaagtcttagcattcagaggtgccaattctttcataaatccaccaattatatcgaatttttcgacaaaacatgggataactttgcttaaatgcaataaaattgtatattcttggtatcattcgatagccgagctttttcactattagcccgcaaaataaaaataaaaattggtcaactttagaaaaagttgtatgaaaataagtactatttctgccataacttatgttaaatttggtaacttttttgaaattttccaagctaatagagaaaaagctgggctatcgaatggtaccaagaattaaaatttgattgactttaagcaaagttatgccatgttttgtcgaaaaatttgctaaaattggcggatttatgaaacgatctggcacggcattcggagataaaagaaatattttaaaatgggataatgcatttttaagagcgatggatcactgctggcggcggcggtggtcgctccatttcgacagagtcacgaaatgaggaagatgaagctgcttccgagccggacattttgcaggacagaatgatcgacttcatgcggcacaaaaaggaaagcacaacaacaccaacaacagcaacaacgaaaatggaggacggcggcggcagcaggggaagggtactgtagcttgggatgggtttttgtaacaataatatactgtagctagttggcatacagtaagcggtggaaaatggatcggcgtctcgggaaatcctaatgggatcccgatcccttcccgtttatagtctcgaattttcggaggtcaatctcggtccgagtcttgccgagtctcaaattttccatgcctaattttctgggcctcaatgcgcggctggccagcagcagcccttttccaaaacagtggtgccaaatcttagcattcatcagaggtgccaggtcgtttcataaatccgccaattttaacgaatttttcgacaaatcatggcataactttgcttaaatgcaataaaattgtatattcttggtatcattcgatagccaagctttttctctatttgcctgcaaaattgcaaaaaatttggtcaactttagaaaaagttgtatgaaaataagtactatttctaccataactactgttaaatttggtaactttttttgcaattttgcaggctaatagagaaaaagcttnnctatcgaatggtaccaagaatgtaaaatcttg

SEQ ID NO: 84501 - DNA, 1596 bp, Heterodera glycines; identical to SEQ ID NO: 19762
  misc_feature (1578)..(1578): n is a, c, g, or t
  misc_feature (1591)..(1592): n is a, c, g, or t
  Genomic contig location: Contig_ID=SeqID_19762; Location=1..1596; Strand=+
  SCN-specific regions: Sequence locations=1-972,994-1596

SEQ ID NO: 84502 - DNA, 1532 bp, Heterodera glycines
  Genomic contig location: Contig_ID=SeqID_19763; Location=41..1572; Strand=-
  SCN-specific regions: Sequence locations=1-755,777-1181,1203-1532
atggcgaagcgttgcacggaggcggtagacgtacaagcgcatttgtcgtcaatgtacatgcatgaggttgtgccagccgaggtcgacctcactcgcaactatgcgcgcctcggtggcaattatgtgcttaacacggaggcaccaaaagaagcgcatcgcatgctgaccatgcatttcagcaaactcgcgagcaccgaaaagcatcgcgtacgtgtaccgcacaagcaacgcatcggttttgcatcaatgcgcttgttggaaagcacgcaggagaatgtgtcgctgattctcaatctgcagcgtcaggcggatgctcggaatgcggagatgatgcaaatttgtgcacaaagaggaatgccaatgcacgcaaaaatgcgagaagctggtgatgaacagcagacggtcaattacgagctgaaggcaaagagagagttgggcttggacatgcatgccagggcaacagttgacattgcttcatttggcaacgacgctcgtttggatgccgatgctgcggaggacatgcatttttcagtgtcccgcgagcttgaacgagacaccgcattcgcgcaccacgcgttcactgtgcgcatacccaacgagctgagtacaccgctgcctgtactgcgcacaagaacagcaacggaagagcatgcgattgtgatcgaaacgagacatcgaccagaacagaatcagcgagtcgaattgatccgatggattgcgcacgcattacctgcgcagaaataccgttgccgtgaggcaggcgatgtgcaccaaggcatttacctgcgatacgatcggcctgtctctttgcacgcggtggaactgacgcggcagttggcacgctggggaggagagatcagaatgcgcaccgatgcttcgggcgatgaacagcttgaactcgtgcgcgagttggagtcctcacacgaacgcgtctcacacagcttctgtaccatcaaaacagcgaataaggcaacaaggcaacagttgcgcacaggccaatccgagggcgttgaacaggtcatgcacgcaatgttgcaacggcaagctgaagcggaacgtgccactccgctcactgtttggctgaagaacacgataagccacgggccgttgcggtcacgcgaaagcaccgaggagcagcagcgcgtgcactgccaatgggcacgacgggaagcgccgcaacttgccgagttggtgaattggattgctttgttcggcggccacatcattcttcacacacaagcaaccggccaagcgcaattctcccatgaaattcggctacaaaaacaacgagaagcgtcccctgcgcccgcccgccggtgcattcgatgtgcgcgcgaaattgtgcccgcacattcacgcgtaaaggagccgttgcacgagcagtacaacgtcagtgaacaatggcgacgcggttctgcctctgaagaagtccaactgatgatgctgtgcccaaacttgggcccacctggcattcaaattcgcacgagagagtcgcagacacagacagaaaacagttactcgcaacacacgcg

SEQ ID NO: 84503 - DNA, 783 bp, Heterodera glycines
  Genomic contig location: Contig_ID=SeqID_19767; Location=63..845; Strand=+
  SCN-specific regions: Sequence locations=1-783
atgcagaccaagctgggttatctggatgaaaaggtaatgcaagccatgaaattggcttttactcaagctctgaagtcgatttgtgaatacatggttgaaactaggcggtgggcttcctccgcccttttgtctaatccaacaaattttgccaggtcagtgttcaactcaggaaaattattggcaaaaggcattggccccaacctgatcagaatctggccctgtgttgaactggcaaaagctgactaccaattctttccattggagcaagatcagagccaaactgaatgctacgagctaattcccatcaaatttggaacgtcaagtggaaccaaattggcattcgtcgatccaaaaacaatgatcgtaagttcagaatcaaaaattgcaccatgctcagaatttcgcaagcagttaattttcatcaatgatgcactgtatgaagttgatcagtggactgctcaagtaaagcaagtcaaagtggacaaaattgggaaagttggagaattcgcacccgaaattccgtcattcaaaccacacacatttcattatttggctttagtcaatctctccgacattttggaacaggtttacgatgccaattcgccaaaaatcagtgaaattacctatggccttcgatccacggacacaattgtcacaaaaacaatgtcaagccagtggaaagcagtcaagcaagagctgaaggatgcgattttcggcggatggatcagcacctaccaaacagttattgcaataatggttgcaattgtttttgcagacttcctg

SEQ ID NO: 84504 - DNA, 643 bp, Heterodera glycines
  misc_feature (81)..(81): n is a, c, g, or t
  misc_feature (91)..(91): n is a, c, g, or t
  Genomic contig location: Contig_ID=SeqID_19768; Location=29..671; Strand=+
  SCN-specific regions: Sequence locations=1-301,331-385,407-608,630-643
atgggcgccattatctatgcattgcgcgaattcaggccatttatcttcatgtcagatattgaactgcacactgaccacaanccgctcgctnttctgctcaagaaagcggacaacagcccacatttggcgcgctggctgattgagttacaaaattatcaaatcaaaatcgtgcacatcgccgggagccaaaattcactagccgatgctctttctcgtgcagctgaagataagcctctgtctgaatttcgcaaattgcaggaattggatgacattgtcgaatttccggtatgtttagccatctcgcaatacgaccgagtggttttggacccttttgtcaacacggtgacgatacgacacaaggatggtaactcttatgaggtaaatttggaaaaagaactcaagaatgatcccgaggccacggcttatattgattttctgaaaattggcaaatttcctgactgtttagatgagaaagaaaaggacgagtttgccgtggccactgttaattttcaattggactctggcatcctttatttcaaagaatcgggatgccaaccacgaatttatgtcccaatttcgttgagaggcctaatttttgaatcatttcactcttcccttcttggtggtggtcatttgaattacc

SEQ ID NO: 84505 - DNA, 209 bp, Heterodera glycines
  Genomic contig location: Contig_ID=SeqID_19770; Location=215..423; Strand=+
  SCN-specific regions: Sequence locations=1-209
atggccacgctgcgctcgcccttcttcggcgagaagagcaacatcacgtcgctgacgcagaagatcagcgacgcggagtacccgccggtgcccgacgacagctacagtcagccggtgaccgcgctcatacagtactgcctgcgcccgaaagcggaggagcggcccagcgcggcgcaagtgcaccgtatggcgctgctgatggcacagcg

SEQ ID NO: 84506 - DNA, 516 bp, Heterodera glycines
  Genomic contig location: Contig_ID=SeqID_19772; Location=4..519; Strand=-
  SCN-specific regions: Sequence locations=1-80,177-292,400-469,493-516
atggtaaaacaactcagaaaaatttggccatattttgcaacatttttattttcttaacacgcaatgtttctttttaaagcaaaaaaaaaaaaaaattatttttgcaaaattataagaattttacgctttaaaatttctaaaattaattgtaagcaaattttttttaataataatttgaaaacaacaatttttacaggcgattattagcgaggtgaaaagcgtaatgccttttgtaattggaatggtcatcggcgcttgtcttctcttcattcttttaaaagttaatggtggaaaaaagaaaagaggagaaatggaagagaataaggaagaggagggaagagaagaagaattagcggaggaaaataatggagaagaagagggaggaggaggaatggaagacaatgaaccatggacgttttttacgcataattataaaatagactatttactagaatttaatcttatcatctataaaataaaattataaataatgaagcattctcttaaaaaaataaa

SEQ ID NO: 84507 - DNA, 78 bp, Heterodera glycines
  Genomic contig location: Contig_ID=SeqID_19772; Location=2159..2236; Strand=-
  SCN-specific regions: Sequence locations=1-78
cttctgctgcctctgtgttactgcttgtgtcacctgtcgaacaagtacttgccgatgaggaacatgatttcattggac

SEQ ID NO: 84508 - DNA, 144 bp, Heterodera glycines
  Genomic contig location: Contig_ID=SeqID_19773; Location=62..205; Strand=-
  SCN-specific regions: Sequence locations=1-144
gaagccttcattttggaagcatgtcgaactccaattggctctttccgttctcaattggcttcggtgtcagcgccggcattggcctccgaatgcattaaagaattgttgaagagaactaaagtgccggcaaaggaagttcaagag

SEQ ID NO: 84509 - DNA, 119 bp, Heterodera glycines
  Genomic contig location: Contig_ID=SeqID_19773; Location=799..917; Strand=-
  SCN-specific regions: Sequence locations=1-14,37-119
gaagaaaaatggcaatgagaaggcgaagggaaagcaatcggcggagaaacactcatttcgaggcaattgtctagaaatgatgtgccgccggaataataaaaaaagaaaaaatcctttct

SEQ ID NO: 84510 - DNA, 1477 bp, Heterodera glycines
  Genomic contig location: Contig_ID=SeqID_3392; Location=6..1482; Strand=-
  SCN-specific regions: Sequence locations=1-85,107-309,331-391,422 -466,572-695,732-733,776-1067,1118-1119,1298-1303,1342-1477
  Gene Ontology: Mol. function=AMP binding; Cellular component =cytoplasm; Biological process=lipid biosynthesis
atgtgctatgtgtacatgaccaccaaatgctcgtttgatgcacatgctgaccatgatgtttattggtgtaccgctgattgtggtcaattttttaaaattttaattagaattggtcgatgaacctggaattttcgaccggaatcccggttttgaaaaaatttgaaacaattactagaaaaaattttgcgggaaagaattaaaatcattctcacaaatcacaggctggatcacgggtcactcatatgtggtctatggaccgttgctgaacgggctgacatcggtgatctttgaaggggtgcccagctatccagacacatcccgaatgtgggccattgtcgagaaatataaggtggaaaatcaattaaatattgatttattaggcctggttttgaattttttaaataaatatatacattatatacctttgctaaaaaaccttcaaaaaaaaatgctaaaacaccaaaagaattataacaatttatttttatgctatatttttttttgacaatttttataaataacaattttttaaaaaatttagtaaaacaagtctaaataaaaattaaattttcgtgatatcgtctagaatttgaaaattttttctgagaaattttttaagtttttcatgcttcactcataaaaatgtttatctacaaaaataaaatgtgtaaaaatataaaaatctaacataatccatattattttttgaaaattatttaaaaagattttaacatttttattttcctttattttttttttgtttttttaattttttccatacagatcaccaagctgtacactgcgccaaccgctgtgcgtgcgctgatggcattttcagacgaaatggtcacaaaacatgaccgttcatcgcttcaagtgatcggctcggttggcgaggtggtaacttttttaattgaattattacaaaattaatttttgcttttttttaatttcagccaataaatccttcagcttggaaatggttgtacaccgtagtgggagaagaacggtgtgccattgtggacacttattggcaaacggagactgtaatattttgtgttactctgtatttaatacatttctaatttattttaatttataataatatttaaaaaatcattgattcgtatttattttttaattatttttctttattattattttttatataatttttctttattattttaaaattaaataataattttttatccttttatttaaaaaaaaattattttttcttttctttatttattattaatttttaattattgcttcactttaatttttccctttaatcaagatattttcaattaaaatcatttttaatttttaatttaagggtggtcatgtgctgacgccaatgcctggggcaacgccaacaaaaccgggcgctgccacgctgccattctttggcattgtgccacgcattttggatgccgaaggacggcatttggaggtgggcatttacttttaa

SEQ ID NO: 84511 - DNA, 1759 bp, Heterodera glycines
  Genomic contig location: Contig_ID=SeqID_3393; Location=1..1759; Strand=-
  SCN-specific regions: Sequence locations=1-798,847-1297,1324 -1411,1479-1485,1508-1560,1583-1759
  Gene Ontology: Mol. function=acetate-CoA ligase activity; Cellular component=cytoplasm; Biological process=acetyl-CoA biosynthesis
ctgttagccggtgcccatgttaatggcatggcaacatatgtggtgattaatagaacccggaatttttgaaaaaaagcgaactaggatctggacctgggggccgggggtttccaagatggacccagacaggagtccggacctggtccagtcaggatcttgggaaaatcctgcacaggatctctcatgctcctgtcctgccggtctctaatggattaacagactttttccactagtcttggcatttcgaggatagaatttctaaaggtttttctttgatcactgttttacaaattcatctccaactcctgttgatcagtgctcggccaaaatcccttgttgaatttcaacaaaaaatccgttgccaaaaccctcgacttttatcatgccaaaattgaatgttttgccaattttgtcaggacatgtatcgccattctttggacgacccgaaaaagttttggcattctgttgctgaacagcttcactttgaagtgttttcgaacaacgggctggaatggaattttgatcatcgtaaaggcgaagtttttgtgcacttcatggtcggttctcggacaaacattgcgtacaattgcttggtgagaaattattatttttttgcatgattgacttggtaaggcctcgaaagtctctctttactcaagaatggcacaaattgtgccattacacagcgaaccaccgagaggagggtatgggcgacaaatcgggcgtcaaaaatgctgacgtatacctaatgcctgattgtgagactgatttgtatggatctgattgatttctacttagaaaattttcaaaaaattttttttagaattttttataagaaaatttaaagaaaaaagtagtatttcatcataaaccttgaaaaatcgttggaaaatttttttcgaaaattttgttttcttgaattttaaaatttatgtttgaatttttctttttgttagggagagggacgggaaacggtgggggaatggatgtagtacacccatttggtcaatgatcattatttatacccccccaaaaatttaattcaggaacgtaacattaaagccgggattggtgatcgggtggcctaccgctgggagggaaacgaaccaggcgacgagcggacaatcacttaccaacaactgcttgatcaggtggtgttttcaatggcaaaaaatgatgattgagcctattgtagataatgggaaataattttctcagaattatgccatgttacctggcttaaaaagggttgatggcttttcgtacaatgggcagttagtttgtacaatggagtttcgtacatttttaattttcaattaaaacctagaatttctttctcaaaaagaattaaaattatttttttgtttttctaggaaacacgaaaaatttctgctaattttttcgttatttcaaattaaaaaaaattagaatttttaaaatttttttagaaaaaataaatcattctaattttttttatagaaaagattaaaaggttttaaaagtttaataggtccgctttcatttttttatagttgccactttttaagaatttttggtcttaaatttcaaaaattttaatgaatttcttttaaaatccaaatttttttggctccggatgcttctttcacgggtctttattttgctgcacaggtggtcacgttcgctgccgtattgcgcgcccgaggcgttcgcgctggtgacgtagtgtccatctatttgcccatggttatcgaattgccggtggcaatgttggcctgcg

SEQ ID NO: 84512 - DNA, 290 bp, Heterodera glycines
  Genomic contig location: Contig_ID=SeqID_3394; Location=953..1242; Strand=+
  SCN-specific regions: Sequence locations=1-55,77-160,185-290
atgtcgaaagtgtgtgctgacgagaaaagtgtgggtattgagcgatttttgaatgaacatacagcagagagagcaacagcagcaggtgttgtgagattataatcataattatgatttattgatatggcctagagctatttaaacagaaccataatttcgaaatgaaaaatttcagatttttagaatggatttttccaaatgtagactaggttccgataaaattaagtatctttatagcgctaaaaaaattagataataatattctgctcattattagtttggtcggtgta

SEQ ID NO: 84513 - DNA, 1710 bp, Heterodera glycines
  Genomic contig location: Contig_ID=SeqID_3396; Location=522..2231; Strand=+
  SCN-specific regions: Sequence locations=1-353,376-858,880-1078,1100 -1337,1361-1425,1447-1520,1542-1628,1650-1710
atggctgaagtgtgcgtaaggcattaagacggacgtcaatttaattaatccctccaaaaacaaggaaaaccactaatccctttagggagttcaaaaaatattaaaaaaaaccgggtacttgtacagtttggatcacatacatagaagatttttaatgctaaaaatgtgtttttaggggtattcggggtcgctgatcacgaatataacattaatttcgaccaatttcgaacccgtgacttgaattcgaaccaaagtcgaaaaaaatcaccaaaatccgccattattatccaaaatcgattcaaatcaaattttattcctttaattcgaatatttttcatttttcagatactttagtactatttccaattgataactctcctctacaaattacacacaacaaatatggttgttgacatttcaaagatggagcctttttcaccaccagtatgctttttttttataaaagaaactgaaaacaagatacctaaatgaactttattttgcccgacatcgttcgggtgtactttttcgaaatccctgtccttgacatttgcgccttagaacttgattttgaacataggagcaatgtccaaggcgcaaaccagggatggggcgcggacagtaaaataccgcagtcgcggattcaagttgccgcggtcgcggatctcgtcaaaaaaatcccgcgtcaaattgccgtgttcgcgtcccaccccaggcgcaaatgtcggagaacataaaaatcaaaaaatttcattcttttgaatccattttctggttagaaaaattttggtttcgtattcattccggtctctaatggtttaaatataattgcccgaaaatttgggttgtctgtgtacaaaattattttataatcattgtccatttttaggtgagtcacgcgttgttcccccatttgaccactgttttgctttccatcgggctcatcttcaccgcgtggttttttgtgcatggggtaagaaaaaaatggatacattttgaagctatgcaattttttcaaatttcgctgaaattaaaaaaaaaccagatacctgtcggaacggccggaccctgattttctaaggttttcaaaaagccaaaacccatacatttggctatatttaatctcgaaaaaaacttcggaccgaaaaacaaaacaggaaaaaatccatggttttttagagtgggtattaaattgtcgacccctcaaccccaaaacttacgataaaatcgaacaaaacggaaattttctaaaatcactaatatgctttattctacacaaaaaattcactgcatattaatgcaaataaagagtgtcacaataaatttcaactttttttgaaaaatttttgtggggtgggggcgaactgctctcgttcaaattccattcctttttgcaggtgaccagtacgaagaaaacgcgaaaccttgtcaaggagttgttcatcggcacattggcgtccctttttcttggcttcggcaccctttttctgatgctttgggtcggcatttatgtttagagttgaaaggaggaagaacacagggatttttgtcttatttttggggactttttttttctaatttatttgtattttttttattcctctgctaattgttattgagtgagtctgcccttttttgtttgtttcttcccaatttggaaactgttgaatgttgtgtaattgtttgtccctttaatatttttattttaaa

SEQ ID NO: 84514 - DNA, 2170 bp, Heterodera glycines
  misc_feature (589)..(589): n is a, c, g, or t
  Genomic contig location: Contig_ID=SeqID_3397; Location=430..2599; Strand=-
  SCN-specific regions: Sequence locations=1-40,67-236,265-388,410 -530,552-752,776-1098,1122-1207,1245-1373,1406-1590,1620-1897,1927 -1970,1992-2170
atggggccagtagccggaacaatcgtgtcaattttgccagtccaatttccacatctcttaaatcaaccacttcgagcaggtacaaaaaaaaattgttgtaacgaagccggagggggcgggggggctttagtgtggctgacaagaaaaaatttctggctcaagagcacttattatttaaaatttctaaggaaaacttatctgtactaacatcagaaaaattttcaaaaaattaagccaaaaattaactttttttttttaatttaagcaaagttttagaaaagtggagtacctatttagtgttttttttttttgttcaaatttcggttttattcattgattttgcctcatgtgaacaggcaaacagggacctcatcacccttaggtgcgcgtgcagatgccagcaaacagagggagcaggtgaacaacgaaatttttgttaataatcaattttgagttgaattgttttcttcggcagccaaaattttttttgtaaaacagtggttctaatggaggtctcttttccatactaatttttccaaaaaaccacaaaattatcatttttggcgcgggtttaaaaatatggccctanattcttcaatttttcaatgtggcgcctatctgcactgccaggcccttccttccccgatttttgattttgaaaaatacgctctgcaaaggttgcgtaaagagcaattttttctatcttttctctacttttccccagggtcagaagagtcgtgcctatgagatggcgtttcatgaacagcagcagcgtgccaagggccgaaatcccgcaaattcgtcctccattttccaatatgtgcatcaccccaatccgccgccgccgcgtaaatgatcattaacaaacctttggcatttcattttgtcgcgtatttctctcacaatctctatttacctgttggttcatctctcgtttttttcggactgacgtgtttttatggtgtaagaataatatgcaattttcttttttgtaaaaaaaatggctactctacaatacttcccctataatatgtgtcccccccctgagttttcgtaataggtttgcaaaaaaagacaaattttcatggagtgtgaaaaatttattgcaaaaaatattttttagaaactaacatattttaataatcgtgatttttgagctagtttttcaaaattttaaatgcttttttaatttctctatttttgaaacttattttaaaaataaataaaaagtacaaatttaaattccagctccaaccatattcctcaaatgtgcggacaacgtggaagtggaagtagagctcgatcgtaatatttttcgtttttctactacgcttgacacaatgatggaaggtaaatacatatttcttcgatgcaattatttaaaaaaaaaactaattttttatttcctagatcttggaatgtacactgctgaaggcacaaaccaggcttgtacctctggaaaaaatctgacaaatgagggaatttgaagagcattttttgctcttagattaaaagttcaaaaaaaattagattactactattattcatgtctaaatagaaattttataatgaattttgccataattttcgataaaataaaaatcttttttaataaatttcctataaatagagtgcttgacgattatttatagttttttagaaatttccggtttcaaatgtaagtagtacggtgatgcgagaagtgattgaatggtgcgagcatcacaaaaacggtttgtgcggagcacggggtcatggtaaacaagctcgaaaatcttttccgctcgaccgttcaaaattaacgagaccgcgacttttcgattgattggtcgaatatggctaacgggactaaatcgcccaattcaaaatttgtgtacacgctcttaaaaaatgccacaaaaattaatttttctttaaaattctattcctggctaattccatattagatgcctcaatagagccaatttatgaagaaattgctttggatgtgccaactggtaaagatgcggaggcatccgcaccaaatgctcaagctggagaagttgcggaggcagccgaatcaaatgccaaaccaaaagaattggctaataatgaaaagcgtctcgtctttccaagctgggatgagaattttttggataaggaatggcctgagcttgttgatataatttta

SEQ ID NO: 84515 - DNA, 1015 bp, Heterodera glycines
  Genomic contig location: Contig_ID=SeqID_19775; Location=114..1128; Strand=+
  SCN-specific regions: Sequence locations=1-41,64-92,114-180,203 -220,261-330,376-533,556-607,629-690,720-758,790-792,815-1015
atggaaattgaaaaagtgtcggaatttgcgagagaaatcgacagaagtgaacgtaaaagcgaatctcgtcacttacataaatgggcttccatggaaaataaattgaaaagaaaaatggaagcactgacaatgagaaatggttgggcttttaccttatgcgtgaacaagaaggtgcaaattaaatgctaattaatactaattgtaatgaatttccattaagataattattttttttaattttaatttattacaatatttaaggaactgatggatccaagcaaaggattttacaataaaagcgaggacaaagtgacattggccattgatgtcaattatttatttaaaaaataattgaataatataaagttaaataatcattttgtcagtttgcaagcaattttaggctggtttgaagcatcgtacaaacgtccttcttggaccgtaatcgaggaggctgcggacgcagaaactcaggctaacggagtgcaattgtcatttggtaagtattttacacatcctataaaattctaaaatttttattgtttgtaatcttttatgtcccacaaaaaatactgtatacgcttagtgaatttgcgcatttttttggtttttgaaaataaaaattctaataaatcctaatacatgtgagttaaataaaactttcgaaaatataagcaatgaataaacctcaaaattaatcaaatttatttaatattaatcgatgtttgttctatttttaatggtgaatgttgaaaaatctgcttaaagaaaaatccaaaagtttttgccttagttcaaaccccttaattgaaaatcatttcttaaatttgttattatgatttatagtgaaattggttaaattttcactcttttgtattgaattaaatatttttaaactcctacagacaaactcgctcaccggaacatcgaagactcatacacggtgaaacaacgcgaagcgatcgcattcgatttggtaggggagaggaattcgtatcgagatgctaacaaataa

SEQ ID NO: 84516 - DNA, 107 bp, Heterodera glycines
  Genomic contig location: Contig_ID=SeqID_19775; Location=1262..1368; Strand=-
  SCN-specific regions: Sequence locations=1-107
aattagagtttttctttcttcaatctccttaattgtttatgatttgtcctccgtttttgcttctttcactgtaacatcgatggccaaagtcactttgcctcgctttt

SEQ ID NO: 84517 - DNA, 555 bp, Heterodera glycines
  Genomic contig location: Contig_ID=SeqID_19776; Location=4..558; Strand=+
  SCN-specific regions: Sequence locations=1-289,313-555
gttcgtcaggcgggaggccgcgacatcggcggagtggcggcgccgggtgccgccgctcgtcccgggcaaattctgtggcttttgggactgactcgtctccaaactcaggtgggcactttgtccgtcacttcgtttcgttttgtccccctcactttgaatttcgttacttttgtcaatgtttcgtccgttggtcccttcacattatctttttgttttccatttgacgcttttcttttttaaatttttggcattctattatactttttttgggttagttcactaaatgccattctcttctcttccttttctttcgtccaactctctgtccgtcgtgccgtagtgctgcctctcttccgtctctgtctgtctctcatttgccaatgatccctctcccgctccgtttctctgctgatgtcctattttctcttcagatgagagttgtgaaggctttccaagccactgtgcagaattcccacccgtcttcgctgtctcttcaggcgggtgaccgtctccgccagtcttaccggcgacttcgaattgcgaaagaaattgagc

SEQ ID NO: 84518 - DNA, 1384 bp, Heterodera glycines
  Genomic contig location: Contig_ID=SeqID_19780; Location=42..1425; Strand=-
  SCN-specific regions: Sequence locations=1-427,449-598,621-869,891 -1065,1087-1384
atgaaatatgcattctattattctattatattttccgcctttgccaatttgcatgtaaaagctttcccgccaaaagataaagaaggtaaatctgtaaatatattgaactttctctaagttcctgttgtattcctaaaatacgaaattccgctggctatgccccttagccaattccatgaaatgcttatatatattcctcctcttaataaatttcaaatttaaggcaccagtaatggaaaaattgtcaattctttggcagatcaaatggagaaagtgttgaagaaaggagaatattcggatgttcattttttggttgggaaggatgacaaaaaggaggcgagtcaaaaaaagcaaaaaccatagcttaatgcccaaggataaacaattacatttttagaacatatttttatggaaatcttgtaaattctcgaaaaattttctgcaaaatctataagcaaatgcatataaattttgaatatagtttaatgatcaacaaaatttcaatgttgataagaccaataaatatgcctcggtagctcaatggtcggatgcccacggattgggctttagggtgggttcgattcccacccgagtcctaacatattatcattatttatttgtaggaaaaattactaaattctcaagacttttacgtcagtattttaaattgaattttttgatcttttttaagattgtaacagctcatagagcgattctctccagtgcttccgatgttttcaaagcaatgttccgttacaatgaaggtcaaattgtgatccccgacattgaaattggcgcgttcaaaacgatgctaacatttatttacacgaaacattttaacggattggatgccaataatttgttggaagttttaaaagctggtgaaaatttatgattgggttttaaataaattactatttaattatagctgacaaatataacatcagtggcctggtaaaagaatgtgccaacttttgtgccaaagtttcaattaaaaagttgccaaatgtttttgtggcttttgaacaggctttgttgctgaatatggaggtgaggaaagaattttaattattaaactcattattcatgtatctaaaattattcttcattactgacaaaaaattcacgggtgttcgttttttcaaaaattcaagacaattttcataaattttttgtccagttattttatttttatagagttgtacgcgaccgggacctgatactgaaagaacgtacaactgagtacctacgtcccggttttgaccgggaccgggaaaagtctcgggtttttccctgttttgccagccaaaaattcccggtttttcaacccggaaagtacctggtcccgtttttctatggtacgatccccgacgagttaaagtaa

SEQ ID NO: 84519 - DNA, 498 bp, Heterodera glycines
  Genomic contig location: Contig_ID=SeqID_19781; Location=72..569; Strand=-
  SCN-specific regions: Sequence locations=1-81,140-498
atgtcttttaaacgcgtgaactccttccaacccgccgtgccaatggccaaaaaatgggatttccgatcaatcgggtaagtgatttttaataaattaaataaaaaaataatttcttaaacaattataaatacaattataagataataccctttaagaattatttcaaaaaatttttttgttcagaaataattttgctgaagaaatggaaaattataaattgatggattaccaatcgacaacttgcgaaaaatttggatttacgaaaaatattacggaatttcgtgtcaacccggatgtggagcgccccgatgaagcgatgaaggatgcaatcgacaacatgataaaggtggctttaaaaactacggaagaaaaaatgaagcgaaaagtgcggatgtttggagtggcaattacgggtgctgggcttgcttccccggtttgggtgccgtatcgggcgtacccgcagaacaatgcggatgttatcatgcaggagattaataa

SEQ ID NO: 84520 - DNA, 585 bp, Heterodera glycines
  Genomic contig location: Contig_ID=SeqID_19781; Location=2273..2857; Strand=-
  SCN-specific regions: Sequence locations=1-10,32-455,483-491,518 -544,571-585
aagaaggccatgcaaatgctgaaaagggagttggacattaacatagatgatataaaattaaagagtcgtcaatctcctggaagttatgacatgttttttgaacaatggtatacaatggaacaatatgaaattaaagaaggcgcagttatttacgtttgttatgaatatcattacaagacattagttgagtttgacattttcattgaatataaccagaaaaagtacccagttcgtgtaaaacgtgcggacactgtgcgcgatttgaagacgaaaatcggaaatatccaagagattggcattttgcccaaccaacaacaaaaacttatatgccaaaaagcagatggtaaagtactcgtggactttgaaaaaatcgttgcttataacatcgaaaaaaattcaaccattttcttgacacttgctgaaattgagcggcagatggagaagcattctttatccaacaagcagcaggaggaggagaagcattctttatccaacaagcagcaggaggaggagaagccttcatccagcaattttgcatcaccacagctgaagaagagaaaaggaagaaactacagacaaaagtga

SEQ ID NO: 84521 - DNA, 927 bp, Heterodera glycines
  Genomic contig location: Contig_ID=SeqID_19783; Location=91..1017; Strand=+
  SCN-specific regions: Sequence locations=1-30,96-450,475-488,510 -577,611-612,634-644,681-697,810-927
atgaccctttcggagaaaggtgaaacgatgaaaattatgaaatttttaataaattttcttaacaaaattctttaaaaataccaaaaaaaaaaattccgggcgcctatcggcgccgccggcccataaattcgcctaagatttcaaaatttgaatataaaatgcctatttttcagtgaaatccgaagaaaatattcataaaattacgtttttttctaatgcggcgcctattgcagcaaggggtgaactccgtctagccaattccatctcagcaaagttaaaatctatcttttttcttggtaaaatcagcaaaatcgtatcattcaacttaaatttttcaataaaaaatggcctttttgtcttaaatttctcacaaaaaaatccaatttttttaccgctgcgtctgtcggcgctgtaggtgaaaattttgcttttgaaagtgcgagttgattgttttatttttttaatttttaaattcattgtaacataagaatttaatgcctttttaaatgagtatttttcaagaaaaaaatatttcttaaacttttattacataactattttgctagaaaaggtattgaattattaaaatatttgaatttttattaattaaccatgaatatattcatgtcccttgttaataagtcttttgtatttctttattttatttaaatgatagaaaattcttctatcgttttagataatatatttaaatattttttttaatataatcaaatatatttgaatttatgtatttataattcaaaaaatctagagagaaaaaataatgaatatttaaaaaaataatttatgacacagtttatttactgttatatggaaccaaataaaatttcttagacaccaggaacgatttccatgtcataacggtcagcgcaacattttgatatgaatattggtaatttataggga

SEQ ID NO: 84522 - DNA, 73 bp, Heterodera glycines
  Genomic contig location: Contig_ID=SeqID_19785; Location=1651..1723; Strand=+
  SCN-specific regions: Sequence locations=1-73
atgactcccgatgagtgccgttcaattgcgagcgaaggcgaacgatcccttagagaaggcgacgctgttaacg

SEQ ID NO: 84523 - DNA, 486 bp, Heterodera glycines
  Genomic contig location: Contig_ID=SeqID_19786; Location=323..808; Strand=+
  SCN-specific regions: Sequence locations=1-371,401-486
atgcctatttttacttgggagaatatgaactttcgattggacaccacgaaaaggtgagacaacagttttacccttatcaaaatatttccattaacaaataagcgaattgaacttgcaaagaaacttggggaccaggcatcggttcgccgttcttacagcaacattggcaatgcctatgcattgatgggggattacgaaaacgcagaaaactcctacaggtcttcatgactgtgggtgaagcaaaattgtaatttgcaggcttgccttagcattggctcgtgagatgaatatcccggaattggtcgaccaattggacgcggatttggagaacctcagccatatcatggcgaagaacaaaagtgaatttcattagtatcatttggaattgttttgtaaatgttaggaatgggcgacccttccgcaaaacaatctgccgatataacgttcacaagcggcggaattaattcgtcgtttggaacggaatca

SEQ ID NO: 84524 - DNA, 625 bp, Heterodera glycines
  Genomic contig location: Contig_ID=SeqID_19787; Location=51..675; Strand=+
  SCN-specific regions: Sequence locations=1-224,259-282,304-625
aacgaagtgccaatggaaatgccgacggcgatgagaacgttgcgcgaagtgcgcgagtcaaagggccaccaactgcacacatttgcccagcagctcgtccagctgacacagcacgtgcacgtggcacgcaaggagtacgacatggcacaactgagcactgaaacgaagccgttacgcgaaattcgacgcgatgcggtgggtgactaattagacgaaattgtttcatatatattatttaattttaaatttaataattttccaaaatgatgttatgacaacccctataaaattttttatatttttcgtgtcatgactctccaatttgctcacaggtgtgcaaacagttgcgcgagttcctcagcgagaacgagtggtgcgccgtgttgatggagaaccgtgctgcgttgggcgagcgcgtgcacaccgattggcatgacagcgtgcatggtgggcgcatgagtgatttgttgcaaaggcctgcactgcgtgtgcagcacgctgcagtgctttctgctgcctggggcaccaccagtggcacatattataggcgggcacgcaccggaagcacagtcacaaccaccacaaccactgccatacgcttacccgttaccatccagcacatact

SEQ ID NO: 84525 - DNA, 1248 bp, Heterodera glycines
  Genomic contig location: Contig_ID=SeqID_19788; Location=131..1378; Strand=+
  SCN-specific regions: Sequence locations=1-234,256-515,537-635,657 -964,986-1248
atggacacagttgtgcacgaacgacattcagcggaagagagcgtgcattacaccaccggacaaccagtcatggaacaacggacgctgcaagtcgacatagaccgacggacgagccgagcgaagacgcaagtgcaagatgttgcagaaacagcacgcgcaacaaggagattttctgttgaaaatacgaaacagaacgtgtcgctgtctccgctgcaggtgaacaataaagaatggccaaagaggcgggaagaaaaagcatgcgtgacgataaaaaacggaaaagggacacgcccagatgctgctgcggtgtgccaatatttgatggtacccgaaaaatcagagcgcgccatgagttctcgagctgcactcgcctcgagtgggtcgagttacgtgaaaaggttaagcacggcgtcagaggatgaagcagttgggacgacgagcgcaccggcaccacgcgtaattggcattgaaacacgcattgagcaacagccaacgccgtacatacggcgcgagaaaacggtgctgaggacagagtcatggccaaagttggacagccgagccaaagtggaggaatggctaagggggacagaagagggaatgccggaagaaatgggagaggaacaattcggagaagaacaggatcaactgcagaatcatctaacagtgacaaaggcagaattggctcggccggaagaggcgctcggagtcagcgttgagaagccggaaagaagggaagcgaaggaagagcgccggatgagattggagcggcaagaaatggccttccagctggttcagcagctgttgagtgcaggacgaagtgaagcatcgctttcggaaaagcaacgggcaatggtttccgagcagttcaagcagttcggcctggaggagatgagcaccagcattgtgctggagcagctcgaagaagtggcgggcagacccgaggcaaaagtggcgctcaaagcgtggaagagcctggaagaaggactgagagtgctggctgttatggaagaacgggtcgggtttgaagcaacctggacgaccggagagacggagtcgggtgctgagaagacagtgcagttggcacgtgttgaagctgctcagaagcgagttgaagaagcgcaggagcagctaaggaccttccttacagtgttggtcgggccggaacagttcgaagaagccaaactgctccagaaaattccatggcacacgtcagccgaataccgaggcccggaatcgcgcgaagaatga

SEQ ID NO: 84526 - DNA, 706 bp, Heterodera glycines
  Genomic contig location: Contig_ID=SeqID_3398; Location=95..800; Strand=-
  SCN-specific regions: Sequence locations=1-163,187-310,333-566,589-706
atggacggcttcgaacagaaccaggtaatgatcatgatcagtacaacaaaccgagctgataatcttgataaaaaactgctttttgcataaaatgggggcggtattgtagcgttgacgtgaatatttttggaattttaatgccctttgttaagaattgctttaaattttctaaaaatttcccattttaagtttttttttttcatttcatgggtgggcatgggaatggctatgcttctactgttaacatactaatcacagcaaacgcctttgccgaatttagcttgtacccaaaattttggatctttccaaaggaacattttttaaattttgcttcctcctttttaggtcgccgtatcccaagtaccgccgcagggcgacgagcctcagccgtcgctgacaacaatgggcactgaacaaagtgcaatgggtctatacaagcgaggacttgagatggtgcaacaaggggaagtgcggtttcgtaagagcaggttggtccgactaaaaccttagatttgatggcatattaagccgggcaaattggactatgttcacttaattttgataatttttgattattgttttcaaaattttccaagcgtttagggcggaatcatgcgaatgtgaatctgaacaagactttgctgccaaactttacggggttcgtctcgcccttcgtcaaataatggacgaaccgcaaatgattcag

SEQ ID NO: 84527 - DNA, 1868 bp, Heterodera glycines
  Genomic contig location: Contig_ID=SeqID_3400; Location=645..2512; Strand=+
  SCN-specific regions: Sequence locations=1-1260,1297-1320,1343-1868
  Gene Ontology: Mol. function=RNA binding; Cellular component=Golgi stack; Biological process=RNA splicing
atggtcgagaggcgcaaggaatcgcctaagcgtcgccgccgttcgtcaagttcttcgagttctggaagctcttccagtactggttctagctcatcaggttcatcttcgtcctcttccaccactgcttctcgttcaccttccccaaagaaacaaagagcagctgctcgtccttctgctcgtgacgatcgtactacacgtcgttctccaagaaggttaacctgttagggactctaattggctaagctaaccaatgtttctgctccctccatttcgatgtatacacttattcgcaaatcttttattttaggacggggggacggttaacccactcgtattcttttcgtttaataggtcgcgttctccccatcgtgtccaaccgaaaacagagaaaagcactgtcagctctcgccgttcaccgtctccccgtcgtcgtcgtccgtcgcctcccagccgcggcccgcgtcgccgttcgcgctcgcctcgtcatgaacgcgcggctccatcaccaccaccagtgaaaagggaacgtactccggaaccaccgccacgccgactttgtgttcggtaatttttgttgtaatttattgaaatacaaatgaattgttcagaaatctaagcagaaatatcacaaaagcgcacatggaggaaatcttcgctctgtttggggctctaaagtcctgtgagttgccaatggaccgtgtgcatgtgcatttgccccggggatacggctatgtggagtatgaaaaggcggaggatgcggagaaggctctgaaacatatggacggaggtcaaattgacggactggaaattcagtgcgaaatgacttttcctttcaaagggaccggcggaggttagagcacatggggagtgttttcttcggtttacttattgcttcgtttaggtcgtggtcattcgcccgtcgggattaattctatgggcattgggatcaagcgcgagcggagccgttcccctgcgcgtcgttttgccgctcgtttgtcgcctccgcgtcgcggccgtcgctcgcgctcgccgcctccgatgcgcgcgtctggcgcaaatcaaattcctttggggaacaacggccgttttagaagtcgatctcctcgtcgttgatgactgatgaccatcttttgcaatgaagcgatttcgaataatacccacgtaaaattgtttgatcaaatgaaaacgaaaagtgttctcgcccctcgttattttgttctcgttttcgaaatcgatcaatatatatggtcattctgtcccaatttatttaaaaaaattaatgtttttacattaattggctagcttttgttagaaatgcacttcagaaatatttaccagattgtttggttttattgcatcttgtttagaattttattgttataaacgatttgcagatgtcaatttttcgtagctttttctctgctacagacgatgctcaatcggacgatgcaactaatgcagaaatagtcgatcgccttgtcgaacgattggaaaccgggagcagtatcgaagacaggagggatgcgctcaaagcacttaggtcgttggcgcgggtaaggcgcctgttccaccatttttcttaaggttacaacctttgattgcagaatcttcgtcttcatgtcgcgactcgtggcatgagcgcttacatggacattcttgaaaaggaggccaacctgcaagatttggttgccctcacattagacattttggacatagtgctcaacgacagtgccaacggtggtgagcaagacgcaacgacagtggctgagaacgaggacgaagtgggcgatcgccttgctgaagtgtttctgcaaaagcccacatttatggtctcgctgatcaaactgcttgagtgttatgacttcgcc

SEQ ID NO: 84528 - DNA, 70 bp, Heterodera glycines
  Genomic contig location: Contig_ID=SeqID_3401; Location=281..350; Strand=-
  SCN-specific regions: Sequence locations=1-48
atgctctttttgctgctcattgtccgtcttttgttgcttctgcgcaactttcaactctttcagttccctg

SEQ ID NO: 84529 - DNA, 1200 bp, Heterodera glycines
  Genomic contig location: Contig_ID=SeqID_3401; Location=5..1204; Strand=+
  SCN-specific regions: Sequence locations=1-112,134-276,299-457,481 -722,745-1056,1081-1200
aattttacatacgagcggcccaacgcccttcagccgttggcaaaaggcccttccgatttgttgttggattatcaattcaccaaattcttcaaattaatggagggtttgttttctgttcattttttctcactttgaactgcatctttaagggcatttgcttaagtttttccgtccaaacggtgaactttcttcttctgtaaatacacagcttgaaggtgcgcttgtgccttacaaaaagttgatcaaaaaacaggacgaaaccattgccgagcttaccagggaactgaaagagttgaaagttgcgcagaagcaacaaaagacggacaatgagcagcaaaaagagcataccaactgcaatggagtgggtttttctttatactagtactagtacacctcattatttagtttctcaaggttattccaactgaagagtttgcttcaacgactgtccaagcggatgcctcagcaaatggcgagcaattggcactgctgagggcggaattggcagagaaaaatgcactgaacgaacggagggcagacgcagagacgaaactgcagcagctgacagtgtccggaggcggatttcccatgaaatatcgaccaatttcaattttagccttgcacaacaatggcaaatcgaagctgatcgatacaagggatgggctttgcaatggcagtcctaccaaatatcgcaggttttcgtcaattaccgaaaaaaaactatttattttttaactcacaataagttgcctaacccaactgatacggtaatccaacaattggagcagcaaaaaacagagcttgaactacaaatccaatatggatggcaggcctttgaagcgcaaagtgctcaattaggcgaattagtacgaatttcggaagcaaatgcgaacaaactgaaccaggtggagcgtgaattgtccgaagttagcagtgagcgagaaactttgcggcagcaattagaggtcttacatttactctcccagaagtgcatcgaatcaatcgacaaatgtttagagccagcaaaatgtcccgcagggatcagccgttgccacacacagcgaggagttgacactgctgaagcgtgaacacgaggacttgttgctactgttggcagagcaggacaggaaaatacatgactaccgtcggcggttggcctcccatggagaagcattaagtgacgcggacgaagagccatga

SEQ ID NO: 84530 - DNA, 443 bp, Heterodera glycines
  Genomic contig location: Contig_ID=SeqID_19791; Location=460..902; Strand=+
  SCN-specific regions: Sequence locations=1-443
atgggcaaaaatgaatcagcccaaagtagagacaaacactcactcactcattttccattcacttacggcgcggtggtaaggcgatttgcgacggacggacgacgaaatgtaaacgatgggaaaagcacagcaaaaaaaaaaattagggatgggatttttaaggatgaaaaagtccaaaataaggccgtaaataagggcgaaaaagtcaaatttagggtataatttttaaaattgctgttttttacatgaaataatttcagactaaggcaaacaattttattcactgattgcagtacaaataagctatattttagaaaatttttttcatttcttagggtctatttttgaaaaatttagtgtcgattcataggggtatatttttcgaaatttttttgggtcgattcttaggggtgtatttttcgttttttattgcatttttgtta

SEQ ID NO: 84531 - DNA, 544 bp, Heterodera glycines
  Genomic contig location: Contig_ID=SeqID_19791; Location=1183..1726; Strand=-
  SCN-specific regions: Sequence locations=1-99,124-226,250-378,400-544
atgtcttctttgtccaccatttttgttgttctgctggtaattgccatttgcctttcattaacaattgccatgccagcagtggacaatcaaattgaaaggtataaatttttattttttatttttggcattccatttttctttctaatggctgtgccagaccaattacggcactttttgacgccgtaatttcacattccgccaatttttaggaaaatttcggcaaaaattggaagttttatttcttaaaaattgaatgcttcaaaagtgcaaaaaaaaacaacctaattttataatttgaagatttttcaaaaagttttttgttccttttttaaattaaattttaagtgttccacttcggaaaaagcgttatggctacggcggcggtggatttggcggcggatttggcggtggaatgggctttgatggctgatttggacgctgagccgtgaagaacattaatacgcattgtgaatgatcagaaatcgatcaatataaatgatgtgcgacagaactcttttaaagactttcaagtttataaaataaa

SEQ ID NO: 84532 - DNA, 901 bp, Heterodera glycines
  Genomic contig location: Contig_ID=SeqID_19792; Location=1595..2495; Strand=-
  SCN-specific regions: Sequence locations=1-720,742-901
atgctcgatccatcaatgccaattttaatcccgaataaagcatttggggtaaggaaaggatgaaaaatggttgtgagtgtctccgttgtttgaacttttgggaatgataacattctattgttttagaaacgagtctttgattttcatattaagctttcattcaacgatgtccaacagcgtgaacagcacgaacaattcctcgtgtcggtggctatccgtacgctcacccgtccgtttggtcaagcgatgctgcatttccgtacccgtcattgtttctcggaagaaaattcggaccctgcgatgggcatgcgacagatttgtctgaatggccgagttcactccggccgtaaccaagtggactatccgctcaacgattcatttcccgtttgctgctcttcgggtttcaccaaaattcaaataatttagacccataaaattgctatggattgggctaatttttacaacgctttggcccatggcctttccttttgcggcgactttccacggcgtcttttctccaataattcatctgaaaatgaattacccaacactgttcgggccggccttattttagccgctggctttgtgggcaacgtgcgaagcatgatgaatttgtacgacattcacctgctgcttactcaaaacaatagacatttggtcatcgcattgctcgtcggatgtgcggcagcccatcgagggacgagcgaagtgcacgtaatgaatttgggggagggtggagagaaaggcggtacatcaaaatgtacaaggggtcttgagagggtgcactccattgttatgcccatttacgggggggggggcatggaagggggcttgacttatgttacggcgtgctgacgcattttataaattccgccaaatggtaagaaaatcaaaaaataaa

SEQ ID NO: 84533 - DNA, 61 bp, Heterodera glycines; identical to SEQ ID NO: 61697
  Genomic contig location: Contig_ID=SeqID_19793; Location=595..655; Strand=-
  SCN-specific regions: Sequence locations=1-61

SEQ ID NO: 84534 - DNA, 729 bp, Heterodera glycines
  Genomic contig location: Contig_ID=SeqID_19797; Location=1864..2592; Strand=+
  SCN-specific regions: Sequence locations=1-140,162-653,675-729
atgagagaactacacttatattatttatttaatctcaacaggtattctgtctctaaaaaaattttcgagaaaatcaataatatccctcataatcccaagtaactatatttataaaataagactttttaggtgtacaaataatcaaaaaccatattttaatatttcgacattcctaattccaaaaatgctactcatttcaactgacatcttcatgagcctgtcgttagttgccgctttttctcattctgctccagtaactcaagggaaacgtaagttttcgaaactaattaataaaaatacttgaatttcattaatcaaattcttccacgaatggaagaacgaccacagagaatccaccaacttctgctggggctgtctcatcagtcgcacaagttgccaccgccgtattggcagtgactgccgccggactgccggatgccgactgtgcacgacgaccgattgggtatgccaaagaagcgtagactgaggtgacctatgttgcttctgccgttgatgccccgttgtctcaaccagaatcagcaccaactcaaagctttgcgacagatgattttaagacactggtcggtgccacttactgtgatcaaaagagccgtgtgttcacgcattatttatcatgaatatttaattgcgattaattccgatttttattttctgttttagttatttaaatttaacaattaattgtttttcctcaacccatgaacaaaa

SEQ ID NO: 84535 - DNA, 1313 bp, Heterodera glycines
  misc_feature (306)..(306): n is a, c, g, or t
  Genomic contig location: Contig_ID=SeqID_19799; Location=1199..2511; Strand=-
  SCN-specific regions: Sequence locations=1-190,212-1037,1059 -1157,1179-1313
gaatggacattgtttgttgagggtccaatggtacaaacaacgacgagtgcgccgaatggcggcggtgccttttccgcgagtggcggctcctccggcgtctcctcatcatcttcgacggcgacagcgcccgtggcccgaccgttggccaccgccgagctcaatgtacgcgtgctgatcggtccggcggactgtgtggcccaggtgcacctcgaactgcgtcccattcacgaaggagtgagtcagggacaggtggaattgctctaaattggcaaaaaaaaaccgggaaaaaaccatcatacattttgngacaggacaaaacacaaccaccgaaatacagtcgaaacataacatagccgggaataaattttcaaaaccagaaagtcttctagaaaaaaatcagaaaattctaagaaaaagacatttttcaaaaaattttaaagcgatttttcaaaatttaatgacgaattacaaagttttttataaaaatctctggaaaattttttacttcgatttttctaagatttttttcttgaaaaattctaagtgaaaaaaaaattaatttgttcccggctgtgttatgtcttggctgtgttttggtgtgtaccgccaacatttaacatcatttgtgtctgttttttttttggttttccacgggcctcttttcgtgagtcgaatggatggatgacttggtttttgaccctttttaggtgctcggctgttcccttgacttggtggtgtactgttttccctttgacaacgaatggtcagtcgatggcatccaattttagtttaattattagttttttaattcacttttttaagtgtttcacccttttcccaccatttgctcgcgagcactccgaattccgtccgtggtccccctccgtccgccgcagttgtcgaacaccaccacaacgccgaggatgcaaatgtgggcgatgacattcccatcgaactcgttccccccaacgacgacgacgaggagaacggcggtggtgatggcaccgatggctgctgcggcattgttgccgaaaatgttgcccaacaacaacaacaaattgttggtgatggcatttccatcgaactcgttccccccaacgacgacgaggagaacggcggcgaagtcagcgatggcactggcactgttgccgaaagtgttgcccaacaacaacaacaaattgttggtgatggcatttccatcgaactcgttccccccaacgacgacgaggagaacggtggtgaagtcagtgatggctgctgcggaactgttgccgaaagtgttgccgaacagcttaaacaccaccaagaaccgg

SEQ ID NO: 84536 - DNA, 333 bp, Heterodera glycines
  Genomic contig location: Contig_ID=SeqID_19801; Location=164..496; Strand=-
  SCN-specific regions: Sequence locations=1-37,59-69,92-333
atgcccgcacttttcacttccattttcaacatctttctgattcttttgctggtaagcaacaaatatcaaccaatctttgaatttaattctcccaatcttttcaggtgtttaagtttcaagaaacttttgtgggctttgcgggcgcaacgaaacagacggacaaagtacggaataaaaaacaatcggttgaagccaaattccaatttttagaaaagtgaggacggtaaagaatcgctgagtccgacactgccaccatatgacaaatgggcggccggcgtttgttttgcgatgcgattcacgcaatatttcatctacacgaatctcgagacgtaa

SEQ ID NO: 84537 - DNA, 1595 bp, Heterodera glycines
  Genomic contig location: Contig_ID=SeqID_3402; Location=2594..4188; Strand=-
  SCN-specific regions: Sequence locations=1-572,595-673,695-731,753 -1181,1204-1242,1266-1424,1448-1460,1482-1595
  Gene Ontology: Mol. function=glycerol-3-phosphate dehydrogenase (NAD+) activity; Cellular component=cytoplasm; Biological process =nucleotide-sugar metabolism
atgacgaagaaacaagtcaccatcgttggttctggaaattggggcacggcaattgctcgaattgtgggcaaaacggtgcaaatgcataactcagaatttgatgactcggcggtcaaaatgtgggtctttgaagaggtgaaaaacacccaaaacgaaatattcttttttttaaattcgtttaggtggttgaaggacgcaaacttagcgaaattatcaacgagaaacacgaaaatgtgaaatatttgcccggaaaggtgccgaaactttgaatttgtcattgtctttccaacttttattggaattcagaaacttcccactaatgttatcgctgtcactgatgttgttgaggcttcaaaaaacgcggatgttctcattttcatcatccctcaccaattcttgcacaaagtttgcgaacagctcaaaggaaacatcaaaaagagcgcaatcgcaatttcgctgattaaggtgaaaacgattaaataaagcagtgagttatttttgaaaattatttttagggcttggccacttttcacgaaaaagacattgggctgcgactgatctctaatgaaatcgcgacctctcttggcattgacacttccgtgctaatgggtgctaatctcgcgaacgaagtggcagaagaccacgtaaattctttcctccattgttttataaatcatttattatttttagttttgtgaagcaactattggtaaacatttaattcttgttggtaaaattcattttatttattttgcctgtaggaaccaaaaacccacagcatggaaatgaattgaagaagttgtttcacaccgacaatttccgaataaatgtggtcgaagacgcggcaacggtaaatgaattgcttctttttttcgcggaaatgcctattttaggttgagttgtgcggtgctcttaaaaacatcgtggcatgcggcgccggattctcagttgggctcggttatggcgacaacacaatggttgggggtgaaggagaaacagcgaatcatttttaacctttcaacaggcggccatcatccgaatcggtctcatggacatgataaagttcatcgaactgttctatcccggcgccaacttgaagacctttttcgagtcgtgcggattcgctgatcttttgaccacgtgtataggcggacggaaccgaagagtgtgcgaggcattcgtcaaatcaaacaaggtatgcgaataatccgtcaaaataagaatttatttgtttcttttagcctttggcagaggtggagaaggaattgctgaatggacagagtgcgcaggggccattgacagcgaaagaagtgttcgaagtgctgcaagcgaagaatctgaccaaagagtgagtcgaacaaaatatgtaaataagaatgatcaacggtgatcgtttaatttgggttgcactatgtttctcccccaaaaaaaattattatttttttttgggtggggaaacgatatgagaagatgaaatactcctatttttgctttattgaatttacttatccttcaggtttccgttctttgtggcgattcacaaagtttgcagcggtgagacgccggccaagaatttcctcgaccttattcgttaa

SEQ ID NO: 84538 - DNA, 376 bp, Heterodera glycines
  Genomic contig location: Contig_ID=SeqID_19802; Location=819..1194; Strand=+
  SCN-specific regions: Sequence locations=1-376
atgttgttgccatcggcggccatgaaaatgcgtcgcaaatgctcattcaatccggcatggcaacaccaatacgcatttgtccgccgtagcaaaaagggcaacggctttttttactgtgcctattgtgagaaggacatcaatgtgcaaacaatgggcatttcagcggtcaaatcgcacattgacaacaacaaacatcggcaaatggagcagcaacaaattgtcatgtcggcggtaattggaaatgccgagaacggcgccattgttgcggcacatcagcagcagcaacaatatcaaatgaataatcataattgtaatgctgttggaggagtaaaggcggaagaaccgccgttgcaacaactacaccaacagctttttg

SEQ ID NO: 84539 - DNA, 115 bp, Heterodera glycines
  Genomic contig location: Contig_ID=SeqID_19802; Location=1868..1982; Strand=+
  SCN-specific regions: Sequence locations=1-44,81-115
gaacaatttttgcaagacgagaggcaaagagtggacaaactgttcaacaacaataacaacaacagcaaaagcaataataagccattagaaaaagcatatggaggagcatttgcaa

SEQ ID NO: 84540 - DNA, 1754 bp, Heterodera glycines
  Genomic contig location: Contig_ID=SeqID_19804; Location=294..2047; Strand=-
  SCN-specific regions: Sequence locations=1-34,58-262,285-386,414 -730,766-779,801-983,1005-1081,1104-1356,1378-1464,1565-1621,1674-1754
atggcaaagcgttcgtttggcgcactgttgtcgcccacattctgcggcgtgcccagcgagcgcaccgcgatgctggcagcgtcagcgactgcggcagcgaccgcggtaccccactctctgtcccaacagtcgccgttcgtcgtcgtggtgaactcgcgcagcgactaccgccatttcgtcgaactcgttgaacagcccgacgacaacaacaataacaatcggccaaaactgttggcgacgtcgttgtcatcattggcggaggatggcatttgccaacagcaaaagttggccaacttggcacggtcacttgccgatgccgtgggcaatgtggcggcaactgttgctgaacgtcttgaatatatcgacgatcatggtgagggtgcaagtttattttgttttatatttgtaaatgaggttgcgtgatttcgttgctaaatttcaattttaaaaaaattcgcagtaatcttttccaagaaggtacgataattattataccatacccaacattttatgtaacacagaaccatcttctactgctgttgaacaccatcagtcactggcacatatcgccaacaacaaaaacaacaacaatgaaaacattgctactacagtaagtcagcgctgggactcatccggcgagccttgcccggcacgcgaatcgctcccagcaggcgaaccggacaacaaccacttgccgttaatgatgcgcgaaatgcccagctgcaaaatggacgacgacgacgacgatgatgatgctgatgatgaacagtcgtcgatgggtgctgctgctgaacagcttgaacttcagttagtcgattcgtggtccatggaggatgattcgcaatgtactgaattggccgttggtgatggatcggtgccgttgcggcacaaggacacgcttgaacgactggacggcggcaacaacgagcggagactgggcatgttcctggctgaacggctcgcacatgggcttgagcggaacgagcgtgccatggcacgggccagccggcagcgcaactcgttgcttgacgcgctgatcagtgctcttattctgtcggaggagggcgacgatcgcaagggggagcaccagcagcaggacggcgacgaacagtgccaggacgagctgcagttgaacaacaaattgcggcgcgtgtgcaggggtaggaattattcaaaatggagtgggcaaatattcaagacttgactgaatagttaagtcgcagattgtagccgtaacagttcaaaggaatccgactgataaacctggtcataagctggattgattagagtaagcgcacttatccttgtcaaaaaaaaatctgaagcttcgttcaggcttaaccggggagattttccaatattttaacaaatttttgacgaatattgcaccggattttcgttaagcagatcagcaacataatgccaaaaagaaaaatggcttattaatgacgccgacggcaaattacatcaataacagcaacaacaacaattatgctaatgagcatgatgatcaacagcatagtgatcatcatcaacaacaacaacatcaacagcagcagcagcagaattggtgtacaaccacaaaaaatgggagcaaaaagtcgcgatccatggatttgttacagcaacaagcacacacaacaacaacaacaacaccagcaacaacaacgacatggagcagtaccaacaacacaaccaaacagccggagttgctgctggatgcagcagcagcagaacactggcagatcggacag

SEQ ID NO: 84541 - DNA, 434 bp, Heterodera glycines
  Genomic contig location: Contig_ID=SeqID_19804; Location=1219..1652; Strand=+
  SCN-specific regions: Sequence locations=1-29,51-64,100-434
catggaccacgaatcgactaactgaagttcaagctgttcagcagcagcacccatcgacgactgttcatcatcagcatcatcatcgtcgtcgtcgtcgtccattttgcagctgggcatttcgcgcatcattaacggcaagtggttgttgtccggttcgcctgctgggagcgattcgcgtgccgggcaaggctcgccggatgagtcccagcgctgacttactgtagtagcaatgttttcattgttgttgtttttgttgttggcgatatgtgccagtgactgatggtgttcaacagcagtagaagatggttctgtgttacataaaatgttgggtatggtataataattatcgtaccttcttggaaaagattactgcgaatttttttaaaattgaaatttagcaacgaaatcacgcaacctcatttacaaatataaaa

SEQ ID NO: 84542 - DNA, 1419 bp, Heterodera glycines
  Genomic contig location: Contig_ID=SeqID_19805; Location=167..1585; Strand=-
  SCN-specific regions: Sequence locations=1-1419
atgggatacgcaccaagcaagtgtccaaaatatccaacacctggagcacgcagaaggcggcttgctgatcaacatcgatgttttaattgccttatgcaagggcataactctcaacaatgcagctcaccaaagaggtgtccaaaatgtggtgaaaaacaccacttcatgatctgctattctgaaggagacgctccgagaggaaccactcctcaacaaacatccaaaggaggggctgttcaaaagaaacagtcctccaacagacgaggagaaccacctcgtccgactcagaatcatttttcggcattaaatgaacccttaagaataagggaaaatccgtctgaaatatcaatttttgacggaaaaagaacaaatgttttaaccagcgttgtgacaaagaagtcacacgcgtttttgatgacccgacgattgagggtccggtcaagtcgcgatcctcgtcgaatgatcaaagccatgtttctttttgacccagcgagtcagacttcatatatgtctgacccgttaattgaaaaactgaaaccacataaggtgacttccgaagaaatggaagtctacggtttcggtggtgaaaggaatggaccaatacggttccattcacctgtctactccgttcaaattcaacggagtgacaataagtgggaggaaatcctactcaatcgaaccgagcaaatttccactccattcaaaatggtggagtggaattcagatgattacacatcggaggagcaggatgttttccaagctctaagtttttctcaggacgaacctgagattctcataagtgctcggcacttttggaaatttttccaaagcaaaaaggaagttttgcctgggttgtttgtcatccaaacaacactgggccctctagttaatggagagtcagacttcggaccaaaggtcccaaatacaggagtgtcaatggtggccattgatgaatccaatcaagggcagatgccagctgttaaagaaattgaatatttctttaatttggaatcgttagggataaaggaagaccccaacgaagatgatgatcaaacagcaatgcagctgtttgacaaatcaatccgtcgtgaaaacggcggacgatattcagttaaatggccgtggaaggaagagacaccgaatcttccttcgaactacagaatggccttttcaaggttaatgtcgactttgaataagctcagacattctcctgaacttctacagcaatataacagcacaatcaacgaccagttatcaaaaggtatcattgaagaggccagggaagcacctggcactcttgagcactacattccgcatcaaggagtgttggctaagggcaaaaaacttcgcgtcgtttatgacgcgagtgctcacacaaggggtacaaacagtttgaatgactgtttgtacagaggtccg

SEQ ID NO: 84543 - DNA, 1531 bp, Heterodera glycines
  Genomic contig location: Contig_ID=SeqID_19806; Location=1..1531; Strand=-
  SCN-specific regions: Sequence locations=1-2,24-38,73-677,699-757,895- 1107,1150-1531
  Gene Ontology: Mol. function=cation-transporting ATPase activity; Cellular component=integral to plasma membrane; Biological process =bile acid transport
tttcttccctcttttcccatttcttccactccatcgtccttcttcttcttcttcttctttttctccttcttcagattgttctgtttctgttggcaatgtgtttgatttgcactatgatgtccggcctttgggagcacgtcacgggccgtcagttccgcgtgtttttgccatgggatgagttcgtcgtcagcaccaaacaagtcctttccatgccgacttctttcaatggcatttctttgcccgcctccgacgacgaggaaaccgaccaaaactcagtgggaccgtccaaggcactgatcatcgccgccctccaattcttttcctacatgattttgctgaacaccgtcgtgccaatttcgctatacattaggtaatgccgcagggaatgccccgggcaaacaaaggcaaaatgccaaaggcaaaagcagactctgtccactcgggaatttgactctcgagcaaagcttctccaaatcactcccatttcaaatgccattatttcacgttcactttgtcttactgcattttcttcgtcatactgtatgcatatggttttccctctccccaatggaaagtgtcgaaatgattcggttggcccactcgaaattcattaacaacgacatcaaaatgtacgacgacaaaacggacactccggcacgggcgaggacgagcacactgaacgaagagttgggacaggtgcaatacgtattcagtgacaagacggggacactgacgcagaacataatggcaagaaatgataaaatattataaaaaatatttacatttttttaattttaaaaaataattaaattaatttttattaaaattaaaaattgtaaattttaacaacaaacaaatttaattaattttaaatatttcaaataaatttattttgcttttgtccattttcggtgttcaaaaagtgttcgatcaatggacgaagttatggcgatgtaatgacagaacgtggcgaaattgtgccgattgacgaggagaaggaaacgccgccggcgttggacttttcggacaatcattggcacgagccgcacttccgtttctacgaccggacattggtggaggacacgcggaggggcgtcgaagaagtgcaaattaacatattagtaatatttattactaattaattttaatcaccttttggtccacgaattttggcgtttgttggccatttgccacaccgtaatgccggagagaaagccgggcaaagtgttggaatatcaggcacggcaattccacagcaaaacacccgcatatattcacatgtttaggcacaaagtccggacgaagcggcgctgacatcggcggcacgaaacttcggatttgttttcaaatcgcggacaccaaaatcgattacaatcgaagtgaacggagcggaggaggtgacaacaaggaaaagcaaaaagtcaaaaacaatgccaaaggtgtatgaagtgctgcacatcctcgactttgacatgtgcgcaggagaatgtccgttttggtacgcaatgcgacgagaacggtgctgtactgt

SEQ ID NO: 84544 - DNA, 1645 bp, Heterodera glycines
  Genomic contig location: Contig_ID=SeqID_19807; Location=1..1645; Strand=+
  SCN-specific regions: Sequence locations=1-22,64-674,717-774,797 -1075,1097-1112,1135-1163,1249-1609,1631-1645
acaaaatttttaaagaaagtgcaaattttttttttttttttaaataaattagttatttattaagttgctttccaattttcgttcgggaaacggcttcttatttggaacacctttcgttttcatatcagtgacgatacaaaccaacccttcaggcgtttatctattaaatctgctgtcatccccggtggcactacgaaattcattcaagtattagacaattcaatttaaatcaaggaaaattattttagcccccagacgtgtgttggaacgcaccgtttaaaaacaaaatcaggcaaatttacgatgaatggatggtgaatggagagaaagaaacaacggcgtccggaaatatgaaggctccgccaatggagacgtatctgcaatggattgtcaccgcctggaactcactctcgaaggaactgatcgccaaatctttcctgtcatgtggaattacggaggaaattaatggaagtaaagatgagctgatcaatgttttcaaggtcgtctatttgcagttttttgtgtatttttcaagtgttttaaggcggacggagccataccgaatgggcttaagcttctgagccaacgtcgcaatgaagaaaatgttgtgaaagcacttgaactaattgatttaggacaagatgaaagcgatgtctctgtcgacgttgctaatgaataatattttcatcaaatttattttcttttttaataaaattgatcgccccatgaagtctttttttaggggcctttaattagaggggggggccttctaccagaggtgggccttctattttcaacccctccaaaaaggggcctttaattggagggggccttctaccagaggggggccttctattgttcaacccctacaaaaaggggccttaaattagaggggggccttctaccaaggggggggccttcaaatacaggaaatacggtatttggtacatattttgggttagggatgcgatttttaggtaagaaaaatcccagaataggtacttaaataggtaaaaaaaaatctctaaataggtattaaataggtacaaaaattccaaaataggtaccaaaataggtaaataaaaatttttattaacgattttttagtggaaaaaagcaaacaaagagggaaaattttggttctacatatctctttgtaaacgaaaatttaaatatattaatattttcttagataatattgacattttaaattaaaaattttgtcaatagaaaaaataaataaattttgggataaatttttgagaaatttttccaattcttagggtgcatttttgaaaatttttttggtcgattcttatgggtatattttttgattttattgcatttttgttaagaattttttgaaaatccttaaaataggtaaccaaaatgccgaaataggtataaaaataggtacctaggtaataggtagaaaaatcccgaaataggtaaaaataggtattataaaagtgggtgtagaagctccaaaccaagctaaaaactcgttttttatgcttatctcaacgttacaagtgcgcaaaaattttaggtatttaactaaaaatcgcatccctagcaataaaaaataaaatataccccaaagaatcgacccaaaaattttctcaaaaaatacacccctaagaat

SEQ ID NO: 84545 - DNA, 472 bp, Heterodera glycines
  Genomic contig location: Contig_ID=SeqID_19807; Location=1938..2409; Strand=-
  SCN-specific regions: Sequence locations=1-472
atggacaaaaatgaatcagcccaaagtagagacaaacactcactcactcattttccattcacttacggcgcggtggtaaggcgatttgcgacggacggacgacgaaatgtaaacgatgggaaaagcacagcaaaaaaaaaaaaattagggatgggatttttaagggtgaaaaagtccaaaataaggccgtaaataagggcgaaaaattcgcgaaataagggcgaaaaagtcaaatttagggtataatttttaaaattgctgttttttacatgaaataatttcagactaaggcaaacaattttattcactgattgcagtacaaataagctatattttagaaaatttttttcatttcttagggtctatttttgaaaaatttagtgtcgattcataggggtatatttttcgaaatttttttgggtcgattcttaggggtgtatttttcgttttttattgcatttttgttaataaa

SEQ ID NO: 84546 - DNA, 63 bp, Heterodera glycines
  Genomic contig location: Contig_ID=SeqID_19811; Location=59..121; Strand=+
  SCN-specific regions: Sequence locations=1-63
gtgacgcgcaaaaaaatcgaattgaatcccttcgcgaagggatttagagaccaaaagggcgac

SEQ ID NO: 84547 - DNA, 1032 bp, Heterodera glycines
  Genomic contig location: Contig_ID=SeqID_3404; Location=25..1056; Strand=-
  SCN-specific regions: Sequence locations=1-87,109-135,157-218,240 -644,702-760,782-790,813-981
atgtctttttcatccgcttcaacagatgatgaatttacagctgaccatggtaaaatagaaaagagtactgtactaactcttttgttaccacctgaaaattattaatattattcagagttatattaaaaattgaaaatccaaaattaaattggttaacaaaatgaaaagagtattaaaatacttataggctatggttttgaaattaattaatttcaggcatatctgaaaattttttaaaattcgagcaattgcggcgttcgagaagaataattgaacaacgggaacgaattctggaaatgcctgcacaaaaaggaaacggtttaaaaaattagtcgtgctacttacttactgtatataatggtggcactttacccctctccaccacacaattatttgggaaaaatcggaatcagagaggacaaattcgtaaattctgcgtgactctgttgtcaaagtgccactgattcgccattaatttcgaactttggccaaacaaaatccaatgaaaaattacattattcaacagatgaaatccccagaaagaatttgccaaagccggaaaaactagtggatcggatgaaagtgttgttgagcacggccaatggggcggacattcactttttggtgggagaggaaaagcaggcgagtttaaaattgaaaaagctaaaaaatcattcattttaattttattttagctttttcgagcacataaacatattctgatgttggcttctgatgtgttcgaagcgatttttcgtattgacgagaaaaatccaactgataaaggcaaaatgaaaattaaaaattattatttccattggattttttcgttaaatttagccatttccgccgaactgtcagaccctgttgagctgcccgatgttgaagcagcagcattcaaagtgctgttgagcttcatctacgcggaagatttgagtgaattaaacggagacgatgcaatcgccgtactttacgcgggtgaaaataattttaattgaaaaatttgatgttttaagatataaatataataaa

SEQ ID NO: 84548 - DNA, 148 bp, Heterodera glycines
  Genomic contig location: Contig_ID=SeqID_3404; Location=1730..1877; Strand=-
  SCN-specific regions: Sequence locations=1-61,83-148
atggcatttggcatgtcataccaaatttcagtgagatttgttaagtccaaggagttgggtaagttttcaattttaagtaaaacgatatttttcagaaaaattggtaaagtgtgcaaaataagcaaaattttcactaaaaattaataaa

SEQ ID NO: 84549 - DNA, 1284 bp, Heterodera glycines; identical to SEQ ID NO: 3405
  Genomic contig location: Contig_ID=SeqID_3405; Location=1..1284; Strand=+
  SCN-specific regions: Sequence locations=1-559,581-854,877-977,999 -1284
  Gene Ontology: Mol. function=phosphatidylethanolamine binding; Cellular component=soluble fraction; Biological process=regulation of proteolysis and peptidolysis

SEQ ID NO: 84550 - DNA, 429 bp, Heterodera glycines
  Genomic contig location: Contig_ID=SeqID_3406; Location=3361..3789; Strand=+
  SCN-specific regions: Sequence locations=1-59,82-294,352-356,379-429
atgctgatctatcgatttgccattccatatttatcttcctcaatttgtgtcgcttgtagtttttggttttgcttaacaatattcaaaaattttctttaaatattcctccagttttttccagctatacatcggttgccgcgtcaaatttcaattgtttcaattagggttgatccccgttcccgagccacgtaattaaaaagccaaaatttgaatccaatttttgccccccgaggggtcgggaagcaatcctagtttcattgcgccaaattctttttgtgccataagtgaattggttatacatatatatatatatatatatatatatatatatatatatatatatatatatattctgtgattttttgaatatagatttataaggatacgtgattaatagataatttacgtaaaaagaaatgaaaaattgaa

SEQ ID NO: 84551 - DNA, 720 bp, Heterodera glycines
  Genomic contig location: Contig_ID=SeqID_3407; Location=1880..2599; Strand=-
  SCN-specific regions: Sequence locations=1-430,472-599,646-720
atgcattgtttacaaatacgaagaagaaacagaagcaaaatgtgggtgttatttgcctcgacgccttttgtgtctctatttttttaaattcaaaagtcaaataattttaaatgcttcgtttccccaacttttacaggtattcttttacaaaggaagaggcgggaacggaaaccgtttcgtttctaaggctctttgcgagagaagatgcaatgcaagtggattgataaattaaggaaataattaattagtttattgttacataattagtgctatttaagtttatttaaaagtcttaaatagcttccaattaaatattaaaagtggacactataaattaataaatcatattgaaaatttttcattaacgaaacaatttttaaaccgaattcaatttcagaaatgagcaaaaggaagtgatgaggagcaacacagagaagagaaaggaagaaaagagaaaggaagaaaagagaaaatgaaatgagaacattcactgaaaacgcaatggatttttaaagtttgacatgttcataaattggtggtataaattcacggtccgttaacacattaaatggtcaaattgcaaaaagcgcaggaaatagtaattaaaaactttaatttaaattttattttaaatgtaaaatttatgcttcctatcttttggtctaatcagtgaaaaaggaatttcggtaaccccaaccggagaatgaacagcaaaataaa

SEQ ID NO: 84552 - DNA, 1287 bp, Heterodera glycines
  Genomic contig location: Contig_ID=SeqID_19812; Location=745..2031; Strand=-
  SCN-specific regions: Sequence locations=1-165,191-578,600-910,932 -1287
atgtccccacaaacaatttatgcaatgggagaaaacccatcagatacagtaagacgacgttgttttgatgtacggcaaaaccaaaacaatgtgtactccgacttttgacaaaaacaagcaacgaaaaacaaccaaatatccagcaatggtagttttgtggtttcttcgaaaaataaaataaaataattccgaagtgcattttctaggctaaaaaaatacgttttgcaaaataattggttttgtctatgattattcatcaagtacttggctttttcagaaatttcatttttattttttctgatgaattaggggttaaaaatgcgttgaaaatgaatccgagctctgatcatgcgaaaccaatgtttttgtctatgattttcatcaaatatcattataaaaaataagccgcagccaagcgggctcgaaccccggaccccgtctcatatgacccacaaaggatcaataactaaatttcaaaaaatcttaaaaaaactaaaagctcgacttctccagatagcttattcgaaagctctttttgtgctctacaacatctgtgtatgagttttttatgcccgattaattttcttaaaattttgaaaaatcaagtacttgatgaaaagtcatggaaaaaatcaatgattttgcaaaatccgagctcagattcgtgatcagcgtatttttttagcctcgaaaatgcattttcgaaatttttaattttatttttcgaagaaaccacaaaactttaccattgccgggctccggttatccataaaaaaaccaaattttatgacatttcaattacaacatcattatttgttccagtgggcgtcccgtcgccggtggcactgcgtgcagtgtcggcacgcggcgtgggcagcggcacgcattggattggcaacgattttgaggactttgacaagcactacaagaccggactgcgtgacgccgtgccggtgtgtgactggtttggtgactgattggtgccgacacgttccattgcatggcaacacaaatttcacggcattttgccaccccccccccttcccttcccaattttaacattagacatggtaataaagacgagtctatagtatactacaaaattttcagattgccgccttctggaagaaattctccgctttcgtcatgatgccactgttggtattcgcgggctagtgagtgcacaacgccaaaaacaattatttaaactcaaaaaaaaacgaaattctttttcagttgcggatggaaggaccatcagaatgtggtgggtgtaacgcacaattttaa

SEQ ID NO: 84553 - DNA, 318 bp, Heterodera glycines
  Genomic contig location: Contig_ID=SeqID_19813; Location=81..398; Strand=-
  SCN-specific regions: Sequence locations=1-318
atgattgtactctttttaaccattgttgtaccattccaacaatttttgtacctctccaacaattattgtaccttttcgacagtggttgtacctcttctaatcacttttgtagctcatttaatcacttttgtacctcttctaatcaccgttgtacctcttctaatcacttttgtagctcttttaatcacttttgtacctcttctaatcaccgttgtacctcttctaatcacttttgtagctcttctaatcacttttgtacctcttctaatcaccgttgtacctcttctaatcacttttgtagctcttttaatcactttt

SEQ ID NO: 84554 - DNA, 61 bp, Heterodera glycines
  Genomic contig location: Contig_ID=SeqID_19814; Location=1..61; Strand=-
  SCN-specific regions: Sequence locations=1-4,26-61
gggcttcgccttcggcttcggcttcgagtgcaaagccgagcttcgcccagccctgatccca

SEQ ID NO: 84555 - DNA, 560 bp, Heterodera glycines
  Genomic contig location: Contig_ID=SeqID_19816; Location=9..568; Strand=-
  SCN-specific regions: Sequence locations=1-188,232-318,340-472,494-560
atgtacggttttgttttgaaatggacagaattatggtaaagtacaaaaaatcaaggaaagttagaattgattggactcataaactctcataaaatgccaatgatgagttataattgcaattgaatcatcgtttttcagtcttctcgacgccgcttctcccgggccgagtgatcagcagaagaaagatgaatgaattaattaatcaattaattaatcgattgattgattgatgcgattatgtgaccgaaaatgatgtgatgttacattgtgttattgttattacttaattaccgtatatgctctaattatagcccagtctctattaatcccccagtctctaattatccccccttttctgaggaggttgaaaaataatcccccatgggctataattagagcatatacggtatgttattgtttggatgtgtttgacttttgcttgctcaccgcaaattcgtccatttcctttgtattttatttatatgtaattacataactcattaattgtgattaatcgttgataaaattgctgatgataaaatgtgacgcaacacaataaa

SEQ ID NO: 84556 - DNA, 615 bp, Heterodera glycines
  Genomic contig location: Contig_ID=SeqID_19816; Location=1013..1627; Strand=+
  SCN-specific regions: Sequence locations=1-107,143-615
atgaattcaaacagtatccgagccacttcggcactttcgccgacaattctcaccgatctcgaccaattgaattcaatctattccggtgatttgttgcccgatgcgactgttgatgatgattttgatgggccaaatgcaacaatttctgctggccaaatgttgtcaaaatggttgcacagtccgagaaaagatggcatgccgaagcaattgcatttctttttgaaggagccaccaaatatggaatgggccaacactctcaaaaaggtgtggccatattttcgttagccaactgattttgattgcatttaattaatgtccgtccgttttcccattgtttagcattttctccgtgccaatgccatttcttcggtcagttaccaaattcaatttactgttcagcaaccgtcaacgcaaattgtgccatttgaattagcgaacgaacagaccaaggaaaagcggacactgatcaaagcaagcgcaaatgtttgggaagaccgctgggtaatgaaacggtgccaatattgggagacggcggcggttcaatgggcagcccaaaatttggacggatttagcactgtcgagtttcattattacgtcgaagctggcattgggtga

SEQ ID NO: 84557 - DNA, 849 bp, Heterodera glycines
  Genomic contig location: Contig_ID=SeqID_19818; Location=1605..2453; Strand=-
  SCN-specific regions: Sequence locations=1-769,791-849
atgattgactgtcgcctctacattcccgtgactgcgcactttcccgaccgagctatcgcagctttcctggatccggaacttcgcatcctctcgctgacagcacaacatgcaagctgtaatagctatcggttccatcatcttcaactgcgaagcaatcccaacatctggttatggattgtctctcgaaccggcacagcacgacgaatgccgaaggactacgtccacgaattgtacgaaacaacgatcaaccaaacgaatagcaatttggaacttcatccattgatcttccacgcatggcaactcgacaatgagtctgacgcgacacgcttcccgcacatcaacgaattcatcaactcggagcagttcaaggacaagctggaacagcacattacggcaaggactgaagctttgggcgcgttgaagggcggaatagaaggattcaccatgcgctggctaaaaggcctgatcgacgaagcaatcacatggtggattcgagtcgcctgcgtttattcaaccttcctcatgctgcgcgacattgttctgccatgcactctggcgtatttgctcaatcccatccgagtgactcttctcagcctcgttggagtacgcccgcatccgacattccgacccaccgtttccaaaccactcgggatcgaagagggaatgccgctgcgtgaaatgccacgaacccccaaaccaccagcgcgcagggcagagcatcgatccatgtcaccaatcaaattggacatgatcgccagaacggctcggtaccaacaaccacgaacacagagccatctcgaccttacagaagactcgccctttgggaggcccagacgaaaagaattctga

SEQ ID NO: 84558 - DNA, 1236 bp, Heterodera glycines
  Genomic contig location: Contig_ID=SeqID_19819; Location=178..1413; Strand=-
  SCN-specific regions: Sequence locations=1-369,392-439,461-607,630 -701,723-1236
atgcccaaaattcaatctaaatctgcatttattcgtgactggatcaaaaaagttgaaggcgaagaaatttactccattaatggtaaaataatcttctgtcaagtttgtgaacagcaggtaaagacaacaacgacttgcaacaaacaacatcagcaacatgataattttccacagattccatgctcgcaatattgccatttaaaacaacacgcaaaacatcgcgctaatttggaccgattttcaaaaaagaaaagcaagcagcatcagccttttttgacaacaaatgaaaacaaacaggaccaattttctgccgacttttgcaaagcacttgtatcggccaacattcccttttttaaactgaacaatgcagttttgagttcatttttggaaaagtattgtcaacgcgccgtgccggaccaatcaactcttcgaaaaaattatttggtccaacttttttctgaggttatataaattgttcaaaaatttttttttcaattttgatttttagacaatgacaaaaattaaagacgacattggtgaagcatttgtttggatttcagtggacgagactactgataaaatggggcgaatgatggccaatttgttgataggaaaattggatggaaaaatggcatcccccgcacttaatttctgtgaaagcgcttgaaaaggtggacagtggaacaatggcgcgttttgtcaattatttattttagttttttgtagtaatgatttgcattgtttaggtagtgaattctttcaattcggatgatgcagtgtgtatcaaagaatgtcaattgactttcaacaattcagtttggcaggaccttgcttacatccattcaaattttgggcaattggctactgcaattacaaaattggaaacacaaggaatgaccattttcgatgccatggatgtattcacaggcgttcacaatcaaatggacaatgtttatggcgaaaaggcaaacgaaattcgcaaaaaattcgcggacattgtggacaagaaccatggaattgaaaaaatctcccaattttgccagattctgtccgaaaaaaacactgagtcagatgtttctccaaacctttccctttttacaaatttgctcctttgacaccttgtgacgttgaacgatctttttctgtttacaaatcaatgttggccgataatcgtatgcgttttacccccgaaaattttgaaatgtatcttatttgtaactgcaatcagtgaataaa

SEQ ID NO: 84559 - DNA, 1570 bp, Heterodera glycines
  Genomic contig location: Contig_ID=SeqID_19820; Location=344..1913; Strand=-
  SCN-specific regions: Sequence locations=1-257,307-675,733-796,818 -1314,1336-1380,1425-1547
atgattttaattaagtgtttgttgtataatacctgggtataaacttcacttcactgaattcattcaaaaattgaaaagaacaatttggtaagcatttcgacacccctctgagctttttgttgtttttctggataagctgaatgagtttaattaaatgattgaagttatggcatcgaaactctcaggcacatcaccatctgcacacaactgaaagcaaaaaagtccgaatttgccatccaagaatccaaaagaatggcaaaaaataaaattaataaagttttagtaaaatccaaaattattttaattgcctaagtgtttcctacaggagaattttggcacatgaacacaaaaaattacatttttctgtattaccaaatgtttaatgtgtaagaaatctgttaaaaagtagggaattggctttgaatgtcggagattactgaagggtcttttgtatcccattattccccataattgcagaatccaacattaacgcctttatttcgggaaagcatacaatttgggaccctcggcgattcggtcttgggtcggatgtgacaaaaagtgatcgagagcaacacccattgagcgtaattgaaaggtcgggggggggggggagatcaaagaaccgcttaatttggtggggcacagataagaaaaaagcgagaaaaaagaatcaaaaataatttttaaataatagatagataaaatatccattattattatttttattatcatgttcgtattttagctcaatttgcgtgtaattttttcttgtaaaaggtcactgaaatgcatgatttcaaattattgcctatttaaaagacttattcaaaggatggaccaaattagtacacaatttcaatcaactcttcatgatgtgctcccgaatatccgatcatttttgcagcttttgtcattcagccattcccagtcccttgtgctcctttcccgtgccactgatcgcgcccgcaatgccatcctggaatggaaaagcgctgctattgcgaattcaatcattttttcaaaaatgagcaaaaacaaaagataatttaaagaacttaatttttgataatcatccatttttagggggggggggggtgtatttttttaatttttatgtcgtttcttagaggaactctttccgttcaattgcgttttgtatggaaacttcttcctgaaacagcaccaaaaaaatgggtaaaatggaaaagtagggtggcgactcactgattcggcacaagaaaagtgcggggacccatcgtaaaatttagtaatttatggtgaaaatctgttaacaaatagtactcaaattttcaatatttttcccggcgccgccagcccctcttcaaaaagttttttggaaaaagcgcaccgaaaaactttttatttattttttaaatttggaatagaattttaaaaattatgatttttgaccacaaacgatggttttttgtcggccaaacgcagattttgaaaattttcagttgacagccctggtttgaggcttctaggtccaactttttcatgccaatggaaattataaaacgtaaaaataatttataaaaataaa

SEQ ID NO: 84560 - DNA, 1129 bp, Heterodera glycines
  Genomic contig location: Contig_ID=SeqID_19821; Location=824..1952; Strand=+
  SCN-specific regions: Sequence locations=1-157,184-610,652-1129
  Gene Ontology: Biological process=signal transduction
atggaccgcttcttccccattcggctggaacttttgtcggacccggcggacgacgtgctaatgttggacattatgctgatcacggaaatttgtggccaaccaaaacagcagcaacagttggacattcgcactttgagacttggcgaggaacttaaccaagaagtgggggaggggagtggaaggtcactttcaacagcaaaatccccagttaagctgaagtccgtgtctccttacttggtcaaattcagcgtggccttgcttaagatgttcaaagacgatgacaaattaatcgacgagcgcggcattcacattgtccggtgcgtttttcaccagttgactacaatattgtaaattggtgcttcaattaagacaggtctgcttgttgcttgagccgacggatgtgtttcgttcgttggcattacttctcggcacaatggtgaacatcgacggatttgtccttccgactgcgggacaacagcagccacaactgacaacggccccctcaggcaccaaagacccctttttcgaccttcaatttgttgccaaaatggtcaaaatcctcaaccagattctgatgactaccaggtaaataaatccatttgtcggtcgatagaaaataatattttattttctgtgagctgtttcctctccgtcagcgactccgttgcccggagcaaaacgagtgggccgagttgtttcagaatatgtacaaatgttgggcccatcagcccatctgtttgctgtctttgtatttgctttcgcagaattaccaagtcaatattcaatcgaattttgtccttttttcctcgtaaattattcactgtttcagcccgcgttggagttggtcccgagactttctgagattgaaataacctttgatctgctgacagaggttgatcggcttgtgcaactcatcgagtccccaatccttgcttgtgcgtctgtcttctcgtatatatttcatattttgtttatttttttcagatgttcgaatggatttgcttcatcccgaccaccaaaaatccctttctgcgcttctttctgcccttttgatgttgttgccgcaaagcgaggcctttaatgtcctccaaaagcggcttcaggccgttccccatttggctgttctcga

SEQ ID NO: 84561 - DNA, 437 bp, Heterodera glycines
  Genomic contig location: Contig_ID=SeqID_19822; Location=269..705; Strand=+
  SCN-specific regions: Sequence locations=1-437
atgtgtgttaaaagtatcatgtaaaggaaataaataccataaattttaccagattaagcctaggcccaaggaggcctagcctaaccgaggggaaaagtcagtgttttcgttttgagattgcttcgatggtcggcgatattaacgcctttccgtgctctgatgatccaagcattgatgggaaggacgaagaaacaattggaggagggacgaacgacatttctcagcagcgaaatgattgtggggacggggacaaacgatgcttcgaactgtcggtgatggtggccgagcccgggttcagaagacgcggaattgctctcgaggcctgcaagctgatgattgcttacattcttcaacgcataaggggaaagccaaattttatcgcgaaaatcagtgccttgggagggccccaagtttggcactcttccgagatcggctga

SEQ ID NO: 84562 - DNA, 306 bp, Heterodera glycines
  Genomic contig location: Contig_ID=SeqID_3408; Location=222..527; Strand=+
  SCN-specific regions: Sequence locations=1-121,152-270,292-306
atgattcacaatattatattcttcatgggtcagggtcagcgttcaaatccgccgcccatgcccatgcgtccatcaaagcccatccatgcccattccgccgtcaattagactcttctgccgccgtagccgtagccatagccatagccataacgcttttaacgaagagggtgaaattagaaattccggcgccaaaaagtgccgcaattggtcatgcacaaccattaggagaaaaatggagtgccaaaaattaaaaaaatgatacctatcaatttcatattaatagatttttaaggcaaataattgcca

SEQ ID NO: 84563 - DNA, 218 bp, Heterodera glycines
  Genomic contig location: Contig_ID=SeqID_3408; Location=166..383; Strand=-
  SCN-specific regions: Sequence locations=1-11,42-196
tcgttaaaagcgttatggctatggctatggctacggctacggcggcagaagagtctaattgacggcggaatgggcatggatgggctttgatggacgcatgggcatgggcggcggatttgaacgctgaccctgacccatgaagaatataatattgtgaatcatctgaaatagattatttacaaaatgccattcgcaatgaaataaattttgaataaaaa

SEQ ID NO: 84564 - DNA, 138 bp, Heterodera glycines
  Genomic contig location: Contig_ID=SeqID_3408; Location=1608..1745; Strand=-
  SCN-specific regions: Sequence locations=26-138
catgggcggcggaatgggcatgggcatgggcagcggaatgggcatgggatttggacgctgatccgtgaaattaattgcaccaataatcggattgtcaataaaaagataatggaataaaaataataataaatgttagaa

SEQ ID NO: 84565 - DNA, 101 bp, Heterodera glycines
  Genomic contig location: Contig_ID=SeqID_3409; Location=52..152; Strand=-
  SCN-specific regions: Sequence locations=1-1,23-101
atgtcttcttcgtccaccatttttgttgttctgctggtaattgccatctgctgctgttcattaacaattgccatgccagcagcggtcaatgaaattgatag

SEQ ID NO: 84566 - DNA, 160 bp, Heterodera glycines
  Genomic contig location: Contig_ID=SeqID_3409; Location=1190..1349; Strand=-
  SCN-specific regions: Sequence locations=1-160
cgagcaactgaaacgagaaaagcgttggggctacggcggtggaatgggcggcggatttggcagtggatttggcggtggaatgggcagtggctttggaatgggcagcggcatgggcatgggatttgttggcggaatgccaatgggaggatttttcgactaa

SEQ ID NO: 84567 - DNA, 695 bp, Heterodera glycines
  Genomic contig location: Contig_ID=SeqID_3410; Location=18..712; Strand=-
  SCN-specific regions: Sequence locations=1-138,221-310,355-438,460 -465,487-648,673-695
  Gene Ontology: Mol. function=structural constituent of cytoskeleton; Cellular component=intermediate filament; Biological process =epidermal differentiation
atgactgctatgaaagtgtccatcattctgctcattcttggcattgtgctcctttcgttggcagttgccatgcccgtagcagaagctgaaaagtattttatgccttttcaatacacatttatttggcctgacttaaacaattttaattttcaaagtttaatttatataaaaataaaatttcgatgtttataattaaagaatttttttaataagaaaatttggcttaaatgtctaatatttttcattatatgtatatatttgaggatttttgcttttttaactgcctttttaaacaatttcaattcatagcaaaattataaaaaaatttaattaatttatttatttttttaatttgtcagcatgcaactgatacgacaaaagcgttggggctacggcggtggaatgggcggcggatttggcagtggatttggcggtggaatgggcaatggctttgggatgggcagcggcatgggctttggtggaggcatgggcagcggaatgggcatgggatttggacgccgctgatgcgtgaaatgatcataaatagattatttaaaatgatccaacattttcctctgctaattaaatggatcaaaagaaaacaaaaaaaatgaaattggaatattagcgatgataatattttcaatgatataaaaaatatttcttttagttctaattaatttattttgaataaa

SEQ ID NO: 84568 - DNA, 543 bp, Heterodera glycines
  Genomic contig location: Contig_ID=SeqID_3411; Location=363..905; Strand=+
  SCN-specific regions: Sequence locations=1-103,136-180,216-334,357 -424,446-497,519-543
  Gene Ontology: Mol. function=structural molecule activity; Cellular component=intermediate filament; Biological process=cytoskeleton organization and biogenesis
atgactgctatgaaagtgtccatcattctgctcattcttggcattgtgctcctttcgttggcagttgccatgcccgtagcagaagctgaaaagtattttatgcctttaaaataaacaattttaattttccaaattcttatttattttcaaataaaatttcgcttctgcattgcagaattcaaaaaatgtattttaattatatttttaaaaaatttgtcagcatgcaattgatacgacaaaagcgttggggctacggcggtggaatgggcggcggatttggcagtggatttggcggtggaatgggcagtggctttggaatgggcagcggcatgggcatgggatttggtggcggaatgccaatgggaggatttttcggctaatgaaatggatcaaaagaaaaaatgaagtagtatatttgcgaccatatattttttattatgtaaaagtacatttgcttttttaaaaaaaaaattggaaatcattggtcaatgtcaatttcaagggcattgttaaaaactacaaagaaaatacacagattttcaa

SEQ ID NO: 84569 - DNA, 420 bp, Heterodera glycines
  Genomic contig location: Contig_ID=SeqID_3412; Location=576..995; Strand=+
  SCN-specific regions: Sequence locations=1-327,356-382,404-420
atgcgaataatgcgaaaggcgaaatgcgaaaagcgaaacctcggcccatccctgatgtttagttaccaaaaattaactcaattaaaaagagctcatcactttcactccttggcatttgatttgataaattcgactggggatggccctggtatatcttggctttatttattattagaatcaaattggatatcctgatatcctattcattagggcttatattttatttggaaaaacctggggtaccttccgggttttaagagtcggtgccggtttttggcgattttttctaggtggcagtacacttaacttctaatcattctaacactcattatttttaattattttagaattttttcaagattacgcgtcatttaatatatgttcttgagcaactttttaattaattattgacgaaggtaa

SEQ ID NO: 84570 - DNA, 430 bp, Heterodera glycines
  Genomic contig location: Contig_ID=SeqID_3412; Location=1879..2308; Strand=+
  SCN-specific regions: Sequence locations=1-99,123-237,272-430
atgtcttctttgtccaccattcttgttcttctgctgataatttccatttgcttgtcattaacaattgccatgccagcagtggacaatcaaattgaaaggtataaattttattttttatttttggcattccatttttctttctaatggctgtgccagaccaattacggcactttttgacaccggaattaaattccgccaatcaattaaattttaagtgttgcacttcgtcaaaagcgttatgactatggctatggctatggctacggctacggcggcagaagagtctaattgacggcggaatgggcatggatgggctttgatggacgcatgggcatgggcagcggatttgaacgctgaccctgacccatgaagaatataatattgtgaatcatctgaaatagattatttacaaaatgccattcgcaatgaa

SEQ ID NO: 84571 - DNA, 807 bp, Heterodera glycines
  Genomic contig location: Contig_ID=SeqID_3412; Location=3597..4403; Strand=+
  SCN-specific regions: Sequence locations=1-105,130-132,400-423,490-807
  Gene Ontology: Mol. function=structural constituent of epidermis; Cellular component=intermediate filament; Biological process =epidermal differentiation
atgaattcatcaatgacagtatctcttctgctaatgttgatcattggcactgctcttttggcattgacaaatggcatgccaaacgcagagtaaaaaaatagagacaaataaaaataaaaataaaactaattgaaatataaattataaataatcaaatcctttttaataaactttttaaaattatttaatttttttgaataattaattttgttcacaaaattttaacagaaatttatatacaataaattattttaattcatttatcttcaaaataattatcaattcaatttctggttaaatataaataaaaaacgcaaataaaatttaataaaaaggaaaataacattttattaattgtttaaaataattgattgaaagaaaaaatatatttaatttttagtgtttcattgacgcgcgaaaagcgtggcagttacggtagtggcagttatggtggtagcagttacggtggtggacccagcggtggtggtgacgcatttggaagcggaggggccgcaggtttcggaagcggaattggcaacggtttcggaagcggaggcggcagcggttttggaagcggaggcggaaatggtttcggaactgggggtggcagctacggtggtggcagttacggtggtggtagttacggtaaaaggcgatgatggaaaaacattggtccatttgtgacgaggaaattgcaatgtgatcatcctttcttcccgatcactgcttttccaaatttatttgttgtattatttatacaaaattttaatgaaaatgaattactgctaattgatgggatggagtaaa

SEQ ID NO: 84572 - DNA, 1421 bp, Heterodera glycines
  Genomic contig location: Contig_ID=SeqID_19823; Location=538..1958; Strand=+
  SCN-specific regions: Sequence locations=1-628,664-829,866-1215,1237 -1421
  Gene Ontology: Mol. function=transposase activity; Cellular component= nuclear chromosome
gtcaatggagcaaggaaggagcctatacaataagcgctaatcgagctttgatggaaatgctggccacacaattactgccatttaattttgtggacggagagggatttcgttgttttattgaaaagttgcagccaaaatacacaattccacacagaaaacactttgcattacatgaactgccgggtagttttgacgcaataaaagtactcaatttgcttttttactttgaaaaattttttatttaagaagtttgttatcgcggaattggattctatttacaaaatagggctaaccagcgatggatggacctcaaaggataaccgtcactctttaatctctgttaccggacattttttggacaaaaaatttcgaccaacattttatgttcttagtacaaaaccaataaagggtaatttaaaaataactaacaaatcaaaaaaaaaacaaaattaagggcgacatacagcagatgcaatttctgcttttattcgtgaaagcttgaacgaatttaaaatttcggaggacaaaatctcagcaataacacgcgacactgaaaatacaatgaaaaaagtttcaaaagatttgggatttgaatcaatcgattgcgctgcccatgtacttcaattggtaattaaaatttaaaaaatttaaatttcttttttaggtgtgacttaaaaaaattgatgaagaagaaagattgaaggaacttattgaaaatgtcaaaaaatttgttcgaaaagtacgaaagtcaagggttttgacagaaaattagctgaattccaatccaatgaagaaataccacaaacggttttgctaaaaaacacagaggtaattatattattttttaaaattaattacaaaaaatcatttactctgcttttacagaaccgaaacgcttcaagttccattatcattccactctttaaagttaattatttaacaatatatcttaatctaaatagcatttaggctattacgtttgcattacgtaaagagggggagaatcgattttcaaatatcaaaaatacaattgcattggccattgaaaagagactaaaccaattcgagaaccaaaaatatttggtgatttcgacccttcttgatccacggtttaaggctgtttatttggattgcaatcacgtagatggctacaaaaattggctaatcagtgaaatcgagagttatcacaatgaaaattacgtaatgaaatatttattttgagtttatattttaatttttagtataccgatgagttgttagttgaaaataatgcaagcgggtcaagttcaaccgacattttttctcaatttgaaaaagatgctgaattcgaccaattaattaatacagtaaagctttctttttaaacaatcgcattattgttcatttcacaggcaccatcgcccagcccatcagcgttagaa

SEQ ID NO: 84573 - DNA, 1877 bp, Heterodera glycines
  Genomic contig location: Contig_ID=SeqID_19824; Location=411..2287; Strand=-
  SCN-specific regions: Sequence locations=1-431,472-532,573-804,853 -1304,1339-1593,1615-1670,1717-1877
atgtacgacttctgtccgttggcgttgtacagcggcgtgcgcgcgcgaatgcagcgggcgctgcgctcactgctgcaccaaccgcaccacaacctgcgccttttcgtcgacggcaacgtggtgcacgaggacggctgcgcgttcgaaccgcacgcactcggcgccgcacttttccccgccggggcctccgacggcggcggcggccatgggcccagcgacggagcgaacattgacacttttgtgtccgcggtgtgtgtgctttgtggtttttatttcgcaaatatttggtgatcatgggcaggattttcggaattttacgggatttacttgaattgataattaaaacgattattaaaatgattgatactcactttctctgtttgatgcacgcacacactccattaaaaaacgaaaaatggcgcgaaattcacaaaaatttttgaattaaaaaaaaataataaaaaaatatttcaggaaaaaaaattaaactatgaacgatgggactttggcttacaaatagaatttctttcacaaattatatattttaaaacaaaatatatataaatatatatccttcagatctgttgcattttggccggtgttgcggacgaccggcgggagaagtttcggctgaccgagggcagtgtgctgaacaatttgctgaccgctcaacgcattgacaccgtcggaatggtgcgggccttcgagctgtacaagagtttgccggacgatgtgcaggtgaacacacactgatgttttttcaatcctaaccattaggccatggaatttttattcaaaaatcggattttttttttgaaattttaaaaaaattttgaaaatcttatattattagtagaaaaaaagagaaaatttaggaaacagaaaatgtccactacgaagattttttctgattacggaggccatacaattctgtcacatttcacaatattattcgaactttttccgtttacgtcattttttttaaatttcaaaattcttagtaagcaaatcttttgggttagttttaaaaaaaactaattttaaatgcttatttgaatttagaatcagttgcgcagaaaggcaaatttgttgacgcgctcctacaaaagttttccgtcgttgccaataaattttttggaatttctggagaaggaggacccgcgctcgttggtggagcgctatttgctggccgcgacaatcaaagactgctcactgatggtgagcacatttacacgtttaacaaatgaaactctcagttttttgccattcattttattcactgtcaaaaatttagcgaatttcccaataaaaaattacaaaaaaaaaaattaaaattttgtccgatttccatttttttttatataaaacaattcgaattgggaattttgctccgtcccggctgctaatataatccaaatccagacacattttagcatgcattataaaacaccaaataatttgtttaggttagcattcggcttgtccatgagcatgccatcacaaatgaaatggttgctcatttacggcaattaaataataaattgtttttttaatcattttgtgcattttactgtagatttctgctgtcggcgacaggggttacattcgtgtgcatgggctggacggacggtcatttcactttgcatattcggcatgtgctttatgggggcattttaaattttaatccaattttttaaataatttttttttttaattcttcggccgattacaaattattttggttttatttacagattcgtatcgtcgatttggacccgaagtcggcaaagaatttggagaacagttacaagcgtttgatggccggcatccgtctgttacatgccaatccgcacattcatccgccatgcgttgcctaa

SEQ ID NO: 84574 - DNA, 1543 bp, Heterodera glycines
  Genomic contig location: Contig_ID=SeqID_19826; Location=138..1680; Strand=+
  SCN-specific regions: Sequence locations=1-46,91-306,342-385,428 -467,498-661,686-728,757-849,871-1262,1285-1543
atgagagccgagaattcgttggttgctgtgaaaatgttgcctggtcaattttttattaaattaattaaataaaaatatttatttttatttgtgatttatagaatatgctgatgatttgtcaaaaagtgattttctgcgtgagattgggctgatgaaatcgttgggtttccatgaacgtcttgttaatatgcttgcatgtgtcacacaatcggagccatattgcttaattgttgaatattgctgtgatgggtgggtcaatttggtgctaggtcgtttcgtaaaactgccaattacagatttttcgagaaaattcaccataatttttcttaagcacaataaaattaaataatcttgatatcatacgattcagctggataaagaaatcattaaaataaattctttaaatcaatttaaaactaaaattaaactccttaacgtataaaatgaccggaaaagtgaattatctctttaattaaagatattatatattttatatagtgatttggttttattaatcattgacctcattcttatatttaattttgttgtgatttctttttttgtttaatgtttaatccatattactcgaggacgatttaatctatgacacgtccgcagagtaagtggattactcccttttgtggacttttttctttttttgcataaataaataaataaaagatcacttcctccgtcccttttgagcgttacttcgccaaagttttgactatttttaaatgaaaaataaatttatttgccccattttaaagggcttcccccattcggcacggaatggaattgcttttggtggactcggatttgacaattgttgacggtgaagtgacaccaacagcagcagaagcattagcagtgggaggaaacggtgagcgaaaatggaaaaaatgccgaaggacaaaatgtcaaaggatggttattaatggcgggcatttaaatttcaatttttctcatttctaattccctattacaatcccccccccaaccaaattccagcagaaaatgccatcccttccgttgctgctgtcgttgtgccatcgtcgccttcccccgtcgacgccgccgtcgttttcgcgttccccgtttttccttcaccgtccccgcttttgccatgtcccgccttcgatgttgacgtcgtgccctgcgcgtggtggaaacgcccgtcggcgagtgcacacgcaacgcgcgcttcatgcagcgcgtgtgcaggcgcatgtgcggcttttgcgacgcgcggccgacggaaaaacatttggaatttaaatttttgaaattcaattagaaaaatttatatgcaaatttatgattttgatcaatcaatcactaattcataattgatatttgtacaatgaaaaaagtcactcataaatcagaaaaattacagaatattttaaacagtaagaaacagaatcagcagaagagtggcgctagttggaacagttactgtagcttctttgtttcacaacaattgttcacattcaatttacctttacggagagaaactaggcgtaaaatgaaggagatgaaa

SEQ ID NO: 84575 - DNA, 812 bp, Heterodera glycines
  Genomic contig location: Contig_ID=SeqID_19827; Location=445..1256; Strand=+
  SCN-specific regions: Sequence locations=1-38,64-136,168-179,209 -229,334-477,505-553,576-602,641-674,696-812
atgtcgtcgtccaattcacacaatcagtcgttgttgttgtctgctgctgctggtggtggtcatcagctacaaaggccgccgccaccgccagtttctgtccaatccgccgccacacattcatcagttgcgacaaatgcaacaacacaacaacaccagcaacaacaacaccgtttcctcacaaatcatcaacagcaacaaaatgtttctggaacaactgctgcggttgtcaagcaacaacagcaacaagcacaacaacagctcctgaacagcagcagcaccatgggagcagcagaattgagcagtattttgcagcagacgcatcagcagcaacaggtgtttgttgctttgtgattggagttcggttttggagctggaacctgaatcaagattcaaataaatttttggcagtttggctttttttttgctggatcaagatttttgtccaggatagttcttgttcaatctgaaaactcaaatacggaaaaacaaacaaacaaatgaatagaaaagtcactcattcggaaaatacattaaaaaggggtccggaaagcggttttttaaacaaaatctttaaattttcaaaatttttgatccccaacccccctattactgaaccatttgaatgttttatttgaattttcttcaaatccatcgcttgctgatttgcttctgttcatagtttcagcttcaaaatgctggcgttccattgctcggtcttcccgcccaactgctcgcatcaggcatagagaactcgaacattcttcaaccaaatgctctgcgtatggtgcccggcacccaatacgccataatgg

SEQ ID NO: 84576 - DNA, 112 bp, Heterodera glycines
  Genomic contig location: Contig_ID=SeqID_19828; Location=495..606; Strand=+
  SCN-specific regions: Sequence locations=1-112
atgttcggcatcaatgccaaaattctttcgtccaaaagtggtgctgatttggcagaacatgcccgggctctcatttatcattttgagaatggcggagcccctgtgatgattg

SEQ ID NO: 84577 - DNA, 1040 bp, Heterodera glycines
  Genomic contig location: Contig_ID=SeqID_19830; Location=30..1069; Strand=-
  SCN-specific regions: Sequence locations=1-566,588-821,843-850,874 -997,1019-1040
atggtctattggacggacaatgccgaggcacggctcattgaatggcaaaagatgacggtgtacggacgacgggtcattttcccggaattgaagcacgattggttctatttgtactgtggtgagaagagaaagaaattatggcacaatggacgaagtgccaaaaaaggaaaatgccaatttaaatttcaaaggctataaacggagcggcgggtgtttcattttaattggcatttaaattagcaacattttcagctaatgcctgctttcaaaatggccaacgttcgcctctttcccgtgcaattttcgtaaaaaccgataaaatggaaacgaacaaaaaatgtgagaaggacggcacagaaaaagaaaggattcccttccctcccattcattcattgccaaggcattggccattcgcgcaccatcgaagtgatggaagcgattggacagcgcgaggaatgggcggacgaaagaacgccgctgctaaagcgtgccaaatacgcctcattcgccgcgtgacagcaaattgaaagagaaaagcaagcacaaagcgagaacattcccaaaacaaaacaagttttgcattttattcacactttttctaacttgcgtataaatcggactcattaatttgtaagcgaaagttaattagtgccaaaaagggacattggcactgacaatgagtgaattagcagcccgggaaggcagcagaaggggtgggtgggcaagtggaattttgaaatcaaagggaaaaactttttttacaatgacaacaaaattattttcaaacaaaatttagggaagaaagtccggcggtgccaatcgaagcagaagaaatgctttttctttctcgaaaattcttaaaaagataaagaattgctaactgatttttgtaaaaatgccaatttttgtggttttcaagtcaaattcatcctgagatttcttttctttttttgaattttgttaaatggccaaccaaaggacaaaaatgaatatataatttattcatttgaaaatggggaatcgggggcaaatgaaataaa

SEQ ID NO: 84578 - DNA, 135 bp, Heterodera glycines
  Genomic contig location: Contig_ID=SeqID_19830; Location=1..135; Strand=+
  SCN-specific regions: Sequence locations=1-13,37-51,73-135
taaaataataatgcacaataataataatatttatttcatttgcccccgattccccattttcaaatgaataaattatatattcatttttgtcctttggttggccatttaacaaaattcaaaaaaagaaaagaaatc

SEQ ID NO: 84579 - DNA, 239 bp, Heterodera glycines
  misc_feature (32)..(32): n is a, c, g, or t
  Genomic contig location: Contig_ID=SeqID_19831; Location=982..1220; Strand=-
  SCN-specific regions: Sequence locations=1-239
gatgggtctgcaattgctgtcctccgttttcncgaccgctctttgggtggagacgctcttgggcacttgtgcgacggtgtgccgcccacgccgttcgtttcgcccactgaactcggcttcaccgtcttcaagcatctgtgtctgtcgcctgatcaaagggcgctgtactgtctggccagtggtccccggagggcttcttctctgatcagattggacttgtccactgattgtcacacagt

SEQ ID NO: 84580 - DNA, 162 bp, Heterodera glycines
  Genomic contig location: Contig_ID=SeqID_19832; Location=370..531; Strand=-
  SCN-specific regions: Sequence locations=1-162
atgccggacgtggacggcactttgctgcgccatgcggacattgccgcgcacggtgacttcgtctacgcggtgcaagagattcactcgaagaaggacgaaagtgcggaaccgacgaacaaattggtgcgagtgaatgtgcgggacggacacagcgaagtcgtg

SEQ ID NO: 84581 - DNA, 80 bp, Heterodera glycines; identical to SEQ ID NO: 51817
  Genomic contig location: Contig_ID=SeqID_19833; Location=65..144; Strand=-
  SCN-specific regions: Sequence locations=69-80

SEQ ID NO: 84582 - DNA, 80 bp, Heterodera glycines; identical to SEQ ID NO: 51817
  Genomic contig location: Contig_ID=SeqID_19833; Location=677..756; Strand=-
  SCN-specific regions: Sequence locations=69-80

SEQ ID NO: 84583 - DNA, 800 bp, Heterodera glycines
  Genomic contig location: Contig_ID=SeqID_19834; Location=2025..2824; Strand=+
  SCN-specific regions: Sequence locations=1-34,85-183,205-277,299 -461,525-800
atgaaaaatacggtaaacaattcgaaattctattgtaagtgattaaaaattgaaacaattttagattattccaacaatgaaaatgaggagttggcagaaatgctcatgacctttttgaagggtgttgctttgaatggctttatctcatcagattttgaacggacttttagaataaattcgacaatttgctttttgaaaagatttattcaagaaatgatcaatttggagtctagccaaaacagaaaaatcagcaaagaaaataccaaattgatcaacaattactgggcagttatggtgaaaaaagagacggaggacgaaaaaagggaacaaatctgtaaactgtggcaatttggggcgcaaatgtaccgaaatttggcacaaattatggcacaaaatgaaatttttgagaaattttcattcgaaaatcgaattgataaaatatttggcgaggttattttcgcaatttatttttattatcatctttttgaattaattatttttctataaaatttagttaaataattcttatgaaaatgactgtggcacggccgggcaaaaacagcaaatattcaacagattatgcgaacccgatttaattttcattatcaatggtctaaatttggcaaaacttctggaaattaacgaaaatttgcgttactttttctgccacgaaattgaaatgggaaacgcaaaaatgtttttgggtaatttcatcgaagacgaagcgatgacgaggctggatgaccaattcccacaaataatgcgactaggcatggattttaatttaaaaaaagggatag

SEQ ID NO: 84584 - DNA, 65 bp, Heterodera glycines
  Genomic contig location: Contig_ID=SeqID_19834; Location=1..65; Strand=-
  SCN-specific regions: Sequence locations=1-65
ccgggactcaaatgtcccgctcaggccaagaattttttctatttccgggaaaaaatagaaatttt

SEQ ID NO: 84585 - DNA, 2425 bp, Heterodera glycines
  Genomic contig location: Contig_ID=SeqID_3413; Location=2221..4645; Strand=-
  SCN-specific regions: Sequence locations=1-636,658-1397,1429 -1461,1484-2425
atggccgagttggacaaactcggtcaaagtgatggcgatgacggaaatgttggtgcagcagagcacggtgccgcagacgcaattgataagcgatcattgttgcttagcgagcctgttgaaataaccgtcacatgcctaactccaccgaccggggcaggccggccacgtttctacccttatcagcattggggatacaatgatcaacatcgcataaggattaaaaacttgggcgacaactattgtctcttccatgctttggtcgctgttcgggcgtaccatgaccctgctttgttcaaagaatggatgtcagcggggcggcaactgcaacaaccccaacagcataacatgggccaattgacgctgatgctcgatttttgcgaaaacaaagaagcatttgagctcatgatcaacaaccggcagatgatgtgttccgctgttcgccgtctgatgaattatgctggcatagctgaaggtctagctgcatatggattggaccacattcaaattgtacaagactattgggtgagtaagaaatgttgagcaaacagtacgctttaatttttattacatcaggaccaacgttttaccgacctttatcgcattgtgctcttcgaagaccggtctgaggagttgcccaagccaatttggaagggcccatcagggcgaagtattgatgttgtgctgtttctggccaacggtcactatgacggcatcaaaaaaatcaactgtttcttcaagctggccaaacaatattgtgtagactgtgagtgttcgtacgatcgtgctttgaaacacactcttgagtgcatcagacgctgtccccaatgcgcaaagagttagcttttgtgtttgattcagtactttatacttttacataaaaatcgattaagtcggaccagggcatccatgcgcaaaggaacctggcgtcaaaattctatgtcccgcatgcaatcgtttctttttcgctcatggttgctatgatggccaccaagggcagacatgttcattgctcaaacgatgcaattgttgcttgcgcacgtatcagcgggatccaaaacgtccgcataaatgtttcaccaagtactgtacccgttgcaaggtcagagtatcaagccttttcagttgttatacaacaatattacttcattaccaggtttaccatggcaaagacacgggatgctacattaagaaattacgcattccaatggaaaagcagcggtatagaatggtcttctgggatacggaaacgcggcttgagcccgcggaaggtggtcaacaacaaattcacaaagtcaacttcttgtctgcacgtgttagctgcaccgagtgtgccgattccaacctgggtcaatttgatgattgtgaaatttgcatgaatgaggatggggaagtggagcgaaacaaatattggtatttggataggttttttcctaaaaactacaccatctctccaaaaaggagtgaagctgaagaagatgagcctattgccagctttgtggaatggataatgagggcatggaatgaaaaattcaacacttatatttgggtaaaaatggaccattgctagcaatttatgataccaaaaaattattcccaaggcacacaatgcttccagatttgacggtcatttcatccttcgttatctgggtgagaccagaagaagaccggacgttgtgatgaacgggctaaaaatttttgaatttcgtcttcaacattcgcgcggccgttcacttctaatttggcgtgactcatgcctgctcctaccaataaggcttgatggactgaaagggacatttgaccttgactgcccggacaagccctttttcccatacggtttcaatcgaaggtttctcatcatcaatgaatcggaatttatgacgactgatcacatacttgttaagagaaaattatgctattcggttgccgcatcttccaccgaaagagacctattttcccggatcaatgaagcaggcaaagctagaaaaatttgaccaatggtaaatttccatacaactgctgcaacagcagcaaaatatgtttttcccaaaaggtacgaagagaatcgacagacgcccttctttcttcctgaagagctgcgttactactgcgaaaatgacacggagattctgatgaaatccattcttcaatttcgtcgaattttgttgcgtgacgtgaccagtggatatgatgcgttgcccattagttgtacaattgctaggtgacataaccgtgtcttttatccacaattcatgaacacaaaatttagcctttgtatgaacatttttcgtggaatgttcatgaaggacaatcagctggccattgtgccagaggccgggtacgaaagaaatgacagagcaagtgttctggtatctttggttacgttttcatgaaactagctctttattatcataattaaggcaataaa

SEQ ID NO: 84586 - DNA, 366 bp, Heterodera glycines
  Genomic contig location: Contig_ID=SeqID_3414; Location=39..404; Strand=-
  SCN-specific regions: Sequence locations=1-113,135-366
atgaaacgacactgggacttccgctcaatgagctgtccgcctgctcaacagtcagcatcattactgccacaacaacaacttgaagaaattcagcaaggtgaggggagcgcgacaggagcggaaggcagcagccagtcagacagcagtgatcagtattttcggcaaatcgcccactcagtgcacaaacttgaacgtttctctgtctcacgccacatcaccgaatttgtgctgaatgcccgggtcgaagaaccggatgaggtgttgcgaaatgcgttagaaatgctgatggcacgcgcaatccataactcggagcagcaaagtggacgaaaagttgtcaaaattggcatcacgttgcagggcagagga

SEQ ID NO: 84587 - DNA, 804 bp, Heterodera glycines
  Genomic contig location: Contig_ID=SeqID_3414; Location=589..1392; Strand=-
  SCN-specific regions: Sequence locations=1-175,210-682,704-747,770-804
atgtcgacagcgttggaccgttttaaactcgagagtggcactgccggacaaaagcgcaccagcgaaggaataccagctaagacaaagcagctgaaggaagtgatagacttcaagagcccgggaatattttttgttgaggccaaaattgcaaatcttcagtacaaaatttataatgtaagagggaggaggagcgtctgttcctgctgatgagctcctatttgcaggcgtgccccttaaagcagcgaggattgtgctgtcgacggaagttaaacgacgaaatgtattgtgagacgtgtgaacacactgcaaaatcgccgctcaaaaatttgtttttgaggatcgagtttaaagattgcgctcatcccgaatgcacgcaatacgcgaccatgtttgcccactcggctgaaaaatatttacagcttaaggctgtcgaaattgccgaaatgagcgaaagggagcctgagaaattggctaatgcattggaagccaaactggagaagcaagtggtcgccaaattgactatcaaagtttgtttatggcaattctttaaatttatttttgagtacattccgctgtcaggagtcaaaaggcgattttgaaaatcgcgatttcgattggataatcacgtccatcttcacggacagcaacaacaaagaccatgaaaaggcagcggaagcgacaaagaaaacggcggagaaagaggatggagaagaatcggaggatgaagatggacaagaaattcaattggttggggaagtaaaaccaatcaattccgaggcctttaaaaaagcaaaaaagaactga

SEQ ID NO: 84588 - DNA, 384 bp, Heterodera glycines
  misc_feature (262)..(262): n is a, c, g, or t
  Genomic contig location: Contig_ID=SeqID_19835; Location=74..457; Strand=-
  SCN-specific regions: Sequence locations=1-115,137-384
atggtggtgcgtctcaagatgtacattgagacagcccaagaaaacttgggcaaagagctggcggaccaaagtgtccgtgcagatctaatcgcggagagacaaaatctctgcaaaacaatttctcttttggagaaatacaacggaaaatgggaagccattttcctgagagtgaagggacaagctcttcaagatgaagagcaaaattacagagacttcaaaccagaaggcaaggccttcatgcattgggggtcgaccaagcccngagggcttgtcgacaccattgaaggagctttaggcctctcggagcttgggggatgcaattccccagccaaatcagccagcacaagttgtgcagcaggcaccagtggtgcatcagcgtcatga

SEQ ID NO: 84589 - DNA, 1163 bp, Heterodera glycines
  Genomic contig location: Contig_ID=SeqID_19836; Location=187..1349; Strand=+
  SCN-specific regions: Sequence locations=1-373,395-753,792-850,873 -927,949-988,1010-1163
aaacaattgctgataattgccaagagggaactgtcgaaagtgaccaagaaattgttggatgatgaactgtcactcatatccgcgtccattggatgtagcttttacgttggctctaatcacggagtcacgggaacggactttctcggcctgacgtctctggaagtgttcaacaaaaaattggaaaaagtccttgccgaacgtgtcgattacgaagacccaaatgagattgaacgcgcggtgagaagtgagttttggcatattctttaacaaattgcgttcaaattttactggatcatcataaccccatcaattctctctctctctctttccatttcccaactaatattataaagttgcgaccccgacttcggggttggaaaagtcggggtttggggagaaaattccccgactaaatttgtcggggtggcaggagaaatctaaaaaatgtcgggggcaaaattttcataaaaagtcggaaaaagataaagaaaaatttccagaacaaaaatgtcttaaaaactcatttaaggacttttccattttatttgaagtgcaattgacgactttcgtaaaaccccgacatttcgggggcccaaccctagattaaagtgaaacgaaaaaaagtcgaattttaaataaactgacattcgataaacagtgaaatttatgagaaaattttcgataaatttacctccttcgccaattgccactggccatttttatctcttctgtataaagacaaaattttgcaacaaaaattgaattaaattaatgataattattttaattttcaaattccagttcttgtctgtcaagtcaatattgggattggttttctcgacattcggactgagacggattttgtcaatggacctgagcatatttttttacattatccgtcgtttttgtatcttccattttcaatctacaaaaaattcacaagattataattatctgaacacccgaactatataaaacaatatgaaattctgaaatgttcagttttatctagggttgcgaccccgaaccctgactttaacttttgagtgtactgtatgcttcgcaaactgtatgtaaatcactaacatttaaataatgataatacttttacgaaaagtttgatatgttttaatttgcaatgtcattgtttttgttttatcaca

SEQ ID NO: 84590 - DNA, 455 bp, Heterodera glycines
  Genomic contig location: Contig_ID=SeqID_19837; Location=2043..2497; Strand=+
  SCN-specific regions: Sequence locations=1-212,234-315,341-455
aaaataataataagcttgtactaccatactaatcagaatttttagaatgtgtgctgatatatgccatactgctgtgaaaaattgttataactccattcagagaagagatagaaaaaaaaaaataaaaataggtttagagagcccatgaacagctgaatcggatgcaagtaccgccgttgctgtacgcctaacagttggtgagcaatgacggaaaattgcttaaaaaagaaaccaaacaaactcatcaattgtttgctcccgttgacaaaccgaagggtacattggggcaatggatgttgggctaccgtatcagttattaaaatttttgtttttcaaaaaggatactaaaactgggataaccccattcagagacaagtcaaaaaaaataataataggcttggactaccatactaattagaatttttagaatgtgtctgttaaatgcaaaactgttg

SEQ ID NO: 84591 - DNA, 712 bp, Heterodera glycines
  Genomic contig location: Contig_ID=SeqID_19837; Location=452..1163; Strand=+
  SCN-specific regions: Sequence locations=1-81,103-162,197-323,369 -429,451-509,583-712
atggtcaacggcactttggcaaaaatgattcattttgtgccaccatcgaatgatgacaaaatgctcccatttttccaaattgaaaaacccaaatattcaaaattcataaccaaccgtacaaaattgttaccctaccaagatgatccgaacaaattcagtcagtaaaaataaatttaattttttaaaaattaattttggcactttttaagacagacctgacccatgtgatgaatacggcgcagattgcgtgccgatcagaaatttgttgttgaaaattgaggaattggaaaactgtggaaagaacgaaagcgaaaacgatgcggtaaaataaaaataaaaatttaaaaatatatttaaaaattattttagatgttcgaaatgccagaatgggccccaccacttccgccaccgatgaccatgaaaaagccatccgaaacattaatatgtgaaggggatttgttttgtgacaaacaaacgctgcgagaacagtacaaccgattgagggagagtgagttaaatttaaaaattcaattaattaatttaaaattaaaaataaataaaattaaaaaatcgaaaattaaaattcacagtttgtggaatgaagcccgaagaggtggaaagtcagcgcgaaaaacgacaatacaacccatacgaaaaatggaccgaatcaccgatcaaaatcgcattcgacgaaagagctcgtaataattaa

SEQ ID NO: 84592 - DNA, 350 bp, Heterodera glycines
  Genomic contig location: Contig_ID=SeqID_19838; Location=1412..1761; Strand=+
  SCN-specific regions: Sequence locations=1-45,74-137,159-306
atgcccttgcttatttatccttgtctgaaatccgttaattccccaattattattattattattgtaattattactcaaatgtgccgagctcttatcctttcggggtcccctgattcatttgccaggttataatgaatatttacaaatttgaaaataaaccgttccaatttttaaaatatgcattttaggtacccaaaatgggcacaaaccttcgaaaatgaacttagttttgaattcaaaacgcgcatgcccaatgcattactgctgtatacagatgatggcaagtttaaatgataaaacaaacagaaatttatacaataatttttgataaatatttttatcaattttta

SEQ ID NO: 84593 - DNA, 436 bp, Heterodera glycines
  Genomic contig location: Contig_ID=SeqID_19839; Location=54..489; Strand=-
  SCN-specific regions: Sequence locations=1-436
atgccattggattgttttgttggtggctttccgggcagcttttcctatacaggagatggatatttttggaccaatgcttcctatagagggaatatgctcccagcattttcgcgagatgatgtcatcggatgtggcatttgtttgaccactcggcgctttattttcacgaaaaatggccaacgattgggttggaataattgtaaattaaacagacaaatcacttaccaattgattaagccaattagactgattgggattatttaattatcatagtgaagtaatttttatataaaaattcagacaccgccaaattagccttctgttcttccattttgctttttccatgcgtttctttgcgtgactccgatgatacaattgatgcgaatttcgggccaaccttcaattcaatctttccgcatgaaaattttgtaataaa

SEQ ID NO: 84594 - DNA, 220 bp, Heterodera glycines
  Genomic contig location: Contig_ID=SeqID_19840; Location=221..440; Strand=-
  SCN-specific regions: Sequence locations=1-26,50-50,105-220
atgtcactttcaaatgttcacacaaatttggtacaaaatggaaaaggtagaaaattaaaaaatattacataatttatgaaaattttttcactttttttatatttcagaaactaatgacccattcgctttttcggctgctgaccacccacaaaatgttggcaacaacgaatcatcgtcatccattgagcagaaaagggtcagcaaaattgtggaaaaataa

SEQ ID NO: 84595 - DNA, 1044 bp, Heterodera glycines
  Genomic contig location: Contig_ID=SeqID_19841; Location=81..1124; Strand=+
  SCN-specific regions: Sequence locations=1-44,96-321,343-974,998-1044
atgaggaggagggagggtaccatccgtaccataaccgagtggggttttttaaattttctacttaaaaatttttcacattttttaaaattaattttcatttttcagcacttataaagtgcaaatccgctaagggaagtgaggaagggatgattgaaggaagtgaatatcagtgctatgatgattcaaaatgcggtgccattttctgttcagccgataaaaatgaatttcgaagaatttttttattaactttcgggaaaaatgggggccaaccgaagaaaaaaaaaactagacgattgagtcgaatgggtaacgccaaatgggcgccaaatggaaaaatctttcgttttttagattcttatttattttttttttttcgcatttttcgctcatttttaggcaatattttggggaacgaatggagttgctacattggttactacggtgaacaatactatatcggactcagaacggtcgaatttaaattgcggccccgtgccaacaatgattagtggaagtgcacagtccactttggagcgatcggtgtgaacatgagcaatgcattgtttgtgccgccgttggtcaaaagtgtgtaaacagtagaggtgtgccgtgactgaaaaaacccgtgaaccgtgaccgtaaattggtcccgtaaatcatgaccgtgaccgtgatccaaaaaacccgtgaattcacggtaaccgtgaccgtgaccgtgaattttttgagtttattttttctcggtcggtaaattttttgctttttacaccgtctttttttctggtatgattttacaaaaaaaaaatttaaaaaagggggtccaggggagctgatagacgctgccgcaaaaaattttgaaaattagactctaattgtgcgcaatttttgtccaaaaaatgaccaaattttgcgaatttgagccaattttttatgaaataatatgttttgggggcccggcggtgccgatatgcgccgccgggggtaaaatttaaaatttgagtgcggcacacctctagtaaacagcgtggaaaattataaaattaa

SEQ ID NO: 84596 - DNA, 855 bp, Heterodera glycines
  Genomic contig location: Contig_ID=SeqID_19841; Location=1459..2313; Strand=+
  SCN-specific regions: Sequence locations=1-100,123-273,304-390,412 -418,457-706,747-798,829-834
atggctggagggggtgagctgctccctaataaaagtattatttcatccgatttgaaaaatgtctaacaatgatcagggggtgataaaaacgatttgacactttatttaaaatttaattaattcactcatcacagcaatgaagtgcaaaaaagccaagcaaagtgaggaagggatgctggtaaaagataatgaggaacaaatcagcagcagcaacatttgctacagttacaatggaaaatgcggcgtcattttctgttcagcggaaaatggtacaataaataaatttatttaatttatattttagtcggaaagcgaaaaaacggtggaaatttactcgcaattaaagcacaaaaattgggcactcatcgattaaaaacgtggcttttgtgaaaaagtgttaaattttcttaattatgccaaaaaattaaaataaaaaatataccaaaaaaaatatttccaaattggcgacgccaaaacggttcgtcaggctggaatgtccccgaccgaaggttccaattaaaaaaaggattggaattgggagggaggtcagtcagctaatgccagtgttgaatttttataaagttttataagaaacccgtccagaattggtcaattgagttttttgaaacgtttaagagctttaaaaaaatctcaaaattacaaaaaattcgtaaaaattacacattactgtaattggcttattgagatttttaaattattaaaattaaattgttattttttaatttgttgtttaattgtagaatgcgaatgcgcgggcattcgcaacagtgttgaaagtgcattgatgatgatgatgatcgggctgatcactagtataaattaatattttttaaa

SEQ ID NO: 84597 - DNA, 876 bp, Heterodera glycines
  Genomic contig location: Contig_ID=SeqID_19842; Location=744..1619; Strand=-
  SCN-specific regions: Sequence locations=1-83,115-134,164-275,297 -599,622-876
atgggtgctctatgcacccacaaagtttcattcggaaatcccacggacacctggggaccttcctttgtaagcagaattttatctaattttatttaaaaagttaagaggaaaatattgtaaatgtaattcattacaaatattatttttaattattcttattatagaatgcaagtcaattaatgcattatgatttcagaaataaatatttgttatcaaaaaatgcaaaaattgttgcttcattagaattgattcagcagggcaaaacatcgcaaaggaactgaaattttgcagcaaaatacgttggcacaggggcaaagcttctaaaatttcaaagataaatccttcttttgagatttgaacgtgaaattttcaaaacagtcggaatttcatagcgtttaaaatattaagattgggatggcctttttgatgattcaactattttttgcgactttcgaaggaaattatacgaaaccaaacactcattttttggcatttttctataaaaggaaaaaatccttttcaaaaaatcaatttttaattccggcggaagagagaatttggaaatctatgaaaaaaatttcgtagaatctttcaaaaaagttttcttttaagaaaattgagaacattaaaactcgctaatttttcatttgttatttctctgtaaattatatttttgagtgcttttggctcacaattttgtcacctgtttctttactttttcggacttttgtgtcaccgttttgtaatttttggtgcttttcttgactatttaaaatgtgtactcgaaaaatcgtttccaccgtcataagcactgatttaagccgtcttaaaaattaattctcctcaaaaatgattagttttgatatgcataataaa

SEQ ID NO: 84598 - DNA, 1563 bp, Heterodera glycines
  Genomic contig location: Contig_ID=SeqID_19843; Location=175..1737; Strand=-
  SCN-specific regions: Sequence locations=1-98,122-174,228-328,350 -745,767-1042,1064-1209,1231-1563
atgaatgaacattcgatggaactgagctcaaagtcggacatttgggccattggcattatcgccatcgaaatggcggcaattgggacggaattcaaagggacgcacgacgaagagccggagaaggatgccaaagaaattgtaaggcgaaaacaaaaaatggaattatgactaagctattaaaataattaaatttaattaaatcaaaattttatttttaattataatttgtttgtaggtgccaaaagtttacggagtgatcgaagtattgtggcgaatttacattcaaaatacaaatgacatagacgaacgaatggaaaagaattgggacgaattctatgccaatttctccgtgctcctaagcatccgagcgcattttccgcgcctttttcatatcgttacagtaattattgtttaatttacatattttttagttttttaaagctattttatttctatatgattgagcttgtttttttgcatgtttcaggccgttttggtgtacgatcccgagcgaaggccaacggctaatggcattttggattttttggacgggaaatgccgcttcgagtcaatgcaaaatgcgccgaggcttctcccatggctaacattggaccaattcaaaatgcatttgcggaagcgaaagattttgctcaaaaaagagtcgaaggaatctgatgggtcaagcagcaaagaattgctgaaaaaacagatggaggaattgaaaacactgctaaggttggcaaatgccaaagaatgggtgccgggagagaagcagagggaaaagccatgcgacacaacgacaaacaaagcgatgaacagccaacggcacaaccagcggaagaacggaggggacacgacgccgcgggcaacgaatgcgcgaagtgccaaaacgcaaagcgcgcgctggaaagacagtgaatggagggaaatgggaggggcaccagggcagggcgtaattacttaaattacggctttttggactcccgtatatacggatttcggtaattgaaaatccagttacgcccagtcttgcgaagcacacacattttatgtacatttttaagggctcgcaaacatcgagaaaaccattgggttgagtctgtcgccaagaattcaatacgaactcgacaaaatcatcaccgaagaattcttgggaatctttgaaaatttgcaagagtcattttacaacagcaattttgaagtaaagcgaaaaaagggaatatttaaaatggccctatttttcagatattcgaactgatgggccaaaactttgcggcacttttgtggtcaatgggctacggcaaactgctggaacaattggacaaagtgagcgaacgaaacaaaagtgaggcggaaatgctgaaaagtgttgtggactcagtgcgcggacaattggggacggaatgggaggaaatttaccaaatggcggcgcaatacgaatgtgacgagggcgacaagacgtacacggacataatccaccagatcagcgccctttacctgtacgaactgatgaacaaacagttgctggaccagttcagcgccggaagcgaacttaatgacgcg

SEQ ID NO: 84599 - DNA, 674 bp, Heterodera glycines
  Genomic contig location: Contig_ID=SeqID_19845; Location=29..702; Strand=+
  SCN-specific regions: Sequence locations=1-122,144-674
atggacgatgaagagggaaaattggcgcctgaatctgaattggactatgacgaactaaaccgaggggatttctacctaatcggaggcgtccatggtaagtttcgaacttttttgtgaattggtaaacatataaaatcttgaaagttgtgaaagactgaattactaaaaacatataaattcaattttagacccgatcagtcttcgttttgaagctgcgatccgtgaccaaaatgccgtcgaacataaaagtgccgaacgctactactggtacaaaatggcggaatgctttggcgacgaggaagccatgaagaacattctgcacgcgcagaatgtccaacaggccgaagaggccatgaaaaacatcaaaggcttcgacgttgccgaatgggacaaagtcagttggaatgagaaacattggtggaaaggaaaagggttttcaggtcaaacttaaacattgggaggacggacagcgactgaagcttgagcaagtccgttggatcgaaaatttgctggtgctgaccaaaaccacctacttggccattgcctctgaagacaaagtctcccctcccccatcggtccactttttactgtccatttttgcagtttttcggcactggatggcgcaagaatcgcgacgaggccaacaaaccgatcttttgggatgggaagaatga

SEQ ID NO: 84600 - DNA, 1141 bp, Heterodera glycines
  Genomic contig location: Contig_ID=SeqID_19845; Location=1022..2162; Strand=-
  SCN-specific regions: Sequence locations=1-182,220-513,537-1067,1089 -1141
atggcgtcggcgctgggggcccttccgccccaatcgctgccagcgtaagtgccaaaacgaatcagcagcagcaaccaacgctttgtggcagcggaggagggaacgcgcagcatttaatggccaatccgttggacagttccgccgcggccgcaactttggcagccgcggcaatgcaagcgatgcagcaacaacaacagcacaaccacaacaacaacagcaggacagagacaaacggagaagcgggtggggggacaagcaacagcaataacacaacggcagaggcacaaagtgagagggaattggacaattagggaggggagggaaatggacggatcacttggggaaagaagtcaattagggaaaggggaattaaggaaacaggtcaattaggtaagagtgattcggaaaaggactgaccaattagagaaaggatgaaaagtgatcaatgaaatatcttacaacggcgcaatttgagatagaggaaaggattcgctgaaaataattttggtggcctttcctttccctcccaattcattggttcagttaggacgatgaaacaatcgcaacaaaatgacgacattttcggagaagcattgctcaaagggacaatggcacagttgcaaaggacgtgcccatcgggagaagaaatgttggagagaaaagcaccgacagacatcgaaaggatcgcgggaagcggagaaaatggcactggcgtcattcggcacggcttttgcacaaaagcgatgaaaatggcaccgacggagagaacaaatgacggcacaacggaaagccgagggatgggagcaatggaaatgttcagcagaatgccgccaactggagaaatgggcgccattttttatctaagcaatagcaacagaatcacggaaaactgaagacaaaacgggggagaaaaaatatatccgaattttatataatttctaataccctgagatggacaaatcaattgaaaaattgatccttttaaacgaattcaattagcccagacagttgaccaaacccctggcacagtttattcaacagttttcgttttgaacagtcagtctttgaccagaaaataacataatgtggtgaaaattggctcatcctttcgttgaataatgtgaaaatgtccaataataaa

SEQ ID NO: 84601 - DNA, 330 bp, Heterodera glycines
  Genomic contig location: Contig_ID=SeqID_3417; Location=917..1246; Strand=-
  SCN-specific regions: Sequence locations=23-271,293-300
atgccaatgccaatgccattgccatcttttggcttcattgttttctccgtgtcaacaataacgatcattgtggtgtatgtatgttgtagtttatgaatatatatcaattattattgtagtgtctattgtaatttatattatatatatcagggatgttggtcgtttgtatttcgtatttcgagtttttagggcgtttcgaatacgtatttcatatttttgtatttcgtattttcgcatgaaatacgaacgtattggggtgaggtgttgagagaaaaattattatttacagcagattgggagaaaattaaattttattaaaaaaataataaa

SEQ ID NO: 84602 - DNA, 391 bp, Heterodera glycines
  Genomic contig location: Contig_ID=SeqID_3417; Location=1719..2109; Strand=+
  SCN-specific regions: Sequence locations=1-391
atgaacgcgcaattcgctgctgtgccgatgctgacaactgttttgctggtttgtgtattgctgttgttcccaacaatttgtgaagcgcgtcccaaggaagataaagcgaaaggaaagactcacaaaactgagaacacagattcccgcccggttattctcgaaagttgggattgtaatacaaatgcaaaaacaacagcaccatccacatcagaaaacttacaaccacatcatacaacaaactcacccgttagcaatcaaattaatggcttgccaaaaagcatgttcatgccacgcaaatagaacaaatcaggttagtcatcagtgagtgccaaaacagttatcgatcccagaaaatttttggttcaactcaggcacagccgttttgatgaaa

SEQ ID NO: 84603 - DNA, 791 bp, Heterodera glycines
  Genomic contig location: Contig_ID=SeqID_19846; Location=934..1724; Strand=-
  SCN-specific regions: Sequence locations=1-203,237-625,659-791
gaaagttttcgatgagaattgtttgaacaagaatgcggtgattgatagggcgtcggaattttataaaattgcgtgtgatcataaaattgaattatgtgatattgttgaatattcggaagaggcgattagattgatatacagggacaaggaggactttgtgatggagcacaagtcgagcaacataatcattagtttatggtgagaaaaaataaattttatttttatttaaaatttttcaggacgacgagtatggcgaggttaaaattattggaattcatgagagaagcggagagccatggcggggagattttgtacacggacacggacagtatttttgttaggcacgatcgggatgtggagccgatcacgacggggaaatatttgggagaaatgagcgaggaatacggtggctatgagattgaagaatattgctgtggaggggcgaagcagtatgccttgaagatgagaagcaaacagacgggggagattgaatacgttatgaagattagagggattacgttcgatgtggataataagaagactttgcactacgatacattcaaggagatggttctgaattatggaaaaggggaggtggacccggctttctttgtctacaagaatgattttgggttagtttttaaaaaatatttccaaaattaataccaatatttaggccgacgagggattcaaaactggtgacgagggagaagcacaaaatgtacaagccggtctgccagaaggggataatcgatgaagaacttaatgtgatgccatttggattttgttaa

SEQ ID NO: 84604 - DNA, 1023 bp, Heterodera glycines
  Genomic contig location: Contig_ID=SeqID_19847; Location=1..1023; Strand=-
  SCN-specific regions: Sequence locations=1-24,47-311,391-773,812 -814,860-1023
tcgtcactttttcagtcttttcaatgaaatcgaccaaaacaaggacacctatctcaactcgctgggttggatgagaataaacaattgctgaaattcggaatttgttttccaattttcccacagaattcaacgacattcgtccgcttgtgctggccaaagcggagaacgcggcgctgcgatatttgcaaaatgtggacacggaccacaacggacagctgagtctgacggaagcgcagaattacattctgaaggagtacgggatcagcaacagggacgtggaacgcatctggcgattggtggtgccgagcagtggggacgaggtgggaagggcacaacaggaggaggaggaagggagagcagagggaggggagagagggaagagaaagagagataaactgattaaactgtgataaatgcgctcaagatggatgccgtgctgttcagcaagctgaggaggcgcattcgcggcatgagcattcgcttggccagacaaatcttgaaggtgatccgttgtgttgaggaacggtgggctaagggaaatggccaaatttagggggccgatcgagacgaggatggccaagtcaatctgagggaggcgcaactgatcggtatcattttataatggagggactcacaatgaccaattgaagcatgccgttaattcagcatttgagcaagagggcatcggaccgggcgaagtggtggaaatgttgggtgagttgaggggaaattgggagagagggaggaaacatggagggatgaaatatgtgacaaaagtgagagagacagagagagacagagagaggagggaatgttaatttaataataaaatataatgataaaaataattattaaaaatggattaagatttaaaccatccgatcagttctaaagctgtgtttctcctatcgtttctcttttgcttaagccagcgttgacgacaacaatgacggaatgctgaacgcacccgaatttgcggactttgagcgaattgtgcgggcgcgggcggggaaacgtcgaaaa

SEQ ID NO: 84605 - DNA, 752 bp, Heterodera glycines
  Genomic contig location: Contig_ID=SeqID_19848; Location=322..1073; Strand=-
  SCN-specific regions: Sequence locations=1-137,164-523,545-752
atggcttctggccttcaaatggggccaacttctcccgtgccgctttggcctccaaattggcgcccccttccgtcgacggtgatttctctccccttttttctgctttttattgtccgccttcagttaatggccaattccctcgtcgtcctccgccgccgccccaatttgtggccaacaatggtccgctgatccgcgcacccgacggacaatttgttttggcgtcagtcagtaactttttgggctttataggaaattattcaattcgcagttgatttttattttctggacgaaattctcatagcttttgctttgtccgaatgggcttatcagatcaaatttattttctgatcgctcaaatgttttcgaccaaatgccgtcctcctccccccccccctctctttgtgttgacttttgttcgttcttcgctcaaattcttcctcagattcttccccaacaacatcttgctgccttttctaatggccaaatccaacaacaaatcgcctcccaaatttcagcgtcaaataatggtaaaagaaacgaattcccgatcattttattggattgccttagtatctgatcaaaatgcatcttcgtctccacctccgatcgacggtgtccccccgtcagaagtgccgccttctccgcccgatgagtcggcttcaaccactgacactttgccaacttcgcccctctcggcgccagtggacaaaagcgtcgatttggacggggacggggcattgtcactgggcgaa

SEQ ID NO: 84606 - DNA, 330 bp, Heterodera glycines
  Genomic contig location: Contig_ID=SeqID_19851; Location=194..523; Strand=-
  SCN-specific regions: Sequence locations=1-120,142-330
atgaattccgggcaggccaatttgatatcaacatgttcagtgatgcaaaaaagcatttctcacgccccacgagagccatcaataaaggaggagccgatgggcggtgaatcggcaaaggatgacgacaacggcagcgacaaattctggtcgatggcaacgaagacgacgtcgcaacatggggaagcgccagcaattccaacgatgaccaaaaaaagaacgtccattgaattgtgcgaagcaacacaaattggacacagggaagaacttggccaattggtttctccaaaaccagcgaccgatcgtacagcaccgaccgccgatttcatgtaa

SEQ ID NO: 84607 - DNA, 1828 bp, Heterodera glycines
  misc_feature (1713)..(1713): n is a, c, g, or t
  Genomic contig location: Contig_ID=SeqID_19853; Location=1..1828; Strand=-
  SCN-specific regions: Sequence locations=1-9,33-47,92-189,211-321,367- 463,485-542,565-643,681-862,889-1047,1069-1558,1594-1828
tagatccgtgcacaggtgaacatgggtgatcgatttgaatacgttggaataatttttaaatactaattaattctaaaaaatgtatttttttgccgtaaaaaaaactaataatctttttgctcaaatgccaaaagtatcctggataagatttattgaaacacagatgatcaacgagtacaagaagatggcaggaggtgaatatgttggcttcaacaatgccgattttctatccgaagctgctactgctgatcgcaattttgcgcttgcctattttatgaaggttagttactgtaaatggcatccaagacgtgtagaaatttctaaatttacaaaaaactatataaaaattttctaaaatttttaatagtcctaattttgaaagtggaaatcgctaatcaactcccaaatatttatcggaaatcgaattccggaaaattgaaatagagaattccgcactactgctgtatagatttgtaaaaatttttgacaaattttcaggaaaatggctgttttccggaggagtcaaaacacacaagcctcaaggaaacattggatttctattttcaattgtgttcattggaagtcaattgtgagggggcggcagtgattgctgcaacattggcaaacggaggtgcccaaaattatttaattggcattaattgaaattcaaaataatatttaatgaagcttgtaggtcaattaaaactttaacattaatttgttggctctgtaaagaaaagtctttttctataaataataccatgaataaattttacgaagaaattatttaaaatacttgtagctaccgactattttttgaatactgttctagttaaggatactgtatttttattcttatgtcaaaattattaaaatataatataaattgtaaagagatacaatgagagactaacttcaagagcgtgttaggagactcgggtcttgtcagggttttctcaggatcccaatccgggtatttttttttgaaaaatgcacccagactagaagtccagaaaacaagatttaatccggatgaaatttccaaatttaaatttttactaattaaattcccaaaattatttaattaggcgtctgtccgttgaccggcgagcgttgcattggctcccgcccgtgccgcgatgtgctgtcgctgatgaactcgtgcggcatgtacgactactcgggccaattcgcgttccatgtggggctgccggccaagtcgggcgtgtccggcgtgaccattgttgtggtgccaaatctgatgggcattgcgctgtggtcgcccccgttggaccgtatgggcaattcgtgccgcggggtccatttctgcaaaaagttgattgaccgcttcaatttccacaactacgattcgttggcacataacgaatcccaggtgttttttgatttattggtctatatgaatgttaagaaattttcgaaaaattgatatgtaagtgtgctagtgcgtttcttaaaaactgcaaaccctaagttctataactcagaaaaatttttaaaaatacagtaaaaaaattttttggcaaaatttagagaagactttaaaaaagttaagaatttttatttttttaaattccaatttctagaatttctctttagaaaattctaattttctctaagaaaatttttaagtcaaaatttctttcatgaagcttcattaaaaattttacacttttcagtcggggtggtccaccnccattttccgtgcaacccgagtaaattgatttaaaaattttcgtcattttttcatataaatttaattgaaaattcttccgcgcaccttgacggcactgctggaataatccacaat

SEQ ID NO: 84608 - DNA, 1522 bp, Heterodera glycines
  misc_feature (1478)..(1478): n is a, c, g, or t
  misc_feature (1485)..(1485): n is a, c, g, or t
  Genomic contig location: Contig_ID=SeqID_19854; Location=24..1545; Strand=-
  SCN-specific regions: Sequence locations=1-8,30-104,126-298,340 -360,383-431,453-480,502-777,799-1387,1409-1522
atgaaattaataatttctaatgtcagtagcgggtgagagctttggttgccccgttcggccagttcaaagaatttctattttttgtgaataggaatacaacgatgaaaaagcattttaatttaaatttgctttaatatcattaaatttaaagatcaagaaaataggcatcgctttggaaagtgacgccaattaaccgatgagaaacggataacatttagttgtgttggtgagcatcgcttgaaacagagttaccaattttgcaatttaattcattccccaccaatgcatatccaaacgcaaaaaatgaatatttttaaaatttattaaaaaataattaaagctggaatttttttttattcgaaaaattttctgcagaaattttaattcttattcacaagcaatgtcaaaaaacgactacgccctcacaaagaaatgtaaataaaattgaaaattttggaaatttcatagaaattcttcaatttttcagctttatctgcggcgactgttggcttttggtgttcgattttcttgcgccttctcagctcggccttgaaattgcgctggtcaaccgccgttttaactgcatcgtcgacgaacacttcaaaacacgcaaatggaaattgggcggaatgcaaatttaccacgaaattggagagaatggcaccaaacaaatgcaaattgtcaattccgatggaaatccattgccaatcctgcaaaatccgttgtcgaacaaagtcatcggattccgaggcatttcgatcgcgtaaaaaattgattaatttggaatttttcatctacattctctttttttcagctacatcgatcaaaatgtcatcgcatttcttcgccgttttcaccgttttttcgccatttgttcaacggatttgtacattaccactggcaatgaccgcattttggaatttattttgctcaacatttggccaatgcttcgccattctatgcatctgatgatgtttttgaataccatcgcttttcgccgtttgcgccaattggccccgtcacttctcaacgattgtccatcccttcactatgtttctttcggtgacgtcattctccccgaatttccgcccgatgaaagtgccaatgcgtcggatggacaagcggtgaccaaatggttgttcacgcctcgtccggatggtctgcccaagtggctcagatactctgtgaattcaccggtgaatcaatggtcgtcaacgatggaacagtttaaagcggtgattatccctatttaattggattttctatgatttttttgtcccattttcaggcattttccaatgcttcttctccggttacttttcgcatttgttttcactttccgccttctccgcttgactccgttgtgccaattgatcggatcaacgaagtgactggagagaaattgtatcttctgcaatcagcaaatgacttttggctcacccgttgtccaattggatgggatggaagaaagtgggaanatatgancgatgcattcaaagctcgacagaacccatttgacatt

SEQ ID NO: 84609 - DNA, 474 bp, Heterodera glycines
  Genomic contig location: Contig_ID=SeqID_19855; Location=19..492; Strand=-
  SCN-specific regions: Sequence locations=1-148,170-384,412-474
atgtggtcaaatcccccggatgatgatcataatcatgccgacccgaccgaccattgccgatgttttggtgaacgactgaaacagtgccatgagcacggagctggtgttcccaaagtcctgatcatcccacggcgcggtgcccgaatcgcgcatgatcagcatgaaggcgaacgcgaacgtggcaagggttgggatccaaatgatggtggtcttaaatcggatggaaaaatttcggacggagaagtcctgaagactttttttttgcccttcgggtcaaaaataaagttcctaaaaaaagttttctccagtgtattttaaaattttcagcgccgggagaaaaaaaaaacaggaatttgtagccatttttcgccaaaaaataactaattttttggcattttgtgatcaaatttacgaaaaatggtaagattggggtccgacggtgccgtttggggaggcattggaaataataataaa

SEQ ID NO: 84610 - DNA, 1425 bp, Heterodera glycines
  Genomic contig location: Contig_ID=SeqID_19855; Location=932..2356; Strand=+
  SCN-specific regions: Sequence locations=1-266,314-338,360-480,578 -611,633-679,702-735,758-799,832-915,944-951,985-1066,1089-1116,1145 -1204,1226-1425
atgatcggtgaggttgaggccaacgacattttgggccgtaaggcgtgggtggccaactttttgctgattctgttcgaaattatcaccgtcattctgctgatgaatttgatggtgtcgctggcggtcggcgacgtcaacgaattgcgaatgaacgcggaggagcgaatgttgcgaatcaaagtgggacaaatagcaatgaaaaaaaaggaaaattttggaaaattgggaaaaatttatttgggagaatttgattttcaaggttagcctaactaagtgaaaattatgatttattttcctaaattccattgaaaaatgctaattttcgtccaaatttttggtattaattttaaaaaataaaagcaaaatttgaaaaaatggctagaatacgatttcggagccagctaaatgaaaatttcaaaatccaattgcttttaattattactcattaaagttttttttaatttttgccaaaattcgtagtatatttctatttttttaaataaagtaataaaaaaataaaacaaattctttgcattttaattcaaaaataaattaatgaattttttcaatttaaaatccaattaattctatgtgttgtaaataattttgagaaaaatatttttaaaaattttggaactcaatgcttaaaacatactttcaaaaatgaatagtaaaatccaaaatttatttaaatttaaaatccatttaatttttacgttcgaaatatcaaattttaattgttttggaaaaataattaggaaattttggaatcaatgcttaaaattaattctttaatgcaatttatttaattatgctttaaaatatgtttttgttactataatttttttttgaattttagacttaaaatccgtttaattcttttgctcaaaatactaaatttaattagttttagggaaataatattatgaaaataaatatttttgggtgctgtaattttaatttaaaattttttgaatttaaaatccaattaattccgggaactaaattttttaattgatttgggaaataatgttaaaaatcttagagttcaatgctaaagattaattactttaaaaggaaatttgtttaattatactgtaaaattttgggttactgtaataattttttgaattttaaattttttgaaggttaacttttgcatcgaagctcttcatttgtccgaacaaatctcatttctgaatggctttgtgcaagtgcttcatcggagccaaaccaacaacattttggtcatttacaaggccgaaaacattgtgcactctcggctgatgccaaacattcgtaagaaatgccaaaaaaaattgcctatcaaagaaatccgacggaattttgcaaaattttgtgtgttaaaattcggatttttacaaaattttcaattctacagaatttatggtttctgaaacctaa

SEQ ID NO: 84611 - DNA, 2218 bp, Heterodera glycines
  misc_feature (79)..(79): n is a, c, g, or t
  Genomic contig location: Contig_ID=SeqID_19856; Location=21..2238; Strand=-
  SCN-specific regions: Sequence locations=1-151,173-385,424-546,568 -754,777-836,858-1153,1177-1201,1234-1397,1548-2218
tccatttacaaagaggtcgagcagtacaacagcagcaacaatgctaacgatgatggcattggctcgtcggcacctcccnccactcttggactgtgtaaagcgtgtgctcgagtttgtcaacaaattgaacagcgaaaaggttgaggtttatggagttgttgaggcaacattttgtttattgtggattgtcgttgttgtcgttgattgtattttaccctggaccaccaaaaaattcaaaagaaaaagtaaatcaaaaatagatttttttttcaaaatcaaattttatgaaagatcatggataaactcgatttatcgtgttactcatgcactagaattccgatgctctcaaaattttgaaaatcgtaattctattcatctctggtgtcatatattttaaaaattttgtttgtttgtttttgcaggtgcttactcaattgtacgactggttcctttccaattgctccgttaacaccacaatttcatcgccaatggtggcggaccgtctcgccaaggcgtacacactggcacatggactcagttcggcgttgtgccatctccaccatcacattggcacttttgttgcccaattggcctcattccatgcccattggagcgcggtcggctgccatctgttgaccaacggctttgtcaatccaattccaattgcggacagacaaaagggtggcgatgaagcggatgctaaacgaacggaagctggcgatggttttggcgatggcgatttggcaccgaatgccaccgatgtgtcttcccaagtggagaacatggaacaaattgaggggcttaaggtacctggattatataatttaatcccaatttctgtttttattattttattgacacattattgagtcaaaagttaggcatggagataaaaaataaataattttgtttattgtaggaaaaataggcttattgttaggcttaaaaatttttcttttttaccaaggctgtacattacggtttgatcacaatatcaaaaattgtaaggaatttgcatagttttcataattttcaaagaagaaaaaaaacatacaaaaaaattaatgtcatggagaggactcgaacttgcatgctttttttttcgtatttctgactgatccattctcaaatttgcaacagaatgacggaaatgatcaacaacaacagcaacaaatgaatgacgagcaaaacaatgctgatgctgatcagcaacaacaacaacagcagcagaaaatggacgaaacggaccaaccaattgatgtggatgatgactttgccggctgtttggaggcattggacgcaggggaagacgacgagcagggaattggtgggttataataacgggggcaactcattttccccctcctcgccgcggtgcaccccaaaacacagccgggaataaatttttaaaattttttaaacttagaattcttagaaaactaagaaaaaaaatttctaaaaattttcaagcaatttttttttttttgtaatttaatgatgaatttaaaaaaaatttgtttttcaaaatttttattattttttttttactagacttaaaaaactaaggaatttagcgaaaaggaatagtgaataaataaacaagcaatttcccaacgcagatggtgaagacaatgatgatgaccagcagcaacgggaagacattgatgatcgcgctgattggaattttggtgaggttgaggagccggaagagacgcagttggacccaaaattgtgggaagatgagcagaacgacgaacagcaagcggaggagcgggagcaacatgacaacaatgagacaatggatcacgcaaagggtcagtaattgggcacaaaaagggcattttgaatgattttttcgctaaatttaggtgatcagcgacagatgttggacgatgatgatgcatgtgccaagaatgacgacaccaacgctgatcagcaacagatggatcaatcacaagtggaaggggcggataaagcggactggacagctgcccaagatgaggctggtgacaaggcaaaacccacggcagcggatgaacatgctgatgaagaacatggcgatgcggagggtgatgaccaacaacagaacgaaggcgatgttgacaatgagcagcagcagcaggaaatagacgaggcgaaccaacagcagcagcagaaggttgacggcgaagacaattttgccggtcaattggattgtagggcacggaggagggaaatg

SEQ ID NO: 84612 - DNA, 712 bp, Heterodera glycines
  Genomic contig location: Contig_ID=SeqID_19857; Location=1451..2162; Strand=+
  SCN-specific regions: Sequence locations=1-165,189-386,408-476,498-712
atggcaccgcctaagcgcacaaatgcttttaaaagtgaatatgccaatgaatttcaggggatcacaaaaagcaaggcaggagatgaatttgcgcattgcatcccatgcaattttgacatttctttgttgtccactggaaaaacggccattcctcatcatctgaagacggaaaaacacaagaaagcagcgaaagctgcaaattccgcaaaggcaattacggcattcatgccaagcaaatcggcaccaacgaatttggaccgtcaaacagcagcagcgaaggttgaattacaaattaaatcagaaataacttttatttgtttaggtgcttgggcatatcacaccgcgcgccatgcgcaaagctttaaatcggccgattgtgtctcagatttgttgtcaaaaatttttcctgattcaaaaattgcggcaaattacggatcaaaacaaaataaatgcgcagcaattattacaagttttcataaaattaaaggataaataaatcgagaataatttaggagtacttgctccgcattctgtctccattacgttgcaggaaatgactgggcttccgttttcactttcgattgactcatcaaatcataaaaccaccaaactttttcctttggtggttcgttacttcaatccaaaaaaaggaattgccgtcaaattgatcgacttagaggaattgagtggagagacttcggccgaagtttga

SEQ ID NO: 84613 - DNA, 1366 bp, Heterodera glycines
  Genomic contig location: Contig_ID=SeqID_3418; Location=112..1477; Strand=-
  SCN-specific regions: Sequence locations=1-884,944-1242,1274-1366
atggattttatattgaccaaagtgccaaatgtggaaatttattggcaatgtgagattgaggaaatgctgaccaaggaccaacagatgaagcagaaattcaatgaatatacgggagatggcggaccaatcaatattcgtgcttgttttatgggtggaaggacgggtgcgctgaagctttaccatgaagtgaaagcggatgaggaaattagctattatgactttaccagtctctacccatttattaagtaagataatttttttatatcaaaaacaagaatttttagttgcgtaacaaattatcctgttggacatccgacacttcatgtcccatgtgaagaagttgactggcagagaccagaggacaatccttatcctcttgcaattctcaaagtgttcgtcatccctccccgcaaaatcgatattccagtattgccagtcaaagtcggtgataggctatgttttccgctctgcatgagttgttgcaaaaaatacccaaatggaggtgtcaaagaagcatacagttgccagcatactgacaaacaaagaggatggatcagcacatgtacctcattggaggtgcaaatttgttttaaatattaaaaaaaaacttttgtagcttaatgtcgctttggaggagggctacagagttaacatgcttttgcgcgttctcgagtacgacaggagtgacaacaaactttttcggccatatatgagtgaatttatggtccaaaagatacatgcctcggggtttgatgagaatattcacggaaattttgaagtcgaagaacagttcatagcggaatgttgggaccaatttggtataaaaattgatcgaacaaagatggtacccaacaagggaaagcgggctttggccaaattagctgtaaataatttatgtaagtttaattataattaaaaaagtttttttaaagataaaattttagggggtcgtttttcacttcgtaattacggactctcccaaactcttataactgatgacccatcagaactgggaaattatctagacaaccggaaaattgaagtgacaggacttgacatgctgactccagagaggattttgatcagctataaccagaagaaggattgggtccaggaacatccctgttcaaatgtggtcatttcacttttcacaacttctgcagctcgcctacatttgttaaaagcaatgcagatagtcgctcgtactcctggttgcattcttttatacactggtaaatacactttattaattataatttaaaaaaatttttaagatacggattcattgatttatgttcatccaaaaggaagaaatccattgaaaacgggacctcacttgggtcagtttactgacgaattcccaaag

SEQ ID NO: 84614 - DNA, 2243 bp, Heterodera glycines
  Genomic contig location: Contig_ID=SeqID_3419; Location=4..2246; Strand=-
  SCN-specific regions: Sequence locations=1-147,169-578,617-643,665 -1933,1956-2219
atgaaaaattcttcttcttctcctccctctaaacgttctcgtcgtttttttattgaagagttacttcgggaaccatataatgaactttcacctccccgaaaaaacccaaaagattacatcaaaaaacttgattcggaaatcgagcatgttccaaagttccaatgggtcaaaaacaaatcgcgcttcattatcaaagacgtccctgctgaccccgaagcactgctaagcggcatattccagcactgtatggatgaggcaattgttgacagtcaccaaagtggagttgagccaactcatctcggctgcattgtttccagccagctgcttacgtcagatatttggattcctattcgacaacttactcctgatacaattaacacgattttaaatcgttttaacgacgtagctcaaagcaaaaagcaggatggtgtgacactttggggcgaaccatttactgttaccgtgacaacagttaatcgaaatggtctaccagagaaaagacaactaaaaggaggtgcagcacggaaattggcgcccgttcaccatagaattcacccaaactgtctaattaaagtttctaataaaataaatattttatttaaaaaattttattttagatacaaaattttgatgctgacaattattgtttattttattcgatgcaagcagcaatggtccgtgcagttggtgatcttgattttcgtcgctttcacgactatatcaatggcaacaatggaatgaggggaaaacttaaacatgatgctttggaaatgatgcgtgccattaatgcaccagccggtcaaccaaattacgatgcggaagtttatgtgccgagaattgttgactggtggaatggagaaaaattttctgatcagtggaaagttaaaacgtttgtcttcggatcgacgggccattacaaacctttattcaaatatggaccagtagactatggtgtgccgattattctttactttgaagacggacattttaacggagtgcaaaaaagtgggaacttattcggtgtgccttattgtctgagttgtgaaaagacttatgaccgaccaaaaaggcatatgaaaagttgcaaggctcgatgtataaaatggtaattacaaaaagattaattatttatttgagaattttagctcccaaatgggtccaaaattcccgtgtaagccaactcatggtttccgacaaaaatgcaacggatgcaataagttattttttaacaatatatgctatcagcatcatctttcgtctgaatattgcaaaatgagcaaagaatgcaaacattgcggtgtagtttgggacttgagaaataacactcagaatggacgagaggtgtttaaactaatatgatgttgaataatagtaaatttagggacatatatgcaatgaacggtggtgcgagaattgtcaaattttccacaatttcgagagagggtgtttcattcgtcctttggagccaaatttaaaaaaagaaacacaagactggcgactggtcgttttcgaccttgagacaatgcagcacgaaccagtaaattgcgaaattcctgagcgacggaaacaccaggtcaactttgtcaccgcaaaagttgcctgccccggttgcatttcttccggacaatggaagaacactttgcgtggaaaaaaatgcaatatttgtggccatcatcggacgattacattcagccaaatgccctttcatggcacaatggtggacaagcaggtcattgaccgacaccccctagtttccttcgtcaaatggattctgtataatttaccaaaacaatgcgacactattgcctactcacattttggaggacgttttgacatggttttggtgttccgtgaattgttcatggaaggacttaatccatcaatgattaaaaatggcaacagattgctcgaaatgaaggtaaaaaaatttctgtttaataattatttttatttttgaaggtcaaatgtcggaagagtttaaacccaaatgtcatctttcgagactcgtggaatttggttccgggtccattagcctcaatggtcccaatgtttggcttggatgtgcaggacaaaccgttcttcccacatttggcgaaccggccggaaaattacggttgtcaaatatttccaacgaaagcgaattatttggccgacggaatgaatcctgagaagcgtaaggaatttgacagatggcattcccaaaaccataatatgccgttcctgcttgatgaagcattggccag

SEQ ID NO: 84615 - DNA, 1132 bp, Heterodera glycines
  Genomic contig location: Contig_ID=SeqID_3421; Location=81..1212; Strand=-
  SCN-specific regions: Sequence locations=1-102,124-413,440-516,538 -564,586-760,795-1070,1093-1132
atggcttcgaagtttattctcgtaccagaagaaatttatcatggcttaacaagcagtgattcgggaaacataaacttgggttttactaagcatgcgctggaaagaacaaaaagaaagagggagaatgtgacagcaaaaaatattcattataaccaagaattgtctcgttatctccacctgagagatgaacaccaaaatcatccatcaaaagtagaaattgccaaagggttgaaggcactaatcaaaaagggagatgagagtgatgaagacgaacaaatttttaatttgggatcagaaagatcacaaccccctgcttcacaaattcgcagacagcgccggcctcatcatcattaccacgacgatgaggaaatgccattactaccagactctccacccttccaagctgtaaataggggtcaaaaaaggaaagcaaatgagtattattcctcatgggaagagggagctaagcggcaactcatacagcaatatgagccggcttcttcctctaaaatagctaaaagacaaaggagaaaactgccgccaatctcatggcgaagtgaagaaaaaattccagcagaagttcaacaggaagaaccatttcaaccagccccccaaccatctatccccatacactctcaagttaacagaaaacgaaaagcacagcaaaatttaaatgatgttcgagaagcaaaaaagagccttattgattcggaagagttaagacatcctcctcttcaacaagaggcttctcttcgttttaaacagaaaacgacaaacaaacccagagtaacacaaccgcagcattcaacttcttcgaccttggcaacgagaagtaatcctccgagggatttactggccgaggcagccgctgccccattaccggatgatgatgaccatgatttggaactcttacaacaacctaataattcgactcagaaccagccactcccacctgaacctccattgcctagtaaaacaaaaaagcggaaaagcagtaaaaatgaagaagaaaccgaaaaaaaaagaatcagagttggctcaagaaaaagattgtcttcaccaaatgttatcaaaaatcaaccaaaaagacaaaagaacccgtttggcgaagcactttccgaagagcagcgtc

SEQ ID NO: 84616 - DNA, 285 bp, Heterodera glycines
  Genomic contig location: Contig_ID=SeqID_3421; Location=1536..1820; Strand=+
  SCN-specific regions: Sequence locations=1-45,67-70,94-285
gcaagtactcgaataaaatcaaaatttttatgtacaatttctccaattttacaaaaggccattttttggaatgaaaatgatcttttttccttcttcttcgtcgtctttaaatatgccgctccttaatcgcagcagggggtttgaagcagcatgcatatcaacaacgagatagccatagggtttattagtcgcaatacgataggcagaaaggaaataatccagttttcccggaaaaagttgcactccaatgttacgaatcgccagtgcggaatttggagctcgcat

SEQ ID NO: 84617 - DNA, 1865 bp, Heterodera glycines
  Genomic contig location: Contig_ID=SeqID_19859; Location=12..1876; Strand=-
  SCN-specific regions: Sequence locations=1-48,75-134,157-184,206 -1129,1152-1260,1283-1394,1417-1865
atgtcttcaggacttctgtacgttaattatttcccttttttctaatggttcacatttcttcttttgcttaaattttaaattttcaaaattcagaggcttacaattagcttcattggatttaaaataaaatttcacttttggcttccctccctttccattcaattcatttttcagttggggtgacgtgtgtcttcttctgctgttggtcgtctgtgccagcattctttggttcttttttgagcatgtcaaaaaacgacggcgccctcccaaaaaagaaatgtaaataaaattaaagcaaaaaatttttgaaaattttgaaaatattcttcgaatttttcagctttatctgcgccgattgttggcttttggtgttcgactttcttgcgccttctcaacttggcctcgaaattgcactgatcagccgtcgatttgacttctacgtggacgaacatttcaaaacgcgcaaatggatgttgaacaaaaaattgctaattacatggaaaattgtcggaaatggccccaagcaaatgcaaattgacgatgccgatggaaatccattgccaatcccgcaaaatccgttgccgaacaaagtgatcggattcagcaaatgcattcagatcaagtaaaaactgattagattgaaatttttcataattttctgcacttttcagctacatcgatcaaaatgtcatcgaatttctccaccgttttcaccgtcttttccccatttgctcaatattcttggacattaccactgaaaatgttcgcattttggactactttttgctccacatttggccaatgttccgcgattccattcgttttctgtttttgaacgccttcatttttcgccgtttccgtcaattggccccgtcaatgctcagcgattgtccatctctcttcggtgttgccgtgtcaaataacgacattgtgcccgcttttccgcccgatgacagtgccatggcgtcggatggtcaagcggtggccaaatggttgttgacgccccatccgaacggtgtgccgaagcggttcaaatgctctgttaattcaatggaggaggagcaatggacgtcaacgatggaacaattcaaaacggtggattatccctatttaattgggttttcgatgattttttgtcccattttttaggcattttccaatgcttcttctccggctacttttcgcattcactttccgtcgtcttctccgcttgacttcgttgtggaatttgatctgatcaaccaagcgactggggagcaattgacacttgaagaatatgaaggtggtttttggctcgagcgttgtccaattggatgggatgataagaaatgggatgtattgaacgaaacgaacccaattgacatttggatcgaagatggcggatacgacgacgggtgaacaattttaaaatgattttacatatgagtccaatcaccatttttgcttacaattagactttgtgctttcaaatgttaccaaaaaatgtacggttaatggacagaattatggtagaaaaaaagggatggttaagtagttagttggttggacttataatagttgttgaattggcttaaagttcaatagaatcatcgttttttttcagtcttcccgacgccgcttctcccgggccgagtgatcactgatcagcaacagaagcagaaatgaattaattgatggttaattggtgcgattatgtaacctaaatgatgtgggcactttgccatttcaatattgtattatgaccaatttgtctgtttgtatttgacctttgcttgctcgcaaatgcgtccatttccattgtattttatttgtatgtgaaattcattgtgaatgaattaatcgttgataaaatggctaataataaa

SEQ ID NO: 84618 - DNA, 93 bp, Heterodera glycines
  Genomic contig location: Contig_ID=SeqID_19860; Location=130..222; Strand=-
  SCN-specific regions: Sequence locations=1-93
atgccgaatccatttttatttgtgcttttcacgtgcccactttccgtcatctgggctacgcgaaaatcagctactcgtaacacattcgaaaag

SEQ ID NO: 84619 - DNA, 300 bp, Heterodera glycines
  Genomic contig location: Contig_ID=SeqID_19862; Location=935..1234; Strand=-
  SCN-specific regions: Sequence locations=1-196,219-300
gatcatccgatacgtgaagttgggcttctgatcacagtgtgattgtgtgtgtgcgcttggcatttgactgacggacggacgagtgtttcttttttttcttggtgttgtcattggcgcattgtttggcgggaaattcggactggatacacacacatttaaatgaacaaatgatgatgatgaccgataattggttgacttccctttaacttctactctttcgttctctctgtccattcatttccatccatttgtttcacaatttcctaacaaatcgccaacagaaatttaattatttctttt

SEQ ID NO: 84620 - DNA, 861 bp, Heterodera glycines
  Genomic contig location: Contig_ID=SeqID_19864; Location=1209..2069; Strand=-
  SCN-specific regions: Sequence locations=1-363,385-728,751-777,799-861
  Gene Ontology: Mol. function=L-lactate dehydrogenase activity; Cellular component=cytosol; Biological process=carbohydrate metabolism
atggacttgcagcacggcgttgcgttcactcgccaaggggtcgtagtgaatgccagcattggtacgttgttcgtctggactgtccctttaacggtgccgaaatcagttgatttttgccatttttagatggttattcgggcactgtcggctctaaagtgtgtgtgatcaccgccgggtgtcgtcagcgtgagggcgaatcgcggctcaatctgatcaaacgcaacgtggagatcttcaagggtactgctgcggcaggtgccaaagtgctgggtcattgcaaatcaatttcaggcattgtgccggaactcgtccgttactctcccgacactatcattttggtcgtttctaatccgggtcagtcagtcattcccgatttactcccaaaactattcaataatgcggtttcccccccccctttagttgatgtgctcacttacgtcacttggaaactctctgggctgcctcggtagtttttctgttttcccttttccaatgccctccccccttggctcagtgagcgtgtgttcggttccggcactaatctcgactcggctcgtttccgctctttgctgtctgagcgtctcaacatcgcccctttcaattgccatgcctatgttattggggagcacggagactcgagcggtcacttggaattattaagacatattcctttttttttattttgctaggggtacatcatattggaacaaaatgacgactttcagttgccgtgtggagcggagtgaatgtggcgggcgtcagtttgtctctgttggacggtcaaaacgaagcgacaaattgggagaaggaagtccatcagaaagtggtggacagcgcctacgacatcatcaagttgaaggg

SEQ ID NO: 84621 - DNA, 101 bp, Heterodera glycines
  Genomic contig location: Contig_ID=SeqID_19864; Location=659..759; Strand=-
  SCN-specific regions: Sequence locations=1-71,93-101
atgtttgttgtgacaatggcatattgttttgattcttactgtatctcacttcgatgttcactgtttttggttatttttccttactaataaaatttgacaga

SEQ ID NO: 84622 - DNA, 918 bp, Heterodera glycines; identical to SEQ ID NO: 19865
  misc_feature (26)..(26): n is a, c, g, or t
  Genomic contig location: Contig_ID=SeqID_19865; Location=1..918; Strand=+
  SCN-specific regions: Sequence locations=1-124,148-398,576-859,897-918

SEQ ID NO: 84623 - DNA, 185 bp, Heterodera glycines
  Genomic contig location: Contig_ID=SeqID_19868; Location=279..463; Strand=-
  SCN-specific regions: Sequence locations=1-185
caagcttaatgagtgaatggacgaggaccgatcagactgattgcgagactgatcacttctttcccaacccgaccaaatatttttttaacatttttgcccggctattatcatttctaaaatcgtttgttcgttttaaagtgaagcagtgttgttgattgattcgtttgttgatttgtcataatcta

SEQ ID NO: 84624 - DNA, 967 bp, Heterodera glycines
  misc_feature (38)..(38): n is a, c, g, or t
  misc_feature (76)..(76): n is a, c, g, or t
  Genomic contig location: Contig_ID=SeqID_19869; Location=64..1030; Strand=+
  SCN-specific regions: Sequence locations=1-119,143-542,564-681,704 -920,942-967
atggatgaagccattgatcgcaaaaggggaattctctntagtccccaagaagacaacgcgttaatctcggcttatnttgctcgaaaatccataatcgaaggaagtttttcggcaactttaacaacaaaggaaaagaaaaatgcgtgggatgaagtcacacaagcagtgaatgccgttgtaagaaaaaaagagctaaacttaagcaatattctatgggtaaatttaggacgctcgatcagtgcgtgatcaagagcaaattaagcaacgctacagaaacaagctgaagcaatacaaaaacttcattgctgaaacaaaaatgccaccaactggtggtgggagaccgactgagcggaagcctttttttgatcaatttatggcggaggacacgcgaattgttggcatcattggcgaaaaccctattgaactaggttaaatctcaatcaattgacatttttctaatttataaattggcataggggaacgccccaaatcatctcctgcaattatcgactcaagcttttgctccggatcggagacttattctgctgctgctgttccgccatcatttacagatttgacaccgattcgtcatcaatcgggcggcgtgatcagtagcaaaaaacgaaaattttctactgcttctgctgattacatgtctgccgaaagaaaagaaattgtggaaatatttccagcagcatcatcaacagcaactgcacgcgatttacagattaaagtgcttgaaaaagaaagtgccaaactggatttggaaatggagaagcttaagcttgaaatagagcttttgaagctgaaaaaggatcgagaaatgcgccatcacttgggatataatattgaggagctttaatatatcaatgttcattgattttggatatattattccaattacaatttcgttatttcgttaatgaaataatttttaattccgtaataatttatatcatagacaaaa

SEQ ID NO: 84625 - DNA, 2277 bp, Heterodera glycines
  Genomic contig location: Contig_ID=SeqID_19870; Location=1..2277; Strand=-
  SCN-specific regions: Sequence locations=1-139,180-285,307-460,483 -497,519-1223,1267-1422,1445-1621,1643-1963,1987-2277
  Gene Ontology: Mol. function=aldehyde dehydrogenase activity; Cellular component=mitochondrion; Biological process=retinal metabolism
atgaaaatctgtctgatcggaaaacaagcatttggggcggaagtgtgccgtcaattgatcagttcggggcatgacattgttttggtgtgcacggaattggacaaaaatggccgggctgatttactaggtaagaaaaaacaaaaatattttaaagtaaaaagaatttaattaaattttaagccctggaggccgagaaacacaaaaagccaattctgaaaacaaaaagttggcgaagaaaaaacaaaaaaacgggcaaatttgagttggaaaatgaggtgaaaattgggaggaaaagcacaaatggaaaagaatcattgaatggtttagcttttcaacgagtataaaaagtacgcggccgaagtgaatgtcgtcgctttttgtacccaattcattccgcaggaagtgatggactttcccaggcacaaaaccatcatttaccatccgtcgattctgccaaagcataggcaatttatttaatttaatttacccgttttccttttttgaatttggaattgttcagaggtgcttcggccatcaattggactttgatcgaaggagacgaagaggcggggctaacggtgttttgggcggacgaaggattggacacggggccaattctgctgcagcggaagtgtgccgtggaagagaccgacactttgaacactctttacaaacgctttttgttccccgagggggtcaaagcgatggtcggcatttttcgaattggcatttaacacataatttgcatttgcataacaaaacaaaaagttaatttagtgctgcatactgtattgtgttttcctgtaaaatgaataattttgcattttattcacataatttgaggtcgaatcagtgaatttaatcgctgccgaaaaagcgccaaaaatccctcaaccgacggaaggcgcttcctatgaaccgttcattacggcaaagcccgaattggcagaaattgtgtggtccaaaattggcactcaacgccaattgcacaattttatcagagggaatgattccgtgccgggggtttgttcgaatttagcaaatattctgattttgagttaggcgtggactcgtcttaatggagaaaaagtcaccttgttcggctcgtcattgtggaaaagaatcgaaccaccggcgacggcgcgcgaagtgccggcggaagaagtgcccgggggcaaactttgggcacacccccggggcattctgttgagaacggcggatggaaaatttgtaaaaaaataaaataattataaaaatacaaaaaaactaataggtaaacgtagacacaatgcgaatgaatgacggtcggacaattaaagcagcaaattatggaatggtggaagaaattgcggaggaaaaattggaaatgagcaaagaggagaaggaaatggtgccatcgttgaaggcactgattatttagttaaataaaaactaacaaataaattaagaatatttggcgaggcattttgaatttctcggcgtccgatcaaatcgacgaccaaatgaattttttcgacgccggggcgaccagcgccgacgtgacgcgacttgtggaagaagttcgcacagtttgtggcgttgagatgcgaaacggcgaagtcatctcggaattgaaattaccaaatttatttttatttttttagattttcatgaactcccaattcggtgactttctaatcgcaataatacgcaaaattaggggagaagatttggagagattggaatttgaaaaggtaaagcaaaacaaatgaagcaactcaatgctattcaaatcaaaattcagtttgaatcggagtttaacggcacaaaaatatgcgtgcccacgcaaatgtacatcaatggcaaattctgtgagagcaattcggcacgacgaatgcaaaccatcgacccgagcaacgaaaagtcaatatgcacagtgccaaaagttggcgaacagcgccaaacttaaaatttaaaaatgccgttcagggagatgccggcgatgttgactttgcagtgcgatgtgccgaagaggcattttaccacggcgaatggtcacgcatttcggcacgagaacgtgggaaaatcctttacaggtgaaacgacaagaaaaggacaggttgaccgaggaaaactgtcagactcgctgatctaatggatcaacatcggactgagttggccaccatcgaatccatcgacagcggcgccgtttacactttggcacttaaaacgcacgtcggcatgagcatcgatgtgtggcgatactttgctggatggtgcgacaaaatacacggaaaa

SEQ ID NO: 84626 - DNA, 921 bp, Heterodera glycines
  Genomic contig location: Contig_ID=SeqID_3422; Location=1..921; Strand=-
  SCN-specific regions: Sequence locations=1-324,351-456,479-548,570-921
agtaatcatgtaattgcccttcattttctcccaaagttccgtcgtcgtgtctcgctttggttttgagctgaagcgcgactcggcacgatatgttgccgaacggtacatgcccagcattttggccatgatcttctcctgggtggccccgtaggttcattgaccatcattgtccatttccattcattatgctcttaatagcccaattaagctatgtaccgtacaattacgaggaagtgcgcatcatcactccgatcacggtacaggaagtttcttttttgagaattaaattgatcagagtgggaaagccttgagaatgggcgccactaaattaaaaatattatttttaatttgcataaacatataatagtgatgatgttcaggttctgctcactctcgtgcaaatggagaaagggaatcaggaggtgaccaatgaccacccaatttcaaaaaaaaacattttatttttcatttaaattcaggtgatcacttcctatttgacttctctcgacatttggtgggcctttctttcctcaaattgatcacattatttaattttttgagcattttttaggttcgtcgtgatcaaagcgttcacagtgctttcactgatcgagagtttggcggtgatggcttacatcaaaaagggcagggccgtggtgagtgagtgaattgatcctgcttcacaaaatcatagttcaaatgaaattttatctttgatcgctcgggtccatttgaatctccgtatttttggtgccggggtttgcggcgtcccttttccagtcaaaatgccaatcgcggagaattaatgacctttaaggccgagctttttttaatgtctaatcattacatttaatcaattggaaggaatcggaagcgcaacgggcgcccagtgagtatcggcgcgatttgctccaagcggag

SEQ ID NO: 84627 - DNA, 1050 bp, Heterodera glycines
  Genomic contig location: Contig_ID=SeqID_3423; Location=2398..3447; Strand=-
  SCN-specific regions: Sequence locations=1-14,50-89,349-376,398 -428,455-1050
atggaagatggcgaaacagaaacagcagaagaagattatgacgacgacgcagaggacgacggatggacaatcatcgaatttgacaattcggaagaaaaaaggaatacgacggaggaaaagttaaggaaacaaaacgatcggataaatggaagtggaagggatgaggatggaaaatggaaggaatgggacattggaagggatgaaaaagaagaaagagggaaggaaaaaggaagagatggggaggaggatgcccggaggaaaattgaagatgatcagacggatgatgctcggaagatgaagcaaggaagggacaaggcgaaagagggagggagggatgaagagaagggacttttggcaaatgaccagagaccggacgtggcacttttcaagcagctgattatcccttgggttccccatcgtcttcggcatcaccatcatcctcttcatcactctcattcatctcaaatccaaggaacacacactgagcaatcatccaatggaacaattatcgttacggaacaaaatgtcaacaaaactatgccggaacaaaatgccaatgtaagcgaagaagtagcgcaaagagaaacgggcagcacaaaaacgccctcaacaaccggcggcacagcaaaagcagatgtaaagctgcacttggaagacattctgatcttcggcgcttttgtgactccgtcgggcgaagaaacaaaagaaacggcgaaggcggaaacggaaaatggaaatggcacaatttggggtcaagacagggaccaaaaagatgacccaatggcaccattgcgcaacgacttgtcaaacagtgggcaaaaagtgctgctgaacggcacgtcgttggggaagccaatgcccgccacgacgacgacgggtacaagcacaacttgggcaccgatcaacgaggaggaactggcgatgaaccagcacgttgacccgctgggtcgggacagacagcaattgctggcacaactaattgccaggtgggcaattgattggataatgaaatggtttgggaagcggcgggatggattgccttccgactga

SEQ ID NO: 84628 - DNA, 993 bp, Heterodera glycines
  Genomic contig location: Contig_ID=SeqID_3424; Location=804..1796; Strand=-
  SCN-specific regions: Sequence locations=1-334,393-603,625-993
  Gene Ontology: Mol. function=cystine transporter activity; Cellular component=integral to plasma membrane; Biological process=transport
atgttggcaatgattgccaaggtcatcgcctccggcatcattatcattgtcggcctttggctgctaatcagtaaaggtcactcggcacttactaaatctttttttgggttttactttttttttttttttgcaattttcagaagttcaatctggtagttttcggcaacccttcgccaacacaagcgataagccgggcaattgggtattggcactgtttgccgggctgttcagctacgacggctgggacattttgaattttggggcggaggatgtgaagaaaccgcacaggtgtggctgaccgggggaaggcattggcataataaattatcaaacgataatttataaaatttaaatttaaaatgctacaaaaagttaaaaattattaaaaatttgaggtcaatgcctttcgccatcattgtgggcatgtccacggttgctgcactgtatttggccatgaatgtgtcctattttgtggtgctcagtgtgaccgaagtgcaaagctccaatgccatcgcaatggcaagtcaatgccaatacataaaactcaaaattgcttattttgtggcattcgttgtgcatttaattcccttccccaaattgcctcattagcattaacccattttacctaatgacccataacactcgacttatttgttgcagacttttgcggaacgaaccctcggcggctttttgcagtatgccatgccatttttggtgtgtattgtgctgatcgggtgggtgccgtcatcatggcccatttacaattaattaattaatgataaatggttattttcacaggtctctgaatgccactttgttccaaggcagtcgttacatttgggcatccgctcgggaacggcacttcccatcattcatctcatgcattaatcggcaacatgacagtccccgggcggcactttttgtccatgtaaatgccaaaacaaaatcggatataaatttttggatctgcagaatgtttggggatcggaatga

SEQ ID NO: 84629 - DNA, 282 bp, Heterodera glycines
  Genomic contig location: Contig_ID=SeqID_3425; Location=1..282; Strand=-
  SCN-specific regions: Sequence locations=1-40,77-135,157-282
tttgggccccggggtcgtttgggccccaacccaaaaatagaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgatttacattctgatttggacatttttcagaaatggctaacccaattgcaaccaaaaaacaaaaagtaaaattgtcttacgaaggccacct

SEQ ID NO: 84630 - DNA, 1776 bp, Heterodera glycines
  Genomic contig location: Contig_ID=SeqID_19872; Location=706..2481; Strand=+
  SCN-specific regions: Sequence locations=1-771,804-956,978-1143,1178 -1202,1225-1776
atggccactgccaataattatcagccgcgcgtttcctctgcctcgtcccatgctccacaaatgtttatgtccggtcagcagcagcaaatgccgggcggtggcgcacaaattcgcgccgtgacaacgacggcaccggggacagtgaaccaatcgcagcaatttgtacagcaacaacaacaagtcagttgtaaaatgaaaaaagcattgaatggtttggcaatttttaccatggaattgctgggctgacaaaagaatgtccatgagaaatttggacccacaaaaatcgttcccccttttgagatgagtcagcaacaattccatcggcaacaacaacaacagtttgagcaaatgtccgttcacatggcggcacaacaacagataaagtctgacaacggcatggtcggcagttaccaaattgggacccctacggcaccttccgccggggacagtggcgccgcctctcaaaatcgcatgacaacgtcgacgattgttgtgaagacggaaagcgggcttacaacagcgatggggtcgacgagtgttcgaactccggccggaggtctttatttgttgttatataatgcccaagcttttctcaaaattttgagaaaattaacaaaaaaaaatagagggatgggagcgaattttagggttgtttatgacaattcaaatacgtaaaatcgggcaattttctctccgctcgaatttgatatttgcaatacaatctgataggttgttccctttttaattgactttccgaatttcaatttctgtcctccattctcttcatttttgcatttttctctaactctcgcttttttccagccatcgatggtccgccttcggccgactcccatccgccttcggtgggcactgccaatggcatggcgacgggtcgtccgggctctgttcagcaacagttcggcaccgccgcttcgcaagtggacacggaggagcccgagtacaaaatgttgctgaaaaagttgtgcaaataccacgcggatgtaaagcgactgttgggccgtttcgagttggacacattgcccggggtggagatgaaaatcaaagcgtcactggtcaacgtcatccaagtgatggaaggcacgcggaagggcgggtgcgtttttgaggggaccggggagggtaattccccctttcaaaaatgaaatttttattaaattttcggaaatgaaaacctcataaacaaattttataaaattacaaaatttactttttcagtccggtgacaaagactctgctgcaaaaattgctatcaaatgtgcagacagtgctcgaacgtcaccacatttcccgtcatctgttcagcatagcgaagaaactgagcacattggcacctccacacaacggcacaagcgcaaacggtggcggagggacgacaccaacgacggcaccaaaggaagagccatttgagacggacccgtggcgaaatgttcgacacatggccataaagtatgaattctcatcgattaaacatttatcggaattaagaaaaggttacaagagtgactagtccaattgtttctcacttttcagattgcccgatgccgtgctgaccattttggaggacgagaagaagagcacggcagcagagaaacaacagaaaaaggccgacgacggtgggcaagaaacggccgattctgagagtggcgggaatgagtggacgggtcggaagcgaattcgacaacaaaacgagcaaaaggaggacgagaagggcgaaggaccaccgaccaaaaagagcctttggaaagagggccgaat

SEQ ID NO: 84631 - DNA, 470 bp, Heterodera glycines
  Genomic contig location: Contig_ID=SeqID_19872; Location=2017..2486; Strand=-
  SCN-specific regions: Sequence locations=1-470
attacattcggccctctttccaaaggctctttttggtcggtggtccttcgcccttctcgtcctccttttgctcgttttgttgtcgaattcgcttccgacccgtccactcattcccgccactctcagaatcggccgtttcttgcccaccgtcgtcggcctttttctgttgtttctctgctgccgtgctcttcttctcgtcctccaaaatggtcagcacggcatcgggcaatctgaaaagtgagaaacaattggactagtcactcttgtaaccttttcttaattccgataaatgtttaatcgatgagaattcatactttatggccatgtgtcgaacatttcgccacgggtccgtctcaaatggctcttcctttggtgccgtcgttggtgtcgtccctccgccaccgtttgcgcttgtgccgttgtgtggaggtgccaatgtgctcagtttcttcgctatgctgaacagatga

SEQ ID NO: 84632 - DNA, 1294 bp, Heterodera glycines
  Genomic contig location: Contig_ID=SeqID_19873; Location=85..1378; Strand=+
  SCN-specific regions: Sequence locations=1-612,634-1294
atggcggtgcaattgcacttttggcatgccgaaaaattccgcataatttgtggccaaattgcctatgtggcctatctggtccaaaagaagagcatcccattcacattttggcgatcgcccacagaatgttttttaatggatcgcgaggatattttgtcctcaatgcgtacactactcaaaccttcccatttgaactttgtgatgagccgagtgatcggcacagtatgggatactatatcggatacggtacggcaaaagcgtggcgcgcttgcattgctggagaagctaattgggggtacagcactggttaaactgtgggagaacaaagaagccagggcgaagttaatggaggcaaattgtaagtgaaacaatgatggaacatacagacaaaatcaatgcacactgtcttcaacagtagattaggaaatagaatgctattagtacctcaacaggaagaattttggtttgagcttaaagtctgtattactgtaccggatcttttgtatttaaaaaaattattattggatattaaagtattggttctggtaataacaacccaatcctgtacagtaacaataaatttgattttcccatccgtaaaatttttaggccttttcaaattcctgtaaaaaatgacatataaaaaatgccatttaaatacttttttctccattttagttttcttcgacaaaaaccgactcgttgatcattatgtcagcattttgttgaacgccaacattgtgcctgattccgttgatcggatgcgccgcgatataaaatcggctgatctgatcgtttgggcccaatggttccaatcactcattgagcagcagcacaagggaaaatctcggtattccttacaccgggactacgtttggatgtatttacgcattgcgtacgacatgtacgacctcggaacggagaaaagcgaatttgaacacacttttaccaagatggaaacaatgatgagaagtaattagcggggatttgattgattgggatttatggaatgaatgaactaatgagagaagtaattagtggggattcgattgataggaattatggaacgaatgaaagaaatgatgataagtaattgttgatcaagttggtccctgattttagtcgtgaaatagcgattgataaggtgacccgaaaattgagcaccggaaaattttcttgggtgtctaatgttccggtatccaatgtgagggggatgtatctttaaatgggtatccgtgattttgtctaaaaaagcctttgtttaccttagaacaaaaaagtcctaaatgattca

SEQ ID NO: 84633 - DNA, 357 bp, Heterodera glycines
  Genomic contig location: Contig_ID=SeqID_19874; Location=615..971; Strand=+
  SCN-specific regions: Sequence locations=1-262,284-357
aacaaactaaggtcgcatttcatagtttcgggaaacaccagtgagaaaattgataatgttttcgggattcacattggcattggcataattgtgatcattttgggggaggtgaatgttattgatgtcgttatagagtgcgccgtcatgttctaacttaactttgtttcgttttgttttaattttttgctgctggtccatattatataatttaaatgggtcggggtcacttcggcgcggaccatttcggcgccgcaaattttgaaatgctataacttttttatttgtcagttaactttagccaatctggcatcatttgaaagctctatgtgtgctctatattcacatgtcaaaatagaa

SEQ ID NO: 84634 - DNA, 1198 bp, Heterodera glycines
  Genomic contig location: Contig_ID=SeqID_19875; Location=693..1890; Strand=-
  SCN-specific regions: Sequence locations=1-133,156-878,902-1130,1152 -1198
gtacattgatcattctgtgctcacttttcttcgttccaacaagcatatttgggacagaagtggcaccaaattggatttatatgcggtgtttaattcagaaaccaacgtccagccaatttgggatgtttttgtccgccaaatttggcccatttttgcgacaaacattcaccatttgggttttctctgtcacaaccattttgacactttgtgtcgccacatttcgccgacatttctcactgattgcactcgactgcattctgtgttttccgatcagctgtgccccggtgtaattgttgctgatcagtttgatgatgggcaaccaaatactgcaactgcttcttcggctggccaagcgttgtcaaaatggttgcacactccgacaacaaatggacaaccgaagcgattgcgttgctgtgagcatcaaatttcaaattttgaatgggtcaacaatttcaaaggggtgtgttgtcggccatattttcattaaacgatctgactaattaattaattgcttttttattgcgcttcctttttgtttagatatttctccgtgccaccaccaccacttctgttagttacacaattcgttttggagttttgtggccaacaacacaaatcgtgccatttgaattggagaatgaacggaccaaagaaaagctgacactgaaagagggtgataacatttattggctgttggagcgatgtccaattagtgaaaaggcggcggcggttaaatgggaagacgacgaaaatttgaacaatgtcgaattaaatttgtgggctggcagtgattacattgggtgggcagtaaaagcaatgtttgattttgtcaaaaaatgaaaaaattaattaattttagtccattgtcgccaccagcggaagaagaagacgaagaaacggatgaaagcaacgaaaattatatttgagaaatgatcgacgcgatctcaccaataggaatttgatttgatgctctcgttttatgtcagaaatgttttatatgtagggcttcgatttttaggtgctaaaaactgccaaaataagtaggttttaggttctaaaaaacccccaaaataggtgctaaaaatgggaaaataggtgccaaaaagttccgaatttggggtgtaaaatcgaaaattttcttcaaaaagcaaaaatattatgccaaatcattaatgagatagataattttcaaaataaa

SEQ ID NO: 84635 - DNA, 76 bp, Heterodera glycines
  Genomic contig location: Contig_ID=SeqID_19875; Location=335..410; Strand=+
  SCN-specific regions: Sequence locations=1-76
tttttcctgagctccccgtggcctgaaacgcacgaaaaacatgtttttttgggctgttgttaagctacttttcgag

SEQ ID NO: 84636 - DNA, 78 bp, Heterodera glycines
  Genomic contig location: Contig_ID=SeqID_19879; Location=179..256; Strand=-
  SCN-specific regions: Sequence locations=1-78
tagcaagcatgcaacatcacaattaaaataagtctgcctatttatagtcgtagctcggcttctgatcacttccatact

SEQ ID NO: 84637 - DNA, 579 bp, Heterodera glycines
  Genomic contig location: Contig_ID=SeqID_19880; Location=819..1397; Strand=-
  SCN-specific regions: Sequence locations=1-139,161-176,198-579
accaaaaaaaaattgaaaagttttttatctatttttccaggcgccaaacattcatcatatattcaatgatgaaaatggaattagtaaaatttgtttgacgccaatttcagacacttgagacaaaatttgcggacgaattggccacccaggagcgcttctacggcgcggacggcggcacgacagcggctgcggcagcaatgagttcatctacctccacttcgtcgtcgtccaacggcggtggcggcatttgtcccccggccgtgccgcaacatcagcagttttcccttagcggaggcagtcatcaacggcacttttgatggattaatgatggcaaaaaaaagaaaaaaattcctgcagaaattattgccttattatttttattatcacattattttgacgcatcattccttcctttgtttccattggttttgtgtcacattttcgcatcaattttagcccaaaaatgattgttcagaaacagtgaaaagcacacacactatataagctattgtaaacaagctacatacaaatgcatctttttcattgtaatttgccagtgtttaagtgatcaatccgtct

SEQ ID NO: 84638 - DNA, 490 bp, Heterodera glycines
  misc_feature (36)..(36): n is a, c, g, or t
  Genomic contig location: Contig_ID=SeqID_19882; Location=742..1231; Strand=-
  SCN-specific regions: Sequence locations=1-490
attaggaggggtttgttggtacggtggtcgagatgnatgagaccaaggtgtatagggcaaaataccatcggggtcgaatgttaaatcgcccatacgaatgggtctttggcatgattcaaagagggtctaataaggtccggttcttccctgtgcccgaccggtctgcagacactcttctgcccattatcgctgaaaatattgaggtggaaagcacgatagtagcggatggttgggcggcatacggagggataaataatatgcagcagcaatacaaccacgagtggataaatcatcaaatttacttcgtagatcccgccaaccctaaaatacatacacagggaattgaggctacctggagggctttcaagcagtctgaaacatttacatgggaccacccccgaacttttacctacttatttgtttcagtacgcatttcgtcgatatcaacaaaacacaaaaatatttcagcatattttggaagaaatgcgcc

SEQ ID NO: 84639 - DNA, 1060 bp, Heterodera glycines
  Genomic contig location: Contig_ID=SeqID_19884; Location=244..1303; Strand=-
  SCN-specific regions: Sequence locations=1-556,578-763,785-785,807 -1060
atgacacattttggaagtggaaaaaacaaatgctgccaaatgatcataaaagtaagggtttttctttttaagcatataataattttctattcagataagtgtttttcctactaattagagcatggagaatccaggaaaaaaatatgcatttgcataaaattgacatccctacgcataacaaatccatggtttcgtgcaaaaattgactcaaatgaatcttattgttcataaaatgattcaggaatcggacgttgtacgtagcgaatacggcgcattttctgttcaatgtacagcaaatgtgttcatttgttcattggacgaaagcccgcatcccacgacctggaaaggctcaacaacatgccaacataatgtgtccacgtgccagttctcggccaaattgtccatcggcatccaaccgactgtggcgccgtttaaattttgaagataattcgagctaacttacgtttaaatgtttaaaactgacaatttaccaaaaaaaaaatttcttaacaaatctaacgcaaattatcttaacgcgaaaaaatatatgcagatgattttataagttatttaaattttcattatgtaatggtatttttgaaaacaggcagatttaaaaattctttcagtttgcctttatttaaacttctaaattcatcagatcgttcaatgaattctttcttttttaatgggtttttctcttttaatcggtgtaaaggcaatgaaacctggatgaaatttttcgtaattattggatgaatcacttttttatgcctattttaggtagcttttaaaaaattaaatatccaaaaatctgatcaaaatgttattctataaaccatattaatgggattttttatctttcgtctaatttcaggacttttttgcattttatcgtgcttttttgaatctttttgttacatattggtgattttttataacttttttagtcgactttttgaagatttttagtgacttaaattcccagccctagttatatctaacgttataagtagggacgggattttggtgtgctaaaaatctcgaaatatgtaataaa

SEQ ID NO: 84640 - DNA, 1717 bp, Heterodera glycines
  Genomic contig location: Contig_ID=SeqID_3426; Location=506..2222; Strand=+
  SCN-specific regions: Sequence locations=1-1655,1677-1717
atgatgaatcgtcaaattgatacaaaaaagcaaaagcctaaaattacctatgaaggccagctttacaccttcgataaatcaagtgcggacggaacgagaaaattttggagatgcgaatacaagaactcctgcaaagggagaatttggagggatttggacgatcaattcattcgtttggcaactcctcatacctgtccagtgaacgcagcaaatgttgaggcgcagaaagtgaagacggcaataaaacgacgagcactcaccacgttagaaccgccagcagtgatccgatccgaagcacttcagaatgtgccatctccagctggacttttggttacgcaggatgcttcaaaactggtactgtttagtcgatgatatgaaaagcaatcacgaaagaaatcttaaggtaattaaaagggcacggcacgaagtcaatgcaccacctgcggttccacaaagcgttgaccagctattgttcctcccgcataccagacgtacgagtcaactgacggcgaagtggagcagtttctgttggctgactctggtgtgtattacgaggccggaaacgaaaacccgcagaggtaattttttttaaaaactataatccattttactaattttttcaaggattctgctgctttggacgtgaatctttcgggcgatgggctgatcgaatgaaagactgcttcggggacggcacattctcattggcacctccgatgttctatcaaatctacacaattttggccaagtgctgttttaatttgatttcacgtgaaaattgttttaaggcgtgggtcgtgggttatcgtcgtgtgccattgcttgctgacgtccaagtcgcaagcgtcctacgagaggatgtttggacttctccgtcaagcgtggccgacattctcgcctgcctcgttcaacatggacttcgagacagctgcgcgcaacgccgctgttgccacgtttcctgcatgcgaaatcaaattttgcttcttccatttcgtgcggaatttgcaaaaaaaaatcaaggaacaaaatctctggcaggtcagtaagcatattcagtttgtttttgtaattttcgtgtctattcagagatactgtactgacacagtgttggctgagaatctgaggatgctcacttctgtcgcgtttctaccgctcagtgacatcagaacagcagtcatcgcattagacacggagttcgggaacgtgactgcactccgtccgctcattgactggttggttatattattcagatgcattcaatttctgtgcaatttttaggttgctcaacaattacattggacaaccccggccaaatggaacttggtctcaaccactcttcccaccagagcagtggaacgtctacactcgcacactgaacggggaagaaaggacgaacaaccacgcagaggcagaacatcaccgtcttcaaggcgccttcaactgccgtcatccatcgatctggcacttcattgacgttctccgccgtgagcagaagggcaccgatgggaagtatgcgtcatttcttgctggacttgagccaccgcggaaagctaagaaataccaagcggctgatgagcgcctcttcaatttggtgcagaattacatcccggtgaacccgaacaatgaaaatgatcacaattaccacataaatccaaattttcatattattttagaatttctccgtggaatttcgcgcaattatcatatgaacccataa

SEQ ID NO: 84641 - DNA, 738 bp, Heterodera glycines
  Genomic contig location: Contig_ID=SeqID_3426; Location=2845..3582; Strand=-
  SCN-specific regions: Sequence locations=1-177,211-267,289-498,522 -685,735-738
atgggattgccaacatgcactgcccaaaccaccgcaagcgcagcagcgactgcgtcctcaacaccgccgtcgacgaccgttcggcctggcgcggctgccgttcagttggccgcactgttcgacccaaaccgaccaccgccgacactgacgccggaaatgctttctgccggtgcgggtccaacaacacaaccaccaacagcaacaacaccggcagttacggctccaacgaccactctaatcagtggcggggtcgccggcggcgctgtgctctccgcgccgccgccgatgtattccacgacgacgacaatggcactttcggcggaggactcgttgtccgtttgggagaactttttgaagcgcaaagagaacgaaaaggcggagcgcaatttccaactgatgcgcaacaatagtgccggaggcagtggcatttatcagcagcagcaaccgcaccaacacaaacatcaccggacagagcatcgagactatcaccatcgagaaagggatcgagatcgggacagggagcgggattatcatcaccggagcagaggaggcgaagggagagggaccacgaggagggatgagcagaacggaggcagtggaagagaagggaacagcagcagtcaccagccgaaaatgaccgtggaggagaagagcacggtgtggaagctgttcgagaagcactacgagaagaaggacaagaaaggagaagaaaagaatgaggaagaagagagagagtag

SEQ ID NO: 84642 - DNA, 622 bp, Heterodera glycines
  Genomic contig location: Contig_ID=SeqID_3426; Location=4196..4817; Strand=-
  SCN-specific regions: Sequence locations=1-46,92-122,144-264,286 -321,343-576,598-622
atggctcaggaccaacgacaacagcagcagactccgcctccgaccgttgtgagatagaaaaacgagtgcttttaaatgaaaattcaaaaaacacattaaatttacatttaaaaatgaaccattttaccaatttcagtctggtgccaacaaaccgagtgtgctgaccgacactcattcgttgctgcacaaactgttgcccggactggccgctgcgcaagcacagcgcgagttggacaccaccaccagaccgacggcaacgtcaacagcggcacccgacgggacgccaatggtgggcaaaacactggggagcagggcactgggaaaagcaagaaataattaatttttgttgagaccggtgagacccgtttgtagttatggacacctactccaattccattcctccgacccccgagggcattcgttcgtaaatggtcagaccgccccttccccaccagggacgggcgaagctcggctcggcactcgaagccgaaggcgaagcccaatttttttcgaagcacgaagttcgaagcccaaaaaccgtgaagtttcgaagctttcgaagctcgaagtttttcaattttttaatccaaaaaatttatccagatagtaaaattcaattaaa

SEQ ID NO: 84643 - DNA, 204 bp, Heterodera glycines
  Genomic contig location: Contig_ID=SeqID_19885; Location=366..569; Strand=-
  SCN-specific regions: Sequence locations=1-88,110-204
atggccgccacagaattatcagccggcgtttgggcctccgccgccgctgcttacacagcaacaaaatgtaaaaatgaacatatgttgatttctaatggctttctccttttcgagatccttcagccactctctcgtccgtcaacattcaacacttatcgccgtccacgcaccgctgctaatttttcaggaaaactcaaaaaacag

SEQ ID NO: 84644 - DNA, 63 bp, Heterodera glycines
  Genomic contig location: Contig_ID=SeqID_19885; Location=1721..1783; Strand=-
  SCN-specific regions: Sequence locations=1-63
cacttgtatatttcaaattaatataggtaaatattgaactttataaatttacatgtaattaaa

SEQ ID NO: 84645 - DNA, 823 bp, Heterodera glycines
  Genomic contig location: Contig_ID=SeqID_19886; Location=111..933; Strand=+
  SCN-specific regions: Sequence locations=1-823
atgaaccgttgtaattataatcagaaaattaaaacatcgaatccattgtacggacgtggatattttatcgagcagaaggaatacagtaattctaacggttgcggatttcgtaaggcgaatagaccgcttgttccgagtaatgcggccgacattgagagttgggagccaaaggtaggtcaaatacggtagttttaagaaatgtttatttttttacaggtaatgagcacccaagaaattagcaaattgactgctcgttgcgtgggtgtcactgatgcgtttatcaaacttgacaattacgtggacagtgtgaagaagtacaacccgtcgaatcatgatttgcttcgggttgtgtgtccttttcactgaccatttgatcaaagcattccaagttcagatgcaacgaatgcagcaccagtcaaagacattgacggaagacccggacaaatacgccgaacttattgtccaatgtgttgcaaatccaaacaagtttaatgggactcgccactgtttggagcttgtcattggcagacgagcacttgaggaatttattagtcgcaacgaatggacggaggaaagactgaaggactacgacattaagtgcgtttggccatccgatggatttgtttagttcgtttctaacagactatcttaaaataacttttttttctaatttagtgcaaattggaagttcgagcccaatgagttgactgtcccgccgattcccatttacaccgggtcactttcttctgcttgatatatttgaccggttaatgtgactattgaatatattttcaatatttgttttcactttttgacgctcata

SEQ ID NO: 84646 - DNA, 994 bp, Heterodera glycines
  Genomic contig location: Contig_ID=SeqID_19889; Location=1530..2523; Strand=+
  SCN-specific regions: Sequence locations=1-263,286-293,315-422,445 -598,623-743,771-994
atggcatcggataaacaagcggtgactaaatggcttttcactccacgtccggacaatgtgccaaaggtgttcaactgctacctgggcaaggatgatgcgagtttgacgtcgaaagttgaagcattcaaagcggcgtttatttaattgattcatttgccacttttacgggctttgggattctctgacaaaagcatttgcctaattaaacattgtgtggacaaaaatggtctctttctaagcgaaaagtgccacatttctcatttctttctcaatttttaatatttcaggcttttgcctcggcttcatctcctgccaatttcatcatttacgtttggtttccttcgtcttttgctgactccgatgtgccatttgaactgatcaacgaattgactcgtgaacaattgacattggaaaggattaacaatagcaaccgttttctgctgatccgttgtccaattgagcgagacgaaagcaaatggacaaaatgggaagaggaagcgattgattggcgaatttataatcagtgtaaccttcacattggaatttataatgatgataacatcggcaaaaggttaagcgaatgctttttcaaaaatccgattttatttggttttatttttaggcttctcaacgcaactcttgaaccaagtgatcagcagcagaagtgaatgtttgttaagaagtgatcgatcaatatgaattgcgttgttggataattatttttgttgcggtgattcaattgtattatatatatgtgtgggtatatgcctttaggataaattagagatttcctgaaatcccaggctcattcttttgatctaatgataaagtcggtagtcactgttccttcaataactgggtcgtcttaagtaccatttattaaacgatgttgacccgtttcgtttcattgtgccccccccctcgattttttagcaaagtcagacaaattaggacagttggctggatcagagaaatgtggacgattggcctacta

SEQ ID NO: 84647 - DNA, 422 bp, Heterodera glycines
  Genomic contig location: Contig_ID=SeqID_19890; Location=1621..2042; Strand=+
  SCN-specific regions: Sequence locations=1-40,65-186,228-317,339-422
atggccaccttcaaaacagctcctctcatcgctgttgctcttctgatccattttggatgcttaatgtttttgatggaagtgaacggtgaagtccatgttcaaaggtgcggcaaatttgtgaattcaattttttgccaaataccgaaaattttctaaattttcggatgatagaccacgtgaaagatgaaaaatttaatttttaattaaaaattttgaatttttttttagctctctggcaccaagtcatcaagtggtaaagcgtcattgctcttgtggtggcagttggggcggttggggtggcggcggtggagcatgtaaaacaaattttttataaaactaaaactcaaattatggtctggaacagaccgggccgggattggatttgagaaatttagggtttcacacaatccaattctaaggga

SEQ ID NO: 84648 - DNA, 285 bp, Heterodera glycines
  Genomic contig location: Contig_ID=SeqID_19890; Location=2138..2422; Strand=-
  SCN-specific regions: Sequence locations=1-285
atgttgccgcattggccacaggaacagcctgaaattgtagcaacactcgacatgcttggcgcccttaaattgtgagtgccaaggacgtccttgggaatcacggggatttcaaaaaatttagccatctgagccgtttcaatttatataccaaaggggattgggcatctccaaagccacaaattttgaaaattcaggctcgcatacttcagacggtctattccagaaccgaattcaccgcctgaaattatagcaacaacccatatgctcggtgtccttaaattgtga

SEQ ID NO: 84649 - DNA, 532 bp, Heterodera glycines
  Genomic contig location: Contig_ID=SeqID_19891; Location=71..602; Strand=+
  SCN-specific regions: Sequence locations=1-4,26-141,163-184,219 -426,523-532
atggacattttgaaagaggtgggacttcacgggaggatggcgcagtgggttaggacgaagttacccatgaggcattctcgggttcaattccgctcaatgatggacaaaatttaccaaaaaactgagaaaaaatgcggaataacgacgacgaggcatttgtctgagagcaacgaataggccgcgcttttttaatgtttaaaaattaaattattttaaatctaaggacatggaagccgaattgcttttgtgccacgaacgaatgaacgcgttggagacgacatgcaataatttggcacttttgttgggcggtcatttgggcggtagcgaatcgaacaaaagttgcgcattggaagaaaacgaaaagggcgattatttggcacaatttgccaatgaatgcagccgaattcggaaggaattgcagaaactgaagaaaaggtggagagaaaggaaataaaggaattttaacaaaaaaggaagtgaagaaagaaaagagagagaaaaaaagagaaggggcgaaaaagagcagtgagaa

SEQ ID NO: 84650 - DNA, 699 bp, Heterodera glycines
  Genomic contig location: Contig_ID=SeqID_19893; Location=1376..2074; Strand=+
  SCN-specific regions: Sequence locations=1-58,81-319,342-502,524 -565,587-699
atggctgttcgttcgatcattttactttatttaaaggtcgaacatttgcaattgactaccaatggtacaacttcaaagtgcgaaaaagtttttcttatcgataatgacgaaagatacaatagccaaccggacgaactcacggaagaagtgagccattggaatttttaacaaaaatctacaaaaaaaaacaaagaaattgagattgacgggttgtggccaaaaaaaaattactcgaacaattttttttttgttgaaaacttacaggctataggacttgtaaatcgcctttaatcatacaataaacttttatttaatttgagtgaaaaattgaaaaagttattgcgtttgactgacgccaatgtgacctgggcccgaaatttgctctcaccattttgtagtttgagtttgtcgatcactgcaataacaacaacaactccaatacgctcaacaatttgtgtgaacgtcggatgattgtgagctctgagattaaagcggatcatcactttaacgagtcagtgtccattttcccattgtctgatcgagagcatagtctagttgctgttgtaaattttgggcctttttggcaccggcatcaaaagtgatcagaaaaaatcgatcaactttaacaccttggtaggagccacaaactttttttttcaaatgaacagaaagaaatctcttttttggattttatgaata

SEQ ID NO: 84651 - DNA, 580 bp, Heterodera glycines
  Genomic contig location: Contig_ID=SeqID_19894; Location=674..1253; Strand=-
  SCN-specific regions: Sequence locations=1-517,539-580
atggacgaaaacgaagatgacggcaacaacaccgactgttctatttcacgccaattgttccaaatctgcttgacgcttctacaacaggtccaaagccaacagagtgaacttttcactctcaaacagcggcaaattgcggacgaagctgtgcaagatcatgagcggcggcgaagcgttgtcgtaatgggtctacccgaatcgcagaaacaaaagccatccgagcgagtcgctgcggaccgaacggccatctcaggcgttctcgatgagcttggcatcgagagcccgatcactgtttacagaatgggttccccggaccaagcaaggacaggtcaaaaccgcccgcggttgatgaaagtaattttcggctgctcaaaacatcagagacaaaccttggcacaatggaacaaactgcgcgctcaaatcaatcaaaaactggggatgagcaacatcaaaattcgcccttcactcagccaagaggaactcaaggcccggcccgtcgtgtgctgcaggaagagtgcagcagaaaaagaaaggaagatggcggcgagtgggtggtttacgctgacaaagtgatgctgag

SEQ ID NO: 84652 - DNA, 125 bp, Heterodera glycines; identical to SEQ ID NO: 77866
  Genomic contig location: Contig_ID=SeqID_3429; Location=1149..1273; Strand=-
  SCN-specific regions: Sequence locations=1-98,120-125

SEQ ID NO: 84653 - DNA, 382 bp, Heterodera glycines
  Genomic contig location: Contig_ID=SeqID_3429; Location=1499..1880; Strand=-
  SCN-specific regions: Sequence locations=1-382
atgacaaacaatgagatggctgagcaatctgcatttcaatcgaaattaatgttactacggttgaagaaggttacccatttaacaattgatactgacataaaaggaaatggtgagaaggaagctgaatttgtaagagagtgcaaagagaaattagagatcttaacccaacaaagatagctgtgaaccaagaagagtaggattgttaaactatgcttgaacaatttgtgcgacatatttctttacgaaattacagcctttaacagactttacttcaataatgatgtacttgattttggagaatatttgggataatcgttcaatagacgtaatggccatcgaggattgaaaggtgtatcatgttttgattacctacgaaaataaa

SEQ ID NO: 84654 - DNA, 717 bp, Heterodera glycines
  Genomic contig location: Contig_ID=SeqID_3429; Location=2368..3084; Strand=+
  SCN-specific regions: Sequence locations=1-292,314-460,482-515,676-717
atgctaaacatatccgcttacttctattgcagttctctctgtttccaactattcatccacagaataatgatcaatttgccaagtgttcagttgaaaagttattgatctagaaatatcgcatacaggccttatactagtcatacattcctttagtacatcaatgggtactaaaagacgctgccttcccttaataatgccttagttcctttgagacatcaaataattccctcctaaacgataccagcaatgtcattaaaattttcaatgtcattacattttttctcattaattgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttaggtataatttacttaattttaatcaatactattgtatttattatttttattatattttaatacaactttaatttaattttaatttaattttttaatttagttttatttatttttatttatttaacatttattttcttttaattttaatcttatttttattttactttttatttgaattaatttgaattttattttactttatttattattcagtaatttaaaggagttgttcagaacctctatcca

SEQ ID NO: 84655 - DNA, 987 bp, Heterodera glycines
  Genomic contig location: Contig_ID=SeqID_3429; Location=5286..6272; Strand=+
  SCN-specific regions: Sequence locations=1-174,203-219,241-323,349 -430,452-923,957-987
atgaattctgtgccgagatatggcatgccaaagtttttggcatttataattggaaaagaactaattattttcatttcagtaagaagccattggtgtagagatagtgcgttagtcaagtcttttttaagtcacaggttcgaatcctttgcgtgcaaaacctcaatttgaagaagcaatttaatttaaaaaaacaataaaaattgaaaatcggatgattccatgaaattgaaaagaattatttcagatttttcgtcccaatttgtcgcttttcgctcctatttacgtccataaattttttcaatgttttgcccctaaaaacccgcgccatattaatgagaaaagcattataaatatttatcaatcagcaaaatgctcactgctggagggcgtgggttctattcccagccgaggcctaagattttgccaattcttattaataataaaaactcatatactttgtaagagtgagtcgaaattgtcgggtttttactcgtttaactgccgaagctctaggatttcattattttcacatttatttctttttggatttaatttccctttttactaattgtaccgctctcccagcgattcacttttcacttgtatttaatgttcgccttttcaagcgaacggagctcagtcgtcccgagaataaagccacttattgtgtgaccagcgagtgtgggaaggcaaccccgggcttgatcaccccgtggacccatccttcgggaatatgtggcactttccctttccctccccattccgaattccaattcccaacgccagcacgaccaccgcgcccggccgcgctactggtagcaccggatggttcacttttgtgaacttttcatcaacctgggcggaacaggaacagcgaaagggaggtgagtttgagtgagggacattgaggaggcgcctggtgtgaaggaaaaggagaagaagaaaaacgcttcggcgatttaaatgccccggggatgaaaaatgaaa

SEQ ID NO: 84656 - DNA, 929 bp, Heterodera glycines
  misc_feature (414)..(414): n is a, c, g, or t
  Genomic contig location: Contig_ID=SeqID_19895; Location=368..1296; Strand=+
  SCN-specific regions: Sequence locations=1-198,221-356,386-396,434 -640,663-681,720-781,803-845,867-929
atggaaatgatttggctggggaccaaacgaatcggacccccattaaggagattgaaaaagccaaatctccaattggctgaagtcaaaatgcgctgtgaacatcagcacgtgccaagagggcacctcagcgattggacatggacacgtcgaagccgaagtacgacatcgtccggccatgacatctcgcgcaggagggacttttccaaagaagggaggtgttggataagggaccacactgattattgattatattttccctttcactccctctcttattgtctctctcccgccccttgaccagccccataaatatgtctccctttccctcactcggggcattctcccattcattccaccatttcattattttatttatttattccctgctgtcctccatatttatttgtttaatanattatttatttatttatttgacaacatttgttttggtcgaagaccaaacatttttattgttgtagtaaatacacaacacttacataaaaaatgaagccctgataatcaatccaaagcaataaattctcattttttcatttatcaaataatttcacaattcctgtcatcaaattaaattaattaacagaattattgtcaattgaaaatgcaatttcccctgttcttcattttaattatatttttataatcgatccaagcaataaattctcatttcttcatttaataaataattcataaagataaaatttcctttttttagaattgtaaattattactaaatttattgccaattgaaaatgaaattctgtattttattatttttatttttgattgccctaattattccaattgaatcagaaaagaaaaaacttcagcagaaatcatttgatgcaatatttggagaaaaatgggaagaaaaagaagataaaagggaaataattgaaaaatattataaa

SEQ ID NO: 84657 - DNA, 406 bp, Heterodera glycines
  Genomic contig location: Contig_ID=SeqID_19895; Location=1719..2124; Strand=+
  SCN-specific regions: Sequence locations=1-57,239-351,376-406
atgccaattgaatcagctaatgaaaaattacaacagaaatcatttgacgaaatatttggagaaaaatggcaagaaaaagaagaagaaagacgaaatgaactcaaaaaacgagaaataattggaaaattttataaaataaaagagaaaataaagcaaaaaggaagaaaatattcagcaaaagaatggaataaaattggagaaaaaatagcgaaaaaaatggggacaaatcgaaagaaaatttataaatggattaaagaatttggtcttcaaaaacgcaaatcttacaaatcaaaaactgatgaagaaaaaattgaaattgtactaaaattcattgaaatgacaaaagaatataagcaaaaaagtaaatattcacaaaaggaatggaaccaaaattatgccgaaattt

SEQ ID NO: 84658 - DNA, 268 bp, Heterodera glycines
  Genomic contig location: Contig_ID=SeqID_19897; Location=953..1220; Strand=+
  SCN-specific regions: Sequence locations=1-66,88-180,202-268
atgcagatagtttggattacggtatgaattttccgtaatttaatccatcactccaatttaagttgatttccattaatcattggaaaagttaattacggacggagtgagaaattgattttgcaggtcgaagccatgactattaaagcatgtaaatgaaggaaattaattgttaattcgtgacatttgtaacacagttttcagagagtctctgcctttttatgccaaacatttgacagtaaaatattctgataaaatttttctcagttca

SEQ ID NO: 84659 - DNA, 764 bp, Heterodera glycines
  Genomic contig location: Contig_ID=SeqID_19898; Location=247..1010; Strand=+
  SCN-specific regions: Sequence locations=1-225,270-438,462-564,586-764
atggacccgagcaatggattgtatgacaaaaaagagaacaaagtgacattggccattgatgtcataactgttgatgagccaaaaatggagaaattcatttccgatcccaacaaatccaacggcacactttcaatggaaattgaaaaagtgtcggaatttgcgcgagaaatctttgagagtgaacgtaaaagcgaaactgtgcacatcaaaggattgccatgggtgaaaattactaataattaatatatattaacaacaattaattaattgatattgagcagaaaattggagttgcaaatgttcttcaacttttcgaattgtttcgcaaaagagcggcgtaaaggatttaaggagagaattaaatgacgatgtttttgacaataaaaacagaggctggggatatgccaatttcatttcatttgctgtgagtgacaattcaaataaatagtgcccaattaaattttaacataattaaggaactgatggacccgagcaatggattgtatgaccaaagcgaggacaaagtgacattggccattgatctcagtgtgaaagaagcgaatattgaggagaattcataaatacccaatatgatctggcaaaaatctcatcattgaattatcatcctatgggcctgctgtgtttagcttctttcttattgtttatcttttgggttttacaatattgatctatggattattaaagcggctttttttaagcattgaaatgaaattggcatatcccctgctgtgctttctattcaa

SEQ ID NO: 84660 - DNA, 491 bp, Heterodera glycines
  Genomic contig location: Contig_ID=SeqID_19899; Location=1021..1511; Strand=-
  SCN-specific regions: Sequence locations=1-491
atggatttggccaaatcactgctcaccgagtgccaagcggagaatgtgcagcgaattgtggccgcactgagcgacggacagcaaacactgctcggccacgtggagagcgaacggtgtgccgtgaaaaatgccaactgttttttattttcaagccaaattccggttttttggactgttttaaaatgctaatttcgaaatttcaaaacaattttgtgtaaacgaataatattaattacctaactaataacggaacaaatcattttgtcagcgctcgattgacctcgcgcgacgcggaggagcgcagtgccgcactgaacgaactgtgtgccgtcgttttgcaaatgctaccttccgccgccgctggagggaagcaaaaggccgaagggcacgtcaaaattgtggcgtgggaaaatgtgccgatcactcgaccccaaattgatcagttgcttccctttttgctgtccaaagtgaggcaaaacgctggagattga

SEQ ID NO: 84661 - DNA, 1407 bp, Heterodera glycines
  Genomic contig location: Contig_ID=SeqID_19900; Location=1..1407; Strand=+
  SCN-specific regions: Sequence locations=1-1020,1049-1407
aattccacaagtatcttttcgggagacacttcgttctccttttcggaccacaagccgttgttgtccatttttcgcaacaacaagggaataaaggcttgcacagcgaatcgattgcagagatgggcaatcactttgctcggctatgacttcgaactcgaataccaaaatactgtgattttggtcaagcggaagttttgtcgcgcctaatcgcgaagacaccagtgccggacaacaaagtgatcattgcaaacattcgtgaaagcaatgaaacgggagtgttgaattttgttgcgaaaactctcccactggatcacagtgatttggctaacgccgcgaaaagtgatcaggtgatcaaaaatgtgaagaaatttgtctgctcacattggccaacaaagaacaaaatgaccgcagacattgttccgttccatcgacgacgagacgctttgaccatcgaggatgaatgtctgctttatgcggacagagttttgattccggcatcgcttcaaaaagatgtcttacaacttctgcaccgaggccatcccggaatgaagtgaatgaaaggtctccccaggcagtacgtttactggcctgggatggacgaacaaattgaaaattttgtcaaaatgtgcaacgaatgcacaatggaggcaaaaatgccggtgaagactgagcttcagtcgtggccgaaagctgacggaccgtggaaacgcgtacatttggattacgccggaccgttttatgggaaaaatgtttctaataattgttgacgcgtactcgaagtggcccgaggtcttcaaaatgcgttcatcgaattccgcggctacaatcgacaaattgcggtcactctgtgccagttatggccttcccgaaattttggtcacggacaacggcacacaattcgcttcaaaagaattgaaggaatttgtgaccgaaaatggcatcaaccatctgttctccgctccgtacaatcctatgtcgaacggacaagctgagcgttttgtcgatacgttcaagaggacatgccggaagatcaagggagaaggagcctcggaaatgttgaccacatttatggcaacataccggaccacgccttgtgaggctttgccggagtgcaaaagtccggacgaattgttcctgggaaggaaaccgcgcacgactttggacttgttgaggccaaaggcaaaggcaccgataattcgagacgaggccatagagaagcaatttaataggcgccatggagccaaaccgagatcttttgccgtgggcgataaggttctcgctcggcattgtctttcgcagccttggcgccccggaaaagtcaccaaatgtaaaggtgtcatttacgacgtcgaattttttgacggaaaattcggacggttccatgccaatcagttgcttgtgagaagc

SEQ ID NO: 84662 - DNA, 440 bp, Heterodera glycines
  Genomic contig location: Contig_ID=SeqID_19901; Location=1306..1745; Strand=-
  SCN-specific regions: Sequence locations=1-242,270-386,408-440
atgtctaattattatggaagaattggacatttggttggcttcaatccgccgtcaaaccgtaatgaagctgaagaaatgataattgaagaagatgcaaggcttttgcttgaacaaagtttggatgaaaatgggctgcttgttgatcaatactttgaagaaatgggtttgaatgaagtgcaagatgaaaactcgcctgatgttaattcagaggatggagaagtggatatcatgaattaattcatatgaatttttatttaacttttatatttgaagatgcttaaattttacattgttattaaaatacatgaaaattgggtcagaatcatttagactgcaatttattagcgctgagtcttgtttattgagcagtagcgtgtaatacataaaaattttcattgaaaatgaagtttttaaccaaaaaaacgaatcgggataataaa

SEQ ID NO: 84663 - DNA, 285 bp, Heterodera glycines
  Genomic contig location: Contig_ID=SeqID_19901; Location=1762..2046; Strand=-
  SCN-specific regions: Sequence locations=1-137,160-285
atgtgcgcgtttcatgtgaagcaagcgataaatcgccgaattcaatcaatgggatttatgcaattgtacagctcaaaagaaccaaatggacttgagtttgtttgtctctaacttttgtatcgtaaatgataggaactaagtcatgctgaagaagaaaccgcagtggccgttgatgaaggaagacaattgccagctcgcccgcttgaattactcttgaattggacagaggaattgcctcagcgaggcggatattttggcttttttgaacacggattactgcaatga

SEQ ID NO: 84664 - DNA, 183 bp, Heterodera glycines
  Genomic contig location: Contig_ID=SeqID_19902; Location=146..328; Strand=+
  SCN-specific regions: Sequence locations=1-183
gccaatcacaattggcaagggccgtcgtgtcacatcggcagcatttatgtgcggttacaagtctatgccgtttctgtcgcccgacagtccgctgaaactatttgttaagggcaaatctgagggatttccattgcccgaccgtccgctgtccaacaaaattcgcattaaatgccttcaaattaa

SEQ ID NO: 84665 - DNA, 414 bp, Heterodera glycines
  Genomic contig location: Contig_ID=SeqID_19906; Location=917..1330; Strand=+
  SCN-specific regions: Sequence locations=1-16,41-414
atggagcttggaagccaaaaatataaattaaataaaaattcatcatcattatcaccatcaccgttgtcgaaaaagcggtggcttcctgttgaacttcaatttgaaattgcgcattggctgccgattaccgaaagcattgaacgcccattaatacaagcagcaaaatttccacttgttatagccaaatgtgttctgagtcggattgaaaagcgcaatattttattattccctgaagtttatttaaaaaggattcaaacacaaatttttaaaattcagcaagacactttttaccaaatcgagggcattgaaacatccagaaaaattggcaaaaaaagagaattatttataaaatgggtcggctatccttattcacaaaatagttgggaagacgaagaggaaattaaaaaggtttaa

SEQ ID NO: 84666 - DNA, 113 bp, Heterodera glycines
  Genomic contig location: Contig_ID=SeqID_3431; Location=322..434; Strand=-
  SCN-specific regions: Sequence locations=1-13,35-113
ctcaggtgggattgaacctgggactccctttttggtggcaaactcacagaccactaagacaaaaaatcaattagtttttgaactgggggctcaaaattgactcggtgtgttaa

SEQ ID NO: 84667 - DNA, 454 bp, Heterodera glycines
  Genomic contig location: Contig_ID=SeqID_3432; Location=475..928; Strand=-
  SCN-specific regions: Sequence locations=1-204,226-454
atggggattgataagacccataaagaaatggcggttatgatacggtagctcaatggtacaggtgcccacggaatcggtggacgagtcctacaaaatcccagttaaaccaaccatagggcatatttttagcttttaaattatttaccaaagcactgaaatttaaaaaagattttcaggaaatttttgttcggctctgtgagtccggcaaatgttctcccaaacattacggtatctgctgaacgacacggaatgcaagtcagaaatgcgttgggtgaaaatttaattgtgccgcacaccgcgcaaatgtaccaacgccaattggcacaaagttggggccaaaggccaagcccagcggcaacagcatcagacaatggccaagtggacagaagcgaagcaacaagccaactgcagaggatggcaagttttcatttctggtaaaagtcaaattaataaa

SEQ ID NO: 84668 - DNA, 1268 bp, Heterodera glycines
  Genomic contig location: Contig_ID=SeqID_3433; Location=223..1490; Strand=-
  SCN-specific regions: Sequence locations=1-240,262-395,417-711,734 -757,779-828,850-913,938-1115,1163-1268
atgggcaacataatccaaccgatggaacacacggccaaaaattgcagcgacgcgtacgaaatggactcgactcggctcggcctttgcatattcgaaatgttcgtcaacgtttgcgtgatcggcgcctcggcaccgtttgccaaaatggtcaccgccatcacttcgttcaccggcactatgaaagtgcttttcctcaacatgcttttcgccgcctttggcatcgccgccacgcggtcggacatttgaatttgaatttaaattaagttttgaaatatttaggcttttcgtgctcatcccccagtacatttccatcaattcgctttacagcgccgcttttgtggcgcccgtccaaattttccacgatgtcagcataaacgtgtgcgtgaaagcattgcttaattgtgtaatttaattctattattttagcaatactttgatcactctggccatcacaatggaatttttcgtctattcaatttggccaaacccaacgaaatcgaccacaattacactcagcgcaattaacaccttttggccggtaatatctattaattaccatattgaccgtttaatttttggtaatttagtggtctactacaattgttatatattggttggaacaaaatggtaagtactttatatattatttaaaacgatttacaaaatgttccacaggcattattgaaacagtgccccaatttgctgtgctggaagtgattaacattatcagttggatggtagtttcatttcaattaaatatttttgaattaccttttttatcaaaataaattaaaaaccgtattttttctctcaaaaatgtaaatcagaaattttggtcaaaaatgattttattattgagttttttcatcctaagaaattggcagaaaaattggcattgccaaaatctctgacctaataatttatatattttaatattgctttttcatttaaggtttttctgcgcctttactttgacaattgtaaaaagtacaaaaacaaaacaatgcgttcgataagtttggacgaaaaatatcaagtaaaatcctgctggaactttaattaaaaaaagtaaaagttccacaccaaagaattataaaattttctcaaatttatcctttaaaatttattatttttttcttgacaaattttttaatttaaaaatgtaggtaaatattttctaaggaaatattagaaatgtttaaattattcgcttacacaaaaatagaaccaaaattttaccatttatttgcctttttccactaaataaa

SEQ ID NO: 84669 - DNA, 511 bp, Heterodera glycines
  Genomic contig location: Contig_ID=SeqID_3434; Location=457..967; Strand=-
  SCN-specific regions: Sequence locations=1-70,93-97,119-511
atggccaagtggacagaagcggagcaacaagccaactgcagaggatggcaagttttcatttctggtaaaagtcaaattaataaaatactaagaatggaattttttgaaatagaaaaaatgatttgattcgaaattaaatctatcagaaccgccaaacacctaattccttaatattcccaaacaattacggacgaggtgtaaaattctatgttcgtttggcaatatttcagaaaaattgaacgaatgaaaaaaagttacgtcaatttttgacattattttttcaaaatcacgcagcgtgacccccacaaatttagtttttcttacataaaattgtctcgtttataccataaaattttatccagaaaacaacattaaaagtgaaggaacttttcgtgatcaatttgcattcggacagaagcagaagccaatcggactacagaaggaaaagcatggccaacgtggaaatcgcggcgacttcagcttctctgcgggggtcttggattttaattaa

SEQ ID NO: 84670 - DNA, 481 bp, Heterodera glycines
  Genomic contig location: Contig_ID=SeqID_19907; Location=204..684; Strand=-
  SCN-specific regions: Sequence locations=1-3,254-261,284-397,431-481
  Gene Ontology: Biological process=N-linked glycosylation
atgagagagaaagaaaaattaacagagaaagaagagaaaagggagagaaagaaaagagagagaaaacatgcggatgagacaatggaacaagtgatagaagaggagaaaagaaaagaagaactgaagaaaagaatggaagagatacagagagagaaaagagatagaaagttgagacaacgacagttgcagagaaacaaagatagagagcccaaaaaagacaacgaaaagcaaagagacgacgacaaagacgagaagaatcgaaaaagtgaagacagagaaatgagcgaagagagtcagagtgaaggaaagagttcgaatttagcggaggattttatcataacgccaaaaaatgcgcaaaaaggaagaaaaaatagaacatttgaaaataagcaaacgagagaagaggagggaaaggaagagaaaagcgaaatattattcgaaaaagaatggcaaaaagcgatggaaaacacaaaattaatcg

SEQ ID NO: 84671 - DNA, 882 bp, Heterodera glycines
  Genomic contig location: Contig_ID=SeqID_19909; Location=477..1358; Strand=-
  SCN-specific regions: Sequence locations=1-852,874-882
atgttggattggatgtctacccgcatcgcaaatcacatcataccggacagattgcgtgatcgtacaatttatgatcaaacagttaatggggaacaaatgatcattttttgttctcgttttgacctcgatcttttggtgaattatcagaatgaagtgccaatcgatggcacttttgacgtgaatgcttaaaaggctcttttcgcgggtattgcgagagccatataaaatatgccgctacctatgcaccacaaagttaagtaaaattgtaattacaattatatcttaaagacatgcccacggggatttactcaagtctacacaatggcagttgtcatcgatcattgtgcagttccggcagtttatggtttactgcccagcaaaactcttgccacatacacaagattcttcgaaacaattcgtcagtctgttggcaataattggttcccgtatcgtattatgagcgattttgagtcgggagcgatcgctgcggccgggaacgtctttccaaattccataagaaccggatgcttgtttcactttggacaagcaatttggcggagaattcagcgattgccaaatttgctcacgcgatatcgggacgatgaacttgtcagaacatctttgcggtctctacaagcgctggcttttgttcccacggactttgtttacaactatttttgcattgtcatgtcaattcttgagccgactcctgagcttcaagagctgatcatctatttcattaacacgtggattggacctcgccgaatcatacaaaacgaagaagttttggttcgcgatgcaggcggagcagctgataattggattcgggaatgtagtggacagagtagcagaagggcttggaagaacaaacaattcgcttga

SEQ ID NO: 84672 - DNA, 1295 bp, Heterodera glycines
  Genomic contig location: Contig_ID=SeqID_19915; Location=124..1418; Strand=-
  SCN-specific regions: Sequence locations=1-21,44-115,146-586,608 -853,876-946,968-1295
atgtcctatttatttacattctttttcattttcaacctttcaattagcaatggaagcaaattgacacttcaaatagcgccgactttggttggccatcactcattcaggcaaaatcttataatttaaattatgtaaattaattaatgctatccgacaacaattaaagaacaagtggttaattgccatttaaaattcgcagttattttgtctctgtccaatgtattgaaaacggagatggcctcatcggcggtagccttttgtacagttcaatttggggcaatttgaaatcgcacgaattcattgacaatgccagcaaaaaagtgacggaaagagtcatttttgaattcaatcacacaaaatgccgtcactttgtcgtttcaataaaaactctaaaatggaatgtcaaagcaaagggaacgttgtcctacgatttggaattaatagaccaattaacgctcgtaattgcctttataaaattaaaaggggagattaataagtacaaattaagccattaatttacgatgggctaatcgacgccgaccaatcgcataacgccgatctcccaattgactttggcaaatacttcgtcctccaagtcgatccaatgcttgaagaggacgaagcattttacgaggtcgacgtcatttgccacgaaaattcggtgcgtttttattatggcgaaatgttttgcgatttaaaatgctcgacgatggttttctcgcaaaatgaaagctgtttgaacagcgagtttgacatcacaatttggaaatggcacaacaaaagagaggtgataaagcggttcattattaaacaaaaatgtgcaaaacaaaatgatttaaaaaaggaccaccgaatttaaatttaattgtaattttcggtcgacctctattttcaaggagtgattaagcgagtttcaaggacaggaaaatctgttatgcccaaggacaaatcaaaattgtcttttgaatataagaaaatagtacttgaaaatcagcactgtatttaaacttaagcattatttattatcgcataaattcagaaagaaaaagtcagccgaagggaccgcggcattcacagttccaaagtttacattggagacggagaagaacggacaattgagtacgaaatcgaagtcaaatgaaagcgaaaagagttccgagtgcactaattggtcagcaggactcaaatggcaatgctcaattttattgcaatttgtgcccttcaatcatttcccagtccaaaaaggacgttttcaacattttacagaaaaaaatcagcagatgctattaaattag

SEQ ID NO: 84673 - DNA, 1301 bp, Heterodera glycines
  misc_feature (685)..(685): n is a, c, g, or t
  Genomic contig location: Contig_ID=SeqID_19918; Location=346..1646; Strand=+
  SCN-specific regions: Sequence locations=1-167,189-557,580-818,869 -1095,1117-1199,1224-1301
atgttcgacaaggaattggaatcgcacgggacgggcaacaaaagcggcacgaaacatttggccaagttgttgccggaggcaacaactgtcagagacgagaccttacccagaatcggattaccaagcttggtaaaccggccaaataaggtgttcattgccaggcttagtaaaacaaaaacatgttaaaaccgaggattggtataaaatggtatccggacaatcatcagtgtgaaggacaattcaacaataaattgtttttttttgggcaatgattaaatttggcgatagtatttgttagaataaaattcgatttcacaatatttatatgaaatttcgcgtttcaaaagtcctgtttttacagtaacccgggtcttgttggatacaaaaacttacagtaggaccctggaaagcctgtacaggaaagattgacctctctctaatcaattcataattgttacttaattggtgctttaaggatgcaaattcgattccaagggggcctttgcgttcgctttttgtcaatgattcgcttacaaatgaccatgaagcatcatcagtccaagaatcaccaaccaaagatgaacttaatacccaaatgtgtggcatttggtggcttaccgtatttcttctaatagggcctcggggttatttttaggtatttttgccgactccccccctccccccncccccctcactcaaaggggactttatttttcaactttccacgggatgggcttttattagagggggtgttttaaggggtttttcaaccccctagaaggggggagagaggattgtaatagaagaaatacaaattcaaattaaatatatttttataaattaaatttaaattttgtaattttttaaagttcattctccgatgataagccacaacgattgcggaaatatccttcattgcattctgttgattatgactatgaatatttggaagaggcaaaaattcccgaaaaatttcggtttgtcctgaaaattttttcaaaaaaaaaaaaactaatttaaggtctaatattgatgatgtacaaaatgatcagaaacataaaattgtaaaagattatgaggccagcagcatagaacaaggtcatcaacaaactcaaggaaaggtgtgggggcgaaaatttgaagattgaccccttaaaggcgaaaacttaaatttttcaattaaaattggcaaaaaaaaattttcaattttccatttaaaacaggcaaaagatgccggcggccaaattgaatttgtcaaacggcttccttttcttcaagaatcgagcccagaagttgtggag

SEQ ID NO: 84674 - DNA, 369 bp, Heterodera glycines
  Genomic contig location: Contig_ID=SeqID_3435; Location=188..556; Strand=-
  SCN-specific regions: Sequence locations=1-299,321-369
atggtaccctcatgggcatattatgcatatgagggtattaccctttatctgttagtgtcatgtattttcaaaagttcactttagggcatctccgcccgagtgccagcagattgtttacagacgacatcgatacgagttgtgccttccttttgtacgagttgtcaccaagacacggaccgggtcagtttagtctggccggtttagtctggccgttttagtctggccagtttagtcagagggtcggtttagtctggcaagctgtttttgcccataactcttaaaatattttttttgtcaattataaaaggaaaaacttaaaatatctatgtttagctacaatataaatgaatatcccaattagaaaataaa

SEQ ID NO: 84675 - DNA, 522 bp, Heterodera glycines
  Genomic contig location: Contig_ID=SeqID_3436; Location=2200..2721; Strand=+
  SCN-specific regions: Sequence locations=1-285,307-357,379-522
atgctgatcaaaaaaggtagcaacaccaagttgatcagatcactccttcatggtgatctgatcagcccattttggctgggaacgaggggtaaatttcaaaaaaaatttctagggggttgagaaaatttttctggaaattttgagtaagccgggaccttgatttacaaactgacatggattttctggacaaaaacccttgcaaatccaggtccagaaaaatccaggcctgtatcccggcccacatcgagctctagtaaatacattttttcctgggttctcatgctttaaatagtaaaaacattttctttcacacaggtctactcaaatatttcattttcttaaaaaaaatgcctcaaattttcaaaaattggctatttttgggcataatctgacaatgtattgtatttaaatattcaatttttttccctgcgccgcctatcggcaccgcggcctccctcttccaccctggtcaccaccaaaaagttttttcaaaaaatatgccgcaaaaaattgttaaaatta

SEQ ID NO: 84676 - DNA, 575 bp, Heterodera glycines
  Genomic contig location: Contig_ID=SeqID_3436; Location=4222..4796; Strand=+
  SCN-specific regions: Sequence locations=1-282,304-501,526-575
atggagggcaaagggtcaaagaaacggcgtgccaccgccgccgccccaccgttgaagccactgtttagcaccgtcaagcatggcactggtggcactattgttgttgttgttccgctcatccgtcccgctggcaccgttgttctgctgctgttggtgacgccattgcttagcggtccacccaatggtgccgccgggacgatggtggggttgatgatggcacatttggccatcattatggctattgtctccatcattgcactcctcactgctcggcgagcgaatgttcagtctgtccaacttgaccacctgtttgtgcgttgtttatgttattgtatataagggaggaatcggaggcgggcggtcccacaaagagaaatttcggcatccagaaatatggcatcataaaaaattccgaaccgacaccagtcccaatcctgttggtggactttcttcccaaaataaacgaaacatattagaacacatcaatcatttcacattcctcctccccgccccgcttcccccgaataaatttaaaaaactgaaaaatttttagatttctaatttcttagttttaa

SEQ ID NO: 84677 - DNA, 844 bp, Heterodera glycines
  Genomic contig location: Contig_ID=SeqID_3436; Location=4855..5698; Strand=-
  SCN-specific regions: Sequence locations=1-377,403-474,498-611,642 -687,709-844
atgttcgggtggctccctccattccatcattttttccggagcaggacatttctttcccgccgtttctttcccgtcatttctttcccgccgttactttcccgccattcttttgtgtttcatagaagggtgaaaagagttcaaaaaaatcgtgacaaattatacgaagaatttgttcggggagatgatgcagcaaaaaaaaggcttgtgtaccaaagaacagatgagcgtattagaaacattgttgttggcggcctcggagaacggactattgctgaatatttacgtgggattgcaaacaattttgaaatggatcagtgagcaattgagtttttttgtcagtgattggtcatgatgattgttattactgcttatattgctttataaatttatttttaatatttaggattaattctaattttgggaaagaaaagtcccgggaaagaaacggcgggaaagaaatgtcgcgtaccgcattttttcccattttaaagggaagaacatccgctgagcatttccgtctgttcgtccaccatcacttcctcctccgtgccgtcctccgcttccgtgtcagtgccgtcgtcgtccgccgcggtcgccgcatccgtcgatttccaccaccacaaccaacaacaacatgaagacgacggcgaccagcacaacagcggcagcaaagtgttccgctttgatcaccaccaacacaacaaccgccagcagcacataaagccgcccccatttgcgctagaagaggtgcttttgccttgccgataggcgcccaatcgatagtcagcggcggggacggcacaaattctcggcgccgaaatttttttttaaacttcgaaataaa

SEQ ID NO: 84678 - DNA, 542 bp, Heterodera glycines
  Genomic contig location: Contig_ID=SeqID_19919; Location=395..936; Strand=+
  SCN-specific regions: Sequence locations=1-190,212-542
atgccttcaaattctttttatgttgtcgttccgtcgaacaccaatattgaaggaaataggacaaattcgttcctagtgcgtttaccgcgcaaactacaattcaattcggaatgggaggtgggtttggcggtgattgtgtatcccccccccattcatggccttccataggcaccgtggagcaacaatttgttcagattgagtggcagacggggaataaggtgcggattgagcttccaccatcaaatgtcaccaacccccatgagcttagcaaaaatttgtacagactcctgggagatggaagtgatccgttggcaaaaaaggtacgctcaacacagaattctttcatgcttacgataaacaaggctcgccgctgggccagagaagagtacattaagcgaaagaccaaagaaaaacggggtgttcgtgacgaagagctgctcctacaggccctgttgacagatactggaacattggttgaactcaacacccgcaaggacttctggcacgcgaaaagcatgctgaaacgagcaatatcgcgttga

SEQ ID NO: 84679 - DNA, 996 bp, Heterodera glycines
  Genomic contig location: Contig_ID=SeqID_19920; Location=1089..2084; Strand=+
  SCN-specific regions: Sequence locations=1-545,567-677,699-833,857-996
atgcttattttgctgcccgttcaacccgcatacgcccaaaacgcatggcccctccgccgccggagggaagacgcggtggcactgacagtgaaagtgccgatgacattggcactttcgatgtcgaaagtcaggcggcacggagcagcacatccgcggggaatggtggtgataggtttaaacaattaggccgttccctatttgtggtagaaattgcggtctttttgatgattggctcctgttttttcgcgcttattacccctaatttaaatcctacagcggtcatcccttttattgtcatcaatagcatttttatactcattatcattagtcattcattatgtattttttttaaacgaagacattaatttttcggggaaaacagtaatttaagtaaaaaagaaaccctctggcgactcctctgatcagctctataagaccaaaattgtttgttgctctattattccttatctgttcatctgtcttacacattctgaacaccccccactgaagcagatactgtttaggtacggtagccaatgcgaaccaaattttaaaaattgttctttcaagcttcgtatttatgcataaattgattggccctagatttgttcaatttatgatattttatgactatttttggtgatcatttttacttgcgggactaattacataagcgtcagcaacatttgctgaaaagaaactcgaaatcagaaaatgcatttgttattccaaaagggtttttttgaatattcctaacaaaattaaatcagagaccttaattttgaaatggcagagaccgggacttggaaaaaggagttctttgtccagtctgcatattttttaataattattatatcttcaattcccagtaaaaaactgacccacggactccgtcagttgggccctcacgtttgggctccagcatgtttttggttaaacttttttatttatcatccaaatccaacaaacgttttctatgggttctattttttctag

SEQ ID NO: 84680 - DNA, 2045 bp, Heterodera glycines
  Genomic contig location: Contig_ID=SeqID_19921; Location=113..2157; Strand=-
  SCN-specific regions: Sequence locations=1-221,244-355,377-534,556 -927,949-1474,1496-1527,1549-2045
atgttccgtcttgcctgttctgccccggccagcattgggcctcagagtgcagcaaagttacagatgcagagactcgacggaccgatggccgttatccttaacggagaattccatcgccgcataagcagcatgcaggctgggacaacccagattcctggctttggccagctgtacattctggacccagtccaggctatggaacagcgtcgaaacaaccccacatttactggggaaaaaatcacaaacgaagatgagtttgtgcagggtcatgagcttaatgaagcgaccctcgagctcttggaaaaaatgattcaagagcatcaccccgctgcgcaagcgtataagcaagcgcgtgagcagctccaggagctcctcaaaaaacaaaagccagaagagcttcgctttttccgcatgactttgttgaatgagcgcatgactcctgctgctctaaaagatccaaagctccatcctcaccaaataatcaccccttcaacgggtgaggggatgttcgctattcacgcggatcccagtggagcacccccgccaagggggatatgggttgaaaacaagcaaggtcaattgaatgaaattgccgctttcagtccttggactgacagcctgacatacccattaataaagccaatgggtgatgatgggtatataaccggcattaaatatgcaaagccgtcttcgcgtaagcgaaaaagtgatcaagatgtggctggcctattcgactctgaggccgagtccgacaatggctcgtgcgagactcagtctgttgcatcttctgatgcccgggtcggtcgcttccactttcttcactttatggccgcattgacaaatcgaaaagatttgtctccctgcgggattactgtaagtattatctcgccataagggacgaaaatgtggagttgcaataccaccacattctttcgtgtggaggtggtcttggtcagcgctggatacttgatcaggctgctaaaatcgattggcaagtagccacatttttgcgcagacctgacatgaatctgcggatcagcactccaaaaaatttgctgcagtatttggtcaaccaatacaataaacagcaggcacggcagaaccccaatgctcaacagaaaactgttgatgacattggtagtgtagttcgattttccgagcacaatgtcaattctctccagtattggaagaaaatgtatgaagattgcaataccatatttgcacggcatcatgacgctaagaaagcgcgcctcttcatcacattcacgaacaacagggaatggcctgagttcaaagagaacatgtacaacaacggtcaagtattcactgaccggtttgatttgtggatgcgtgtgtggtccagcaaaattgctgagttccacgaagagctttatgaaaagaagttctttggaacaatccttggatcaggagagtccatggagttccaaggccgtggaggtccgcatgcccacattgtagcccagactgacctggacgcaattccagatgttattcagcaatacatttgggctcatattccacctttgccagacaaaggcgatggcacaccaattgcgcaaatgcatcgcgaagtgcgcgaattaatgcatttccaactgcacagatgcagtgacagttggtgtggcccacgtgacccatatgggcgatgcaaaaagggcttcccagccctgtactcaaaatgtacgattttgcggcccgacaggcctgcgttgtattaccggccttcatcagtggatggtggtgccaatatagtggttaacggcttaatatatgacaactcgcaagtcgtgccgtacaacccttatattttgctgcgttaccgagtacaccacaatgtactatttgcgtatggtaacaaagcaaatataaaatatgcgcttaagtaccctttcaaagggcctggacattgttatgtcgagtgcaaagaagagtcaggcaacaaaatcggaatcgatgagccagctcagtatgccaaaatgaacttccgtggtgctacggagctttatgcagttgttaactcatag

SEQ ID NO: 84681 - DNA, 1584 bp, Heterodera glycines
  Genomic contig location: Contig_ID=SeqID_19922; Location=484..2067; Strand=-
  SCN-specific regions: Sequence locations=1-468,491-798,820-921,954 -1053,1154-1548,1570-1584
atggcagtcgctaaaaagcgttcgcccgccgaatattacgcgttcagcaagttggccaactgtttgcatgccgttgggttggccaatcggctcgcctcccccgccgtcgcgtgctcgttccgtgacgtcaaagtggtcgcgatcaggtgagtccaggaatttcctctatctcacaagcttttttaattgtttaattcattttaatttttgcgatacctgcaaaattggtcaatttgaattttcataaaaaaaagtttgtttgcaaatttttttttcataataaatcattgatagcttcttaaaaggttttcggggtcgcttaccacgaaactgacagatctcgaacgaaaagtcggaatttttttttttgagacagacatcggcttacaaaatttttgaaaccataaattcacgaaccaaaactttgtgctttaaaatgagctatcaaactcttatttatgttatgtttacaaaaaatatggattttaaattagcaaggtcaataaaatttgtcaatttttcgatacgaaatttattattttggttgtacaaatttgtgcgttttattaaagtgttttttttctcaattatttgatgttgttgttttttttgaataggcctggctttgtacgcggcactgagcttggacggcacacgaattttttgctcagaatgctcgcctacccgctgatttggatggttgccaaggatttggaccaggtcatagtcaattttgcgaatcacggcgttttttccgggtgcacttcattatttggaaattttcaagaaaaaaattccttggaaatgttttatatggaaattccaaggaaaaatttttgaaaaaattttttagcgattttttggaaaaattttcgaaaaaacttactaactaatttatcataaatttcaaaaaaatcggcgaaatttttttctaaattttttttttaatttttgcggcgaaattttgtcccggcgaaattacggcggcgtaatttcggtggcgaaatttcgccagccgaaattatgtcccgtccccgtcgttttcctccccgcaattttttttttacaaattaacaattaaaagttttttaaaaaaatctaggaaatttcttttataaaaaaattcaagttaaaaatttattgaaaaatttttcagcgacttttgaaaaaacttagtaattcaaaataaaatttcgaaaagcaagaaaacaaattttctgtttcttgcatttaaatccagatgcgcgacccgatccgcgggtattttttctatccgcgcctcaaccctgccacttactccagaaattaagaaaaaataatcaaattgtttgccacggcactttccagggcatttcgtccatgttgcactgtgcccagtgcgacttggcccaactccaaaatggtgcgctgtattacgagggacgcgtggtgccgtacaaaaatgagatggtcaccaatgaagaggccgaaaaattgtggcaaatgagcgaaaaaatgaccaaattggaggaaaatggtgaaaaagggcagccgcagcagcaaaacagtgaagagcagcagcaacagaaatcaccaattaaataa

SEQ ID NO: 84682 - DNA, 405 bp, Heterodera glycines
  Genomic contig location: Contig_ID=SeqID_19923; Location=787..1191; Strand=-
  SCN-specific regions: Sequence locations=1-405
atgccgcaggtattattggccaaaaatgcactcagacataattttgtgggtcaaattatgcataacgtgccaactaagacatcatcccactccggctcatcatttcctcccgataaaggtactgttggaattggagtcatcactgcaatattccttttccgttgcagtatggggtgttcacctttatgtggggagtgccgtaacgagaacttcaagcgaggcgacaagcgcttcctcctaaacaccggcagtggccaagagaagctcgagttcacccaaacattctgccaagactgtgccaagttgaactttgactgcaccgacctgatcatgaaacaccaaaagaaggatgacgtgccacagaagaacgggggacggaacacctatttcaagatggaaaagtga

SEQ ID NO: 84683 - DNA, 820 bp, Heterodera glycines
  Genomic contig location: Contig_ID=SeqID_19924; Location=343..1162; Strand=+
  SCN-specific regions: Sequence locations=1-41,65-72,94-340,363 -570,593-605,628-638,675-694,716-820
atgcaccaaggactccatcgccgccacaaccaccagcagcacatcatcatcatcatcaccatcaacaagttcaagcagtacaacagcagcagtaagttcaaggagtgcaacagcaacaacaagttcaagcagtacagcaaccgagacgacggacggtcagggacgaccgcctttatgaaatcgcagcgatcgtttgttcgcgccgggcggaggatggtcaaacgcgggaattgaggatccattggcagtcttttccttatcgcgatgacacttatgaattggcagtggatatagcaagggtaacatttttttaaatttttgcacaaaaaaataaagcattgaataaaaaataattcagcaagcgcctcaatccacgcggcatggcttcaagtgcacgaccatgggaacacgccaccgcatgacgtcgagatgccaattcggcctgcgacttggatgagcactgttcgcagtggtcggcatctgccagtggtggagtcagtctacccagggcgaaaccctgcgcgccgtcgacttttcggtaaattaattaatcaattaaacattcctttgtaataattaattaattaaagatgcgcaaccagcagcagaaggaaaagaagcacaaaatttgctgagggcaccagcagcagcagaagaagaagaagcagccttaatcgtcgatcaaatgcagccgcaggctgcagcagcagcaatgatggaagatgaggacgacgacgacgacgaaattgtctttatcaatgaagtgcaaagagaagcacgccgccgccaccaccagcagcagcagcagcagatgaagtga

SEQ ID NO: 84684 - DNA, 1739 bp, Heterodera glycines
  Genomic contig location: Contig_ID=SeqID_19925; Location=26..1764; Strand=+
  SCN-specific regions: Sequence locations=1-234,257-1094,1124 -1162,1184-1236,1258-1383,1405-1532,1554-1739
atggacacaagcaaagggttgtataacaaaaaagaggacaaagtcactttgaccattgatgtcattgtggagggaatgaaaacggacatcgccgacccaccaaaatctaaggggaaaattttgtggacaatccaaaaattgtcggaatttgcgcgagaggttttaatgagtgaacggaacagcgaaacggtgcacttcaaagggattgagtggaaaatttgcgctgaagtggtgaaaaatggcagcaatgaaaaggctttggacatttcacttgcgtgtgtccccaccaaaggtgtgaaattataaaaatagctcttaaaataatacaatatttacaattagacaccatttgtaccggcgaatgtacggcgatacttcgatttgtttcacaaaagaacgaaacgttacaatttgcaacaaaaactgttgaaaaaagtggttttagcactgaatatgactgcgtggcgcttttcccctcgattacttttacggtgagcggaggcaaccaaagcgtaacaattcttacatcggcttaagctaggcctaatatttaatgcttatattaagctttataattttttatgtacgagttgccactgacttatcagaagaacgtctttctttgcttaattaaatggttttaaaacaaaggaattgatggacgccgacaaaggattttacgatgaaaaggatgacaatgtgagtttggccattgattttaacgtgaaagtacagaaagggacgaagtgcaataagttgactgtggaatgagcaaagcaacattttgttatcattattattcgattatcctttacaattttacactttttacttttatttattttttattgaaaatgatgatcaattgttatcactcgttatctcacctttacaaaataaaaaaatcgaaaaaaatttatctgacctcgcaaacaattaaaagagggattataattggcagccttagtgatcacgaatataatattcattttaccaaaacgaggggaaaaagcgtttttttcaagaaagttcgggaattgaccaaaatacagttaaagattggtgaaagcttcccaggttggaatagactagtcttttaaatttaatcaaatttaaattttttggcgctttttttaaatttgaatttaattgactttccttttttgcttgctcccttttaatcttcggttcgcaatagtacacccaagatctacttccagatttattgtgcacatctttgtttttcttcatttaaatgattcgtcgatcaaaatagcgataatatagatcatattttgctttccatttcttattgatttatttgttcgtttaattcgatgttttctttccaatttttgtattaaattatttctatttttttagaatcaaaaaacaataaaaactcacgaatcctcaacaaaatgagcaatcaatccgcggctgaacttgctgacgaatatgagaggtgcgtttttagagaaaaatctctgttggaatttaaaaatgccatattttgtggttggtggcacttatttcgttgttgttattgtaataaatattttagggttgacggtgaagccatcaaaagcaacgaggacagacgcaccgaggccgagcaggtcgggttgttgaacacctttttcagtaatagtttggaaaataggagaatgacaacggacagttcgttgtcagtacgccgtccaaaatggacgaatcggaggacagcggcggagaagtga

SEQ ID NO: 84685 - DNA, 2509 bp, Heterodera glycines
  Genomic contig location: Contig_ID=SeqID_3437; Location=290..2798; Strand=+
  SCN-specific regions: Sequence locations=1-413,435-1422,1463 -1550,1581-1581,1603-1794,1818-1956,1978-2509
  Gene Ontology: Mol. function=dopamine:sodium symporter activity; Cellular component=integral to membrane; Biological process=dopamine biosynthesis
ccgctcctttgctctagacaacgttatgatcaaaaaatggccaaaagcagcacggaattggtgttgcaaacagccgatgaaggcgaaaatcgcgaggcggaaggaacggagcgggagacatggggtaaaaggagagaatgagaggggggaagagagagaatgcctgaaggggagaggggagggggaaaagcgggagacaaaaagatgatcaaggcgaaatcaacatctaatggaatgaatgttgggggatgcctttgtttagagcgcaaaatcgactttcttctctctgtggtcggttttgccgttgatttggccaatgtttggcgttttccttatttgtgcttcaaaaacggtggcggtaagtcgcttaaattgccgtttcgttctccccactttttgccgcttcttcaggcgcttttctgctcccttacacaatgatggttcttttggcaggtataaacatccaatgagcacccaaatcagctttatttggcttttgtaaggcattcctttgttttacatggagttggcacttggccaattccatcgaaagggtgcgatcacaacttggggccgaatttgtccgctcttcaaaggcatggacgacggaaggtcccctttttgagcatcattcgctgttttaggcatcggctactgcgtcattatgaccgccttttacaccgacttcgtaattttgctaattgccccccccccccctcttttttgctcactttcccagttttacaatgtgattatcgcttatgcccttcactatttctacgcctccttctccacccaacttccctggtcaagctgttccggaaaacgttcttaattaattctgctaattgccctgtgatttccttttgagacaattcgcccgcctgttacgagccgagttggagcgaccaatcgcagcaatgcgcggacggccccattttccggcagaatgagacgagaaatggcacttcgccgcgcattgaccgacccgtctcagccgcagaggaatatttttagtaagaaacagaaattgggagagagggaaaagaaatgcatttgcagcaaatatttccttggactacacgccgaaaaagaagccattccccacgtcacacaaagcgtgggacaactcggaccaatcaattgggaaatcgtggtaagacagtcaaagaaaggcaattaattggttaacgatgactcattaatccaatctcagactaattgggttgttgtaattctccgttttcccaaggcttgtctgtttgttgtctacatcatctgctatttttcgctatggaagggcatcaaaatgtcgggaaaggtccgtccgttttcttaccgtggttcccctcgtgatgctcgagagtctcggccaaagaaaactgttttctctgatgggttcagtctcggatttgtttcagtcccccgccctctccccccccccccctccccaccccttcccatgctcatttgtcaggttgtgtggttcaccgccatttttccctacgttgtgctcttttgtctgctcatccgcggcgtcactctccccggtcccttttccctttccctctccctttttcatttttcaattataaatttcaaaaggttccgaaaaaggcatcgaatattatcttcggcctaatttggagaagctgaaggacccaaatgtgtggcaagatgccgcaacacaagtgcccaatctgtcgcgtataaatttgttaattttccatccttaaaggttttcttttcacttggcccaggctttggcgttttgatggtttgtactttcatttgaatattttttattttaaattttaggcttattcttcttacaacgaattccacaacaatgtttattttgacgctcttctgacaagcacaataaattgcgccacgaggcatttaatttaaatgcattaaaatttagacaattagacgcattccaacccaattaagagttgattgttttacattaatattctaatagttttctggccggtttcgtcattttctctgtccttggttatatgtcgtgcaaaagtggaaaaccaattcacgacgttgcgcaggaggggccggggtcagcagtgccttcatgactccggccattagtcggctcatttctcagtttagcctcgtcttcgtcgtttaccccgaggctttggccacaatgcccggggccaccgtttggtctttgattttcttcctaatgcttttgaccctcggattggacagctcggtgagcaaagaaacaaaccccgcacccaattccaatccattttattgttttcgttcagttcggtgggtccgaggcgatcatcacggggctaagcgacgaattcccagcaattaaacgcaaccgcgaagtgtttgtggccgtactgttctctttctatatgatcattgggctgacaatgtgcacaaaagtcattttgctttatttggccactaaatgtgccaaaacccaggccgaattaagggcggaatgttggtgatggagtggctgatg

SEQ ID NO: 84686 - DNA, 2313 bp, Heterodera glycines; identical to SEQ ID NO: 3438
  misc_feature (2261)..(2261): n is a, c, g, or t
  Genomic contig location: Contig_ID=SeqID_3438; Location=1..2313; Strand=+
  SCN-specific regions: Sequence locations=1-15,82-301,323-387,409 -623,666-800,824-893,951-1049,1072-1537,1559-2313
  Gene Ontology: Mol. function=nicotinic acetylcholine-activated cation- selective channel activity; Cellular component=integral to membrane; Biological process=synaptic transmission

SEQ ID NO: 84687 - DNA, 599 bp, Heterodera glycines
  Genomic contig location: Contig_ID=SeqID_3439; Location=609..1207; Strand=-
  SCN-specific regions: Sequence locations=1-33,55-565,588-599
cttgaaatgggcctttcgttgctcttccgaagcgaaacccaacgggcagagaaagtcgcgataacagcacagctcattcagtggcacagcttctgcacaattattaattgcaaatggtggtggctaattaattgtctttgctaattacccattttccgtctcagacgcgccaattcgacggccaatccgtggcccagcaaatagcaactgtccgtcaacaccaactcctcccccccttcgctttggcattccaaaattgcattttctctgcgaatttcctccgccgtcggtttttgcagcactctctgtgctgtttggtgggcaatgtttcttaaaatggaaaaaccttcaacttttggctttgtccgttgctgtgatttgaatttccgtcgagtaaataaacgccgtgcccttcggccacttcgaccggcgattggtgcgcgatcagcaaaagatcgccaggaaaagaggggacggaaacggcgggaggaaagtgttcgagcacatcggcagaagcgacgaaaacgaagccgagcgacgaatggacggagagaaggagaggcccaaaaacaaaagaatggcattttggccaatttttg

SEQ ID NO: 84688 - DNA, 696 bp, Heterodera glycines
  Genomic contig location: Contig_ID=SeqID_3441; Location=315..1010; Strand=+
  SCN-specific regions: Sequence locations=1-52,74-445,469-583,605-696
atttcggctgaaagctttttggaatggtgcgatttgaatgaaaattgcgaagttggcaaagaatgcattttgagcggattggtttatgacggggattcactgctgcgcattggcaatggcatttgtgccagcactttcccaatcgatcggaaaccttcgggaggacacgcgggtcggagtttggcattttcattgaaaaaataattcatttgacaaaagaaaaagaaaatatcggcacttaaaaaacaagaagcccttattgcgtttttcagccttattagcatatttttccgttcttcagttgacaattccacggtctctgcttttgttacggtggcatttcaccgcgacgacgacattaagcgaagttcggccgaatgtccgctgctttggtttggccacagattggccaccatcgcccaagggcatgcccaattccattccctttggcactttccccttttctcggctcacccaaatcccagcgaatccctgcaggaaacattggacacaatcaatcgactgggccaaaacgaaccacaaaaaagcgacaagacaaggccgagaagcgatcagcaacttttgtcaattgaagaagtactgcaaaaagtggacgcaaaaaaactgagggaaatgcgcgaaaaattcattaaaatgccaatggaagagaaagaaagcggaaaaccatcaaaatga

SEQ ID NO: 84689 - DNA, 1664 bp, Heterodera glycines
  Genomic contig location: Contig_ID=SeqID_19929; Location=135..1798; Strand=+
  SCN-specific regions: Sequence locations=1-803,825-1523,1545-1664
atgtcagaccgccgtaaagaagcggaggagaaaatggcaaaagcaatgtaaaaaatttaattaaaatgccaattttcaatttcaattttaaatattttctttccttttttttcagtttcatttccgccgactgttggctttgtgtgttcgatttgcttgagccttctcaacttggccttggaatttcaatgatcagccaccgttttgacttttacgtggacgaacattttaaaacccgcaaatgggcgctaaaaattattggaattcgcatcaaaaatggagaaaatggcaccaaggaaatggaaattgtcaatttcagtggaaaacaaataccaattccgcaaaaaccgctgccacgcggagtcatcgggttcgaacgcgtcgatttcgtgtaagattggcgattatgcaaagatttagacaaacttcccatgtttagttatatcgaccacaatgtgatcacttttctcggctattttcgcccacttttcgccgcctgtcaaatcaatttgttcatccacacggacagtgatcgagttttggagttgattttgcgcaacatttggccaatgatcgcgaccaacatttgtgccattcaattgtccaccgaaatttttcgctgtttgcgacaaatggcgccatcaattctcgacgactgtccatcgcttcgcgttgtcaatgcctattctggtcgtttcttcgctgaatttccggccgatgactggcttttcactccgcttcaaaacggtgtgccaaaagtgttcagatgctggatgggcaacgatgaagggacttatccgtcgatcattgaagcccttaaaacggtgcttactaatccatgtatttagattttttgggcatttctataatcagacaaaaagggcgttagtacggacaaaaatggtattttccttcgatttttcattaggcaccaaaaatggaccatctaaaccgaaaaagtgcctgccaatctctggatttttgtcccatccccaatcgtaaaaatgtcattcatttcgtttttcttaaaccacccgcattttagacttttgcctcggtttcttcccccgtcaattttattgtcgtcatttggtttccgtcgtcttttgcttcctccgtcgtgctcttcaatttgaccaacgaattgactcgtgaacaattggcattgaaaagaactgacaatagcgatcgttttctgttggtccgttgtccaattgcgcgagacgaaaacaaatggacaaaatgggaagaagaagcgattgattggcgaatttataatcagtggaatcaaattctcatgctaattaatgagaatgatatcggagatgggtcagtgtgaatgttttttccatgagtcaaatttatttgcgtttatatttttaggcttctcgacgcaacgcccggcccaagtgatcagcagcagaatgaatgaatcaattgttgagaagtgattgatcaatttaattattgaaatcgaaaatgaattgaggctattttaaaatgctcgtaaaattgtttttttgttttgttggaatgatcaatttatttattttctgcttaaattggtatgttcatgcttaatgatgagcattgtgttgaatttagcattttatgcttaattggcatgttttcgaaacttttgactaaaacaccgtcttccagca

SEQ ID NO: 84690 - DNA, 1713 bp, Heterodera glycines
  Genomic contig location: Contig_ID=SeqID_19930; Location=416..2128; Strand=-
  SCN-specific regions: Sequence locations=1-83,112-133,155-160,182 -409,431-545,567-1226,1249-1529,1552-1601,1623-1713
atgcaacccccaaaatcttggtgagtaactacttgattctgttacttttcgacagttgtgattccgacaaaattgattttgacagtaaaattttgcttttaaaaaactttaatggtacatatatgtctcggaaattttgaaaattaaaatgctaaacacggctctttatagaaaaagagaaacgctaaacagagtatgtttaatttaatattaattgtgtgccagaatatgggtggggtaaattgttattcaagttaaaataattattgataaaaaaactatttgcattccttactgtaattatatttttgcccagattttattgccataataataacgattaatagtttactccgataaaatactttggccgaaaatagtgataaacaactattgaattttcataaaaattcttaagtttttcaactttgtctgcggcgattgctggcttttggtgttcgattttcttgcgtttttttcacttggtccgcaacatgaagaagcaaataagggccctgggcctcactcgtgtaattttagaattttttattattccattcccattcaaactcattaaggtttacaacactgatcctgccttcgctgagaagtctaagatgatcacatcattggccttcctgcctgtgcaccaccttcaaaatgcccttaatgctcttcaagcacaaattccgccacaacttaatggcgttttcaattggttaagtccgaagacgaattttatgaatttttttttctaggtttctggacaactacacgggcagaatgcgcttcaatgttccaatgacggcgcctctatttgacccacacgaatggagtgttcatcagcgcaccttggatggtgctgatcggacgaacaacttcgccgaggcattccatcggaaacttcagcggcaatttagctgcactcatccaacaatttggcgattcattgacacgatcagatgtgagcagaaggcgcttgatgctgatatggcacgttgcatgatgggagaagccgcaccccaaaagaaaaggaagtatcgcgatgccgattcacggattcttcgtctcgtccaacgttataacgatgtcaatattgtcccccaaaatgatcacaattatgccaatcccaatgtgaatcccgaaaacattaacaattttctcgccggtatttcccgaaactatgagatgcgaccctagtttgtcccattttgttattgttaaatttatgcattttttacattaaatttatgaatgggaaattaaaaaatgataaaattttggttcgattagttagtcataagtttttctaattgaatctgacgcttgtacaagaactcgtacgaaaacgtcccccgtacgaaaacggcggtacgaaaacgtcccccgtacgaaaacggcggtacgaaaacggcggtacgaaaacgtcccccgtacgaaaacggcggtacgaaaacgtcccccgtacgaaaacggcggtacgaaaacggcggtacgaaaatggcggtacgaaaacgtccctgaccgagattataaatatatttaaaaaatcagaacaatttttgtcgctaccccaaaattagaaattcttataaataagaacaaatggaagcccctggtttaaaggccagattggactcactcttgctggcgctaacgaaatcagatgattaaagtgagaaaaaggaagatttacgagcatttaaaaataaa

SEQ ID NO: 84691 - DNA, 1066 bp, Heterodera glycines
  Genomic contig location: Contig_ID=SeqID_19931; Location=172..1237; Strand=+
  SCN-specific regions: Sequence locations=1-174,197-638,683-1066
atgagaagaagtacggttttaacctcaaagcaacaatattacgaacgcgaacccgaagagtatttaaagtatttatttttgttttttgtttattttccaatggatggatttttagggcgtagaatttcatttaagtagcgaagtgcaaccaaaatatgaaattatccgaaggttagttgaagcagccggtggcacagtgcagaaggataagccaaagaaggaataccttttaaagtgtattcaggtgagtaggagcaaaaccagcctagggggaggaaagtgaaaatgaccgttccatgcttatttttggagcttattcttgtgggggtagccgctggaaaatctcacaataagctattttttatcggaaatttttttttacaactttcccctcgttcagaaaaatgtgccattcttcattatttgtgataaaaacacactttgttcctaccaatttcttatggattcgaactttcgtaagtcttccttttgaaaagattaaataaaaaataatttagctattttcaacgaggatttcattctggtggctatccttcgacacaaaatcgacgtttctgaagaatttcatgcgttttcattaaattcaactcaaacttctaaacctaaaaaagccgatgaataaatttttgttttatttttatggataaattttaaataattagcgttagactaaaataactcaaagcgaagttttatcgctttgatatatttaaatcacagatgtattaacaattaaattaattttcatgattaaatgaaccgacaaaagcgccaaaatttaaattcaattttcaaaaagaaggcaattgacttggccctcaatcagtcccctctctcggtacgcttatcattgagctgtttccatctctttctcacagtttgttgttcatatttattccaaccttaaaaaggaatttaggcagaaaaaattaatgagcggaacaaagtgaaagtcactcttttgtcaaaacctcagtgtgatgcgaatggttatgagataattgtggactataagctaattgtgggaaattggaccaaattggta

SEQ ID NO: 84692 - DNA, 189 bp, Heterodera glycines
  Genomic contig location: Contig_ID=SeqID_19932; Location=353..541; Strand=+
  SCN-specific regions: Sequence locations=1-189
atgttcaaggaatggtatgaaagagaatgtcaaggtaattaacgaattctaattgagaagggtttataagacaatgcgactattttaggggagaaaaacgctgtcatccaatcgattgacgccaatgaattagaagagttgctccaaacttgttgtgcttacgggtcaactccaacgatacacaggtga

SEQ ID NO: 84693 - DNA, 87 bp, Heterodera glycines
  Genomic contig location: Contig_ID=SeqID_19932; Location=1253..1339; Strand=+
  SCN-specific regions: Sequence locations=1-87
atggccgtgcttggttctggcggacatacgaccgaaatgctcaaattgcttgctgcccaggacgaccttttccctggaaggctgtac

SEQ ID NO: 84694 - DNA, 427 bp, Heterodera glycines
  Genomic contig location: Contig_ID=SeqID_19932; Location=593..1019; Strand=+
  SCN-specific regions: Sequence locations=1-69,91-427
ggaaaattttggaaatagcggacaaagagaaaatttcagggtttgtgagtttttgtctttttcgttaattgttaaccaaattaagccttttgcgcattgtcgagtcttttatcattgattccgaatgcatccacccaattaggaagcttgaatatgcagcaggtcaaaactgaatctgcagggtccgacaaataactcaaatgttctttcaaaaacagaatatcggatgagccgactcgctgacacagtgcttcgattatttcctactcaaattgaccggctcgattcattattcttatatttagcagaaaatggagagacattggccgatgttcacttggatgtacttaaaatgcttgacattcatgattcatacattgttatgtaaaacaaattcttgctcttgacaagattttatctcttataa

SEQ ID NO: 84695 - DNA, 741 bp, Heterodera glycines
  Genomic contig location: Contig_ID=SeqID_19933; Location=181..921; Strand=-
  SCN-specific regions: Sequence locations=1-380,405-741
atggcggttcacactgttcaactcgtgggtgaagccagttacaagggtcgggggcccaaccctagtttgagcaatgcgcatacatacaatgctggatgcaaactgggatctcgcaaaatccttcgcgggatccgtcccgctccgtgccctactaattattgtttattctagcttctattgatgtggagacagttaccggtatgccaagggcgactgctatattataccagcaaagaaaggtgaacgaattgacaaaaaacacaaaagaatggttcggggtcactttggctatgaaaaaaattgactgaaatttttactacttttaagcattggcgtcaaaaacccgttttatatgggaggaatggcccatgccaaagtggaaattttccaaaataaacccctttaacaggcaattttggcgaatgttttgacagcgagcgatgcggagcaatttgcaaaattggagtacgagcaaaacaaagcgcagcaaacattggtcgatatcaaattgaaaagggaaattaaagctctacgagtggaaatgtacgcttcggaacaaaaacttcataaacaactcgttcacgcggaacagaaacttcatgaacagcaacaaaaacttcatgaacagctcgttcacgtcagtccatttacagaaacataatataatacaattaattggttttaaaattttagctaacaaatgccgtccaacagattcgtcatcctgagaacaatacgtcg

SEQ ID NO: 84696 - DNA, 959 bp, Heterodera glycines
  Genomic contig location: Contig_ID=SeqID_19934; Location=1662..2620; Strand=+
  SCN-specific regions: Sequence locations=1-959
atgcgcgacagggcgtccgacagttacgaggatgctaagcagggggcgcaggaccgttacgagcgtgccaaggagtacggcagtgagaagacggagcaactgaaggactatgccaccgacaagaaggtaaagcccatcggaattggaaatgacaaagcggagaaaaccaaccatgaccaacccaattcaggaggaagcgggcgagaagatggagcagaacagggagaaggctgctgagaagtgggacgagacgaaggaggctggaggtgggggcgaaagggatagcaaacgggaagcatttggggagagggcaaattggcaatcaatgggtttgaaagttaggggcgttaagtagttgaacaatttttcggctaagggcacactgcggtttaagaatgtgggtgatcatgataagaatgaaagtgggtgtaaaaataaaccgaattatttaactagctaattaattctttataggcgagcgtatgcagcgcgccggtgacaaaatcaggggcaaatagaaaggatgtccaacagaatgaagagcaaatttatctgatctgatcggactctgtgagcccaatttaactgctctttttattggaatatttgttgtccatcttctcatataaaattttcgtgaatgaaaacaattcactataatttgtgtcaatgcgttaaatcaagcaaccgggaagaaaaaaacagcttagatgggtaaacagaatctatgaaattaaaaacggggagtttcgaatgcgttagggccaaggcaaagtttgtctaattagacgatttgctcattttatgttcagtttggccaatacgtctttgtccgaattgttcaggagaatgaaggtggcgaatgcattgagcaaatccttttccttttcgaagagacgagaaaccttcagatagacctcgtcgagagtcgatttctgttggaaatgattggcacttaa

SEQ ID NO: 84697 - DNA, 1114 bp, Heterodera glycines
  Genomic contig location: Contig_ID=SeqID_19936; Location=395..1508; Strand=+
  SCN-specific regions: Sequence locations=1-118,140-320,343-1114
atgcgtgagattgccgacatttttgaacgagtgttccaaaggtacacttcggcagtgccgtgcaatgtatttggaccgcgtgacaattacaatttggagaacggtaagagaaaacgcaatggacagaagagcacagacaaatctttacggagagggaaaaactgggcaatgcacgaaaatatgaaaataataataaacccccacaacaattttttgcgccaaaggtactcgctcggccgcttcgcggcctcgtactggggccttcggccccccacaattttctgcgccaatccaccatcatttaatcactgggactcaacccaccagcattccaatcactgggactcaattctcctgcatttcaatcactggcactcaacccaacagcatttaaatcaacaggactcaaccctccagcattcaatcactgggactcaacccaccaacattccaatcaacaggactcaaccctccagcattcaatcactgggactcaacccaccaacattccaatcgccgggactcaacccaacagcattccaatcactgggactcaattctcctgcatttcaatcactggcactcaattctcctgcatttcaatcactggcactcaacccaacagcatttaaatcactggcactcaacccaacagcatttaaatcaacaggactcaaccctccagcattcaatcactgggactcaacccaccaacattccaatcaacaggactcaaccctccagcattcaatcactgggactcaacccaccaacattccaatcgccgggactcaacccaacagcattccaatcactgggactcaattctcctgcatttcaatcactggcactcaattctcctgcatttcaatcactggcactcaacccaacagcatttaaatcactgggacttaacccaacagcattccaatcactgggactcaattctcctgcatttcaattactgggactcaattctcctgcatttcaatcactggcactcaattctcctgcatttcaatcactgggactcaacccaacagcatttcaatcactgggactcaacccaacagcattccaatcactgggactcaacctcagcaaatttctttag

SEQ ID NO: 84698 - DNA, 786 bp, Heterodera glycines
  Genomic contig location: Contig_ID=SeqID_19937; Location=254..1039; Strand=+
  SCN-specific regions: Sequence locations=1-452,613-691,713-725,748-786
atgaacagaaaaataatgtacaccgaccggatccgaacttgccccccgccccctcaaaatgatgcctcagaatccccaatcacacagggattctgaggtcttaacgatgtcaaaagtaaaatctgattgcgtattcgtgatcagcggcccaaataacccataaagacatatttttggatgatttttgattttcaattaataaaaatatgtaaaaacagcaaaaaatacaaagaaaataatttacacagtccggactcgaacttcgccccccccccaaaaaaagatgcctcagaatccccaatcacacagggattctgaggtcttaacgatatcagaagtgaaatctgattacgcattcgtgatcagcggcccaaataacccataaagacatcttttttgaaggtttttgtgagaaaaatttttccactcaaaaatcctggtcacccaacatgatttaaaatttaataaataaggaaattttttttattaaatattaaaaataaaatgcattttaattttaaattattaataaaaaacaacgttgaaaattaataatatttattttatttaaaatgaaattaatttttttacaaattcagaaaaatattaattgaagcaaaatattcgatattttataaactttaattttgaccagaagcagtttcaagcaaatatgaaaagatgtttatcttattatttgttacatgaatttataaaatgaatggtatttttaatattaaaaaaaatgagtacagcagttgattcataaaaaaagtattaattaaa

SEQ ID NO: 84699 - DNA, 1841 bp, Heterodera glycines
  misc_feature (220)..(220): n is a, c, g, or t
  Genomic contig location: Contig_ID=SeqID_19939; Location=182..2022; Strand=-
  SCN-specific regions: Sequence locations=1-82,109-1021,1044-1397,1419- 1490,1512-1841
atgaacggaaaggagaagccgacgaacaaagaggaaatgctgctactgatcggacatgatcaggatcggacctgtcgggtcggcaaagaatgaatgaattgattgattggtgttaagcattcccagtcatttgaatgatcagccatgatcggagcgcacttttgcatttggaaacagaaacaagaagcaaggccacaacgggatatatgattatcattanaaataatgattgacggatggttctgctgatcgatagacgggactgatcggaattggaatggaagcattagagcacatgatcagtgagtgatcagtgagtgatcagtgaagcaaacagcgacttaattcgattattgaagtaatatctgtttctggattgaccgacactttcaattgaaccctttgagtgtttggagtctatttgataatcaatttgaaatccgacaacatttgatcgggatcatttctcactcgagaaagtaattggattggtcgggataaaaacaggcatctcaagagttcagttttaattttggtctaaacaattcgcaattcggcacaactcaaatgttcgactgagtttgatcggtgaggaatccgaacagaaactaatgccacccaaaaatcagccccctggttggtacataaagctcacaaacgcgcctttgttgggcggtcgtccgcatcggaatgggaatgaacggtcgtcggtggccgacaaaggcacgagtccggcacggcaccggcaaacagaggacgacggttggctcgaagagattggcacacattgggccgaggacgggtcgcagttggacgagtcgcagcggaagaagcgatcgacggaggagggaccaatgtccgctgaaaaacaaacttaagccaaaaataatgccaacacattttttagcgctaaagtttaaaaaaagtcgcgaaaatatcgaaaaaaggcatttttcttatttgttagttaaaattatgacaaaacatctattaattgagaattccaaaaaatcttttaacgaaaattaaaagaaggaatttttcagaaaaaattcgcacataaaaagaatttcttcgactttaattaagcatacggcaaaaaaaacatttaatttatcaattattcctcaacaatttctatcagcagaatttctatttctttttacgtacattttttacaaaatatttcaatccaatcaacctaaatttgaagatcaattggaattggggcatgccacccgcgcagcggggctaatcagtgtcaccccattgacctctttagttggctgatcagcattgataagcactgatcagcttaagcttgtgaatgtgagcaaaaatcataaaatgaaaaatttcaacaaaaaactacccataactttgctcgaatcgaactaaaattttaattttgatatcattcttcgttaagcttcaaaaaatttatggccaaaaatatttgaaaacctgagttgttgtatactttatcgcctcaagtgtttcttttacaatttttaaatttacgactttatgggcttttgtcccccccccctcccccggttacgtctgatcagttgtagcgatcaatcactgataagcttactccctttaaacaacattatccatcactgtctgaacactttgttaccttgcgtttcaaaaagtgcagatgtgttttttgctgtgcaatttcgtcccggccgatcaccaccagcagcagacgacgcagcgtcgatcagtccgtccaaacattcgcaacgaaatccgtccgtcaaatccacgcaagtcgcaagcggatgacagtcgtgcagccccagcaaacattcatcgacccctgttgatca

SEQ ID NO: 84700 - DNA, 296 bp, Heterodera glycines
  Genomic contig location: Contig_ID=SeqID_368; Location=435..730; Strand=+
  SCN-specific regions: Sequence locations=1-62,110-195,221-296
gtgttcaagttgaaaggcaatgttgaaatgaatgaagctgatcgaacagccaacgaagtgggtttttttttttttgaaatttttttaaattcaaaattaaaaattttttgaggaattggacaatgtgatcaacatcagtgccaacgccaatgccaacaatcggaccaatggtgatgaggtgaggtattgtaattgaaatttaataatttaaaaaatttttccattttgatttaaggcggcagcggcggtgagcgacggcggggcccaatgccaacaatgggacaaatgccgaaacg

SEQ ID NO: 84701 - DNA, 1859 bp, Heterodera glycines
  Genomic contig location: Contig_ID=SeqID_369; Location=124..1982; Strand=-
  SCN-specific regions: Sequence locations=1-160,194-198,220-381,406 -445,468-784,812-1485,1507-1516,1550-1654,1688-1859
atgaattctgacattggctcacaaatgaaggacttggggggaaagtaccgctttctacggtacctcttcagtgacctcaaaaatatgacgctcaactgtacatcacgcatcgaattaatggagaattgggctaataatgaagtgagaaattcaattacattttactgattttatttatttttctgtaaattttagcgctattctccatacacatcaaaccgggctacggtagtgtcgccagccatgttgcgtgagacgtttgaattgctaaatcagcagcaaaaacaacatgaggcaattgcaaatcgagttctgcaatatggaaatgaggaggtggccaccatagcagcttcgtccttaaaacgtgctatggcttcgtcctcatcatcatcagcagcaacatcagccaaaaagccaaaattggtctcggaagatgaccggggtataattaatgtgaaaaatataaatgcaaattaataatttttaagaagtggcagctcttgcactggcggcgttcacacagatcaaaatgcgcttggctgaagacattgagggcctggagatgcgcactcgaaagcttgaagaaggtgcagccgcgacaacggaggcgcagatggaaacgatgcgccaacaaatggagcaagaattccgccaaaatctgctggaagccgagcagcggattgatcacaaatgggcgacgatgctgaacaaagaacaacaaaggactcagcggattgcggcacaaagcgcggcggtgattggacaactgatgagtaagcgagtcgcagaggggggagaagaaaaggaaaatacgagagagacagaggaaaaaaagttgataataagtgatcggtgcaattggtgcttagagaaaggtgaagtgttattcggagttaggggatgcggacatgtgtttagctgtccaccgtgcactattgcgataatggccgttgaccagccaaaatgtctgatttgtttccaaaaattaactgatttggaatacttaggatcataaacgtgtaccgaatatttgctttggatcctaattatttcgaatatttgtactcctataattgtactcctacagtatttcctcatgatcactttttttcattgtctacagtaatcgttaacattttcatttctcattaaccaataaaatttgccacatttatttgctttggatcgcatgtatttacaatatttgtgtaattgtactcctactgtatttcctcatgatcactttttcattgcctacagtaatcgttaatattttcatttttcattaaccaataaaatttgccatctttatttaatcacactgtcattgattgaattattagtaaacattaagaaaaactgaaaatttcgaccgtgaattttgtaatttgatttattgaaggtaagcacaaaaataaataaatgaaaatgcataaaaataaatgtgaaaatgcaaaaaaaattattgttgttgtgatggtggagggggaggaggcgggaaggggaaattgaaaggcatcatcattggcatcatcatcggcatcatcattggaaacggcatgtgcgggttgttggtagtagcagcaggtgctcttggttgagcaacagatcgctccttcgctcttcgcttggctgcccccgaacgcggtttatgaaaaaaaaatttttttttattaaatgattaatacacagcagggctcacagcccgtgagcccaatcagggctccaaaagacaaaagggacccaccatgggcccacaccccaagggtgagcccaatctgggcccacacctcaggggtgagcccaatcagagcccaaaaaacaaaaagttgggcccaacatgggcctacaccccaagg

SEQ ID NO: 84702 - DNA, 451 bp, Heterodera glycines
  Genomic contig location: Contig_ID=SeqID_370; Location=245..695; Strand=-
  SCN-specific regions: Sequence locations=1-142,166-170,199-202,224 -385,410-451
atgaattctactgaccttaattcacaagtgaaggacttgggaggaaagtaccgctttctacggtacttattcaccgatctcaaaaatttgacacttaacagtacatcccgcatcgaattactggagaattgggctaataatgaagtgagaaattcagtttcatttaactgattttaatttatttttctataaattttagcgctattctccatacacatcaaaccgggctacggtagtgtcgccagccatgttgcgtgagacgtttgaattgctaaatcagcagcaaaaacaacatgaggcaattgcaaatcgagttctgcgtcctggaaatgaggaggtggccaccatagcagtttcgtccttaaaacgtgctatggcttcgtcctcatcatcatcagcagcaacatcagccaaaaagccaaaattggtctcggaagatgacggggtataa

SEQ ID NO: 84703 - DNA, 411 bp, Heterodera glycines
  Genomic contig location: Contig_ID=SeqID_370; Location=1025..1435; Strand=-
  SCN-specific regions: Sequence locations=1-225,253-411
atgaagagatccgctgctactctttctactgctgctgccgctccaaatcagcatgagaataaaattgaacccattccgacacatgtggaaactgaaccagatcatgagacaaaggggccgccgccaacaaaaaagcgcgcggtggaggaccgagatttgtggaaattagcgaagggaaaatatttgcttactacatacctctgcccgggtaaattaacaatagacaattttttattttaattaatattttaagacgactggaaccgattgtatcacaatcagcagaaggtgaagcgcctggacgacgaccgcttttctatcaactttgagctatgtcaggaatgcgtgcgggtcaattgccgagcgactgacttaattgcacccatgaagaaaaagccaaacaatgaatga

SEQ ID NO: 84704 - DNA, 1059 bp, Heterodera glycines
  Genomic contig location: Contig_ID=SeqID_370; Location=2406..3464; Strand=-
  SCN-specific regions: Sequence locations=1-951,973-1059
atggtggtcaacaaggggaaacggtccctggcaaagctctgcctgaacaatttatgtgagttttgacatatgatttggacagaaaatgtaatttttagggggacgtttttcgcttcgtaactttggcctgtgccagacactcatcactgacgacccggtgacgctggccgagtacttggacaacaaatcgatcgaagtcacatcgattgatcagctggacgagacgcacatcctcatcacctacctccacaaaaaggactgggtcgatgagcacgcttgctcaaacatcggtgagaataaacttataaaattgtgctaaattgataaatttagtcatctctctgtagaccacttccgctgcgcggcttgttctgctcaaagctatgcagaaggtggttaggtcgccaggctctgagctgctctacaccggtacatatgccctaacaaaattacacaaaataaattgcaaatattttttagatacagacagtctcatcctcgtccacccggaggagcgatgtccgctcaaaactggtccacacctgggccagttcactgacgagtacccggaccacgacattgtgtagttttgcagtgggggtgcaaaacaagtaagtttaatgtttatacattaatttgtattgattatttcacattttagtatggtctgtgtttgcgacgaaagggagctggggcggatgccgaaaaggaatacgtgctcaaggtgcgcggattgacgctgaactacgacgtgatcaacaaccaaggcatgcgttacgagacgttcaaagaagaagtggtgcggtacgcaacaacgggtgattatgagccaatcattgtcacttatcctaacttcctccgaccgaacattcgggagggagggagggtcgtatccatgcccctacagaaatgttaccgaccatatgttgggaagggaattataggcagcgatttcaatgtgaagaattttggccacactttgtaatgtttttgttttctgatgtatctgtctttctcatcaatacaccataaattgtatttaactcgtttttcaataaa

SEQ ID NO: 84705 - DNA, 1703 bp, Heterodera glycines
  Genomic contig location: Contig_ID=SeqID_371; Location=201..1903; Strand=-
  SCN-specific regions: Sequence locations=1-622,648-661,683-1200,1222 -1535,1567-1703
atggtggccaaaagccgtggctgggcaagttggaagttccatcgctaccttcacagccaacacggccaacagggctgccttcaaagggatgctttgcaactgatgcaacaaattggcgcacggcctggactcaatgcgtatgatgctgaaattgttgtgccccgggtggtggaccattggaacaacagccagcaacgacatcgttttgctgtgtttatttttggctccacgggtcagtacaagccgctatacaagtacatcaacaactattacgacacaccgattgtgctctacctaaacaacggtcattttgacggtgtgaagaaagagtatggcttgttcggtcaacattactgtctggaatgcgaaaagccttatgaacggccgtcacgacaccttaactcttgcaaggcgcgctgtatgctctgttctcgtgttggacctcgcttcccctgctctccgttggatgggtttttccgtgaatgtgcggggtgcaacaaggcatttcgcaacaacgactgtcatcaacaccatttgacatcaaacttttgtgctcaatcaaaacgttgcaaagaatgtggagtaatttgggacacacgagtgcacaacagagatgggagaaaggtaaacactaaaattaaataaaattttcagttattgttggatttagggtcacaaatgcgacgagcgttattgtcagacgtgcaacaactttcacaacgtggaacgcggttgctacattcagcaaattgaaccgaaagaaaacgacccctaccgaattgtggcctttgacttggagactatgcaacaccaggcgatggacccccaacaacctgagaagagggaacatcagccaaacttcattgctgcgcgggttgcatgccccgactgcattgaaaacggcaaatggaagagggcaactgcaagatgtcaaatctgcggaccacatcggaccgttgtgttctgtcaacgccgattcatggacacacaagtggacaagcaagtggtagctgacaacccgctggagccattcgtgaattggctcgtgttcgaactgcccaagaaatgcgacacctatgcctactcgcattttggtggtcgcttcgatatggtgcttgtcttccgcgagctgtttcggattggttttaaccccgaaatgctgcgacgggtactcagttacgaatttttgtgtcaaaattttaaaatttcagggaaataaaatgtacgaaatgaaagtacagaagcagaaaaggcgcaacccaaacattgtattccgggattcgttcaacctgatgccgtgttcgttagctgcactcatcccttcttatggtctggacgtggaggacaagcccttcttcccgcatttggccaacagaccggaaaactacggcagagaaattcgcccaacgcccaacgactatttggcaaacggtatgatgcccggaaagaggcgacagttcgacgaatggtatgccgcgcaccaccaagagccttttatgctcgatgaggcgctagccaggtaaaggggtttttttaaaatgtacaaattaaatttttctgtttcagttattgcacgaatgatgtcgagattctgatggccgcccttgtcgcattccgtcgggaattcttcgagatttcgcgtcgccaggagtacgtggacgggatcgacgacagagagaaccatgatggtatcgacgtactgc

SEQ ID NO: 84706 - DNA, 552 bp, Heterodera glycines
  Genomic contig location: Contig_ID=SeqID_371; Location=1972..2523; Strand=-
  SCN-specific regions: Sequence locations=1-552
atggtccaagaaggtgctgggacctcctcatctacatcaaaaactgcaaaagactacgttagaaagctggacagcactatcgagcacgtgccgcgcttccagtacagcaaagccaagtcgcggttcagcattgaggacgtaccagcagcagcaaatcctgaaggacttattgctggcattttccagtacagcattgatgcggctgtggcagacagccgtgagcggggaattcatcctacacacctcggctgcctcatcagtagtccactgttgactggcggggacatccccatccctatccggcaaatcacggacaacacggtcaacaccatcttaaatcaattcgtcaaagtggcacagagcaagaagcaacagaacgtcacactgtggggtgaaccgtttaccgtagttgtgacgacagttaatcgacctggactgccgaccaaaagaacgctgaagggaggcgcacgacgagctctagcacctgttcaccatcgtattaatgatcggagtttgattaaggtccggtacatgataaagcaacagttttga

SEQ ID NO: 84707 - DNA, 1169 bp, Heterodera glycines
  Genomic contig location: Contig_ID=SeqID_371; Location=5963..7131; Strand=-
  SCN-specific regions: Sequence locations=1-61,83-91,113-404,434 -611,633-642,665-1169
  Gene Ontology: Mol. function=pre-mRNA splicing factor activity; Cellular component=nuclear matrix; Biological process=signal transduction
caactaagtctactaccgccgcccctgttaagtctacaacagcccctccgccaactgtaaaggcaacaacagcccctccgccaactgtaaaggcaacaacagcccctccgccaactgtaaaggcaacaacagctcctccgccagctgtaaagacaacaacagcccctccgccaactgtaaagacaacaaccgcccctccgccaattgtaaaggcaacaaccgcccctccgccgccaaagacaacaacacctgtaacacctgtggtaaagagcccatctgttaagccgacaatttcggcaccaccagctcagctaaaatcgacagccaatgcgccacctccagcttcggtttccgctgaattggctcctcgcgctcctctggcagactctccaccgcgttttgacgaaggagaagaagaaaataaaacagacaaattaaccgccgcaaaaccttcaactaagacgacaattacggcgcctccggcgcaactaaaaagctcggcaacgcctcatcaacaaaaacagcaagtgcccgtaaaaccatcagctcccatttcggttcccgcaaaaccgtcaggctctcaacagcgttttgaaggaacggaacagaaacagcagccaccaccaccgccaacatcagctgctttaacattagcagatttgaatttaccagaaaataccctcagcgttcaaatagaccctctctcatatgtgcccaattccgtctcaattcaatatcttgagaacatggaacgattcaagctggtgttcaatgaggcgatcgtcagtcatgtgtccttctcaccgcagttgggctatgtgcttggctttgaaaaccctcaacatgtcgtgtcaaatgaactgtcaaaatatcctgtagatttgcgcggaggcatctcaagctttgctgtctactcgaaagggttgaccgaaaacatgatcattggcaattcactgagttcgctgcttcgtgttgtgtctatcagcggtgccatcccttgggagtacaacgagaagatttacgactcgccaatatttgcccgtgtgttaccacgggagatcaatgagattgagattgaactgcgcacaatggacaaaggccgtctcgtgccgttcgcctatgggacaacgatggtcgtactgatatttaagaaagtgataaacttctga

SEQ ID NO: 84708 - DNA, 1324 bp, Heterodera glycines
  Genomic contig location: Contig_ID=SeqID_3442; Location=45..1368; Strand=-
  SCN-specific regions: Sequence locations=1-974,997-1040,1062-1324
atgtcagacaaccgaaaagaagccgaagaaaaaatggaaaaagcaatgtaaaattaaaatgccaattttcaatttcaattttaaattttgttttcctttttttcagtttcatctccgccgactgttggctttcagtgttcgatttgcttccgccacgtcaactgggccttggaattgcacttgtcagccaccgttttgacttttacatcgacgaacacttcaagacgcggcgttgggcgctcaaacccatggaaattaaagccaaatttgaagcggacggcacaaatggatgggaaattgtcaatttcaatcgaaagccgttgccaactccacaaaaagcgttgccaaagaaagtcgtcggattcaagcgcatttcaataaagtgaaatgaatgattgattttttcttttttgttgtaaaacgattccttaattttcacagatacgtcgaccaaaatgccatcgcttttctctgccgttttcgccaacttttcgcctcctgtccaattaagttggtcatctacacgggtggtgaccgcactttggagttcattttgcgcaaattttggccaatgatcgcgaaaaacatttgtgccatacaattgtacggcagaattttctaccgtttgcgacaatccgtgccgtcaattctaaacgattgtccatcgcttcgtattatcaattcctattctggtggctttttcgccgaatttccggccgatgacagtgccatggcgtcggatggacaagcgttggacaaatggctgttcactccccgtcctgacaatgtgccaaaggtgttaatggatgatgggaatttgtcctcgagaattgaagccttgaaagcggtgatttgattttatttgtcatttttacggtctttgtggttcgctgaccgaaatatttcttttggacggcactcaaatttttttttttttgcttgaataatgttcctaaaaataagttaaaaaatagaaatttcgaaattcatatttcatgtcgccacaacatttaagtgtcattcatttcatatttcttaaccaatttttccacatttgaggcatttgccaatgcttcatctcccgtcaatttcattgtcatttggccaccgcgtcttgctgactccgttgtgccatttgatcagaccaacgaattgactcgggaacaattgacgttgaaaggaactgactattgctatcttcttctgttggtccgttgtccgattgcgcgagacgcgagcaaatgggcaaaatgggaaaaggaagcgattgactggcaattcaatgatcaatggaacagaatcgacattcaaatcaacaatgaac

SEQ ID NO: 84709 - DNA, 546 bp, Heterodera glycines
  Genomic contig location: Contig_ID=SeqID_3442; Location=2502..3047; Strand=+
  SCN-specific regions: Sequence locations=1-53,75-86,108-185,207 -383,405-546
  Gene Ontology: Mol. function=profilin binding; Cellular component =secretory vesicle; Biological process=cholesterol catabolism
atgtctttatttgctatgggattattgccatccaaaacgacaccatcgccgaatggcacgactccatcaccgccaactccaccgaatggcacgactccatcaccgccaactccaccgaatggcacgactccatcagcgccaactccatcgaatggcatgactccatcaccaccaactacaccgaatggcacgactccatcaccgccaactccaccgaatggctcgactccatcaccgccaactccaccgaatggcacgactccatcagcgccaactccatcgaatggcacgactccatcaccaccaactccaccgaatggcacgactccatcaacgccaactccatcgaatggcacaactccatcaccaccaactccaccgaatggcacgactccatcaccgccaactccaccgaatggcacgactccatcgctgccgcagcaacctccgccagtcgccacagctccgtcaccgtcgccaccggttggcaatgtgttgccgctgctcgccaacggacagtacgcagttggatgtgccgacattatg

SEQ ID NO: 84710 - DNA, 1460 bp, Heterodera glycines
  Genomic contig location: Contig_ID=SeqID_19941; Location=425..1884; Strand=+
  SCN-specific regions: Sequence locations=1-95,117-215,237-242,279 -338,360-527,549-635,673-1032,1054-1084,1106-1185,1207-1251,1278 -1332,1354-1460
atgaccaaggaccaactgtcggagaggcggaaactgatcgaagaatgcgggaagaaaaggcagacggacaacggtgattgggtgatttatgccaatcaggttgtgctgagacaggacattgaccatattcgaaaaaatttttaaattgtccaaccaaatcactgcaaattacctataattattacccaaaagtacaaaaatttttccggtctgtaaaaaatttctaccaaaaaattactcatccaaactttttaataaaaaataaagggaatgttaaatgctgcctaataaacattaggtcaataatgaataaaatcgatgaaatagcacttattttagaaactgaaaaaatagacattcttttaattaccgagacctggaccaaagacggggaagaaatcgatttttgcccttgggtaaaagagaattacaactatattttttcatcaaggaaatcgaaaactagtggaggtggttgtggtattctaatcagaaaagaaattggattttttacaaaattttcggattcaaaatttaattctgaaattttagttattcaacttcaaaatttacaatgcatcagatttgttttggtgtatcgaccacccaaaacaacactcaagcaaacagaaaatttgttcaaatttttacaaaaattttttaatgaaaattcagtgactttaggagattttaatttaccgaataaggatttggtatggaaaaatgggcatccctattcaatgagtaaatatggtgaaatattttgtgactttttcaatagattttcttacgttttggccacaaatgagccaacacggattaattcctggctagatttgatttttacggccaatgaaaaaattattactgattgtactgttaaaggaggcatattttcatcggatcatttaacacaatttttcacattaattactcctaaaacaaaaccgaaaacaaagatcgtaaactttcgttggttttgtccatcgaatgtgttacattttaatatagtcatagcatcaaggctaaatgccttgtcatatgaatgctttagcataaatcaaaaatattccgcctttaacagtatgttgttagaaattttaaatgagtgtattccaataaagcgtttaacaaagaaagatttgactcctaaatacccacaacatttattagcatccatcaaagaaaaggctaaattattcaggcaagctaaaactgacccatccaaaaaagcactatacgatagcatttctttacatataaaaatacaaacaaataaataccatagccaaattgagaaaaaggctatttcaaagggaagaaattcaatttataaatatatacaaaaattcaatgtcaatccctttgaaatacctaatctaatctatgaaaataaatgctatcataatagtgctgagaaatctgaattatttgccaccattatttgccaattcatttaa

SEQ ID NO: 84711 - DNA, 333 bp, Heterodera glycines
  Genomic contig location: Contig_ID=SeqID_19945; Location=353..685; Strand=+
  SCN-specific regions: Sequence locations=1-333
atggccgcgctggtggagcagtgcctggcgttggccaacattttgcgcggctacgcctttctgccgggccacgagcgaacattggccgcccacggcggactgttgcgtctgctgtccgcactgatgatgctgatggttgacaagaaacaacagaagcgggcaaagccgacaacgaagcgtacggcagaaacggcagcgaagagtggcagggacaacgacgagatcgggacggacacccccgtcccgggggatcaccaccagcagggcatcaagttgaacaccaattgcaatgatacaagcatagcaaccacgttggaggagggagtggagcag

SEQ ID NO: 84712 - DNA, 724 bp, Heterodera glycines
  Genomic contig location: Contig_ID=SeqID_19946; Location=380..1103; Strand=+
  SCN-specific regions: Sequence locations=1-82,110-156,182-376,398 -414,445-488,519-614,703-724
atgtacgaaacacagctatttttcaaatgtatgtttcttcgtttaattcttggtttgactttttattcttttaaaggattgttattttattctcaaacaaattaaccaaatttttatttttcgtgtaaatttgaaattattatgcaatggtgaatttcaatattaaaattaatttacttttaaacgaagaatataaatcgatttgttcaagcacataattattttaatgagagcgcaaatgtcttttttgttaggcggcgcaaatgtccgcggcgcaaaagtctatttttactggccggcgcaaatctcgcggacgcaagtgtcgaaaaaaatcattttaaatattaatgttaacaaaaaaacaaatagaaaattcgaataaaatcataattttattacctaaccataatgaatttttcattgatgaaaataaaaacaaaaccaatttccaacagaaatgataatttaaaaaagcaagttatatcttctaattaaaatttaaaaatatctttattttagcaagtatattttgtcaattaacaaataaattttaaatccaattttatagtcttgatttaccgccgttgcaattcaagagcagcgacagatgaaagaatattaatttatatttaatttaccaaaatttaaatacaaaaccaagtatatatttatatttttaaatgatttaaaaaatatataaatctcaatccgaaattttagatta

SEQ ID NO: 84713 - DNA, 2006 bp, Heterodera glycines
  Genomic contig location: Contig_ID=SeqID_19949; Location=1..2006; Strand=-
  SCN-specific regions: Sequence locations=1-291,313-439,475-550,608 -1044,1066-1260,1283-1793,1827-1841,1865-1896,1918-1935,1957-2006
  Gene Ontology: Mol. function=potassium channel activity; Cellular component=integral to membrane; Biological process=cyclic nucleotide metabolism
cccgtcgcttttgcagaaggcgtcgtccgacatgctctcccattacctccaaagcggcgtgttcaagttggacttgctgtccctgctcccccttgatgccctgtacttcttcaccggccccgtctccgcgtggcgattttgccgtctttttaaattgcactccttctgggagttcttcgacctgttggacagcgccttctccaacccatacgctgtcaggtgatcaaatgagagaaagaaaccacgcaattaggcgacggaggggcaatggcaattagcactaattaatggagcaaaaaataaataaacgaattaatgcgataaaataatgcccattcaaagaattgcaaagaccttctgctacatgatctacattatccactgcaacagttgcgtttattatgtgctcagtgcgtggcaagcctttgggtgccatttttacattttattgcttttttaaatggaaaattttaagacaaattccctatttttacaaaggcaaatggtatctgaacaaatgggtttataacaacgaaggtaagcagaaaacgagaaggggagagagagattaagagagacgagatagaagagaaagagagggagagaggtgaaatttattaatgagcaattaagcaacatattagggctaattgccaaatgattccgtcgatttttcatttttccccaaatgcttcttctttccccccccccccctctcccaaggcaatgcttacattcgctgcttttatttcaccgccgctgtcgcgtgcgttttttgttctttgacttttttcacccattcaatttttagcacttcgactggtaacaatccaatgccgacaaatgtgagttccccgaaaaatttttatctttggaatgcccaaaatatatgtgaacatatccaccagggatgtgccgagccagacaaaatccgattccgattaaatcgccgattccgattatggccaaaaatccgatacggttttaaaaccgattacgattatggcccaaaatccgattacgattccgatttttttaaaataatttttcccaaaaattttattcataatcaaaatcataaattttaagattgtgatgcaaaaataaaagtttgtccacattctgaggcgttttctcagatctgtcacaatcaacccagcggtggagaaaagccgttcgctttcagtcgatgtagctggggctgagaaatatttttttgatagcttagattcggaaacgaaatgtcttctgcatacagaagcccaacaactgttttgttttgcaaaaacgatcaagcatttggaaggtagatgaccaacgcacctgataggaaaattgcaacttagtaataattcattcatggttcttttctgctttaatgtcccaacaaattttttcttcaaaatttcgacttttggttcgaattcgggtccgggattcaaaaataggtgaattggctgccatgttctttaactgacaccattaacaacccttcaaagactttgacatttttgctaaataacaaaaaacttgattatatcggggagaattaatccggcactgctttgtgagaaaaatttaatttcagtcattatcagggcggccaagtttttattttcaaaataaggacagatgaggctaaaactaagattcggaccccaaaaataagattttttctaaaactgatagtagcgcgaaggataataaaaacatgaaaaaacgacttaaaacaacattttattagcataaaaacgaaggcctgtcaactgaaaattttgtaaatcagcattttgaaaaattttattcaaaatttaaaaattaataatgtttttgcggcgtgctttttccaaaaaacttttgggaattggggggccggcggtgccgataggcgccgccgggaaaatttttgaaattttgtatgtgatttgttaacagattttgtataaaaaagaccaaatttcgagattttaaactaatttttttaagaaaaattgggattttggtgt

SEQ ID NO: 84714 - DNA, 1287 bp, Heterodera glycines
  Genomic contig location: Contig_ID=SeqID_19952; Location=937..2223; Strand=+
  SCN-specific regions: Sequence locations=1-234,266-331,354-382,404 -677,718-820,977-995,1267-1287
  Gene Ontology: Biological process=protein biosynthesis
atggacaaattggccaccacgttggaggaggcggacaagaagtggcagctgttcaacctttccaaggagttcttcgcggacggcgaactcagcgcattccaacggaccattgagacagtgaaaaattggtttgagggggccaagaaggaggcggaacagctgaaggacaaccaggacgccacgttcagcacggacgacctgaagacgaaggtgggagagtttggaatgggaaacaagaattttgttttatttttccgaaaatttccactcactagttagtcattccttcctctaattgaaaaaaatggaagaatccagagactttttttttgctaatttatgatttatgccataaaaattactgattttaacagatagcggattgttttatgtcatttttaaacatattttctgtggatttcaatcagctcgtctctccctctctcgaaaaaattttttttcatcttttttaagtacttcgaaagtgtaataattttttttctttttaaaaactctctatgaaatttgagaaaggatttttattttaagatttatgtttttttcgaccggattcgaaggtgctgcctatgaacacttcgaaattaatttttctcaaaaattctcaaaatcccatgacagcaaaatgttttcattgtgtgaaccatttttcgaaaatgtttttaatttaattaataaaaaaacaaattttaaaattttcagacaaattcgatcattggcgaagtgcgtttcctaacgtccaaatattacgcggccgcgctcaaacagcgcgaggaggcggaagcggcagccaaaaaggccaaggaggaggcggaagcggaggcaaagaaggccgaggcggaagcaaaggaagcagaggcggaagcggtggaaaagaaggaagaggaaggagaggtgaaaaaggaggaagtggaggcaaagaaggaggcggacgaggacaaaaaggaagcggaagaggtcaaaaaggaggaagcagcggaagtgaagaaggaggcggaagaggacaaaaaggaagcggaagaggtcaaaaaggaggaagcagcggaagtgaagaaggaggcggaagaggacaaaaaggaagcggaagaggtcaaaaaggaggaagcagcggaagtgaagaaggaggcggaagaggacaaaaaggaagcggaagaggtcaaaaaggaggaagcagcggaagtgaagaaggaggcggaagaggacaaaaaagaggtggaacaagacaaaaaggaggcggagaaagacgaagctgtaaagagtgaactgtaa

SEQ ID NO: 84715 - DNA, 1124 bp, Heterodera glycines
  misc_feature (1076)..(1076): n is a, c, g, or t
  Genomic contig location: Contig_ID=SeqID_3445; Location=173..1296; Strand=+
  SCN-specific regions: Sequence locations=1-8,30-205,227-793,815-1124
atgggtcaatcatcttcagagtccaagagatctgatgacaaaaccgagcaacaaaattttaatgaaatggctgctttatcatcaccgaaagcatcaaatggaatgccaatttctgatttttgctatgaaatttttggggatgatcaattcaacaatttgacgtcatatctcgatgagattgatggatttgagtcaaacctattcgacggccttttgcaagaaaatgatgaacaatttccaatcactgattttaagattacagaaaaacaattttccggatcgaatcaaactttagccgaacagtatgatgaagcaaacactagtcgtactgtaagcgaacaattacagcagggggaaaacattgaaaatacccaagaaaaatcaattggatctgatcaaggaacaaactcgaactcggaaaactttcaaggaccaattccggatcacaacatagttgttgtacaatctccaaaacagcatgagtatactgtattgcaccaagaacgagaaaaggaaataaaaattgatactgtatcggttcagcctaaacgcaagagtccaaacaaaggtgcatctaagaagatcaaagaaaatcgtaaaaaagcatttgatgatagccaaacaaaaccgacccaaaaagtaaagccaaatgcggaaaaacaacatcaaaaaataaaacaagtactcagcgtaactaaaggtgtacaaaagtcaaccagtgccatggcaaaccatggacaaaaattgaaaaagtctaattcattttcaaaaatgctaaataatgaaaatgttgaacatgttttgacaagaccaattcctggcagttctcatacagcaaattaccaaagacagagcaatgcttcaagtccaattaatattcaaacggcacatatgacagtgtccagtccagctaatccaacacaaatacaaactggcacatcaaacagcccggatttaggctggaaaacgcagaaatccttgccaaaattgaatatgacaaaagtcgcaaaattgcttgacataaaccaaaacagtccacaatactcgaacagcccgacaacggtgctaaatcctgngacggttccgaactcaccgctgatgtcctcccagccacgcacgccaac

SEQ ID NO: 84716 - DNA, 1383 bp, Heterodera glycines
  Genomic contig location: Contig_ID=SeqID_3446; Location=123..1505; Strand=+
  SCN-specific regions: Sequence locations=1-224,246-1173,1195 -1287,1309-1383
atgaggcaaactgaaaatgacaacattgtcaatgccgataacaatacgtcagaccggctacaatcgcaacattctgtttccgattacttgaagaactcaccatcatatcccaacttggagactactgtagcatcaacatcacaaagtgtttcatcaacaaacaataattatgctgaagctggacattacaatagcatttcgcctactgtcgatgctacagtaaaatctatgcccccaccacagttttcaaatcctttcgcgtcaaaatcacaaaatatgaacgcaacagatcaacttttggctattaataaagccgcgagaaatctttggacctcacaacaaaattctactaccaatgttaccatctcaggcttacgcctgccacagttgccaattactgatgcaaatgtcaggcaattaaactcacaaccaaataatgctactgtatatatgcccccacaacaactttcaaatcctatcgcgtcaacatcacaaaatctgagcgcaacagatcaccttttggctattaatgaagccgcgagaaattatttgagatcacaacaaaatcctactaccaatgttaccgtatcaggcttacgcccatcgcaatttgctgttgcagatacaaatgtcaagcagttaaactcacaaccaaacaatgctacagtatcaggcttaaccacagagcaaatggctactgctgatgctgcggttaaacgcttgaattcacaaccgaatactgtaagcaatgctaccgtatccgacttaacccccgagcaatgggcgctcgttgaagcatcagtgaaacgtttgacctctaaacatgctgatgatgcaaacattgctaccgtcaaagggcaaacaccaacgcgtgtagctactgtaattgataataccgtgcattcatcgcaaattcaaagcgcaacaaacgccggaagggacgcccaacccattaatagccctcaaaataatgtgctcacgcggcagtcatctttggaatttataaatgaacaaagctttattactgctgccaacaaaacagctgcgaagggcacgtatttacgaaagtctcattcaactacagtacctcattcaatttttaccgtaccacccgtacctcaatttggtaaagaacaatttcctaattgttgtttctcaggaataattttctgacaaaaatatacaaaatattaatattttgatcatggatttttcggaaaatttattgcttaaaaattctatcgacttttagactaacttagggtgttatgctagacaaaggcccgtaaaaaagatggaaattttaaaacgaaagattcactaaactactttttaaggccacacactatacttaaggtaaatccgaagtgctgagtcgaagta

SEQ ID NO: 84717 - DNA, 904 bp, Heterodera glycines
  Genomic contig location: Contig_ID=SeqID_3447; Location=248..1151; Strand=+
  SCN-specific regions: Sequence locations=1-24,46-89,117-302,324 -401,440-639,715-904
atgccacgttatgtcgaaaaaatcgctaaaagggcagattttaagaaacgacccagcaccccaccccaatatataacaggtttttttatactttttaaaaaatttggtttacttttaggggtgacaatatttttaggaaaacccaatcaataattgtttaggtaaatcaacaccaatcggaaacaatcctgctgaggctcagattcaaaaccaaataattgaacctctcaacaccgtacccactacaataattccatcgttggcagttggtggaaaagttggcgaaacttcggacaatttaaaaattgagcaattatcaattggtctggaattggccaaattggcattaaatgccacaattccaccacttattattggcacaacagcgacacatgtaaatgattataaacagattttgaaaatgaattttgcctgtctaatgctgaacaaatcagaactggacattgaccaactttatcaaaatgcaataaattcaaattttaggtaatattacaataaataggaatgggatttttagtttaagaaaaatcccgaaacacctatttaaataggtacaaaaaaactcaaaatacttattaaataggtacaaaaaaccccgaaattggcagagaaataggcaaaaaaaaatttattaataatttttaggtagtaaaacatataaaataatcaaaaaaaatttaattttgaatatttcagtcgtaaatgcaaaaaatttaaagtttttttcgaataaaggacaatttttaaacctaaaattcttgtcaaaaaaaaaattttagaggataaatttttgagaaaatttttttttaagtaatcggtaaaaaaaactcccatatatatagttaaaggataggtgttataaaactgggtccagaaactcaaa

SEQ ID NO: 84718 - DNA, 332 bp, Heterodera glycines
  Genomic contig location: Contig_ID=SeqID_3449; Location=1868..2199; Strand=-
  SCN-specific regions: Sequence locations=1-332
atgtctaaaataaagtccttagggtaattacaatccaattttatcaaattttccagcagctcttcagggtatttatttctttttttgagatctgatctcctaaaatttttgcaccatcacctgatatgaattttttaaattaattacatagaacactttattaattatcatagttattaaggttttgtgatagctaatgtcgtacaaattcaattaaaaaaattttcggatgctttattcagataaaatattatataaggatttatccagtattaaagttggtaaataattgctatattttgcttacaagggtcctcacaacaaataataaa

SEQ ID NO: 84719 - DNA, 264 bp, Heterodera glycines
  Genomic contig location: Contig_ID=SeqID_3449; Location=3592..3855; Strand=-
  SCN-specific regions: Sequence locations=1-85
atgtcaaatcgatgcgcacataatgtggcatttgtgcagtgcattttaccacatcgagaatatctgttttcaaaagttagtgcccaaattaaatttcaaaatttttttttatcatttttgaaaaaaatattataagaaaattattattttaaatatttcagtaatatatatatataaatttcatttatttctgaatgttatgtatttttttatattaaattcgttatttttaatatatatttgttttattaaagattaaataaa

SEQ ID NO: 84720 - DNA, 678 bp, Heterodera glycines
  Genomic contig location: Contig_ID=SeqID_19955; Location=521..1198; Strand=-
  SCN-specific regions: Sequence locations=1-495,519-591,613-678
atgggtcatcgctgtaatcaatgttcagcgtgtccagtccgaatgggttgtgcatggaagcgccaatttcaatgccgcgtttcccatccaacaaacgatgtgccaatttactttcgttgtattgtattcttacaactgcggaaggtcatggcaaaaggtaaaattgaaaacatacaaaaatttatttaaaaagaaatttcacctgctaaaatcctcaaaaattttaaaaaattcgagagaatatgagaaaattattgaattttttggtatgtcttttttcaatgcttttttaaatttttctgcaatttttgagaaaattttctcagggccggcacgatgccgatgggaaccggagaataaattggaaattttcgtggagagaatttgttctgacagatttggtgcaaaaaataaccatttttgtcgtttaatttccaaaaaagcgaagatcttaaaaataaagatgacccagttcaatttcaaaatattgcaatcataaaacaacaattaattaattatattccagctgtaaaaaatattagacggattttccgaatctgccggaccgggctggtattttcaaaaacgaccggattccggatccagtctctcaaaatccggtcaatctatgtaatccggtcaatccctatttttcaaatttccggatccagaacctga

SEQ ID NO: 84721 - DNA, 992 bp, Heterodera glycines
  Genomic contig location: Contig_ID=SeqID_19956; Location=184..1175; Strand=+
  SCN-specific regions: Sequence locations=107-148,183-217,291-404,428 -459,516-516,606-611,675-688,718-754,782-992
atgataggaagagccgacatcgaaggaacaaaaagcgacgtcgctaatgacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaag

SEQ ID NO: 84722 - DNA, 672 bp, Heterodera glycines
  Genomic contig location: Contig_ID=SeqID_19957; Location=1124..1795; Strand=-
  SCN-specific regions: Sequence locations=1-398,421-672
  Gene Ontology: Mol. function=sodium-dependent phosphate transporter activity; Cellular component=integral to membrane; Biological process=anion transport
gtacaaggctttgaagtggtcaagaccgggtttatggccgcccttccgccgcttggccaggcggtgatgaaagaatgtgccgggctgatcaatgatagaatccccgcgcggataatgagcgaaactgtcaaaaccaaactgttcaattccatcgccttcatgagtatgtccgctgtcattgtggccgtctctttcgtgccttccggctatggcaatctcgcgctgtttctgctcactttctcggcattcactctcggctttaacattggcggattttacaaaagcggtagggaatcaaattttaaaaaattatcctttccttcccctctgggagaatgcctatctttccattaatttatgtgccaatttaggctcgatgattgccgggccctattcgccttttgtaatgggccaaatttccaccgcaatgaccgtcacaatgtttgtgtcctcctttcagctttacctttcccaatcccttcttcgtttaggctgactgtgccggtgattgtcaatccgttgaccataaataacacccgcgaagaatgggcattggcattttatgtgaacgccgccattatcgtcgcgtgtaatattttctacgtttgtttcgccaaagcggagctgcagccatgggcaacaattcaggtgcaaatgaatggaactgaattc

SEQ ID NO: 84723 - DNA, 796 bp, Heterodera glycines
  Genomic contig location: Contig_ID=SeqID_19958; Location=418..1213; Strand=+
  SCN-specific regions: Sequence locations=1-96,129-475,497-534,557-796
atgaatagcggcgtcagcccaactccgttcctctcgctccgctgtgtgtgctcagtgctggtgctgctcatctgtgcgttcgatgtgtcactggcagcaaaagacaaggagaagaatggcaaagaagaaccaggaggccaatttaatacgctcagcatcattttgctgattccgctggtcatcgtcaccggcgcgttcgtctacctgctgtttatgaagccaaagagcgaaggaaccggcgatgacgacggagaaggcgaaggggacgcggacgtggagaagggaccaaccgaagagacgaagtaaaacacgggcagagccgatttggctaaacaaccaacaatatttttcgcatttcagaacggagcctcgaattgaatctccagcaactcttttgggcgtgacagtgccgttggagcaagacgaagaagagcagaaaaaggacgacgaggggtaagtgcaaaggcggcggatcattttttactcattaaaatttaccatttttagtggcgaccaaaccgcggagaagaaggaagaggacgcggcggcagcggacgaacaaccgaaagaaggcgctgcggaggcagcggaagcggagaaaagtgcgacaaaggaggagacgaccgaggacacggaggagaccacggaaacgacggaaggatcgaccacagagacttccgacagcggctccgggtcgtcttcagcatcgggctctgactctgaggggagttctgggacttcggacgccacttctgaagccacagaggacgcatcatcttcatcggagggttcttaa

SEQ ID NO: 84724 - DNA, 996 bp, Heterodera glycines
  Genomic contig location: Contig_ID=SeqID_19961; Location=83..1078; Strand=-
  SCN-specific regions: Sequence locations=1-481,503-541,579-736,762-996
  Gene Ontology: Mol. function=protein kinase C inhibitor activity; Cellular component=cytoplasm; Biological process=signal transduction
atggtcactgattccaaagaggacattgtgttctttgccagagtgtgtaagaaggcgcgacgctacgatgacatgaccgaggcaatgaagaaggtgtggtcgatgattgaaagcattgcatttgatttgttttcattttttattttcagatgatccaagcggacgccaatttgaacagcgaggagcgcgagttgctcggcaccgcctacaaaggtgcgattaatgcgcgtcgtgcgtcgtggcgttcgctctgttacgcggaacaacgcgtcgctttggaccttacggaccagcaaatacaggcggagtttgggcacaagtgtcagcagcgagttcctttttgacgtttcccctttttacaggtggcggaagagtaccggatgaagatggagtcagaactgctcaccatttgccacgatattttggtcagtttttgttgttttttttcccttggattttgaccattttcccatttacccccgtttaggaagccatcaatgaaacgcttcttccgaaggcgagcgacgctgaggcgaaggctttctacttgaagatgaagggcgattactaccgctacatgatcgaagtggcgccgggggaggagcgccctggtaatggtttttttgctctcttttctcccacaaattcgctttttttagctgtcatggacctctcaaaacatgcctaccaagatggccttgaaatcgccaccaaggagatgaaaccgtccaatccgactcgcctgggcctggcgcacaacttcgctgtgttccactttgaagtcttaaagttgccggcggaagcccgtcagcttgcgcagaaagtcattgtttttgactttttttttggaattcgtttgcaaaattttaggcactcgacgaagcgatggctgaaattggcacaaacgaagtggccggggaaacggatgctgatcttcagttgattcgggaggttttgaacgcgtggaagctgttggatttcgctgctgacgcgtag

SEQ ID NO: 84725 - DNA, 93 bp, Heterodera glycines; identical to SEQ ID NO: 55936
  Genomic contig location: Contig_ID=SeqID_19962; Location=441..533; Strand=+
  SCN-specific regions: Sequence locations=1-93

SEQ ID NO: 84726 - DNA, 601 bp, Heterodera glycines
  Genomic contig location: Contig_ID=SeqID_19963; Location=33..633; Strand=-
  SCN-specific regions: Sequence locations=1-201,225-601
  Gene Ontology: Mol. function=structural constituent of cuticle; Cellular component=basement membrane; Biological process=cuticle biosynthesis (sensu Nematoda)
atgctcagcactcgttttgccgtttttgtcttcatttttgcattgcttattctggaaattgatggttgttatcggcgtcggaaaaaggacaaggacagtaacgagagcggagagaaaaagcacgcaaaaaaagaggataaggagtcgaacaagtcaggcaaacgcggaccgcgagggccgcctggtcgaccaggaaagaaccacgaaggaaaggaaggaccacccggaaagcctggcaaaccaggacaacctggcgaacctggacagcaccacgaaagcaagcaaggaccacctggaaagcctggccaacctggaaagcctggccaaccaggaaagcctggccaaccaggacagcaccagcaccacgaaggccaccaaggactacctggagcgcctggcgaacctggagcgcctggcgaacctggacagcaccacgaaagcaagcaaggaccacctggaaagcctggccaacctggaaaacctggccaaccaggaaagcctggccaaccaggacagcaccagcaccacgaaggccaccaaggactacctggagcgcctggcgaacctggagcgcctggtctaccaggaacgcacggaaatg

SEQ ID NO: 84727 - DNA, 205 bp, Heterodera glycines
  Genomic contig location: Contig_ID=SeqID_19964; Location=1925..2129; Strand=+
  SCN-specific regions: Sequence locations=1-38,60-205
atggaaatctacgcatgttttcggttttataatataggtaattaataaattattaatttccgagtgcaataaatttttgagtgtcacccattccgattatcaattatgactgctgtttatacaaataattccaataaaaaaaatttttaactaagtttcagtgtttcggagaatggaagtctacgcatttttttttaatttttaa

SEQ ID NO: 84728 - DNA, 366 bp, Heterodera glycines
  Genomic contig location: Contig_ID=SeqID_3450; Location=194..559; Strand=+
  SCN-specific regions: Sequence locations=1-102,124-366
atgaaaaatgaatttaaacaaaacagaaaatattcgcaaaaagaatgggagaaaaattatgccgaaatttgtaagaaaattggagttggctatgtaacaattaaaaaatggaagaaacattttggctttcgatatatgagaataacggaaaaagaaaaaatggaaaaaataaaaatttattggcaaatgaaaagaaaaaatccaaaaatgactgacaaagaaattgctaaaacattgaaaattcatcaaaatagcctccgaaaatggaagaaacagtttggaagagaagaaaaatgagaaaaaatatttgaaaatatgaaaattgattaaaggaagaaaagtttagaaattttttgaaaaatttga

SEQ ID NO: 84729 - DNA, 663 bp, Heterodera glycines
  Genomic contig location: Contig_ID=SeqID_3450; Location=602..1264; Strand=-
  SCN-specific regions: Sequence locations=1-475,497-620,656-663
ccaaatttaatatctaagcaaaaaaataaatttattgaaaaacaatttttcgaatttataaaccatttttaatatttatacattagagtgcctttaacgtgtaataattaaaatttggtgcgattttattaataatagaaagagttaggttcaaaattaattaattactgaaaatttgatcatcaacaactcatttgtaaatgatattttatttgccgaagggaaatttagccaatgataaggaataaactatcggcatttgaaataaaccaaagactctcgcataaaataattaccattaattaattgggcttatttgggtgcctaatgaaagtctaagacaatagtttatggaaagctcgattggatttgtttaattaatcagtttttttaaatttcatgtttatgccattaaaaaagcgcaaaattaatgcttgaaagaatattaaaaattttgtcaaaaaataaaccgcgtttttaaatcaaattgtgtacttctaaatcatctgttcatcgccaaattttttttcaaattttcatgatttttctatgaattttcaacatttttacaattttttttgtcattcattttttgtttttctttttttatttgtcaaaactttttaatttttttctttgataaataaaaataatagttggaat

SEQ ID NO: 84730 - DNA, 868 bp, Heterodera glycines
  Genomic contig location: Contig_ID=SeqID_3451; Location=1016..1883; Strand=-
  SCN-specific regions: Sequence locations=1-166,203-244,317-728,750-868
atgcctctgtacggattgtccggagccgcggtcattgagggtccggagaatccgtcagtgaaggacaatccgttagcaatggacaatccgtcatggataatccgtcagtggacaattcgtcagaaaaattttttggcaatgattaaaaatcttgcaaaaatgattcttaaatttaataaatataatttttataaatttttaacattttagttgctttgtacttcaatcaatggaccttctcgtgaaattatatttaattcttttaaaaatgcttatttatttataattttttaaaataactcaaattattaatttaggtttttagtgacttattaattttcacatgattttaaatagatctgggtgttttaaatctaatttgtttttgtgcagatatttatttatcctttttgattttgttagcaaaaatattcttattattgtgttatttttaattgccctcaattcgggcgttcgccgaaatttcgatctccaagtcgacttttttgccggttgagtaaggtgtctcatagctaatagacattatacggaattttgacaaaaataacattgtgtagatttgtcatgttttaaaatagacacaatattataggtggttaaattcaaatgattatatatagaaaaaaaaatagtgtagatcatttcgtaaaaaaatgtcaatatgtgcgtttcgtaaaacggcaaattttagagatttttcgagaaaaatctgtcataacttttcttaaacacaacctaaaaactaatcttgatatcttactattagcttaaaaaatttcagaaaaatctgtaaaattggcggtttttacgaaacggccctgcacggaaaaaaattgacaaaaataaa

SEQ ID NO: 84731 - DNA, 2016 bp, Heterodera glycines
  Genomic contig location: Contig_ID=SeqID_3452; Location=671..2686; Strand=-
  SCN-specific regions: Sequence locations=1-315,347-1137,1159 -1622,1654-1721,1743-2016
atggaatcaacttccaaatttaatcatgtatgtattatatattaattaagacagcacaaatgggttaaaatcggagtaattaaggagaaagtggaaaaattttgaaaaaaaattaactcattagagaaaaaggctaactccgatttttttgcaaatttcggcataattttgtcgccattctttggttgaatattttattatttgcctgaattcattattcgctttaatgaattttcgtattcagttttctgtttatcagtttttaatttatttatttctccaaaagcctctcttagaattctctcggaaaattcgattttttgatttaaatatttatttaataattcggtatatttacgacatttgaaaaaaacagcaaacctaaatgattttataaaatttatcaaaaaagttttcatgttaattctaaaatcgaatgattttattcagccacaaattgttttttccaattggaaatattctgttgagaagtgttcacaatttttgcaatttctttgtcagtcatttttgggttttctttttttgtttgccaataaattttcattttttccattttttcgttctccgttatttgtttcttgctaattccaaattgtttcttccataacatgccttgcgacgcgcgctgtctaccttgaggcaacattggacctcacatcggaatcattcatcaatgttctccgtcgattcataagtcgacgaggaaaacccgacatcatttggaccgacaacgccacgaccttcaaactcgctcagaaaaccctggagcttctcagtgctccgggtccggatcaggaagtacaaaacttcctgactcagaacagaatcaaatggagcttcattgcccaaataagtccttgggcaggaggcttttacgagcgcctcgtgaagctagtcaaagactgcttcaaacgaactttgggtcgaaggattctttccttcgaccaactcaacacattcgtggccgaagtggaggccaccctcaattacagaccgattaccgcggtctcagacgcagtagatggaccagtcccactgcgtcccatcaatctcttacaaccagagattcatatcaattgggaaacaacaacggacccaattgattcagaggaaatgttttcctccacacacaaacgtttagcttcccgaataaaagcactccgggaagccaacgacattttctgggccaaatggcactctgagtatttaacattactcagagaaagagcccagtgggaccacaaaggcccacgactccaaaacttcggtgaaccgaagaaagggatggtggtcctaatctctcaggacctcgttcctcgcaatcaatggccaatgggacgaatcgttgaaacacacggacggcctggagccatccgaagtgttaaagttgaaatccctgtccgagggaccaacaacaggaaaccaaaggacatgccacgaaagacagtccttactcgtccagtgaaccgcatcttccctttggaagcgggtcctgaaatgacggacccaggaactgaagctgttgctgcaactgaacagccaaatgaaaaccatcccaagctcgctcgagagccgggacaccaaatggtcaccagaagaaaagccaaactactggaaatgcttccagtggtggctatgaccctcctgacacttgcccttccatttgcaagtggtttcccaatcgggaaatgtgatgagtgtggcctcacttgttacacgaaaggaatcgtcgtaacagtgccacccgaaatccaaaagttcgaaatatgctgtgcagaaagctgcatagttcggcaaggcatcaaagccttgaacttcgaactaccaatcgaagtcctactcaacaatcatcactgtgaggccagattgtttcttccattttctaagtgtttcacggcttactccaattttcttgcaaatttcggcataattttggtcccattcttttgctgaatattttcttttttgcttatattcaattgtcatttcaataaa

SEQ ID NO: 84732 - DNA, 600 bp, Heterodera glycines
  Genomic contig location: Contig_ID=SeqID_19965; Location=1744..2343; Strand=+
  SCN-specific regions: Sequence locations=54-62,85-126,148-265,301 -378,401-600
  Gene Ontology: Mol. function=RNA binding; Cellular component=small nuclear ribonucleoprotein complex; Biological process=primary sex determination, soma
atggcaatggctgatgttaagcccaaccatactttgtacatcaacaatttgaatgaaaaagtgaagaaagaaggtgactcactgcttttctaattagtttttcttttttaaccattatttcaaatttgcagagctaaagaaggcactgtacgcaattttctcacagtttggacaaatcatcgacattttggccttcaaacacttaaaaatgcgtggacagtcccatgtcattttcaaggagataaattcggccgccactgccctccgttccatgcagggcttccccttctacgacaagccgatgcgcatccaattctccagggaggactctgatgtgatctccaaagcgaaaggcacttttgtcgaacggttgcgcatttcatattacaattttttctttcaaaaaaatccttgtaaagaaccatagtttgtcgttttcttttttgcaatagcatattgcaatccaaaacggttgctgtctgttttcattgtagctcatttccttgccacttcgcaaaatcggatagtgtgttacaatttaatttctttgagccatttttcaaattcttcgtcagagagtgccaataccaacacttttga

SEQ ID NO: 84733 - DNA, 1012 bp, Heterodera glycines
  Genomic contig location: Contig_ID=SeqID_19969; Location=226..1237; Strand=+
  SCN-specific regions: Sequence locations=1-183,269-661,705-1012
tcaatgatggtggcgtccaggacgaggcaattgtggaaggacagcaacttgtggacttagggaacatcgacgagcttttggccggtaatttgtttttttctctttattgctacagttttttgttagtttgtagcaagtgaaatctctctccgctgttttttctccccccccccgccccacctcctctccctctccttcgctctctttcttttactttcttctgtttttctctctctctcccttattcttctctctctctccctctctccaccttcgttctctttctttagcttaaaatcgcaaaaattggccatatattgtgaaaatctggtaacaaatcacaaccaaagcttcaagaaaattttcccggggacgcctattggcaccgccttattcccgcatttttttggaaaaccgcgccgaaaaaaactatttgggtctttaaaaagcaaaaaaatgtcatcggtggccgacccccccccccccccacttttttaatgtatgattcttttaccactttgcttttttgtctctcattttctctctctcaaacgcggggggtctgttagtgccgttaggcgccgccgggaaggaatttacctttgatttgttaactgattttggggagagtggggggggggcgggacaaaatttcgccgccaaaaatttagaaatttatgttttttgattttaattttttttttgtattcaggaattcgacatactcttgtgaacttacgtgatagcgccaatgcggaaattgaccgaattgatggccgtcttcaaggtgggtatgctgcttctggggtttttgtcgggattcgagaatatggcatccccttttattaatttctggttccggacctggtttgtagtaaattccaatctttaaattacacatttatttgtgtttgaactaataagggaacctcgcgaacttacagttaaaatgggtataaatgtggtataattgaacagagtcgacttgaatattagcgatatgtgaaggaaa

SEQ ID NO: 84734 - DNA, 671 bp, Heterodera glycines
  Genomic contig location: Contig_ID=SeqID_19970; Location=255..925; Strand=+
  SCN-specific regions: Sequence locations=1-102,124-304,326-401,424-671
atgttcctagtcttcaacgtaatactttgcaattctttgcttctcctgtcaattaatattttttcacatattaaattgaaattaaggcattaaaatcaattaattaagaattatataaaatagttgtggtcttttgtctgtgggtattttttgagtggtttttttgactgtggatcttctgtcattatgcctaatattttgagcccaagaattcccgagtcagtctctttatgtggtattaattgcttaacttcttccctatcgcattcctacaaaattatagagaaaatgaaacaagcaaaaacttcgcccaaaaagataacaacatttcatcgcattatctgagcaagtccatccgtttgatgcctcaaatttgcaatacttttaaatattttctgatcatttttcgatataaaatttgttcatttctcagcttggcttcggctggactaatggcgctgtgttggaccttttggtcaaatatggcgacaaaatgacgctgacacagatgccggatgttaactgcagcaaaatgacgaaggatcccgagcccgaagtattcccaccggaataaatagaatggaagtgatcagagcgaaagtgatcggaattttaaacttggctcccccgccacagaaatatgtccatttattaatccttcattttataaa

SEQ ID NO: 84735 - DNA, 173 bp, Heterodera glycines
  Genomic contig location: Contig_ID=SeqID_19970; Location=1..173; Strand=-
  SCN-specific regions: Sequence locations=1-73,95-135
gggtcgtttcctaaaaaccgccatgtggtaggaaaacaaaaaaatgtaagacatataaattcataacttggtccattttcaaccaaattaataattcttggtataattcaatagctctaggtgtttctatagaagtataattttattaaattttttacttaagtatataaaaa

SEQ ID NO: 84736 - DNA, 2021 bp, Heterodera glycines
  Genomic contig location: Contig_ID=SeqID_19971; Location=61..2081; Strand=-
  SCN-specific regions: Sequence locations=1-403,435-609,632-652,705 -956,984-1092,1114-1134,1260-1298,1339-1490,1512-1789,1830-1866,1888 -2021
ggtgacgatgcggtaacatactgtgttttgactggcaacggacgggtggaggcgcgcctttcggtgaacccggccaacacaaagaacaatgtgccggcgcctgcggtaagcctaaaaggaattcctggtaaattaagcataattaggcaccaattctttaccatgttggtaattattttgcaagaatcgcgttaacgagactaagagtgggatcttgtgaactaaaaccggaattttaaaatacaaatacctaattgggatgtcaatcacttgtgttttggtatataaaaatgcttaagggggcggagaatggctttctcgagctgttggaaggaaaagcggatgacaacggcatttactgtaaagtgagagagttttctgaaatgtctatatatttgctggcattttgccaattaaaaataaatttgcgtttctcagtttcggcaacactcaaacaatgggccgggcaaagatttggcacggccgaacctgcacaaggcgtactatctgttcttggccaagggaccggcagaagaaccacacagtgagtaatgtgtcaacaatcgcaaaccgtccttttcctttgagtctaaaacttttataaatatgaaagttatgttatttttaaaaaatttcgaaaattttatgactcaaaatattttattatttttatatatttttacaaaaaaaaaagaaaataaaatcattttcgcaagaatgcttccgatcattagtgatgcgagtttttactctttattctgctgaattctgagcgcgaaaaattcagataaaatttttttgattggcttgaatgatcattaatcacttgaacataaaaaatagttgttttacagcgatcggaattcactcgttggacagcgatgatcacgcggtgttcccacacatttccgcccgtccaattgtgccattggacgcttcatcgctgactaagcagccgaaacaacaacagcaacaacaaccagcaccaccacaaaatcatggacatggcggtggtctgacactgatcgatgtacatggtgagagggatggaatttctaggccaaaaaaaaatttggaatctacacgaaaaagattttgaaaataggattttgcactttcaataatgttgaattgaaaaaattaatacattaaaaaaaataaatttcggaattttttaattttatattaaatttattttttaattctttgtaaataaattatcttaaattttatttttataattacctattttttaatttctttcttgaacctgaattgattaattgaaaaaaaatgttctcaagtttattttcaattaaattttatttctttcttcagcacaataatttttaaattctatgcaacagaatatatagaattgaaaaaaaacttctatttaaattttgcgaaatttttagttttccacaattaaatttgaaaaattctatacaacctgctgattggattacgtttggataaatttttcgtatttttccaaatttaagttacctaatctttgcatcatttttccaattttttaggcataatgatggtgatcgcgtggctttgcctcacttccgttgcgctgtactcggcccgcttcatgcgcagcgcgtggccccacacaacaataatgggactgaaaatttggttccatgtaagggttttttgggtcggggtcaattgggcgcggacagtttcggcgccgccattttttaaacgttgaactacttttttcaatttaataaaattgccatcatttgctaaaatgtagatatgttccacatttaaatgtcaaaatcaaaaaatatatttttacccttaaggaatttcttttttaattttatctatttcgaatgatgcaaagtttataaatttggttgtctgacaaaaaaagtttatacagtacacattaagtgtattccttcagatccaccgtaccctcaactttctgtctgttattgtcatggtggtctccgttctgctcgttgtgcttttcaaaggccgttggacggcccatg

SEQ ID NO: 84737 - DNA, 502 bp, Heterodera glycines
  Genomic contig location: Contig_ID=SeqID_19976; Location=16..517; Strand=+
  SCN-specific regions: Sequence locations=1-332,358-397,419-502
atggccgatgatgatgggcttgacagcagtgggcattcctgcgcgagtgccggcttcacaccgaaggtccaacatggcggcggtggtggcaccgtcggcactgctgccgctgctgcacaggcgtcggcctcgtccaccggggtggcaccggtccatcggctgaccatcaccgacctgaaagcgccgtggactattgaaaaccgccggtgggtgtgaatgtggaattggaattgcaaaaatataggcatttcatcccctcgtgtcatccccatttcgttaaaaattcttcaattttttaatttttatctttaaacagtttttttcctaattccaattttttttaaataaaaaatttttgcgcggggggaaatatagtgtaccccggaaaatgaatatattttttgtttcagtgacaattgtttggtgattgcgaaaggtgttcaaaaggcgcacattggcttttcatcgtccacatgcatgagcctgttggcgtacatcgtcg

SEQ ID NO: 84738 - DNA, 694 bp, Heterodera glycines
  Genomic contig location: Contig_ID=SeqID_3453; Location=18..711; Strand=-
  SCN-specific regions: Sequence locations=1-55,82-233,270-423,451 -505,529-666
atgttgctggcgaaacgttagtcactggctcaatgaatgacattggaatagcctcagtaaaaaataattttaaattgttttctaattagtgtttaattaagtatcagtgcagcagcaatttgacggattctattttgcctacgcttatgaatatgatatatttatcaacaattctcatttatttgcttgttacgattttaatttacttcagaaaagacgattttaattgtttgaataaatttaattctacaattttaattaaatattttcagctcagcccaattcaaattccaatcaattgaatattcgcattttccgtgcattattttttataatttctgttaatgttggcggttattttttgaaattgattcacattaccatgataattcctttgttgaacaatgatattattgaaatttggaaccaaaatcaaatttttggcattttgttaaacattagttgcatttcaaatgcgccgattcttttttggacgaggtaagcctttaaatttaaaattttaatttagcaataaatgtttagtagcgaatatcgccaagcatttgtgaaagaatgcagaagatccgaaataaattcgaattgttttattcgccacaaattctgtacaacccttttgatgtcatttcatacggatgcaaaagttcgaaaaaatttttaaaatatgaaaaataaa

SEQ ID NO: 84739 - DNA, 631 bp, Heterodera glycines
  Genomic contig location: Contig_ID=SeqID_3453; Location=1491..2121; Strand=-
  SCN-specific regions: Sequence locations=1-48,87-180,212-365,393 -447,471-603
atggattacaaaatgattatgatgtcatgctttttccattacggtaacaaataaataaacataaaacttaataattttttaaaattcatttagggaaacaaaaagtattttaatctatgcattctcatttatttgcttgttgcgattttaatttacttcagaaaaggcaatttagtttagaaaattaattacaattttaattaaatattttcagctccgccaaattcgaattccaatcaattgaatattcgcattttccgtgcattattttttataatttctgttaatgttggcggttattttttgaaattcattcgcattaccatgataattcctttgttgaacaatgatattattgaaatttggaaccaaaatcaaatttttggcattttgttaaacattagttgcatttcaaatgcgccgattctttattggacgaggtaagcctttaaatttaaaattttaatttagcaataaatgtttagtagcgaatatcgtcaagcatttgtgaaagaagggcagaagatccgaaatcttttattctctacaaattctgtacaacccttttgatgtcattttatacggatgcaaaatttagaaaagatttttaaaatatgaaatataaaataaa

SEQ ID NO: 84740 - DNA, 401 bp, Heterodera glycines
  misc_feature (119)..(119): n is a, c, g, or t
  misc_feature (138)..(138): n is a, c, g, or t
  Genomic contig location: Contig_ID=SeqID_3453; Location=2419..2819; Strand=-
  SCN-specific regions: Sequence locations=1-352,382-401
atgccttcggcgattcattcgttgcccaacaaaaaaccatttttggccactctttgcgctctggggctcgtaagaatgcctcatcattggctattgtgagcactctcatcggcaaaatntaattgataaaccctttcntgtctttttttagcctgtttcggagtcctttgtttgagtcttggcaatgatggatgtttgccattggcaatttgttgctttaaacacttgcttttttaaattccattccggcatttaaattattttcattccttacaatttcgctctctcactttttgtcattattttccattaatttcacttcctttctcttttgcattggctggacttgttgaaaaaatttttataattattttatattttccagtaattaatttaataaa

SEQ ID NO: 84741 - DNA, 758 bp, Heterodera glycines
  Genomic contig location: Contig_ID=SeqID_3454; Location=182..939; Strand=+
  SCN-specific regions: Sequence locations=1-137,159-308,335-499,521 -625,647-758
atgctttcatcatcagaggcaccacattcatcagcggcagcgagttcatcaacagaaaaaaacatttcaaaagaaaaaaatatacgtaagtgcgggccacagacaattggacagaaatggaaatatggacagtgaacaatatttaaaaaattataaaaggcattagcaaaaaatgatataagttttttgaattcttagaaaaattggaatttttttaagtaagctcgacggttatttgataaaaaatgactaattaacatcattttttaaatttttctgtcaaagtgtccggattcttttagtttccatgagcttgtttctatttctgattggcaatgaggggatataaaaaaataaaagaaaatttgaacttttttggttggcttacacgaaaacgaatgttaattttgaagaaaaacagaccattcttaggtcaataaatgctacaaataacaccttaggtagatatgacgattttgtgaaatttaagaagcattccaaaacagattttctttcctttataaattaggtttttagcaattttcttttctcagtttttaaacccactaaccaattatctctcattaagaaataaaactcttccaaaagttgagcaaccgtcttgctgtttccaaaggtcaatgtgcaatttgtttgggtgatttagtggatttagaggccaacacaactgtaaagcagttgccgtcgtgtaatgtaaataagctttaaaccttttaattatttaaaactaatgaata

SEQ ID NO: 84742 - DNA, 662 bp, Heterodera glycines
  Genomic contig location: Contig_ID=SeqID_3454; Location=1122..1783; Strand=+
  SCN-specific regions: Sequence locations=1-154,209-662
atggcaaaggtaagcatcctgcataaaaagttcgaaaacaggttgaataatcccgcatgcaataaaaaggaaaaatacactgctacgaatcgacccaaaaatttctgaaaatacttcgctaataaatgaaaaattttctcaaaaattcttctccaaaatttattcaattattttcatgataaaaattttacatttaaaaattatatatctcaatattgatttggcttaatattgttgacttttgaataaaattttgccattttacaccctaaatttgaaactttttagcagctattttcccatttttagcacctaattttgggttttttgaaccgaatttactgtccaaatgtccgattacgtttgaaagttagaagaaatacggataaaaaccgggtacccgaccgggccaggataccccgacttttccaagacctggcctcagtacccagacccgactttttgaaatccaatacccggtacccacccgaactggtaggtccgagtccaaccgggtcgaaaaatacactgctatgaatagggtttttgattgtttagtaaaattaaaggaaagaaaaatggaaaaattattattacttatttcaaaaactttcttgctgttgtggcctagtgttattatctttagtatacaaagttgacta

SEQ ID NO: 84743 - DNA, 774 bp, Heterodera glycines
  misc_feature (693)..(693): n is a, c, g, or t
  Genomic contig location: Contig_ID=SeqID_3455; Location=918..1691; Strand=+
  SCN-specific regions: Sequence locations=1-510,533-774
atggtggatgttgatgatttagaagtgaaatttgaggctttaaaattaaaggtgaatgatttggaagataaattggcaaataaaccggcaacaaatttgccagcgggggtaaaaacaccgaaatatgatgctacaggcgaccttttcaaattcttacgagaatttaatttaatggccactgccagcaattggcatgccacggactgcgtccgaatgttcccattattccttgagggagaagccaaagagctttttctaaatattccgccagataaaaagaaaacatggcgagatttaacaaatgccatggcggatcaaacaaaaaagattgacggtccaatgtgggcaaaaaaattgttggccagagcaaaaatgggccatgaaagcataacagaatatgccaataaaatacgtgagttggtggaacaggcttcccccgacccaaattacacgagcgaggcccgagaatgtgagagtgtgcattattttttaaatggacttccgactttcctaaaaaggaaaatattttttatgaaaaagccaaaaacgcttgttgaagcaatttcaatggctaaagaagttaatcaagcaagggaagaacttgcaaatgatgaaaagggagacgaaattaaacagcaaataaatgagataagggagcaaataagtgtaatttcgagtcaaaataatgggaanaacgaaaatcaaagagaatttgttaaccgttcttggcgtaacattttgaaacggaaattcttggatcgtggagagaaataa

SEQ ID NO: 84744 - DNA, 2589 bp, Heterodera glycines
  misc_feature (2519)..(2519): n is a, c, g, or t
  Genomic contig location: Contig_ID=SeqID_3456; Location=236..2824; Strand=+
  SCN-specific regions: Sequence locations=1-568,590-1230,1253 -1786,1809-2128,2150-2178,2201-2492,2517-2589
  Gene Ontology: Mol. function=myosin light chain kinase activity
atgaaaatttgtgggctacggataatcccgaaaaaatcgaatatgtttggtcaggagaaaaatgtacaacaacaggtcaataattttattgaaaaaggacatggaggaattttggatttttacctcattacttcttttggtcataaaatgaatccatacagaggatgggaggaaatgaacagtcaaacatttatttgggagattcccgagccaactgacacttattgggccacccactttccagtgggcaattttcttgctgaaattacggatgatgcaatagtgattgagagtgagcaaagtgtgttctatttcgaaaaagaacatccggaagaaagagaaggaattattggcataccggatgacgcttttaaaatgacaaacgatgcatttataacaattcaagtaaaacaaaaggcaaaaagagaggcaaaacaaaaaattgagcctaagaaaaaagagagaccagtaaaacaggaggtggtatttttcaaatttcgacaaaataagggaaatgagagtgttgtaaaccctaccattcaaattacaagggaaccgaacattagccaagaggagattaaaaaagaaagagaaaatgcgaaagaaattatttcagaaattccaacaatgcctaaaccggaccaaccaaaagagaccaaaattgcggtagcacctacaaattttcccataacaactacagtaagaaatgtactaactgaacagacaaaaattacgacaagtacgaccccaaaaacaaaaatggcggcagtaacaaaagcgccaaaaacggtgccaaattcaaaagttgaaaaccaacctttttcaaaaggttggatcaaattaaaacagaccgagcagaaatatatgataaaaggagtgaattttggaaaaattgatacaaccataattccggttaccaaaacagctaaaaatatggaaaataccacagcaacaacggccaaaactccgttaatgagttttactacaataaaaccaaaaaaggaaaaaacacccaagaatatttcgaattccgtttttgagaatgaaaagtcaaaacagggaaataagacaaaaacacagacaaaagggacaaaggaagaaaaacatcccaaaatggtaaaaattggcaaagaattagacggaaaaacaatgcctgaggaggaaaaagtcccaaaaattgtgaccaaccaaaaaccaaaagaaaaaggagtaacgaaaaacattaccacaacacaaacacctaaaatgaccacaataaaaacaatttcaaccacaactcctaaaccaaaagtggaggagataaaggcaaaaaaggcattgccgaaccaaaatacaacactttcaacgatttctgttacaaatttttctaaaaattctgaaaaggaactaataaaaactgaaacaattgaaattaaaaatgaaagcggagaaaaagacttacaattccgaaaattgtcagaaggcgatgaaaaagaaagtgacgacgtaatttttgaaaaagtgaaagacaatttagaaaatgaaaatgagtcagatgagtatgaaaatatggaaaattctgcagaaattgaaaatgaatacgaattggacagaggggaaaatcagtttgaatttatggaaattgagagaaacaaacgaacaacaattactaccccagacgctaaatggctcagtaagcttaagaaaagcgaaaaaaggataaaatcagggcaagagaacaaaaatttaaatacgcgtgttaattatgcactttaccgactaaatgaggacagaaagaaacagtacgaaaatatttttctccaagcctgtgaaaacacaaaattccaattacaacttgcaaaggcaatattacaaataaacccaaatgagggtgtacggaaaatttttgatcgggatgatttagtcgcccgatgggttggtgaaaatttggaagttgggttttgtgtgccaataacaccggaaaaaatattttggagcaaaaaaattgggaatgagtgctacgaatggacgccaattttggcagaaaatacaacttttttcgtaaagccagggtcccgggaactgagcattttgggtaagaaagttggctgtgccgaaatggaagaatatgttatgaaaaatgacacacaaaaagaagcaataacaaaaatcagtacaaattttgagaaaatccgaccaaaatacagaaacattcaaaatcctttggtcttaaaagcaggaactctttacgagtcggaaaccaagcgaattgaaacagcaatgttggaatacagggcaagaatgaatactttaccttctgcaactctgcgtataattcaaaaaccgaacatttctgaggtcataaaagtaatcaaagaagaagcaagtgaaaccatggaaatagtgatgggaaaaacgggaaattggttcgaaatggttaaaaatatcccagaaaaagcggaggaggcagtaaattatttaaagggcgcctcatttttgcttattttaatacccattttaattttgttggcactaattgngtatgtgatggtaaagtaccgattgattatttttgctggttttcgcgcgggaagattcttaacagaataa

SEQ ID NO: 84745 - DNA, 2870 bp, Heterodera glycines
  Genomic contig location: Contig_ID=SeqID_19977; Location=1..2870; Strand=-
  SCN-specific regions: Sequence locations=1-104,126-219,241-344,387 -463,486-514,548-578,601-632,654-867,909-1684,1717-2870
attttggaaaatacaggatttgcaagattaatcctgccggatcctgtcctgtaaaaattttgaattccaatcctgcacacggcgaatcaattttgggctccaagtacaattaagttggttttttcgtcttagtggtctgtgagttagtcaacaaaaaggggtctcaggttcaagtcctccttatgttgtgtgttaatttcaatttcttcttttaaagaagaaggcagaattattttttcattaataaaagttttcgtgtcataacatcgacaattttatgaaatttttttagcttataacttggtgaatactagagcaaataaaaccattttatgctcattttgaagggaaaattctggagaatattgtaaattttatttggtttggccttaaattgtggacttggctaaaaaagaattaaaattattgaaatgttcgtccctttcaaaaaaaatttctagcttttaaaatttcttcaaattttgcataggcccatatttcgaccccctctatcgaattctcttttgttttttaaaagtttcttttctatctcgagatcggctcttccatttttacaagggaaaatccccaataaattttaagttttgcaaagttttggcgttctgattactaaataaataataaacttatttgcactgggagcccaaaattgactcgccgtgtgcaacaggacccgcaaatttgaaatttccggtctctaattttaattctgtttaagttaaaattatgtacaattagcgcaacaaaaaacatccctattctttataggtccaatacttttggcaactgatcattaaaagttattaagcttctctaatgctttcaacgatggatcctaagctgaaaaggaaaagggtgtgtttttcattttcttttattattgtatttagtcgatttttaggaaaaggaagagaaagagcgacttgaagaagcgtttgaagaatttcgtgaaacatttgaggagaccagtgggaccaaaaaaattgtaaagactttcatcagaggagacgttgttaatgccacaaatcaggttaaaaagcaaaaaaaaacttgtgtttaatacattggtttagtttcttcctcctccgttgtttataagccatcgcccattaatctcaaaacgctgtcgaaacccccaccgttagaagctgcgaaaaaaattgcagaagaaactgccaagaaaataatgatggtaagacaaaaaggaatgaataccacctttctattcagagagcaattcgatttaaggaagctgccgataaaaatagccaaaagcctgacccactaatacttcaaacaccggtgccggatgcgactgttccatcaattggcaaaccgccaaaattgggcattaaaaaggtggtagaaaagccccgtctgagcaatttggagatgttcaaggaagaattgaaacagtacgtgaaaaatgaagtttattcatagaggccttttgttatttgtaaagggtattattcgaaaagctttttaggatgcaggcgatgagagatgagcgcaaaggactgagacagcatttgaaggagcggttgaatatgccagaagaggaattggaccgaatcgcaccatctttagaccaaccatacgggccgagcatctccgacccctacggggaggatgacccgaacacgaccaatttgtacgtctgcaaccttccagcagatgtaaaacactaacaaatgttcattacaactctggcttattgtcaggcaaaattggaagattttttcgacacatttggcacctttggaccattagcatccgcacgaattctctacccacgtccagaagacgaacgccgttatcgtgaaacgctcagcggatttgttgcttttatggtgaaaggcatttaaaaaaaaaatttgtattttgacacactcagagccggacggatgctgaacgttctaaatgtgcaatgcaccaagaaacaatccgaaattgtgaacttcgtgtgtcttgggctcgttccgtgaacatgccaccgctggtcagataatcaaaaaccctgaaagcaaaagcaatcggccaattatagccctttttcgtcccgctgcctcttcgtgagcttgccatgcccgacccaccttcgggtttgccgttcaacgctcgacctgtgacggaggagctgcgttcatttctgcagaactatggagatttgccaaagttgggagtaccgctaactgaggaagagggcgaaagagacacacaaatgctggaggactacaaaaaggttggggccacaccttttctggcgccttttcactccaccaaatctgatctgatccgattaattcgtcacgttcaactagcagatgattgagaatgccactgtgcgcgttgtcattcccacagagaggtttagggaacatgcggccatttttaaattcagccctctttctgattcaggcctttattgacacttattcaccgtgttgtggaatttcttgtacggagtggccctctttttgaggcaattttgatggccagagaacgtcaaaacccaatgtatcggtaatgtcttttttttttttaccaaaaagatggcaaaaaacaattgtcgcttctttagttttctgttcgataatcatcaccctactcatgtctactaccgatggcgtctttacacaattttacaaggcgatgaccgtcaaaaatggcggctggagaagttcaaaatgtttgaaggagggagttggtggcaggttgtagtaacataactttccttatgagacacattatttacagccaccaccgcacgcgctttttgagcagggaatgccgccacaactgtacggaggagcgtatgtgccaaagagacgtcgtgacaaacccta

SEQ ID NO: 84746 - DNA, 119 bp, Heterodera glycines
  Genomic contig location: Contig_ID=SeqID_19977; Location=2023..2141; Strand=+
  SCN-specific regions: Sequence locations=1-119
gttgaaagcattagagaagcttaataacttttaatgatcagttgccaaaagtattggacctataaagaatagggatgttttttgttgcgctaattgtacataattttaacttaaacaga

SEQ ID NO: 84747 - DNA, 545 bp, Heterodera glycines
  Genomic contig location: Contig_ID=SeqID_19978; Location=179..723; Strand=-
  SCN-specific regions: Sequence locations=1-347,369-515,537-545
atgattctgtacgtttttcacatttcttctcaacatttatccttttccttctcttttttgttttagtctgttcgttgtgccattgtttgtcgggtttgtcggatgttgtgccattctttggctttattgggaccgcttcaaaaaactaaaaaagaaaatgtaaaaaaataaacaaatttcaaaacgtcagatttaatttttcagtttcatctccgccgactgttggctttgtgtgttcgatttgcttacgccttcacaacttggccacggaattgcgatgatcagtcaccgttttgacatttacgtggacgaacacttcaaaactcgcaaatgggcgctgaaatttattcaaattcacagcaaaattggaaagaatggcaccaaggaaatggatattgtcaattacggtggaaaagcgttgccaattccgcaaaatccgctgccaaaagaaagtcgtcggatttcaacggatcagcatcttgtaaaattggcgaatatgctaaaaaattatacaaattttccctatttattttcagtttcattga

SEQ ID NO: 84748 - DNA, 1125 bp, Heterodera glycines
  Genomic contig location: Contig_ID=SeqID_19980; Location=756..1880; Strand=-
  SCN-specific regions: Sequence locations=1-284,314-324,370-399,421 -658,680-966,988-1125
atgctgaaagtcaatgggccgtccttcaatgtgcacatcattccgctgagccgagaggcgatggctatttccgacattgaaaatccttacgcgccccaaaaattgtattccttggcaaagaatgttgcgctcgacagtttatgccattttcgagacgaagaaacgaaccgatgcattttgaattattttgaaacttttgaagaaaaacaaagtgccgttgttggctttctgtccaaatggcctagaaattcaaattttgctgctggactgacagaaaaggtcaattttcttatttttagaaaaataaaaatgcacaagtataacaataaaaacataaattattaatttaaaaaatttttatgaaattttcacataaaataacattggtttttggtaaatgaaaggaaaattaatttctttaactttgacatttacaaatttagggttaaacagaacaacaattgtccgatttgtggcgcaaaaacattcataatttcattaaaaaacggtttagttattttaatttgaaaatacagtaattttttaccatttatttaattaatttagcgaaaccaaacgcaaatttgaactcagaaattgttggcgatgaaaatgtgtgatttctgagtttgttcattttttgtttgtttttctctgatcattcattcattttgctttgttcgggatggcatttgttgcttgttttttttgaccaagaaaaactatttgcttcttaattttcaatgattttctttcttatttaacacggccaaactgatttatataatttttgaaaatcttagaaatattttattgattgctcataatattcaataaatatgtaaagcgtagaagataggtgaaggtgctataatagtcgataagataaagtgcatataatgttattcattctaagaataatttccttagtttaacaaatccgtcatacttttcagtgtcattttaatacttttcttcaagaaataactcattaacataatgtcaaagcatttgaattcatttataaggcaaaaaaattctattaactgaaatggtgagaagtttcgattttaagaaatatttattccactaggaattgcaaaaactaaacgcgaaagaaataaa

SEQ ID NO: 84749 - DNA, 442 bp, Heterodera glycines
  Genomic contig location: Contig_ID=SeqID_19983; Location=1485..1926; Strand=+
  SCN-specific regions: Sequence locations=1-442
atgccctttttccaaattctgttggaattgtgcgccgcgttggcttccgtcccggcactgctcccaaagattgttttgccgcaagacgcacacggaaaatcaatcgcgaaacagctgatcccgcagtttcggaacaacctgaacaattaccccacactgatgagtggaatcagcgaagctgacttatcattcatggactttattcgcaaagtcaacgattattcggaggttggggaagacaaaaaaatgatttccaatttaaattttaacttttcaggtcatcattcgtttggcacggcaatttgaacgtcaaattccagcggaaaagcgcgtcaaaacgtcccattcccatcgctatttcacccgcattggcgccgaccgcgtgcgacgactgcgtaacgcgtcggcgactgtgccatcgtcgacgggtccgagttcggcg

SEQ ID NO: 84750 - DNA, 523 bp, Heterodera glycines
  Genomic contig location: Contig_ID=SeqID_19983; Location=186..708; Strand=+
  SCN-specific regions: Sequence locations=1-420,443-523
tttgtccgcgttcgtttggccgtgccattggcaaattcctcgacttcgttatgggttccgcgcactcttccgccaacccttcgtcttccgtctcttcttgctcatcgcccaccaattttcgggaaaagcacacgcccgactcgttggaggacaaaattgagctgatctttgaactgttggagaaaaagcccacccgattgggctacagcatccagtgggcagtgcaggtgagggagggggagggaacggccggcacaatgccatggagcatggcacccaactgatcatttaaatcatcaaactcattaggaaagggaaggaatgcgagggaaatggcacggcgcaatgccattgcatccacccaaagtcccaacatccatttcttaccatttcattttgtaagttgttggccaatgcaacagaagaagagaagttggagatgttgcggtgtcgtgtgctcagccgaatctgtgccttaatcacccgctacagtaacgtcgaagttgcggcgcccccgggcaca

SEQ ID NO: 84751 - DNA, 1232 bp, Heterodera glycines
  Genomic contig location: Contig_ID=SeqID_19984; Location=1266..2497; Strand=+
  SCN-specific regions: Sequence locations=1-266,288-1232
atgggcaaaaggaagaacaaaatctgcgaaagcatcggaaagggcacaagtgtggtcagtccggcgcaatggtgccaaaagtgtcggcctttcccacagattttctgcacgtgcacctcgggacaggcactgcgctttctactcaagcgttggttctgccccgacttggtcgtgatggacgaggcgtcccaaatggtcgaatgcgccagttggattatgctgcttcacgtcctcccccccccttttcacgttcttgccaaatgcctccttttaaggctccccgtttcgtaattgttggagaccaccagcaattgcccccttttttgctttctgctcggaactctccggtgaactcagctgaaagactgcacatttcgctgttagaatatatcaacgaaaccttcaaaaatgaggtgctgcatggaaagagtgtttaaaactgtgtagaacatcacttttaaggatttctaccattttctttctgtccaatatcggtcaaatgaactaattcaaaaatggtccaacaaaatattctacgacaacaaattggtcacttatcagttgacgaaaaacattcacttgcgccaaataataaaccaacaaaatggtaagaaaacgaacagacatttccgtccctaataataatgtacgaatttcggctgatctctcctctggtcctttgtcctcaaaacaaaaatttctgatcgatggtccgcttgtgctcatcgatacggtgagctatcgccgagacatttcgggatatttcgaaattggaaaggccacttttcgcattgagttgaagcattttcgcataatttgtaaattctctcagcaattttataaagtagaatcattcccgattaaggacaaaggcatttctgacagtaaatggcagaaagtctacagcttgttcaagttgtggtatcccctctctttccgcgagggtcagaatgagcacacgcactcctaccacaacattggttggtttcccattcttttcaatttaactttttgcttaaggcgaggctttctgtgccgtccttcacctccacgcgttgaatttattcggcggtttggatttgtcgaaaatcggttgtattacgccgtactcggcacaggcggaaaagattcaaaagctaatggccatgggaagggacgagggaccacgcttcgaagtcagctctgtcgacgcccttccagggcagcagcgagaagccattgtgatgtcattg

SEQ ID NO: 84752 - DNA, 718 bp, Heterodera glycines
  Genomic contig location: Contig_ID=SeqID_19985; Location=877..1594; Strand=+
  SCN-specific regions: Sequence locations=1-294,316-367,389-590,612 -691,715-718
atggaaaaatatggaaatatggacataaatcgtgaaatatggaaaaatatggatatggaaagtcatcctagaagcttcaaaccaagcttaaaacatgtttttcgtgcgtttcaggcctcccacagtccaggaaaaaaaatatggatttccatataattggatgccctattattcataacaattgaaaaaaaaaaaaagtttttcactagaaatcggtaccctattaattaaatatattgcactcaaaatatggccccctgttcacaaagttttttttagaaaaagctcgccgcaaaatttgtttttatttattttagtatttggaataaattttccaaattagcaaattaacactggccctaactgatatttttaatttcccttctttaatggactttttttaaacaaacaaacacaacaaaaacaacggtgaaaatgatttatgaaatcaattattttcgcattgattagagaatgggctcgcaatttgctgtgctatttatttgtcattcgtccagcagcaaaattggtttttcgcgagcaaagaattttctcactttttgttgtaaaaaaatttacaatttcgattttcaaatttttccagggcctcggaaaaccattcttgtgtacattaactctctgaggattgaatatttaggcaaatgtcttctggttcctattttcaggaatttggggaaaaatctttaacaaaaatgca

SEQ ID NO: 84753 - DNA, 88 bp, Heterodera glycines
  Genomic contig location: Contig_ID=SeqID_19985; Location=1973..2060; Strand=+
  SCN-specific regions: Sequence locations=1-88
ctcatgctcctggcgagttcgaatcgcattgcatttgaagggcattgaatttgatcagcgcattgtcaatttgttgaacggtgatcag

SEQ ID NO: 84754 - DNA, 1173 bp, Heterodera glycines
  Genomic contig location: Contig_ID=SeqID_19987; Location=204..1376; Strand=+
  SCN-specific regions: Sequence locations=1-94,116-318,354-379,401 -653,678-1075
atgccaaacgaatgggaggagcagcgaatgtgcggacgactgctgatccaagcattaaaaatggtgtgcaaccaccaatacgcgcagccgaacagaggtgggaacagacaaagggagacgattaattagtgcaattcattagccccaaattagcaaaatgattggtcgtcctttggttcccatcgaatgccctttcctctcaaatttccataagtctaacacctctaattgtcagccgaaagctcctcctgaccatttttgagcttgccatgcaattccattagctcattttcaaaatgagattatccgcccccttttaccatttcttttctcaataaaaccttttgtctttttatcatttattctttcaaaattcttaaaatgccaacaaacataacacccgccctctccattttaaatactttcaaaataatgttttttcctttcttacgatttactcaacataatcctctgttttgcccgacggggcgaaatgagacaaatatagccttcttctgccaacgcaaaatattttgcttttttcaaccgccggcaaaaggcgccggggaaattagcctcgtctgctgaccattttactaattatggctcaaaggcacaaaaatgggaagggcttaatgaggaggaaaatggatgacaaagaagagagagaaaaggaatgaccaaattgagggaaaggccaaagaagcgcaatttcaaattagcaccttttgcagataatttctacgaaaccaccggcgttttgttgcgcgtccgccgttcgtccgcctcccgcgcttatgtggtgaagcggcaacggtcgccgacagacgacggcgccgcgccaatggccgcgccacacggagcgatgggacggaacagacgcggcatcatctgggagtgctgcaccaacaaatgctcgctgaattacattcgcaacaattactgtgccgcaccgccgcaccaaagcgaacagacagaggaaaacgccgcattccaattggaggacgagcggaggcggcggaaatgatacactcagcaacggtggggaataaggacgagggaaaagcatacgggaaaagaaaacggggaaaagaaagagggaaaaagagaggggaaaagaaaacggggaaaagaaagaggggaaaagaaagagggaaaaagagagagggaaaa

SEQ ID NO: 84755 - DNA, 896 bp, Heterodera glycines
  Genomic contig location: Contig_ID=SeqID_3457; Location=95..990; Strand=-
  SCN-specific regions: Sequence locations=1-323,345-386,409-661,683 -785,839-896
atgcttaaggccaacggagacgaatgtgcgatttgcttggatgcttatcaggagggacagatgattcgtcagattccgccatgtcaggtgaatgtttaagccgaataggggctaatgtacgaagtgattttggtaggaaatattgtaaatttgtcaacgcaaaagttatggtaggaattgcgtagatgaaatacggtagtaacattggctattgtagcagaggcacttaatttgttgaaagtttgttcttttgttgagatttcagctttactactgtaaagtttatgcgtttattcatttttttatgcgttcaatcaaatcgcatttaaatattttaatttaatcttttgagtgtttacaaaatgcctcacaattgctgttaaggctttttttaaattatattaatttgtttttccaaattacccgtcatatcacacaaattatattccgaataaatttccaattgttcgctatccgaaatgtaatgataaagcataactcataacaaatataagccaatcggaacatagcaaactgagtgccgtattgaggtggacgcataaataattgtaattgtgccgcaatttctattttgctgatttatttaaactatacttaaatactaattttgcatttagcacaattttcactcggaatgcattgatttttggtaaatgaaaggacaattaatttctttaactttaacatttacaaatttagggttaaacagaacaacaattgtccaatttgtcgcgcaaaactttcataatttcattaaaaaacggtttattttaatttgaaatacaataaatttttaccatttatttaattaattttagcgaaccaacgcaaaattgaactcagaattttgtgcgatgaaaatgtgtgatttctga

SEQ ID NO: 84756 - DNA, 799 bp, Heterodera glycines
  Genomic contig location: Contig_ID=SeqID_3459; Location=1202..2000; Strand=-
  SCN-specific regions: Sequence locations=1-95,118-149,188-196,219 -242,279-699,723-799
atggcacgagaacaggtaatgagccaattataaaacaggtaatgaaccaattaaaaatacagctaataattaagagactaggcaatcagcgaataaaaaatagacaatgttgagaagccaattaagagaaccggtaatgaaccaattaaaaaacaggtaattaggcaattaaataattaggtcactcgtcgattaagagaagagctttttctgttaagagaaaatacataactttctaaatgtatttaaaagaaattcatttaaaataaaattaaaatggctttaacagctcggtggatgcggcgtcggatccatttgcataaatcttccgggctcgttcaaatgcgactgtttgcccggctatcagagagtggatgagcgaaactgtgtggatttgattcgaatctaagggctggctgatcagaatgaaacaaatattgtttattgtaagagtgtataataattgtatgaatgccccgaagtcatttttgtagaagaaagaatgggctacaagaaggtatacgaagataccgtcgttaagcttatatgttttaaaatttcaaaatttgtagattttacaatgaattttcatttatttgtattaattttttacatttttactttgtatttgaaatgagcttgtcaaaataagcacatttttaaaactcgataaaaaactttcaatttgcatattagtgaaccaaaaaagcaaagcattttaacccaacaatatttgagccgacggtgccgatagaaacgctggggattaatttaaaattttgttcgctttgttaataaa

SEQ ID NO: 84757 - DNA, 1409 bp, Heterodera glycines
  Genomic contig location: Contig_ID=SeqID_3459; Location=2125..3533; Strand=+
  SCN-specific regions: Sequence locations=1-33,56-375,397-600,622 -703,729-959,981-1130,1153-1172,1194-1409
atggcgtcccgacaaacatttggcgttagggtcacaaattttacgctggctgtcggcacaatggtcgacattcacacagacggggcaacaatggttgggcaatgtctcttgctcggcacagtccaacgggggacagagcgcggcatttctaacagtgagtggtacggtagtcacatagttacggtaagtaacgttaaaaaacgtaaattacccgtgcaccgttcgaattttatttaataaaagccggcaaattatcggccggtttctggtaaaacctcataacagatttgaaatgttaatgacccaaataatttttttaaatgataatttagcgctaaaaccttctaaattaataattggctcaagtctcagtgatcatttgccccaattttaattcactttggtccataattagtgtggcatatttgaactcgaaattcagaggccaggaataaattcaatttcaaattctcgcgaattcttcacctgaattcgcagttcattcgtccgtcgctgcactggcaaaatacgcacgactttggccaaaaagaggccccactttcgtatgtttgaccattgtaaaagcactgaaatttaaacttatagccaggccagatttttctggctaaacctctgaaatatggggaaccgcccacttcggcgccggccttttcggcgccgttgctaacaacttttttcctgatcaaccaaattaaaaatttttgttatcattcgatagctcttcagattctctattagcctgtaaaatttcaaaaaatttcgtcagtttacaaaaaagttatggccaaaaaacctcaaaaattaactttttcttggctttttcggcgccgcgtggcataacttttttatttttgaatcattcatttctatttttacatgtaaatatagagcacacatagagctttcaaatgatgccagattggctaaagctaactgacaaataaaaaagttatagcatttcaaaatttgcggcgccgaaatggtccgcgccgaagtgaccccgacccgaaatatgcctaaacaatttattattgatagagccaattggctctaatatttaaatattacctattcatttctaaaaaaagccaaaatatgtgaaatatgcatttttgggaaaaaatttattttatgcgccaaaaatccctttaattgattattttccataaaaatgcgaattttagcttcttaaacctattaaattaaaatattccaggtttatttttcatttctttgaatgaattttgtcagtttagcttctcagcgaccggaatgatttaagatgatttgaaagtttttaccagaaaattttgcaaggcttttctttcttcgccatgacttgcttttttaaatcgtctctttcattgagtgattttttttttcaaaaa

SEQ ID NO: 84758 - DNA, 373 bp, Heterodera glycines
  Genomic contig location: Contig_ID=SeqID_3461; Location=579..951; Strand=-
  SCN-specific regions: Sequence locations=1-85,113-116,179-373
atggcctcttttttatcaattcttccatttcttgttgtctctgctcagtttggacgcggaaattttctgttggatcatttgaaggtgtttttgtttaattttgtaaatgtttggtgattaaaaaatgtatatataaatgttttttatttttatattgtaaaattaaattattttttaagtcggctaaattgactgaattatttatggcaagaaatttatccctcgaatttgactttcgacaatcaaatttcactcaattcgatttgttcaacctcaaagatggcgaccaaaatttactgtttcgcattgaaagctcaaccatcacaacgccaaatgaagtgccaaattaaaaaaatcaattcgatgaaataaa

SEQ ID NO: 84759 - DNA, 931 bp, Heterodera glycines
  Genomic contig location: Contig_ID=SeqID_3462; Location=580..1510; Strand=+
  SCN-specific regions: Sequence locations=1-103,126-189,211-215,243 -552,628-639,663-908,930-931
atggctattctcctcccattcgaatattttgtggtacaaaaagtgtacacatttgcgcacaaagtgccacttgaaaatttgtgccaaggaaacaaccaatgcattttaaattattttgaatcatttactcagaaagaaaacgaactttcaaaaatcattgaccgttggtttaatgcaaatgaatttgcgtattttacagaaaaggttaatttgtctttaaattaaaatttattataaatttaggacaatttttttctgagtgctattttgaaagagttggtaaatgaatttaaaatcagtgaaaacaatggcaatagaattggtggggattatgccaatttgctcggcattttcagcaaagcttttattgaagaaaataacccattgatgaatattgtcaagttgagattggctgaagagcaaatgatcgacattatcagtgaaatgtgccaaacaatcaaaaagataccgaattctaaacagtttttgattgagcaatttaatgtatgcccttcaaaatgctcaataattggctttctttgcctattttgcatttttaattattatgaatatattattttttaaatagtttactattttttaaaaaacaattgattaaattttatagccaaattcttaaagtcaattaatttttagattctcgaattaaaaaatttctgtgataaatgggcccctgtacaccaaaaaatgttgcacttcagtgagccaaaaatcgctaacaatgcgcttgggcattggcttcggcaaaatgtcaatgatgggaaagaattggcggacgaagagcgacaaattgtcaatttttggatgacagttttgagctcaaaaatgcattacctgtgtagcaaatggatgccaaatgatataattatgctaacaaatattggttaattttcaaaattttcatcattta

SEQ ID NO: 84760 - DNA, 194 bp, Heterodera glycines
  Genomic contig location: Contig_ID=SeqID_19989; Location=1..194; Strand=-
  SCN-specific regions: Sequence locations=1-194
cccgttttttaattttgtggaaacattcggccgcttcgcggcctcaggacgggcgcttcgcgcccgtttttaattttgttgaggacattgggacgcttcgcggcctcaagacgggcgctttgcgcccgttttttaattttgttgaggacattgggacgcttcgcggcctcaagacgggcgcttcgcgcccgttt

SEQ ID NO: 84761 - DNA, 450 bp, Heterodera glycines
  Genomic contig location: Contig_ID=SeqID_19989; Location=1834..2283; Strand=+
  SCN-specific regions: Sequence locations=1-24,46-372,396-450
gtaacacccagatatgttcaacggcaaaattgtgcaaaggctttggtgaagttccaaagctatttggagaccttcgatttgaaggtttaattggacaggactaaatcctgtcaaggcaattacctttctcccagtatttctgagttggtaatttttgatgtttaatggaagtctcctctcaggactttccattaacttttcaaggttatgtgaacggcaattgcagttcactaaacctgatgaatggtcaggtatgcaatcagtgcatgcctgaacgccaagactgcaattgaaatcaattgcttcttgtcgacttttacagttaaagtcaattgttaatggctctctggttagagctatgttgctcccgtcaaaaacaaaatctgagtttaagacgggggcgggcggaaaagttactccgatcggagtaaggctgatgttgttccatct

SEQ ID NO: 84762 - DNA, 1548 bp, Heterodera glycines
  Genomic contig location: Contig_ID=SeqID_19991; Location=135..1682; Strand=-
  SCN-specific regions: Sequence locations=1-346,370-423,452-524,546 -570,637-723,767-811,850-955,977-1548
atgctgggccatttggctgccaattctaacattccgatgcttgtctggggacaaagcatgtcttcaaagtgagttcgttcaattaatttgactaattaatcttcgaattctcatcagtcttgcctcctcaaacaatgccacctatccaactctgttgaacattgtgccaaattacaaatagtacactcattttgatttgtatattatttaattgcctgactttaccattagcatggcttccgggcttataagtcttcttcagtattttaattggacacaaatcggcattataatccaaagtgatatcatatcagcaagtggaggtaataattaagaaatcgcaaaattaaatttaaacatttccattttctttttcggttgtgattattttggcactgacattgacgtgagtcattttattgcatttttaaatgttttaaaaattattttagaattcgcttagcgaacagtcgaaaatcacaattaattataaaacacgcattttcaacattcaatcatccgacacaagcacaattgtcaatgcaattcgagaacgggcgaggagtacgcattttaaaataataatttataattagggaaagtaaaattaaattatttatttcttttttaaatttagtcgttttgctttgctttgacgatttgaagcagatgcgaactttcgcacttcaattgttcgatggaggactaaacacaaaagtcgtctttatttattttattcattttttgttaattgtaaatatttttaggattatgtttacataatggtggataatgacatgtatttatcttgtgagtttaattgaggaatctgaatgattttttccacaatttagtcaatttgacgagattacctttttgggtacaatcgaggtaatttatggtttcaaaaattagaaaaataagaatcatctcaaaagccaagccattgcttcatattaaaatatttatacattaaaaacaaatttgaatttaacaatgatgtggcccattttacttataatattgcataaaaaaatcctatggtaattctttatccattacagtaacaattcaaatacgctcgacggaagaaacgcggacgccgaagtgattggccgattggccttatgggtagaaattggcacattttgataggttaattttcaattgatgcttgcagtggcactacgacatcactttgtccgcgttgtccaatcaaaattactacggctttttcaaaagagtgatcgacagaacgggcgattggcccttttattgcgatgaatccaattgcagcaaagtgatcaatgtgaatggattattttttgattattcgctacatccaatcactctttaggcatccatctattcgcttctgttgtacgacgcaatttacaattacggaatggcactgaacgaatctttccgccaatttggcattcggcccgaagtgtaccgaaacggcactctgttggcacggaacaacagaaagccattcatgggcaagaaatgcaaaagaaagccgaattttgaaagcatttgcttaag

SEQ ID NO: 84763 - DNA, 1292 bp, Heterodera glycines
  Genomic contig location: Contig_ID=SeqID_19992; Location=5..1296; Strand=-
  SCN-specific regions: Sequence locations=1-95,129-487,509-579,602 -615,640-747,770-793,816-887,909-1031,1082-1292
atgtcatcaaatttatttcgatctgtcgaaccgatggaaatgactgatccaattatctcaaatgaatccccgccaatggcacgagttggacaatgtaaaaaataattttaataataaaaaaataaatactatcaaatggtaattcaaacataatttttgttgtttttgtttttattttggaagttgcccaatactagagagcccagaaatttcaaatttgcggatcctgctgcgggatttgtgctcaaaattttgcgagacgggattccgcatgtataataccgcatttttcgactgagatcccgcaaaatcccgtcccgcgccggctctacccaatacacaaaaaataatttaagcatttttgttgctttttatccacttttattaaaatatagctttttgggtaaaaagacaacatgaccctgtaaaggaaaagaaaacattttctgatttttataaaattagacttattttttcaatttccagacagaggaatgcagagaaaaatgacgaagttcataattttgactgtagtgaacattacggtaacagtgggactgctcggcttcattacggtggtttaatttaaaataatataaaagttttttcttcaaatatacagttatattcaattatcagattgagaatgggcggaccaatgctgagttggaaattttgaagaactctgttggaaaattggaacaacatggaaaaggttggaactgcataaatcaaaagtctaaattcatatttatattaaatatttattcccaattaattcttatggggggttaggtatttataaaaaaggggtaaattcgaaaatttcgcgagactgtaattgaccctgagactcaaagttgtgactctcgggcatcaatatttggattaaaatgtgttgttcaaaatatatttgttaattaattttcatttgtggtcaaatccatcaaaacaaaagtcatcgcattggaggaacatcaaaagaaagaagaaacctttattggcgttttgaaagaccgatttggaaatggtaaaaatgaaaaaataaaataatttttaatattttaatttattaatttttcagaacttttaaaagctgtccatccggacattcgcaagaacattgctgaggtgaaaaagaaggaatagatttaaaaatacataaaaacggaaattattttagaacttttcgaacccaaaacaaaactgttgggacgccaatgccattcacaatgatctcgaaatctttggctcggaatctttgaaagtgcattacaaaggcgatggaagcg

SEQ ID NO: 84764 - DNA, 591 bp, Heterodera glycines
  Genomic contig location: Contig_ID=SeqID_19993; Location=186..776; Strand=-
  SCN-specific regions: Sequence locations=1-31,53-591
gttgtggcatgttcacaggtggcggcttcggatgtggcatcagcaattgcaccaaattcacataagtggtggagggcggctgatcatcttttgaataagaaaatttattgaaacgaaaacattttcggcggtaaaaaaaacgtttgaaaaaattccaggcaaaaaatggggttaaaattcaagaaagttttgcttcaataaagaactcggtaaatctcatgatactaatggcgctgcggtttagtcgagtcttgaagacaataaaatgtcaaaatgttcgcttgggccaagagaattccaggccagggaataccgaacaaaaggggacccaaagtgcccaaatttcctcaaaacccaattctcgaaagcatcgccaattttggcacctttgccgaactgactgctctccttccaatgccgtcggctgctggacatcattgaagatgatggtattgcttggtggtgctgctgttttttgaatccggcgccgactaagccggcgccgctgcgccgggttcgactccgaatcagaaacagtccgagcgccatcagcgcacatgcaacgccgcaggcaccgaacaccgccctgga

SEQ ID NO: 84765 - DNA, 336 bp, Heterodera glycines
  Genomic contig location: Contig_ID=SeqID_19993; Location=2000..2335; Strand=-
  SCN-specific regions: Sequence locations=1-336
atgggggaaaagccagtctcgagcatttggagagcctccccggcgactaccgaagagcaaaagttgctccaggatctttttcaaaaggaaaagccgattaaaaatgttccatgggaggaaaagccgttcccgaccgtgtggacagaggaaaagccgcttctgagcgaggaaaagctgacttatgacaacggacgacgccttcgtgacgttggcggtttggtgaagccgtcgcccgccggcgccggatggcagcagcgccggcgcctctacggatggcgcccgtcggcacactttggcgccgccgctgaaaatggacaaattcggcgccgtttttaa

SEQ ID NO: 84766 - DNA, 722 bp, Heterodera glycines
  Genomic contig location: Contig_ID=SeqID_19995; Location=1014..1735; Strand=+
  SCN-specific regions: Sequence locations=1-86,118-424,447-722
atgatggcatttaaatgtcattttgttctttctctgttgctgttcttctgcgcctcatcatttttggtttatgggggagggaaaggtaaaaatataaaaaaatatttgttttaattagggtagggtttcagatttaatcaaaacttgtaaaatattcacgtaaaaaactttttcaaataattacaaattaaagtgaatgagtttttcgtgctcattagcctattttgcctattcccttgtaattttattcctaatttgcattttttaatcctttttacagatgcgtcttcgggatccaataacagtgaaaaaaagtcgttggccgatctgatggtagaagaaagattggccgaccgggacggaaaaccattgaatgaattgttaaaatttgacaaaattgacaaaaaagaattggatgcatttttgaaagaaaatggggaattgcttgacatctcatttgatgattacaatccgcaaaatgtgcagcttggtgaccatgaccaagtcagtgttctttttagtccaccaagtgcggcatcgccagcagaagtgggaagcgaatgccatccgatatttgtgccattttagtggaccaattccatctgagtcaatgtattttttaagtgtcgttcaaatccaacaaactttgtatcattcaaaggctctttgcagacttttttagcctaggaatttcacacagaaaaaaaatttgcaaaaaaaca

SEQ ID NO: 84767 - DNA, 772 bp, Heterodera glycines
  Genomic contig location: Contig_ID=SeqID_19996; Location=61..832; Strand=-
  SCN-specific regions: Sequence locations=1-146,168-182,204-651,675-772
atgccctcttcggcaccggaaattccgcccgtccaatgcttccatcacatcgaattttttgtgtccaatgctaaacaggtaattaattaattaattgccccatttaaactaattattgcgctgctgaatatttgctattccattcattaattatttgtcccttttctttcctttaattaggcttctttttggcattgtttccatttcgattttcgtcgttttgcgcagcgtcagacggaaaatgcctccgaaattgccattagaaagggaccggtaattattgtattgtaattggctaaattcaagagtttctgcgatttcacagattatttttgtcttcaaatgtagcatttcgccggacgattcggagggaattggcgctgaagtgggaaaacgcggagattttgtcaaggacgtggtcagtcaattcgccactaattaattcccttttctgtgccatttatcttttgtccctttcagtcttacgaagttgacaatttggacgccgttcttgcggtaggccattaacactaattagtgagtattaattaattgccaaatcttttttcagaccctccaagaaaatggactggaattattggcacctaagcaaatgaccactgatcaaaatggctgtttgtttgtcgcaaaaattgccggttccgccgggtccattgcccacactttgatccaaaacattgactaccgcggattattcatgccaggcttccgtcccatcgctgacttttctctcaccagcactttgctgtaa

SEQ ID NO: 84768 - DNA, 289 bp, Heterodera glycines
  Genomic contig location: Contig_ID=SeqID_19996; Location=1215..1503; Strand=-
  SCN-specific regions: Sequence locations=1-166,236-289
agaggtgggcaaaccatcgttctgaactcgttcaatggcgcaaatgggggcaatgggatgaggagaagcggaaacggagcgaacggaggggcggaaaggggggcgcaacggcaaacgattgcctcgagaagcattcccgtttagagacagcgcaacggcacaagccaattaaggaattaattaacgaattaattaattaattaatgaacaaattagctaattaacgaattaattacgaatatttgttgatcagctcgttttgtttacttattaaatataattttgctca

SEQ ID NO: 84769 - DNA, 852 bp, Heterodera glycines
  Genomic contig location: Contig_ID=SeqID_19998; Location=194..1045; Strand=+
  SCN-specific regions: Sequence locations=1-165,187-490,512-569,591-852
atgtattcattttttgacttaggcaagaagaatttcggctatttggtcagtgctgtttcgtttttggttttctacaaagtctccagcaatatcaagttgaagaaggcaatagaagcggttagtttttacgattgtttgcttatgcttttgtaaatgttgcattttagaaacagaaattggaaatgaagccgtacgttgttcaggacgcgatgacacgcagcggaatttaaagaaacaacgcattctaataggtgggaggcaaagtatcttcggattcattagttttaaactcagaatggcgtatttgttgtaactgttcacaagagtaaattaattctatgactaatattgaaactttcgtttttgtgaatttcaataattggttttgacaagttacctacctatattggttgattcgggaaaaaatagtaaaatttgattgaatgttaaagtacgggtaatttttcagaattgcggtcccgacgaaaagttaatttaaaaattttattttggttttttcagggtgaaaaatgtgctaattacgaatctgagctcagattttgcaaaatcattgattttatctatgatttttcatcaagtacttgattttttccaaaattttaaaaaaattaaacgagcgaaaaactcatgcatagatgttgtagagtttaaaaatagcttttgaatgaactattaaatttatgaagaaggcaaatttaaagttttatatgattttttgaaatttaattactggcccttaggggtctatgaaacgggtctggggttcaaatccgcttggctgcggattattttttatgacagccaatgaccgttcatgcctttcatataaaa

SEQ ID NO: 84770 - DNA, 66 bp, Heterodera glycines
  Genomic contig location: Contig_ID=SeqID_3463; Location=32..97; Strand=-
  SCN-specific regions: Sequence locations=1-66
atgccgttgaccattgaggagtatcaaattggccaattgttttctgtggccgaggcatcgcgacag

SEQ ID NO: 84771 - DNA, 864 bp, Heterodera glycines
  Genomic contig location: Contig_ID=SeqID_3463; Location=344..1207; Strand=+
  SCN-specific regions: Sequence locations=1-607,629-757,779-864
ctataaaaagggatgaaatttgcgagatccactcattcttcgcatttgcgacttttactctctgctgaacaatttcttctctcgacgacactttgcgcattcaatccgagcacacttcttcacccatttgctagtcccatgtctctgcaatacgtcggcatcgctgcggtaatcctcggaagtaagtgccaaaacaattgttgttaatccatgttgatttgctgctaattaatcgccatttttcagctgccatcgctctgttccaaactgtgtcgctcagcaccagacgacaaatcgccgcacaaaatggccgaagcagcggcagcaaacgccaaagcaagtcgccgtcgtccgcaaaaaccttggcacacaaaatcgctgcgacggtcatcgctgagaagagcctgagctccatcccggacaaagaaatcttgcagctgatggacatcggctttcaactgctcgacgaggtgggctcagcctggatccgggatgaccagccagtgcctctgttaattcgtgccaccactgttttcaggagccggcgcgtgttgatgtgcatgccccttgctacgttttcggtgacatccatggcaatttgtcgtaccttctcaagtgggttttggactcgtcgactcggctttttaacatttcagcggcacttgcaaatccgttgttgttcaggtacttctccgacacccacatcgaaccgcagctgctcaagctccaaccgccgctgttccatttgctgttcctcggcgactacgtggaccgcggcgagttcagtctggaagtcattgcgctgctcgtctcgctgaagatcctcttctgggacaagatcactctgctgcgtgggaaccatga

SEQ ID NO: 84772 - DNA, 191 bp, Heterodera glycines
  Genomic contig location: Contig_ID=SeqID_3464; Location=939..1129; Strand=-
  SCN-specific regions: Sequence locations=1-130,153-191
atggcccgcgccaaagtgaccccgaccctctgtctccttcttcactttgttccccttttgactgcacttcagcaacaatgctcatcagagaatagtgagttgcttttttcatcatcattcttctgacaccttaattaattacgttaattaattacgctttccttttttcagtcgcatcgtcatgccgttga

SEQ ID NO: 84773 - DNA, 1809 bp, Heterodera glycines
  Genomic contig location: Contig_ID=SeqID_3464; Location=1602..3410; Strand=+
  SCN-specific regions: Sequence locations=1-607,629-757,779-1051,1073 -1286,1310-1541,1563-1711,1737-1809
  Gene Ontology: Mol. function=calcium-dependent protein serine/threonine phosphatase activity; Cellular component=cytoplasm; Biological process=embryogenesis and morphogenesis
ctataaaaagggatgaaatttgcgagatccactcattcttcgcatttgcgacttttactctctgctgaacaatttcttctctcgacgacactttgcgcattcaatccgagcacacttcttcacccattggctggtcccatgtctctgcaatacgtcggcatcgctgcggtaatcctcggaagtaagtgccaaaacaattgttgttaatccatgttgatttgctgctaatttatcgccatttttcagctgccatcgctctgttccaaactgtgtcgctcagcaccagacgacaaatcgccgcacaaaatggccgaagcagcggcagcaaacgccaaagcaagtcgccgtcgtccgcaaaaaccttggcacacaaaatcgctgcgacggtcatcgctgagaagagcctgagctccatcccggacaacgaaatcttgcagctgatggacaccggctttcaactgctcgacgaggtgggctcagcctggatccgggatgaccagccagtgcctctgttaattcgtgccaccactgttttcaggagccggcgcgtgttgatgtgcatgccccttgctacgttttcggtgacatccatggcaatttgtcgtaccttctcaagtgggttttggactcgtcgactcggctttttaacatttcagcggcacttgcaaatccgttgttgttcaggtacttctccgacacccacatcgaaccgcagctgctcaagctccaaccgccgctgttccatttgctgttcctcggcgactacgtggaccgcggcgagttcagtctggaagtcattgcgctgctcgtctcgctgaagatcctcttctgggacaagatcactctgctgcgtgggaaccatgagatcgcggaagtcaacgcggagtgagtgccattggcgaaaagtgccattgtcgtcattcaattccccttttcaggtacaccttcgaagaagaactgagaacgaagcgaggcaagggccatggccgcatttacaaggtgtcaagagctaccaaaatgaatgaatttttaatgtttttgttcccctttcatttcagaggtgcaacaagctcttcaccaagctgcctctgtgtgccatcatttccaagacgttcctctgcatgcatggtggcttgccgcggccagaaggatgggactttctgatgggtgatgacttccatgtgcgtttttcgtgtttccctgtcaaagcctttgtcatttccaatttctcacacatttttcagaagccaaaaaccgacctggaaatcgacgaaaacaacacattctgtgacctgctttgggccgaccccactaacaatgcgcaggagcttcgcctttccaaggattttgagccggacaaaggattcctcggcgagtacggcaactatcgctttaatcaggtggattttggaggactgctgacccagcattttgttgaccgcttttttaatactttactgtcattttcaggaccgcgagacttcaattcagttcaacgaccgctttgcgcaggagttcttcaaccgctttccccacatccgcggcatcttccgggcgcacgaaaaccaaccgaaagggcacagcatcaacgaggcgcgtacaatttgcacggtgttcagctcgcctcgctacatggaagacacggactgtggatctgtgctgcgggtgcgtgctgcttttgccatgccatttttttgctttcaattttcaattccttttccccctcagctttctgccgacatgaaacacattcacttcgtcacgctgaaaccgaaggctactggagagaaattgagccaggaagaatga

SEQ ID NO: 84774 - DNA, 531 bp, Heterodera glycines
  Genomic contig location: Contig_ID=SeqID_19999; Location=777..1307; Strand=+
  SCN-specific regions: Sequence locations=1-492,518-531
atgaccgccatgtctgtgcaggggaagggacaaaatggaaaacagaaaaacggaaatgcaaagaaaatcacgttccaaatggacaagaaaagcgatagtgccaagtgcgttaccataaaataatcattcaaatcatagaatcccaagtggcaaaacactaaataaaaatcaaaaactgttttatagcatttaaaagaattttttatgtgtaaaatcttaggctaattacgcgcctaattactaaaacatttacaacaattattaatttaatttgctataatgtccaattttcgagagacgttccgtattcccccccccctcctctccttcgtccgaatacgtctcggtcagctgctacctgaaacgggtcaatcggggcaccgaaggaggacgacttttgccgaacgctggccgccttcgcttggtgaagcgacggagcggcgccgccattctgccggggacaggccaacgaattgagccattcttcgctgcaaaaaaaaaaataaatttaattttagcaaaaagaattaa

SEQ ID NO: 84775 - DNA, 481 bp, Heterodera glycines
  Genomic contig location: Contig_ID=SeqID_19999; Location=1312..1792; Strand=-
  SCN-specific regions: Sequence locations=1-109,131-241,263-305,327-481
atggtcaccttcatggagacggagggtgccgtgctgaagtgagtgggggcagaaacgctggcaaatcgggcagcaaatggcacaggcgtatttattgaattgaacaccaatcaaatttgaggagttttgaaactggagtaattcgtgtttccccaccctgttgtttcataaaattttataaaaatactttgttttttacgtaaaagtttaaaattcaattttttaaaggaaagtgtaagagacaaaagaaaattaaaattttgtagatgaggttttctttcgaaatttaaaacaattttttcggcaaaggctttaattgggaaaatgcccacccaattgcattcgttaattaattgttgttacacaatttttcagtttggacaaggacagcaacagtctttggtcgcgtacccatgtcggccgacactgttaccgtatgcagccaatttgcatggaggaggagacggagtcgcccgtgtaa

SEQ ID NO: 84776 - DNA, 2028 bp, Heterodera glycines
  Genomic contig location: Contig_ID=SeqID_20001; Location=94..2121; Strand=-
  SCN-specific regions: Sequence locations=1-194,216-729,753-860,882 -1765,1787-2028
atgttggaggacgctcagaaaaatggcaccaacatttcactcaagaaaattgaggaggagttaagggcaattcaacttgtcaaagagagcgcactttcgctggtcaacccgccaattgccaccaacgccattaacacaagaccgcggcaatggaccgacccagcgcaaagacaaagtggctccaatcaacgacaacatcacaatgcaaattcaaatggaaagcaaacacgtggtcgcccaacgcttccgtgtgcatcatgtggcaaatccgaccattggcgctccgattgctcattcaaggacgccatttgcctcaagtgcaacaaaaaagggcacatttcgacagtctgccgacaaaacaagacaaaggccccaccgaacagccaccggtcattccacacagtcaaagttgacacacattgcctacatgttggcacaactcaaggccgatggtggaaattgatcattttgataaatggaaggcaaacttccatgaatggcgacaccggcgctcaagccacaattatttctttgcaaacatggcgagagttgggagaaccgaatttgactccatccgacatcgatgccaaaaactgcaatgaccagccattagctttgcttggcaaattccaatgcaccgtccaatttgccgacaaaccaccgcaaactctgatcgcctatgtcagcggcgaagtcggacacaatttattgggactaccatggattgaagctttggagatcatcccacgccaaattttattcccgaccagcaaattggctcaggcgacaaaaatgattgaaaatttttcgacagtgaagccgccaaacaaatcgatcagtgatgtgacaacgctcacaacggcactccaaaaggattttccggaagtttttgaagatggattggggcactgctcaaaggcaaaggcgcatctcattttgcggtctgatgcaaagcctatattttgccgagcccgcccaattccacatggcgccatggaagctgtgaatgccgaattggaccgtcttcttcaaattggcgcaattaagccaatcgatttcagtcattgggccgcaccgatcttggccgtaaaaaagaaaaacggcaagacgagagtctgcatcgacttctcaactggcctcaacaatgcattggaattgaactggcacccactgccaaggccggacgacatctacgcttcactgaatggcgcgaaatttttctcaaatttggatttgcgcgatgcatatttgcaaatggaaatggatgacaaatccaagcaattgtgcgccatcaacacgcatcgtggactcttccaatgccaacgcctgccattcggagtcaaatcggcaccggcaatatttcagcatctgatggaccaaatttgtgctggcatccctggtgttttcgcgtatcttgacgatggattgatcgcaacgaaaaccctggagcaacacatcacggcactttacactctttttgggcgcataaaagagtacggtcttcgcatccaactggacaaatgcaaatttttgcagcccgaacttttgttccttgggcatattgtgtcagcaaatggcattcgtccagacccatcgcgttcagacgcaattcggaaaatgcccgcaccgatcgacaaaagcacgctccgatcattcttgggagctttgaattattatggcagatttgtcaaatgcatgcgtgagttgcgtgcaccgctcgaccgactcctccaaaaaaacgtagcttggaattggacttctgaacagcaaaatgcttttgaaaaagcaaaagaaatgatgacatccgatttattgctgacccactacgacccggcacgaccaatcgtcgtatcagcagacgcgtccaaagatggaatcggcgccacattaagccacacattcccggacaaaaaggaaaaagtggtcgaacacgccgcatgcacactgacagcagcgcagcaaaattacagccaaattgaaaaagaggcattggccattgtgttcgccgttcagaaattttaccgcatg

SEQ ID NO: 84777 - DNA, 1111 bp, Heterodera glycines
  Genomic contig location: Contig_ID=SeqID_20002; Location=700..1810; Strand=+
  SCN-specific regions: Sequence locations=1-174,204-220,243-270,292 -351,378-499,524-581,613-711,749-1111
atgaatgttaccgatttgaattctacaaattttacagtttggcgttgtgttgtcgttgattgtattggcaccaaaactgtgaatgaaatgatcgaaatgacttttcgtatcacagaagactatgaaccgcagacagatgatgaagaaataatggtcaaagtgttgaagcaatgccatgaatattttcttaaagaaagatttatggtcaattttaaagagatcatggacaattttgttggagtaattgttcggattggctttacgaatgtgcacaaatttttggaaagtgaattcgagacgaagccgaatgatttctgggattcaataaagaagggcattgacgaaataaggtttttttttaaatatttatttatattcaaccaattttagtaagataaacacatcaatgcctttcatttttgttttgatgctgttcaaaattgaatgcgtttactgtatttttcactcctcattattccaggatttttcagttgttatgttttaaaatataaatttaaattttgtattcacttaatgtacctttttttaaaaaaagtacacttataagtaaaatatatgacaatatttattaaaatatatagatatatataactggcgctcaatattctccttttagttcatgttttgaatcggatgtaaagtcagaaatttgggaaccagtcaatgaaaaaagtggcaaacagaaaatgaagcaattatcatcatcctcttcatcatcatcatggtacgagaagcaaaatcagcaagaatttcttgcattagaaaagcatgacatcctgaaggaaaagccattgcgcggggaactgatgctccaagcggagcgggtcagtgctgcactactgtacacactgatacacatgaaaatgcggttgttgttcgaccgcaagcaggtcaaaaaaggaatcaacatatcgaaaaccaacatatcgaagacatccgcaaaggtcaaatcaaaaatgcggaaacagttaaagcgtctgcaaaaaacagtggtggaacgaatcaattcggtaccgtaattcgtcagtgtatgcatattttgggttggggtcagtcccaaaaaaccgattttttggggtacattttcaaa

SEQ ID NO: 84778 - DNA, 331 bp, Heterodera glycines
  Genomic contig location: Contig_ID=SeqID_20005; Location=1..331; Strand=-
  SCN-specific regions: Sequence locations=1-303,325-331
ttctggccgccattttgctggccaaaaagtctttttggctcttttccgccctttccgccggctccccttgcgcgccctttgtgtcctctgtcggatgcaaattccaagtttgccgttgacatccatcaaatctcacccaaaccatcaaaggaattccccgtggtggccgtttacttgcactcattggcatcatccttggcatttagtgtgcaaatgtacacaaaaagcctaaacgactctatgggttacagtgctgaaagaaacgcaccgaactcccccaaaaacattgggacgacagcaacagaaagacggcacgggcactggaaaagca

SEQ ID NO: 84779 - DNA, 199 bp, Heterodera glycines
  Genomic contig location: Contig_ID=SeqID_20006; Location=451..649; Strand=+
  SCN-specific regions: Sequence locations=1-199
atgtctggacaaggaaacggaggaaagggacgcggaaaaagaggggcaaaaggttaccgtaaagtgagtaaaaaataatttgcaaaaaataataactatcgaaatttaattagtttttaccaagccacttcatttaaagctatttatgagaaaattattttaaatttgacaaattttctagggcaactaatacttttaa

SEQ ID NO: 84780 - DNA, 622 bp, Heterodera glycines
  Genomic contig location: Contig_ID=SeqID_20006; Location=1557..2178; Strand=-
  SCN-specific regions: Sequence locations=1-552,574-622
atggtgatcatttggacaatttgcgtcgtctcaacaatttctgctggccaagcattgtacaaatggttgcacacgccgagaaaagatggccaacccaagcggttgcgttgcgcatatttcttcagacaaacggacttcgattgggtcaacaatttcaaggaggtgtggccataattcgacaaatcactgatttttgttttccaaattgtttagcaatttctccgtgccaatgccatttcttccgtcagttacgaaattcatttttcttttcttgtgccgtcaatgccaatggtgccgtttgaattggtgaacgaatcgacaaaggaaaagctgacattcgccaaagcaaatgaatgggacatcgattggataatgaaacgatgcaaaattgacgagacctcgtcggttcagcagcagaagaaagatgaaaattgggacaatgtgttcatttggctttttgctggcactaattgcattgggtgagcaataaaaaaaaggcatttaatttttatccgaatttgaattttgcgcttaatttaggccattatctcctccaccaccagcagaagaagatgaagcgggacaaagcatcacaaaagggacgtcttctgctgacaaatga

SEQ ID NO: 84781 - DNA, 1194 bp, Heterodera glycines
  Genomic contig location: Contig_ID=SeqID_20008; Location=825..2018; Strand=-
  SCN-specific regions: Sequence locations=1-5,35-122,144-152,174 -402,426-1194
atgcccatttttctcctcctcctcctcattccattctctcattattttcaatctatttcccggtgattttgctgctgcaaatgtcttcaggaattatgtacgtttattatttctttttgaaacatttcgcatttcttttgcttgacttttgaccagaattgggagatgaaaaattcaaaatcaatttcgaaagattagcttgcatcggacactaaaattcacaatttatttcttcgtctttagcctttgatcctttcattggattttcattccccttcacagttggtctaccgtgtttcttctgttggtcggctttgccaccattctttggttcttttttggccatgtcaaaaaacgacgaagtcctcacaaagaaatgtaaataattaatcaaaaaatttgaaatttcataaaaattcaattttcagctttatctgcgccgattgttggcttttggtgttcgattttcttgcgccttctcagcttggccttggaattgcattgattagccgtcgctttgacgtttacgtggatgaacacttcaaaacacgcaaatggaaattgggcaaaatgcgaatttgccacaaaattggagagaatggcacgaagaaaatgcaaattgtcaattccgatggaaatccattgccaatcctgcaaaatccgttgtcgaacaaagtcatcggattcagatacattcagatcaagtaaaaaactgattaatttgtaatttttcgtctaaattttctgcttttcagctacatcgatcaaaatgtcatcgcatttcttcgccgttttcaccattttttcgccatttgttcaacggatttgtacattaccactggcaatgaccgcattttggaatttattttgctcaacatttggccaatgcttcgccattctatgcatctgatgatgtttttgaataccatcgcttttcgccgtttgcgccaattggccccgtcacttctcaacgattgtccatcccttcactatgtttctttcggtgacgtcattctccccgaatttccgcccgatgaaagtgccaatgcgtcggatggacaagcggtgaccaaatggttgttcacgcctcgtccggatggtctgcccaagtggctcagatactctgtgaattcaccggtgaatcaatggtcgtcaacgatggaacagtttaaagcggtgattatcccgatttaa

SEQ ID NO: 84782 - DNA, 1001 bp, Heterodera glycines
  Genomic contig location: Contig_ID=SeqID_20009; Location=247..1247; Strand=+
  SCN-specific regions: Sequence locations=1-277,299-384,407-1001
atgctttacatcgacaaaagtatgcctgtcctcattggagtcaaggcaatgcgtcaactgaacgcacttttcggacatttcacaacatcttggccaaatacatttcgaagactcagcccgacttcgatgaatttttggatgctgctaatttttgctacaacacgtcagtgcatgcttcaacaggtgagactccattttttcttatgtttgggcgtgacccaattttttgtgttgaccaaataattgacccaaaggttcgtgatccgatagcaatttcggatcgaaatgaatttaaacagaagttagtcgttgccataagacacgcgtggcacgccgcagctgatgaatatgcaaaagctcagcgaaaaatgaaggaacaatatgacagaaaggcaaggccacagcaaatcacaattggtgatcgagtgctgatcagaaactacgacggacgggtaggcacatccaaaaaattccaattaccgtggcgaggaatttttcgggtcatcaaaattgagggcatttatgttactgtgatcagttgcacttcgccaaattcgaacccaaaaagacttcacttaaatcaaatcaaaaagtgcttcgaaattttgggccctccctgcactatgccaacccaaccgattgaagaggaaaagtgccttgaaaataccgaaaatgccgataaagcaatttcgaaagggtctgaaattcaaaatgaaatggaccccgaatcccgggaaggcgaaaatttggagcaaatccacccccgagggccggaaacaagaccagaacttgaagcagatgaggagaaaaatgagcataaaaaaacagatacggaaccaaggaaatatgaccttaggaagaggacgagaacttggaaagatcttgtaaattattagcacagtaatcagcaacgtcaaaatttattttaacaaaatcaatgaaattattcgagatcgatctcgtctaaaacgaagtcagttcggaaaggtccgaaactagga

SEQ ID NO: 84783 - DNA, 397 bp, Heterodera glycines
  Genomic contig location: Contig_ID=SeqID_3465; Location=448..844; Strand=+
  SCN-specific regions: Sequence locations=1-95,117-160,183-397
gaacaaacggaattcgtataacacgacagaggagcagtgctcgcattaattggctgaccgaactcaccacgcgcgattcaactccagttacaaccacccaaacttcaaagggttttgtgtattattcatcaaaatttgagctttaattttttagatttttctgaaatcagcaaacatttagcgctcgttgaggacgaagacaatattaaaaggattcaagcaaaacgagaaaaaggtttttgaaatttccattttaatataaaagacgcctttattgatttcagaagcccacgaacgcgcgttggcttttgtcaagaatcagttattgaactcgcggaaagacgactggctccatcaaccaatcgaagaattgcttggctacgcaccgaaatactaa

SEQ ID NO: 84784 - DNA, 683 bp, Heterodera glycines
  Genomic contig location: Contig_ID=SeqID_20010; Location=596..1278; Strand=-
  SCN-specific regions: Sequence locations=1-2,24-190,228-340,372 -562,584-683
ggccaaaggaggccaaatttctcagctttttggagcagttcacactgtgcacaatgttccgcatttttgtccgttttgtcggcacttatcccattgcatttctgatcttctcattgatccttgcttcgctgtcaggttgtgcgaatttgcagtaaaatgtgggacgaaatttagaaaaaaagaggaaattacaatttccttagattcaatttcacccattaaaaaattgaaaactttgagaaaattacattcaatttctaaaaaaaacatttcaaatttcctcgaatattatacgaacaaattttcaatttttaaaggaagtttttttaaaaatccgatcaaattaattaaaaaattattttttataaaaagttctagagttcaacattctaaaagcctggacctgggttccatgtttgagctggacctggatttcctgacaaaaatccatttccaggaaaagccaaggttgccggaatagccagggactggacctggacccaggaaaacccagacctggatccaggtccgggtcgaactctacgaaattcgcattttcgaaccccccatttcctcccctttccagttggaattgagggaccgagttcgggacgggtacacgccgaccacgtccatgtcacgctacaaaacggacgtactcagcgaatttcttggctcatccg

SEQ ID NO: 84785 - DNA, 130 bp, Heterodera glycines
  Genomic contig location: Contig_ID=SeqID_20010; Location=93..222; Strand=-
  SCN-specific regions: Sequence locations=1-130
aagacggccaaatttctcagctttttggagcagttcacactgtgcacaatgttccgcatttttgtccgttttgtcggcacttatcccattgcatttctgatcttctcattgatccttgcttcgctgtcag

SEQ ID NO: 84786 - DNA, 504 bp, Heterodera glycines
  Genomic contig location: Contig_ID=SeqID_20011; Location=1677..2180; Strand=+
  SCN-specific regions: Sequence locations=1-142,208-334,359-455,483-504
atgcaattaatgatgacccaagcggcggtgctgttgatcatcccttgtacagcggaattgattccgtttattcaacagccggtggattgtcggtgttggcacttgtcgttttggttggcacgctattcggctttttggtaacaaatttaaaaaatatatttatttttttcttaaaaacgaataattaaaataataattttttttataggttggctggcgaatttcgagatggcgaatgctcagcgagctggcacgtcatacatcatcaggcatgtgtaaaataatattcaggggtcaagctaatagtcccaaaaaatacttcagatggagaaagcaccttttgtttttattttctgttacttaaaaaaatttcgacaaaaattataataacttttttttcaaaagcaaactaaacttatattttttggtattttgatagacctatttttttttattagacagaaaaatttaaaaaatttggcaaccttattaaggcctgaaaaa

SEQ ID NO: 84787 - DNA, 857 bp, Heterodera glycines
  Genomic contig location: Contig_ID=SeqID_20011; Location=1..857; Strand=-
  SCN-specific regions: Sequence locations=1-152,184-468,613-641,688 -793,855-857
ttttagtgccagctttacagccgatgtgctaatgagccaaatttggcacgaccgtcgcttgcgctattcacacatgagcaattgtcatcaaaatttaactttaagttcagcaattgttgaccgtttatggcaaccattcgtttgttttgtggtaatttattttttattttttttgtttattaagtgccaaatagttagtgaagtcgtattttttgtatgaaaagtataatgaactgaaaaaactcgtaaaaatggttaatggcaactcgtacaaaggcgactcatacaaaaggcaaactcgtaaattgtacaaaataggcttaagcataagcctaaaactttggcctagcctaagccattgtacgagtgccataaaacctagaaactatatatccgttaaaaatttggaaaaaacaagccaaatgaaaaaaaatgaatgggtaaaatgtaacgaatttctttagattgattaattgattttatataaattagttgattaaaaattttccttaaatactttgtaaatttcaaaaattatttataatttattaaataaaaattttcaaaatttttaatttcttcttattttttgaaaataaaatgtttttatttgcataaaaaaattagccgcctagttaaagaatttaaatatttccataaataaaaaattaaaattgtttaaaaatagaacagcaaaaaatcggagctgcacatttcaccttcggcaaatacttttgtgttgatttatcccaatggcactgtgtggatgaattttcgactgcgagttgaaggcaaattaattatttttttaatttatgaaattaaaaattaatttaaatttgaattttaattttgca

SEQ ID NO: 84788 - DNA, 430 bp, Heterodera glycines
  Genomic contig location: Contig_ID=SeqID_20013; Location=324..753; Strand=+
  SCN-specific regions: Sequence locations=1-344,372-430
atgactgtcgtcgtattttttttatttctgctcgcaccgatatgcgaaattgctttagctgataacaaaggaaatgctcttcatctgaataatcatccgaaggatgtcaaaactaacactaaaaaggcacctcctaaaaattccattaaaaccaatggaatttctcaaaaagcaccgcttcatgaaaatgccaacgttttaactggaaggaatgagaagcatcataaagacaagaaacttccggtgcataaaaatggaaatgctttaccaaaaaacaatgattcttcggagttcgaagatgacttactgagtcaggcactaactcatcttcgtaaaatgaatggtaattattttttttaaattataattttgtttctccctcattttagaacaactaaagaatagaaactggccacaaaattcggagtaa

SEQ ID NO: 84789 - DNA, 447 bp, Heterodera glycines
  Genomic contig location: Contig_ID=SeqID_20013; Location=887..1333; Strand=-
  SCN-specific regions: Sequence locations=1-77,99-422,446-447
atgcaattttccgttacattggcaatatttggcattttctcttcactgtcattcttggcaaactgtcgccatttgccaaatcaaaatttaaatttgccgctgccgtggaagtcacttttgttgccccaatttatgatccgaaaaattgagcgtgaacaaatggcaacgattcttgacgcggaacagcagataaaacatgcgaacattattgacaaagggcaaagtgccgaaattgaaaaagtgccgtccagcgccaaagacattttgaggtaaagaatttgaatttttttaaatgcattaaatcgtgcaaaaaaacacatcgccaaactccggttttgtattcatacaagggcgtagccagacgtagccagacccttggctttggggggggggggggctgaagtcaaaaaattgatttttaggggtgtatttttcatttttagttga

SEQ ID NO: 84790 - DNA, 1266 bp, Heterodera glycines
  Genomic contig location: Contig_ID=SeqID_20014; Location=714..1979; Strand=+
  SCN-specific regions: Sequence locations=1-1266
atggcgttaaatccgacaattgaccagctcgtgaaaatgctggcggatcaacagaaaatggtgcaggaccaatcacagcaaattgctcaactgattgcgatcggacaaaacgcaccaaatgcggcggcacagcccaatcaaggagcaaattcagtaccaatattgccggacatttcaccattcgagccaacggacgacaagagccgaatttcggaatggattgagcgattcaaattcgcgttggattgcacagcaccaacggcggacgacgaagtcaaggttaaatgcctgatgaataagctgagcgaatcggcattcagtgaatacagcagatcagttctgccgtcgtcggtcacagatttcagttttaaagtgacgaccgaaaagcttgagaagctatttgccaaggctcagtccatattcatcgaccgctacgagtgtttaaaagcggtgagaggagaaggcgaacaattcaggcagttcataaatcggcacagaaaattgctgaccgattttaaattcgatgagctgacaaaagagcaatttaattgcctcatgttattgatggcactcaaagcgcccaacgaagctgcattgcgacagcgaattctgacaaaattgtcagcagatggcgccaacatcagctatgatggagtggtggaagacttaatcagcttccaatccacaatttcagaagcaaaggcaatcgaagcgacaagttcttcgaggccagtgaattcgattcgacaaaattcaaagccgaacaattcaacgaacaaatacgtcaaggaaagtccaaagccaaataatttgccgaacaaattcaaagaaaggaccaacactgaggcaactacaatatgttggcgatgtggcttcggcgtgcatcgacctgacgaatgccgttacaaaacgagcaaatgccgcaagtgtgagtttgtcggccatttggacaaacaatgcgagcgtgtccaagagtggcgcaaacgccaaaatgccaaaaagaaaggcaacaaccgcgttggccaccttcgtattggaatgaccacgcatgccgtaaattccatttcgctgctaaaaacagcggttctgttcaacatgaagccagtcgaattccatctcgacacggggtcggacattgttgtcattgatcaattgacgcacgaatatgttggacgacaccgatcgaaaaatgcaacgaaattggcaaggctttcgacggcacaaaaatttcctttattggaaaaggattcggtacattcaaatttg

SEQ ID NO: 84791 - DNA, 60 bp, Heterodera glycines
  Genomic contig location: Contig_ID=SeqID_20015; Location=353..412; Strand=-
  SCN-specific regions: Sequence locations=1-1
atgctgttgttgctgctgttgaatttgttgctgctgttgaatttgttgctgctgctgttg

SEQ ID NO: 84792 - DNA, 1403 bp, Heterodera glycines
  Genomic contig location: Contig_ID=SeqID_20016; Location=448..1850; Strand=+
  SCN-specific regions: Sequence locations=1-397,435-439,461-607,630 -631,653-662,704-880,902-947,1037-1120,1142-1301,1339-1403
atgctgttggaaatgtcaatgcgcatgggatcgaaggtagaaaaaattcagtgggaaaatttcggcccacttttacgcgaaaattttttgcaattttttgaaaatttcaaattttcggaaccattttggaatcaaaatttaaaaaaaggcggtaataaaaataattgcgttaagcatgtcagcacggaggtgaacgaagtggcgacacgacgagcaaatcggcaacagcagcgaattctttttcaggtaaaaacaaaattgaacggcacttttaattatttattttttgacacgtaatttgttttgaaaaaatcttttttcaaattttttcacctttttaattactcaaaacagcgaaagtttgccatttttgaacaaattttcacatccaaaattttatttttacctcaaaatctttgacttttcctatgaatattttgaaaattatcaaaaggaatttctgggtcatttggatgctttaaattttaatgttttaaaatgtgtttaaatttttgaaacgaaaacttatttagaaacgatactgtatttttaaaaaagatacaatcaattttaaattatgccaatttttttcattttttcgaaataaatttatttgtttagatttctgttgtggccatcatcttctacctgtacatgtctggtaaaatattaaaaaaacattttttctaatttttaaatttttccctcacccattttatttagcctattatttgctttaccatgtgttcaatgtgtccaataaatggctggtgttgttcaactcgttcttttattccaccacacacatgatcaatcccgtaaaatggagaataatttcacatttaaatgaaaaaaacgatttatttttggcatttttatgccaattttaaacaaattttggcacatttttttttgattttcttactaaattttgggtgatttgaaaatttttgacattttcatcaggtcaaaaaaataatatgagaattttttaaatcaaatttttcaaaatttaatttattttttcaaattttttcgttctacaggtgatctacttttcgttgaacaaggacatgcgagcgcagctgatccgtgccattgccgactgtttgaattgggcttgttgtgtcggtgacgcggccggcctcagtcggttcggcggcattcactcgtccatctacggccgggccagccggcggacacagcccggcgctgagtcgtcttccggcggcagtgtgctgctgcacaagtcctcgtacggcgccggttgcatgacagaggcgaacaggtggagaatgaatgcatggcaggcacggcatggcaggcacggcatggcatacaaaattggtgcaggatggcttagtgccagccggcggttcggttctggcactttttgtgattaa

SEQ ID NO: 84793 - DNA, 420 bp, Heterodera glycines
  Genomic contig location: Contig_ID=SeqID_20018; Location=220..639; Strand=+
  SCN-specific regions: Sequence locations=1-98,120-395,417-420
atgcggatttcaactggtgcatcggttccatcgacaccaaacccaacaacgagtgaccaaaacagtccgggtccgaccgaaaagagggtcggcggagttggcactgttttgggaatgtcgaaacgaatttcgctaccggaaaatttggaattccaaccgcaaatgctgctcaatttgaagcaatcaattcatgtggaaaaacagttgacgaggtggagaaaacgaacctgaaatggagaaacaactgatcaaaataattttagcaactctgacacgagtgattccgcctcagaaatgagtgtatttgagaagccagttttgaaggcatcacgactgcaacattatcaacaccagcaacaacagaagaggaaagcggcacgtttgcaattgctgcgccaacaggcaaaatcattaaattaa

SEQ ID NO: 84794 - DNA, 727 bp, Heterodera glycines
  Genomic contig location: Contig_ID=SeqID_20019; Location=210..936; Strand=-
  SCN-specific regions: Sequence locations=1-6,36-123,164-242,264 -279,310-727
atggagtttaaaatagttttattatttttattaatgctcaaaaatttaaatacaatttatgctggtggaataaaagaagaaaaaaactttgacgaaatatttggccaaagatgggacgaaaaagaggaggaaaatggagaaattgaaactgatcaaaatggaataaatggacaaacaaatgatcaaaatggaccaacaaatattgaaaattttgtgcaaagattatttgtagaagaatctaatcaaatttttgatgaaaatttggaaatgaaagatgagaaaagtgaagaaatgtccacaaattgtgatcaattggaacaaatgacagaaaatagtggacaaatttatgatcaaattccaattttaaatgataaacaaaagagagaaattgttgaaaaattccataaaataaaagagaaaattaagcaaatgggaaagaaattcacaagaaaagaatggcataaaattgaaagaaaaattgcaaaaaaattaggtgcaaatcaaatgaaaatttacaaatggaagagagaatttggacttataattaaagacagttactcggatgatgaaaaacttaaaatattgaatcaatttgatcaaatatatggcaaattaaaaatgaaattaaatggaaaattgcataaaaaagtacaaaatgccaaaaaataatagcaacacatttgggcataaatatcagaagcatttatcaatggaagaaagaattaaa

SEQ ID NO: 84795 - DNA, 1161 bp, Heterodera glycines
  Genomic contig location: Contig_ID=SeqID_20022; Location=506..1666; Strand=-
  SCN-specific regions: Sequence locations=1-103,125-131,167-915,937 -945,980-1161
atggaactgaggtgggagaatgccaacgactcgctggtggacgcctaccaaaaattgttcgtttttattcccatttttacaccaaaaaaaaaaaaacgaaggacaattttatctgtaaaaattgtcacggcaaaaaaaaaattaattgtttttttttcttaatttacctcaatttttcgtgtcctccttttgtttttgaaatacaaacaatcgcaaataaaaacacttatttttcattcatttcgctatttacctaattggcttttaatgcctttgttttgtcagatgcaatttgctgtcacaaatctcccatttggcctcgtcctacaaaaatatggccgactctttgaagtgaaatttattttgcttttaatgaattttgctttattttatttttacaatttttaaagcaatggcgaaacattgtactccctttcatcggccgcttcagtccgactcaaactcaaagagctccaagagcaaatcattcgactgaggttcagagaattgggaaaaacacaaccaatttattattttgtataatcaaaaagaaaaaatccaaaaagatcaccaaaaaatatataaaaataagaattccgcccttaaaaatgtgtagttttgtgcgattttttaagtaattccatcgaagtttggtcttcctctccaagtcaacagaacaacaacggttcacccgctgaaactgttggagaagcaccatcacttcggcaaatgcaacttcaaaaaaacatcaaaatgcttgccctacacacactccatgtaaggggacagtcagcgatttttttgtaaaattttttttgtaatcgtcataaaattttgggaaaaaaattgggcgccgggaacgtagtgtatcaaagttaagtgaccaataaatgccaaattattgggattgtgatgccatttgtggctttttaatgcatttttgttagaaatttttaaattttaattccaaattttttccttcaggatgtggtcagtgttggccccgatttgcccagtgttgagcaatatgagcagaaaaagttggacaaccagcagagggcgatggtggcgatgagacggcacagcggcgctgtcatggcaccaacaaacaatcaacagcaacaacatggcacacctacagcagaccatgacgatttgttg

SEQ ID NO: 84796 - DNA, 1604 bp, Heterodera glycines
  Genomic contig location: Contig_ID=SeqID_3467; Location=1171..2774; Strand=-
  SCN-specific regions: Sequence locations=1-975,997-1075,1120 -1120,1192-1499,1522-1525,1557-1604
atggcgttggtggcctttgcttccgaaatgcgcatttccctcactttatgggccacttttgcgtttatgatcgccaatgtcctcgagcatttgatcagagcacgagcagaccaattccgattcggatcagatgcatcgacggggcgtgctgtggtgagacagtgagagaaccgacgggaagagaagcgagaggaaagggacgatcggacggaagagaagcgatcggtgggagaagcagcgcactgatcccgaatagactcagcgaaggtcagcccaattaagccaagttgtgggcaacgattaactggcactgatccgtcgtcccttagcattttgctacgaaggcactcgcactgatcgccagtgttttttgggtgtcgactgtcgccacgacgaaagttgcgttaaccaattgtgctgtccgcggggcttcgacgaaatgaattgtccgtcccattttttttctttcctcccctcctccttttgtcatgacttcccacaagaatatcatcagattcgtgcggaggattggccagcaacggaagctgcgggccgaatggccaatgcgtcgtggccggcagacgcctcgaatgcgtttcctcgggggtgtgttgcgaatgcccggcggggcaacctcagccgggggtcagcgaatgttcgtccgatcaggtgggcccgggggatggaattggccaaatggcgcaagaattgttaagcaatgccgtgaggggttctcttgccatggcaccggattttgttgtccccaatgccccgggggacaattgccctttggcagttgcaacaaaggccgttgcgccaaagacttcgtttggtacgcccttttcagcccatctgattttttttttgttttaaattttccattcagtcggccagggaatatttgttgtgaggaccaattcggagaattggcaattgggacaaaagaaaattggagggaacgccaaagaacggacggagggagagattattaaagacatttaattcaaatgatattaaaattataaaatttcaattgacagagaatggttgtaaatttccaattaataaacggcgcaataattaattctttaattgaataaattctttaattaattaaatgtctctgtttctttcgctcctttctctctctttttcactcactcttcctccccattttcattccctctttcttccgtcatccgtaccaacaatagatggaactttccacccattcctcgcgctttttgcgccgttctgtcccaattggcccttcgtcaattcgatttgccgttcccatcgccgcattatttggcactagcggaagtaaaaaagcggacgaaaattggagaaaagcggccaatacaaagggaattgtcaacagaaaaaaaagtttcattttcagaatgatcgaataagtcaaagttcacttcaaaaagttgacaataaaaagttaggacaatttgatggaaaaaaaggccaacgcgacggacagatgaacaaacagagggaaaaagacagaaaatgaagagagagagagagagagagagagagagagataggcgaaaaccaaagttggcacataatgggaaaagccgaaaattaaa

SEQ ID NO: 84797 - DNA, 758 bp, Heterodera glycines
  Genomic contig location: Contig_ID=SeqID_3467; Location=84..841; Strand=+
  SCN-specific regions: Sequence locations=51-134,157-222,263-417,439 -696,729-758
  Gene Ontology: Mol. function=GTP binding; Cellular component =microtubule; Biological process=microtubule-based process
accaacttggtgccctacccgcgcattcacttccctttggccacttatgcgccgatcattgccactgatcgagctttccacgaaaaatcgagcgtggccgagatcaccaatcagtgctttgagccgggcaatcaaatggtgaagtgcgacccgcgcaacggaaaattcatggcctgttgtttgctgttccgtggcgatgtggtgccgaaagtgtgccaattttgaaaaataaaaattcttttggtcaatttttgaggatgtaaattcggcaattgcagcgatcaaagcgaagcgaaccatcgaattcgtcgattggtgccctacaggtgtctctttcgccttaatcatgttggcacaaaaatctttcaggcttcaaagtcggcattaattaccaaccaccgaccgttgtccccggcggggatttggccaaaatgcaaagagtaattggcgaaatcggactttttatgtggggtcactcggccatttaggccgtttgtatgttggccaatacgacggccattgccgaggcgtgggcacggttggaccacaaattcgatttaatgtatgcaaagagagcatttgtgcattggttagtattgttttggatatttaaattatgcggctaattgttaaggtatgtcggcgagggaatggaggagggcgaatttacggaggcacgggaagaccttgcggcattggagaaagattatgaggaggtcggggtggacacttacgtggaagacgaagaggagtactga

SEQ ID NO: 84798 - DNA, 562 bp, Heterodera glycines
  Genomic contig location: Contig_ID=SeqID_3469; Location=1831..2392; Strand=-
  SCN-specific regions: Sequence locations=1-47,69-193,222-562
atggttccgccactaataataaggtaaattttggttaaatttttgatgaaaattttatttaagaaaatacgggatttatttgaaccaaattgtgacggtgtatttaatgtgtcggaaatcgctttcattagtccgatcgaacttttccaaaggtcaccataaatatcgaaatttattcaggtgagtttggcagataaattataattgtttaaaaatatttagagactaatttctccgtcgaatgtttttttgaagcaaatttggaatttcggcattcattgaattcgttgaaaatctttcaattgggcacattttgtaaaaaaaaattatttgattaaaaagtctaatttatttttagcgattggcaggaaaattttaagggcgacgaagcgaattcggatggaattcgaatgttggcatttttttgcgcccggtttgtatcggctttccctgccggtgagtaacccaaaagaaatgccgccggctgattatttttaataattaacattcatttcatttagtccgccctttattacttcgtcttccgaatggattcaataaa

SEQ ID NO: 84799 - DNA, 219 bp, Heterodera glycines
  Genomic contig location: Contig_ID=SeqID_3469; Location=2492..2710; Strand=+
  SCN-specific regions: Sequence locations=1-219
atgatttggaatggacaacaaatgaggacaaatgaacaacaattggggaaaaatgaacaacaattggagacaaatggacaacaactggggacaaatggacaacaattgaggaaaaatggacaacaattgaggacaaatggacaacaattgggggacaaatggactcgcgtggatccccccccccccctcccccgcgggcacatttttggcaatgagtga

SEQ ID NO: 84800 - DNA, 1518 bp, Heterodera glycines
  Genomic contig location: Contig_ID=SeqID_20025; Location=77..1594; Strand=-
  SCN-specific regions: Sequence locations=1-73,114-129,152-154,177 -303,325-529,554-584,606-899,938-1017,1051-1249,1271-1413,1448-1518
ctgtgttaacaattttgtgctcggcgtcaccaatccgtttttcttgaaggcttttgcgcattggccccacattcttaaaattggccaacattgcaacaacaaaaacaacccgcagcagcgtcacaatgacagcgcctcaagggcgggaccaccggaaacaacaccaaaagaaacaattgcagcaaaaggcaacggaagagaggcggcggcgtcgttcttcaacggacgctgggaagttggacgcgtactcagaaacgcaaaaacaataaagtgttcgaaaattgaccatcacaagtcagcctccaaacaaaaatgccttttttagacgactctctggccatgcacagcttgacaaccaggccatgggcggttttttgtccacgcatcgtcagttcctctcggatgacaagttgctggcgcaaaagttgctcaaacgggtgccaaaaaaaatcagcattttaattaaagtgtgccaagttttagtccggcgactcggctttaaaaaggcacacattggaacggcatttcatggagctcactcagagcttcatcaatccgcttgaacggtgtggtgtaaaaacactttttgacttttttctgcacaatttcaaatatattacccaattaggtacatcgcttcattgctgcctctgcgacgtcatttatgcccctttcaacctgtgccatcaatgcgcccattttcattggatcaattcctgactaaattacaacattttgggcatccgggtgtcagaggcgattggcagggtgaattttctgaaaatttttttaaccatttcattaaaaattcccaaaaatgtttaccaggacggaaatttagaaaattgaaatttttggatttttctaactataaagttttttagtagaaaagttcacataaaatcttaattttttaaaaacttttgattaaaatggataatctgttaaataaataagaccaaaatttcaaaataaattgcgtttacaattaactcacagactcagaaaatgaattccaaaaaaaaaaaaattttaattattaattaattacattaaggcctctaccggcaatttgtgactcggtcgcccaactttatcggctggttgcaacaacgacgaaaacatattgaaaagcaactgaaggaggagtacctggaattattgtgcagtgcaaatttgtccactgaggttttatgtcatagaaaccaggtcaggaagacaccagagacatacactaaatttttttttgcaccctttttcatttttattatttctgtaattttaggttgaaattgtggacctggtattaaaattccgggatcatttggccgaattggagatgaagcatcggggcagtgaacagcgcgaaaactggagcttctcctcaactccgatgaaagtgattaaaattggaaaaataaattaataaattttcaaaaataaaattgttttgaagcagcaacgtgttctgatcaggcaacgagcgcagcttcaacaacagctgaactgcttgttggg

SEQ ID NO: 84801 - DNA, 875 bp, Heterodera glycines
  Genomic contig location: Contig_ID=SeqID_20026; Location=50..924; Strand=-
  SCN-specific regions: Sequence locations=1-424,447-497,534-576,618 -802,825-875
  Gene Ontology: Mol. function=transcription factor activity; Biological process=regulation of transcription, DNA-dependent
atgggccatcagcgcgagcgaagggcggcgaaggacaacggcgacgcattgcgactgctctcattggacggaggcggcatcagaggattggtgctcattcaggtggtgcacagacgttcggaactgatcgggaaggacacggacgaaaccaacggctggagacgatttaaggacgcggggggggggggggggaagagtccctcaaggacgaaaccagcgggaatcagtttttcgaggccctcacaaatcaggatgtttcaggatttagcatcgtttttgggggttttgaatgggggcgcgcgtttgggaattcacctccatcagtccgttttcgattttcttgccgggtcagtccctttccctgcaaatctccattcggaccaatcaatgccttcttgttgatcacattggcatttatggtttgtaaatattattaattttatatacttttttcagattttgcttgaaattgagcgtttggtggacggcggcgacacacaaaagaaagggcagagaaaaaaggacaattttgttcagcgccatttcgattgggtcgccgggacaagcacaggggcggtaagttaaaaagaaatttaatttaaaatcatttgtccattatcgaattctcatccgattataatagtcttggataatagattaagctgaatttctcagattttggcacttgccctcgcggatggcacttctttgatcgactgtcttcggctttatttgcgtctcaaagacgacgtcttcggcccggaggcgaaagcaagccgttttggcggatacaagccggaatgccttgagaagtttttgcaagatcactttggcaagcagcgaaaaatgtccgacattcgatgtggaaaaatgaa

SEQ ID NO: 84802 - DNA, 385 bp, Heterodera glycines
  Genomic contig location: Contig_ID=SeqID_20028; Location=29..413; Strand=-
  SCN-specific regions: Sequence locations=1-77,117-228,288-385
atgttccattcgctgatggtcgagctgggatacagcttgtttgtaaaccaaaatttgactgcggatgtgagtaattcaaataatgaatttttatttatttaaattaaaaaaattaagggaatgatcaaagtggttcaacgatttgccgagtacagtaaacaccatgccgcagcagacaggtgacaaaaattctatgctataaataaatgggaagctcattaaattaggaataaaaagctaacaaattgtcaaataaattagttaaattttatcatatttttaatttaccggtactgaaattaaatgttgaataattttcagttgcgtagtgctgattgcgtcgcatgatctgtatgaccatgtctatggtaaggacatggcgctg

SEQ ID NO: 84803 - DNA, 894 bp, Heterodera glycines
  Genomic contig location: Contig_ID=SeqID_20028; Location=1337..2230; Strand=-
  SCN-specific regions: Sequence locations=1-120,160-588,610-640,662 -722,744-775,808-848,884-894
atgattctcacctcttcatatcgtttccacaagatatttaggtcaaaattaaagcttgaataaggaaacaaaaaaggctttgctttcccagttctttcatatatgaaatcactagcattcaaaattttaagaaaattttattattttaattttttaatacatttttctagctcaaacaactattaataaaagtttaaaatgagccagtgttccaaccactcttcaaaagcagactgaaaaaggaacactgaagctgcatgtgaacgagttcatgtatgttttggttttagtaaattttttataatttttgcagtaaaaaaaattattttatgaagaatcagattcttcttcttctcccgctgatgaagcgtcgtcaagtgatgaggatgaaagcactgactccgagatgcaaaaggacgagtgtgtcatcctctccggcctcgtcagaaagctgaaagtgcatgtttggagcgctcttcgaattgagaggcgcccaaatcttggcagcaatttgttaggtttgaacatttaaaattttggatttgggatatcattggagaaaatttgcttccgcggttaattgccaatatgtttcagtaacatattgttaatttgtagggctataaatcgtatggtttacgtttttatgagcatatgctacttaattcgccaatagatcacaaaatgccatgaaggagtttatacaacagagggcaattaaaaattagcatttttaaagcaaaaccatttcttacgtgaacataaaatatggactaaaaagctgaaaaaggacaaatatggattaaaatatagactaaaaactaccagaatataagtttaaaacctccaaaaattctaaaatattaatatttattcaatatttgcttaaataaa

SEQ ID NO: 84804 - DNA, 1035 bp, Heterodera glycines
  Genomic contig location: Contig_ID=SeqID_20030; Location=896..1930; Strand=-
  SCN-specific regions: Sequence locations=1-80,102-193,216-724,747 -797,819-1035
  Gene Ontology: Mol. function=cysteine-type peptidase activity; Cellular component=intracellular; Biological process=proteolysis and peptidolysis
atggaatgctgcaacttgggccctgaggtgttggacgaaatctgtagcatgatggacttgcgcacttcggacgtcccttcgtgccttcggtcgagcgcacaatgggcgcagtttgcgtcggacggcgaatggtcgcgacagaaaggcaccgccggcggatgtcgcaactttcgtatggcatttgaatttggcatttcgtttcattttctctcttttcagccacttttgcgaataatcctcagtttgggacgaccatttcgttcagcatttcaccaaacaatggaacggaggatgacggaaaatgcacggtgatttgcgcagtgctgcagaaataccggagagaattgcgcgcggtcggattggacgaattggccattggattcgccatttatgcgacggacgaagggacggaggagggacagaagcaccagcagcagcaaaagcacacagcacaagttagccacgttcagcgacagaacgcagaagcaccggcgagtggaaggagcttgtcagtgggttggcccatcgtggcaatttggacattcattttgggaattaatttatcttagaggatttggacatttggtttattggtcattagatgatttggtgccattgggtgatttggactcatttggccaattaattaattgccttaggggatttgggccgggctatggacagccaaattcgtacggtagcgcatatgtgcaacagcaacaacatcatgttcagcaacagcttcaacccctcgtcccaaattattatcaaagtctcccgcaaatgcaatgccaaaaaggaaagtgagagacagataaagtgataataatgtgatcataacaaactgattttaattggttaagtttaagcattttgtacggccaaacgtatgaaacgcatttgcccaaacagcaaaattgccaatatcagacaaacccaaaacgaattggccaacagtttttggaaggggccaaatcagtggccaaaagtgcgtcattcatcaatttgagagaggtgatcagaaaaaaggagtga

SEQ ID NO: 84805 - DNA, 852 bp, Heterodera glycines
  Genomic contig location: Contig_ID=SeqID_20031; Location=669..1520; Strand=+
  SCN-specific regions: Sequence locations=1-234,256-638,660-852
atggcgggggacaatcagaaactgacggagcaaacgctgcagcaaagggacgaggacggaggcggaaaggagacgggcagaggcggattcggacaaacctaccaaaggtacgaccgatcagtgcccaacagagcggacagtacatcccaggctaacaaacatccgaaaccgattgaactccacgctccaatctgtgcccaatgtgagtccgcgaaaagtgccaccggtggagaaggaaaagctgattttgttgagcgaatgtcgactgttcgttggcatgtacgtttttttgttcttttccccggccttactcattattaaccgtttcgttaagctgtaaagagatggtccgttgtccttccgcctcggtttgttcagcttcatcctccgtctcttctgctgatgattcttccatttcgtcaaattcgcttcgaattactcaaaatgcggtggaaagtgtcgatcggctgacccaaagcgtggaaatactcatccgcaagagcagctccatattccaagcccaacagctgactaccaatgccgaccaggtcagaagaagagtgccctcggcggatggccaaacaatcgcaaattttagcttttaaaaacactgacggacactttgaaagaagttgaaaagtgccagaaaggtggccaatcgcgcggctttgatcagacgagggaagtgattagatgcagcacatctttggccgtcacgcttgtccaatttacgcagttaattcacggcctctgagtcggcatttcggttgaatggaattggccataagcaccggttctttggaattttactttgttccctcactgatttcacaatttccaattctatcgaaa

SEQ ID NO: 84806 - DNA, 1336 bp, Heterodera glycines
  Genomic contig location: Contig_ID=SeqID_3470; Location=1517..2852; Strand=-
  SCN-specific regions: Sequence locations=1-22,47-58,81-418,441 -1034,1084-1194,1230-1277,1299-1336
atgaaaagacaagaaagaaatcaatttatttttataaattattttacatgcctaaatcaaaaaataaacaaacaattaaatggtaaaagtcatttaattaatggacagtcaaatgtttgtcgtttggaacgccatatttcgatttgtgctcttcgaatagctcattcaatgcattgcaatagcgaagatggagttggtcgacctgagcaggggttgggctgccaatgcgtttcacttcaatcggggcaccttaatcaaaggatttgtgtaaacattgtctcttcattcaccgataactgtcgtgatcgaacgacggcgtggcaacagaccaaagcgatcggagattccgcaacatccgttgatgatcggaatgcaaaaaccacacttcctcttgatggtggactaaatgaagaagtgcaaagtcagaaacagaaagagaatgcgttgcctgaactgtcctcagaagggaccctcgggggtttggtaattggtcaaacaaatcattttcaccaaaactgtacgaaggcacaagaggggtgctaaatcagaaaatattacttataaaattgcacattttgtgcatatttttgcgccttttccacttgccccgttttcaacgcgaatcggcagaatccgcgtcgtcccattatgttcaggtggtgttttcccgggtgtgcgtccagcacttcctcagcaccgccgatgacaatgccaatgagacggcctcggccggggttattcagcaagaatttgagactgtgcgaagaactttcgaccccaccttaaattgggtaaactttggacaatttgattgtccttttgccgcgtttgtctccgtaaacatgcccaatccgatgccaatttcgcgacgaaatggaaaccaaaattggccattcaatgtcagaatgttcgatttcaatccgggaaaaagctgcccaaaccccgtcgcagaagtgcaaagatgaacgaacgaagcggtactgaacactccgtgaggatggcatctgaaacaaacaatgccagtacaaatacacaatttaaaataagatataaattaaaattatttaatgaatataaattaaacagtgccctaaaatgtaattgttgttcggtggaaggtcagcagttttgatcaatttgattggaaaataatcagcaaaatgcttccatacaaaggaatttttgtaccataactaaaattatttgaaactttaaaaaaaaattaaattcaaaaagcacccaatttcttgatcctcttcttggcgtgtcaaagtcgtaaagaaaccaaatgaaatacaaacagacaatccaccaaaatttagtgtagaaaaataaa

SEQ ID NO: 84807 - DNA, 128 bp, Heterodera glycines
  Genomic contig location: Contig_ID=SeqID_3471; Location=1258..1385; Strand=-
  SCN-specific regions: Sequence locations=1-128
accgaggcgacgattcgtcggaagaaaagcacagaggcagcaaataccaacagccgcaacaaaatgcacagtcagtggccgtggcaattgccgtggccggcggcgcgacgggaaacgccgcggggtaa

SEQ ID NO: 84808 - DNA, 290 bp, Heterodera glycines
  Genomic contig location: Contig_ID=SeqID_3472; Location=831..1120; Strand=-
  SCN-specific regions: Sequence locations=1-290
gcggtggagaaagcggtcgagcggggcggcgtttaccccgaggcaagaggagggagcaaatttgagtgtgggaagctaacaatgaagaagggcggtcaattatgaattaaatagtctttattggtcaacgtcccttcgttgtgcaggttttgtttcgagttgcccaccattggtacgacgacctgtacttggcccatttggagaacacccagcagcagcaggcgacaacgtcggcgcttccgcccccggcccatccccatccgacacaacgcattgccccgcagcagtgc

SEQ ID NO: 84809 - DNA, 670 bp, Heterodera glycines
  Genomic contig location: Contig_ID=SeqID_3473; Location=510..1179; Strand=-
  SCN-specific regions: Sequence locations=1-576,598-670
atgtccgtaaaagacggagagattggcgcatttgcatcgacacaaatggacgacccatcgaattgggacgggaaagagtggggaggacgacggaatttgggggaatcgccgaagaagaaagggcggagacctaaaaaggaaggagaaggaatgtatacaaaaggacaaaagggcgacaaaaagggacaaaaggatgacaaaaagggacaaaagggcgacagaaaaggacaaacgggccaaaatatacaaaaggacaaagggtgacaaaaaaagacaaaagggcgacagaataggcaaaagacgagatggaagcccctgctactgattgtgaactgctttggctatcccaagaagtgattgattgtccctcacccttttgctgctctcttcccccaaatttgtcctcctccactttttctcgtgccgatgactgaggttcaaagtaaacgcatctgtccaccgacagagctttggacgtgtctccgttgaccaattcggcaattggcactgtgctggtcgaactgctgcccggaggggacgacagcgaattgcccttttgtgggtgaaaggaatggcgcggagggagggacggcgcggaggagggcattgaagagctaaaggaatggcaaatgaaacgaatttgggaggaaaaaaagaggggacaaataaa

SEQ ID NO: 84810 - DNA, 1301 bp, Heterodera glycines
  Genomic contig location: Contig_ID=SeqID_3474; Location=1494..2794; Strand=+
  SCN-specific regions: Sequence locations=1-69,91-567,589-1301
atggatttggtcactttccgacgcgccctcaaagtgcggccaaagggaaaggcggcacatggaaaagcattgttttcttttttgaaggaatcggaacggatggaaaaggaaaggcaaatgttggcgggcgagcgcggagtgtgcgccgcgtgctgcgacttttgctgcggcggctccgccgtcctcctttggctcgtactcactttggtcgcgctcggattcctaagcttccttctcatcgccatttactttctttgaaattgaaataccaaatgcaatttaatcgccagcagaagaaatgcagtaaatacttcacttcaattttcatttccgattggacaatcaaacgcaaattgaactttttttccaataagaattataattactattttcgtttgttgaattatattcgaattttaatcaattttaaaatgacaaatccactcgttttcaaaatatctatattttgtttccgataaacatatgtaacatatatattagtataataaatagtctctgatcatgaagacccttcccccaatccatcatcaaaaccgaccattagttaaaatattccataaaacatttatagcgcaaaaacatgttaaaattttacaaaaaaaaacaaccacaaacataaatgaaaaaattttaaaatgttagacaaagcaaaaatcgtaacaaattttgatttaaaaatgttagtacaaagtaaaaaaattgttaaaaatatgatgagacgaagaatgggtttgtttaatagcctatttcacaaattgtttattccattctgtcgttgtcggcatgaatgtgtccttgtccctgtcctcctccgtcctccccgtccattctttcgtccatttcctccaaatttgcctccccaattgacaacgttacattatcaccccggcctgtcgcaaactcgaaaaattattccaaaatttcagccgttgcgccacctgtcgccggcgttgtccccccaaagctgaactccgccatggttccgtgcccctcttgccgctgaacagtccgctcggcctgtgccaaattggccggtgttgccactgcgctttccctccctccgctgccgtccctttcggctgttctccctctgtcgccgctcaaaaaggactgaactcgctgaatatgttgctgtatctgttggatgtgctgcgtcatcgacactgtccctcgcgctatctctacggatccctcggcactcatttcctccgcaatcgccgctgtgccttcctcgtcttcgtctccaatgctcaacggaacggtgccatcctcagacaact

SEQ ID NO: 84811 - DNA, 1399 bp, Heterodera glycines
  Genomic contig location: Contig_ID=SeqID_20037; Location=442..1840; Strand=-
  SCN-specific regions: Sequence locations=1-373,396-411,433-517,550 -564,742-791,921-1119,1153-1167,1190-1206,1253-1348,1372-1399
atgagaagaggtacaaaagtgattagaagaggtacaacagtaaatagaagaggtacaacagtgattaaaagaggtacaaaagtgattaaaagaggtacaaaagtgattaaaagaggtacaaaaatgattaaaagaggtacaacagtgattaaaagaggtacaaaagtgattaaaagaggtacaaaaatgattaaaagaggtacaacagtgattaaaagaggtacaacggtgattagaagtggtacaacagtgattagaagagtgattagaagaggttcaacagtgattagaagaggtacaacagtgattagaagaggtacaacagtaaatagaagaggtacaacagtgattagaagaggtacaaaaatgattaaaagaggtataacagtgattaaaagaggtacaaaaatgattaaaagaggtacaacaataactaaaagaggtaaacagtgattagaagaggtacactgtgatcagaagaggtacaacagtgatcagaagaggcaaaacaaatgtgttaataattttttaaaaattataaaataaattccttcttttatttaaaaataaataagaaattaattttatattaaaacatttaattaaacaaacaatattaaattaattaaaataaataaataattaattttaaaacaaaacatttatttataaaaaaaaatttaattcaaataaaaaatgtaatttattattaataaaataaaaaatattttaaatgaataacacaatgaaaacaggaaaaaatggtagttattaattaaaaacaacgttggaaatttattcatttaatttgaaattaaattaatttttttacaaattcaaaaaataaataatgaaattctttaattaaaaaaaataaataaatttaaataatttataaaaaatatttgaaattaataaaacatgtaaaagtaatcaaaaatgcacagaaaaataatgtacaccgatcggatccgaacttcgccccccccccctcaaaatgatgcctcagaatccccaatcacacagggattctgagggcttaacgatgtcaaaagtaaaaactgattatgtattcatgatcagcggcccaaattacccctaatgacatgtttttggaagatttttgtgaaaaaattttttcaatcaaaaatcctggttacacacccctttggtcccaaattccaaaatcacttctatttctatatctttttttaaaaatgtgataaaaatgtaaaataaaatttatattatagagaaaaaaattgcggatttttgtagtattttacttttcccgaatagattttcagaaggcagctacgaatttttttctgaaaaatcgaaaatttccagaaattctggaataacttttttcatatttatgatacaaaagccaaataaa

SEQ ID NO: 84812 - DNA, 87 bp, Heterodera glycines
  Genomic contig location: Contig_ID=SeqID_20038; Location=2271..2357; Strand=+
  SCN-specific regions: Sequence locations=1-87
atggctaatgctagagggccgagttcatcgacctcaacctcaactaatgcatcggttggcgttcttatggtcgggccaaatttcaag

SEQ ID NO: 84813 - DNA, 423 bp, Heterodera glycines
  Genomic contig location: Contig_ID=SeqID_20039; Location=636..1058; Strand=+
  SCN-specific regions: Sequence locations=1-423
atgagaagacaccacagtgccttgaatggcaatgtgtcgcaacagtgtttgaccgtgcataaaattcgtcatgctgctgcaacagatgcaaaatgtttttgcttatcaaagcaacgttagtagtatagggatcactttcttggccttttttttgccccccccccctccctcgcgcactcaacccatattcaaatgaaagccaaaaaaattgatgaaaacatgtaacaagtgatcagatatattattagtcggatgtgaatttgtcgattaaggcaacaaaaattagaaatgaatgtaatatcgattcatacgattttcaggcccccaaccacctcataaaagattaacatagatgatttaagaaaaatgcagaacgaattgattgaagacaaatgcagaatgatctgataaaaaataattgaa

SEQ ID NO: 84814 - DNA, 67 bp, Heterodera glycines
  Genomic contig location: Contig_ID=SeqID_20040; Location=937..1003; Strand=+
  SCN-specific regions: Sequence locations=1-67
aagtcatgcgcacccgtccgatctggcagttaagcaacgattgctgactaccaaaagggtccgtgcc

SEQ ID NO: 84815 - DNA, 878 bp, Heterodera glycines
  Genomic contig location: Contig_ID=SeqID_20041; Location=158..1035; Strand=-
  SCN-specific regions: Sequence locations=1-89,269-878
  Gene Ontology: Mol. function=structural constituent of muscle; Cellular component=sarcomere; Biological process=signal transduction
atgtctgccgaaggaaacgacgcaccgccagccgcagagcaaccgccaccagccgaagcagcaccagctgaagcggtccctgtccaggaggcggcggcaccgccagtagaagcggcggccgaaactgcaccagcggaagcagcgcaaccggtagaggaggcggcaccgcctgctgaggcgcccgttgaagcggcaccagcggaagcagcgccaccgatagaggaggcggcaccgcctgctgaggcgcccgttgaagcggcaccagcggaagcagcgcaaccggtagaggaggcggcaccgcctgctgaggcgcccgttgaaccggcaccaccagtggaagagccaaaggcagcagagcctgaggtgaattttgtgggaaaagttggaataacgcgcaattttaggcacccgtttcggaagctgttccagcggcagaagcgccagtggaagaagctgttgctgcccccattgaagtcgcgcccgcagaggcagagcccgtctctgccccgccagctgaagcagtaccagccgaagaagcgccggctgctgaggtcgcccagctgagtttggaggaacaagcgccagctgcggaagcaccggtcgcggaagaggcgcccgccgctgtccctgtcgaagaagcagtgccgcccccagccgaggttccagcggctgaatgcgctccaccagcatccgaagcaacgccagcggaagcgcccgctgcccccgaggaaacgccggcggacggcgtttcccccgcgccggaagcagccggtaagtataaaacaaaagaaaaaaccaaaaagcataaacaatggcagagcctgcagcagaacaaccgcccgcagctgaagaggcgcccccggcggaaggcgcgccgg

SEQ ID NO: 84816 - DNA, 1467 bp, Heterodera glycines
  Genomic contig location: Contig_ID=SeqID_20041; Location=93..1559; Strand=+
  SCN-specific regions: Sequence locations=1-675,855-1399,1424-1467
  Gene Ontology: Mol. function=structural constituent of cytoskeleton; Cellular component=insoluble fraction; Biological process=cell wall organization and biogenesis
acgcctccgcttaaaaaggggtacttgttttgttatgccaaaaagggactgattgtgggactcacccggcgcgccttccgccgggggcgcctcttcagctgcgggcggttgttctgctgcaggctctgccattgtttatgctttttggttttttcttttgttttatacttaccggctgcttccggcgcgggggaaacgccgtccgccggcgtttcctcgggggcagcgggcgcttccgctggcgttgcttcggatgctggtggagcgcattcagccgctggaacctcggctgggggcggcactgcttcttcgacagggacagcggcgggcgcctcttccgcgaccggtgcttccgcagctggcgcttgttcctccaaactcagctgggcgacctcagcagccggcgcttcttcggctggtactgcttcagctggcggggcagagacgggctctgcctctgcgggcgcgacttcaatgggggcagcaacagcttcttccactggcgcttctgccgctggaacagcttccgaaacgggtgcctaaaattgcgcgttattccaacttttcccacaaaattcacctcaggctctgctgcctttggctcttccactggtggtgccggttcaacgggcgcctcagcaggcggtgccgcctcctctaccggttgcgctgcttccgctggtgccgcttcaacgggcgcctcagcaggcggtgccgcctcctctatcggtggcgctgcttccgctggtgccgcttcaacgggcgcctcagcaggcggtgccgcctcctctaccggttgcgctgcttccgctggtgcagtttcggccgccgcttctactggcggtgccgccgcctcctggacagggaccgcttcagctggtgctgcttcggctggtggcggttgctctgcggctggcggtgcgtcgtttccttcggcagacattgcggcaccttctttttgttgctggggcggaattgtgtcttctgcgacgggggaagactgctgctgttccggctgttgtttggagaaggggcagagtttagtccagaaaggaattttcgaggataaggagactaaaagtggaaaaaaagtgggaaagtgagttgatcatttgtccattttgaataaatggcacgacaaatgcaattgtcttgggtaaggtgttttgtcgcgggttacgcgttgccaatgggtcactctgtcccccgagggttcggatgatttgtcctttccttttgccattgcccaaagcgttttcttaaagagcgagcagagaatgagtctcatcagccttctatgcactgaacatcatcagaatggatgggccaaccgtttgaaatcggacattttattttgttcatgcttgtcagcctttccagcccgcccactcggtccattctcaaatgaaatgaaatgaacatttgtccgttcgttttccgtcatttcgtaccgggggaggggcaatg

SEQ ID NO: 84817 - DNA, 1950 bp, Heterodera glycines
  Genomic contig location: Contig_ID=SeqID_20043; Location=199..2148; Strand=+
  SCN-specific regions: Sequence locations=1-5,28-175,207-211,256 -553,590-1950
  Gene Ontology: Cellular component=cytoplasm
atgcaaattttgtgggagagtggcgagtggccaggggccagcattgagcaggccatcaccactttgagttggactccggcggccaaggagggccggggactgctcggcgtcggatgcgacacgggcgcagttggcgtaacgtacaccgatttgggccctgaccacaactgctgtaaaaggtgaaaacattttaaaacagtgtgaaaatgttggatttttcccccaattttcttcctttgtaaatatttgtcattttctccttcctcagacacaatttcaacttacgcgggcatcaggcggcgattgctttggtggcgtggaacaaagcacagaccaaattgctttcctacgacatcaatggcgtcatttacttttgggtgccaaacgaagagcgatggacagtggagctgatcaatgatcggggattcaaagtccgtcaatttttatcccttttgacgaaaattgaaatgccatgtttaaggtccgtgacttcgattggagtccgagtggggcgtcagcattaatttgttatgaagacaattttgtgctaatcggtttgaatttggcagtttttgtatttttggttcctttttcagtttcgtcctccggccaacgcatttggtccaacactttccttttctccattctctgcggcgcgtgggcccccaattcgcaagaattggtcatcggcctcagcagcggcgttgtccatgtgctgaacgaccagggcactttgatcactgaacgcactctcttccaagtgggcgtccaacgggcggccttttccccgctgcgaagtgccgaggcgcacggagatggcaaatggactttggcgtgttgttcggtcggtctctttttcatttacgaataattgtaataaccaatgataacatttgatttctgctggtaaaattggggtttcaatgccaaaaattaatcaataattgcttggttcggcttctaaaattttatatgaacaaatttcttatttcatacagaaaaataataagtcgatttctgacacattaaatagcattcacaattctatcaccgattcacataatattttggacttttccgtttgggggccgcacattcaaatttaaaaaaataacaacgaatgctttgaacattcgtacgtttcccatattatattaggaaaagtaccaatattttgtttgacatgctaaattctcccaaggaaaggaatttttttgtttttaatttccattttttctcctcaggccaccgatcagattctcttcctgaacaccttctacgaggttgagctgtgctcttggcaagcgccggacccggtgatttcgatgcgttggagcagtgacggcacaatgctcgcggtcgtgtgcagtccgaatcgcattgtcattttggactacaacggccgtggcattcactctttctcggcacccatccccggcggcactctctccgcattcacttgggcgcacagcgatcaggccattgtcgtgacggcaaagggcaaaatcgccacgggccgtttggtgcgccgagtgccgtcgctgtcccaattggtgtcctattcgctgtgggaacagttgggccgctcctccaaaggggtggaccatcttccgattccgaagagagagcgcaaacagatcgcccagtttgaccatcacatcatccgagtgccaattcacacctttgacttcattcaaaaaacgctgtttagtgccgtgtccccgttgctgaacgtctctacgacgtggtgtgtcagccgagcatttggcgttggtattgcaccattgtgccggtgacccgtaaaaatctctacatgctttgcgtcgaggtttattcctcagtttgccctcctccatccttttgcgctctcttcagcacatgggcggtttcgtgccgattctcctcggtcgacagaccaaccgaattattccccaatttgttatttcgctt

SEQ ID NO: 84818 - DNA, 1264 bp, Heterodera glycines
  Genomic contig location: Contig_ID=SeqID_20043; Location=791..2054; Strand=-
  SCN-specific regions: Sequence locations=1-1264
atggaggagggcaaactgaggaataaacctcgacgcaaagcatgtagagatttttacgggtcaccggcacaatggtgcaataccaacgccaaatgctcggctgacacaccacgtcgtagagacgttcagcaacggggacacggcactaaacagcgttttttgaatgaagtcaaaggtgtgaattggcactcggatgatgtgatggtcaaactgggcgatctgtttgcgctctctcttcggaatcggaagatggtccacccctttggaggagcggcccaactgttcccacagcgaataggacaccaattgggacagcgacggcactcggcgcaccaaacggcccgtggcgattttgccctttgccgtcacgacaatggcctgatcgctgtgcgcccaagtgaatgcggagagagtgccgccggggatgggtgccgagaaagagtgaatgccacggccgttgtagtccaaaatgacaatgcgattcggactgcacacgaccgcgagcattgtgccgtcactgctccaacgcatcgaaatcaccgggtccggcgcttgccaagagcacagctcaacctcgtagaaggtgttcaggaagagaatctgatcggtggcctgaggagaaaaaatggaaattaaaaacaaaaaaattcctttccttgggagaatttagcatgtcaaacaaaatattggtacttttcctaatataatatgggaaacgtacgaatgttcaaagcattcgttgttatttttttaaatttgaatgtgcggcccccaaacggaaaagtccaaaatattatgtgaatcggtgatagaattgtgaatgctatttaatgtgtcagaaatcgacttattatttttctgtatgaaataagaaatttgttcatataaaattttagaagccgaaccaagcaattattgattaatttttggcattgaaaccccaattttaccagcagaaatcaaatgttatcattggttattacaattattcgtaaatgaaaaagagaccgaccgaacaacacgccaaagtccatttgccatctccgtgcgcctcggcacttcgcagcggggaaaaggccgcccgttggacgcccacttggaagagagtgcgttcagtgatcaaagtgccctggtcgttcagcacatggacaacgccgctgctgaggccgatgaccaattcttgcgaattgggggcccacgcgccgcagagaatggagaaaaggaaagtgttggaccaaatgcgttggccggaggacgaaactga

SEQ ID NO: 84819 - DNA, 1787 bp, Heterodera glycines
  misc_feature (1086)..(1086): n is a, c, g, or t
  Genomic contig location: Contig_ID=SeqID_20044; Location=778..2564; Strand=+
  SCN-specific regions: Sequence locations=1-185,230-495,521-745,776 -808,836-921,943-1203,1239-1787
  Gene Ontology: Mol. function=ATP/ADP antiporter activity; Cellular component=mitochondrial inner membrane; Biological process=transport
tcgccatcaacaccaccaacaaactccgtgccacaaatacttctccaacagttcggcaaggattttgttgcgggcgctgtggccgcttgtgttgccaaaactgtcattgctccggtggagcgcgtcaaactgattttacaagtgaatatgcaaaaactgtgctcaaagagagaatccaatgctaatagtggataaaattaccataaattaaatatttaaaagagattttcaggccaattttcaatgatccctttttttaaacggtaaccgcaggcaaaaccatgttaacgcttaaaaaaaggcaaatttttgtatggacaaaattcgaaaaattccattgaaattggtggccgacgtgccatgccgacaggcgccatcaaaaaaaactatttttttgaacgtttcctcccgcatttagctccaaactgcccagcggaccatcgcggccgcgtcccgctactccggcatggtcgactgtttcgtgcggttgcctcgagagcagggcttcctctctttttggcgtggcaatctgtccaacatcgcccgggcggcgagtcaggcaggtgcgaagagggccaactgtgtcccggggcaagtttaagaagccaccaaatttcatcatttggcatcatgcgaaagtctccttaacaagccttatatctctcaagaaatcacaaggatttgtcgccatacaaaaaagatatgcataaaatgagcaaaatttcttgaatttttacggaatttcatgttacaattttttaaaaagttttttattcgcttaaaatagccttcggacctccattttaccttattttttgaaaatttaaccacaaaatctaaaaataggtcccttttttgacgaaaggcggctacatattcctgttttttgctctccggcgccggcaattttaaaattatgcgggaaaaattttttggttacggacctgatgtcaagatgataaaaaaaaagatcaactgtcttgagaaaaaaaagtcatggcttcttcaaattgcctgggcttggttggcggtacagagttgccatcgagcagaagacaaaccatttctgaacaataccaactcacngttttgacaatttataaagtgccaataattttgggctaaaaccaaattttaatttttccctttttttgcataaaatttgggctcctggaaaatgtctcctgtttcgtaacaagtcctattaatagaaatattaatttttaaggactttttccgagtccgttctcttcgaaaaacttccatttatcccttttttcataatcattttgtgcttttattaatattccatttcgctttttaggagtcgcttggcatggcttttaaggagttgttcaagcgttggtgtgtcactgagtctgatcgctctgtaaattatcgtcgttttgttgccggttggtcgggcaaaaaatatttccgaatgtctcaatgccttaggcaatttgttggccggcggtttggccggaagcgtcacctttttcttcatttacccgttggacttcgcgcgcactcggctcgctgttgacatgggcaaaggttgacccccagctccattctcacaatcagatggcactttttattacgggacataattttgcagaaatcccggtcttatgcccgattttggagaaattgaatgacccatggagtccagcaaaacgggactttttaccgctggtttcttgttcacaaacagcaccattttcgaaacctattcctccgtttctgcgttaaacgaaattccggcctaagttggttaatttctc

SEQ ID NO: 84820 - DNA, 644 bp, Heterodera glycines
  Genomic contig location: Contig_ID=SeqID_20046; Location=735..1378; Strand=-
  SCN-specific regions: Sequence locations=1-114,149-224,269-314,337 -477,499-534,560-606
atgaaaatttacaaatggaaaaaacaattaggattaagcagaaaaaatgaaagaagccaaaagaattattatgaaaagaaaaagagggaatttgttgaaagaattgatgagtttaaaagaatgtcaaaaagaggaaaacagaagcaatttgcgaaagcgttgggcattggcaaaacaacattaagcacttggaaaaaggaatttggcattgaaattagcaaaagtaaatattatttaattttattaattaaatattttatcatttttaggagtttattcgaataaagagaaaatcagcaaaatgaaagattattataaaatgaagaataaaaatccgtatttaagtgacagacaaattgctacatttttgaaaatctctccgtccaccctaaataaatggaaaattgaaaaaaattagtaaaaatcatatatttctaattattgtatgttatatccctccatttttattcgtatgacttttaaaaaattgttaaaaaacgattcaattaacacttttctcatgcaattactttcataaattataaatttatatatttttgagtctttctattttatcataaaaatccttttttgattgaatgattcaattaaaataacaaaaaaaaaaattaacaaaaaataaa

SEQ ID NO: 84821 - DNA, 1307 bp, Heterodera glycines
  Genomic contig location: Contig_ID=SeqID_20047; Location=443..1749; Strand=+
  SCN-specific regions: Sequence locations=1-207,232-373,396-414,437 -473,495-760,942-1307
atgccgacaaacaatgtgctggtcgggttggcatcggtgcccaactttttgctggtgccgtcctcttcgcctcaaaatgggccccttgtggaacgaatcatcgaatttgttcaccgaatacggtaagccaattgggatacactgtcacgggttacggtgtgtatgttcctatccgatagtgttggattactataaattggattactgtattttatttttattttttaatttcagcgaagcccaaccgcccgttgagttgtgccccactgatcgtcagctgtgagttttttcaatttgtataatgtccgttttatcggtggtatacgataatatcgtgcagtttcgcccttttctaattcgatctctactattattaataaagtttcaccataatatttcaatgagttccaccccctttttgcttcctttcttttaccgtatgcctttctcttactgtggttcattactatagctcatgtaatacatgtattacaaataaatcaattattgagtgcctttaacagatcgctcatcgccgcgctgtgtttgtgccgttccgacggtgccggtgagcatgccgccggtgcgatgatgagcgcctcagtgccgaccgcaacgagcgatgacggcaccggccatgcccagctgcagttggccatcgcacgtcgcattcacgaacgactttggcaggtgtgcaaactgagcatggcatttttggatttttaatttttttggaattgaaatttttaattggatttggaatattttttaaatttaatttttaatatttaattcataatttaaatttttaaagttggatttacaaattataactttttaaattaaatgttaatttttaaaatttgattgatatttaaatattttaaaatttgattgaaaaattaaatgttttattttacaaatttaaatttttaataattcgttttaattagtttactaataaacatttccgaggttttaattattttttcattttaagggtttttaaattgtgctttacactaatcattctaatgacattcttaccgtaatcggaattgtaccgtaataataatttgccctccgtacagtcgctcaacgccaccttggccaccgatctgctcccatttggcccctcgttgcttcgccgtgattccatggaacgccaacatttggccgccatgttggaggcgttgcgccaactgcgcttggcacatcgccaatgcttggcacacacaaattgttacaatgtgccggccgaactgttcacggcacaacgacgaggcgagcaaaaaaagagcaattaa

SEQ ID NO: 84822 - DNA, 1204 bp, Heterodera glycines
  Genomic contig location: Contig_ID=SeqID_3475; Location=485..1688; Strand=-
  SCN-specific regions: Sequence locations=1-950,988-1070,1092-1204
atgctttacgaagacccacgaaatcgctgctgttgtgcgatcaaaattcaggtgattcgctaaaaacaaaagcggaaaatctcttataatacaaatgtccttaaatttgttttgattcaattcgaccattttattgcccaatgactgattcattccgtacactttaaaattgccacctcttttaagtttgaccattttctctcaatcattcttgcttagtctgatcacttttatattttttaacttcctcatcccaatttaaattattagtcaacttctcccgatcagtcaaacaacttcacttatgttccccattgactgatcagtccgatcacttttcaatttgcctttccccgttagattggtgctttgatcatcgcttgcattggcattttcgcctgcctttgtctgatgttgcttttgctcattttgggccgttttctctttgccactgttccattaattttggctgctgcttacgtaataattaccttttctcaaatcattaaattgatccaatttaaggcttccattttctatgcgcattatgccaaaacagcgcgcctttattggccctttttggtggccaatgtgcgcaaatgttttaatcgccaatacttttttaaatttatttaattccatttttcggcttttttagggcattgccgttgctgttggttcgctgtaccttttggttttggctgccatgtttctgctcgtcccgcacttttggcaacgttggctgaatgagttcagcgactttcaacatcaggagacaatcatgcgtatgagcaattgacggaaatgaaaaaattgagaattaataaccaattaataaactcatttcaacggtttagagtacccgcgtttggtcaccggatgtatcggagcggtaatgttatttgttcaggtaaaagcttttaggggcattttgttttttatttcggcacttttatattttacatttcaaatttaaatttaaatttacgccattttcatttttgtttatcaggtgattaacatttggtttgaattggtcgtgtacaatgccagcacatttgtgcaacgacagcatttcatttcgcaacacggggcgcacaaagtctgatcattcaatcaatggccgacagaagactgatcagccgatgcttttttaatcattttttgttttaattcgattttttttgatctccggtataataaa

SEQ ID NO: 84823 - DNA, 713 bp, Heterodera glycines
  Genomic contig location: Contig_ID=SeqID_3475; Location=2787..3499; Strand=+
  SCN-specific regions: Sequence locations=1-70,92-125,147-361,383 -435,462-601,695-713
atgcttcttcttcgcgagagcgatgaagcggctgtcagcaaagagtgcccatgggcatttggagagatggaaaaaaggggaaattgtgaaatttggttttatgaagagaaaaacggacggacgaatggacgacgagaagggcatttggaggggaagaagaacaaaacggcaaaaataaagaaacaaaaaagatattcaataatgtatatatgtctacataagtacggtataaaaccaattaaagggcaattaagcatcgaatgggtcgggcacaattaacgccggggcattattatttccggttcgttccgacgtgtttttgttagtgtgtgaataaactcattatcagttgaatttagaaaatggctttttcttttcaaaaatcccttgctaatggatttgtcaagttttacaaattgtgaaaaaaactcattcatattattatatataattttaaaaaagtattctttattcatttggtcttttggataaagcaaaaaacaataaaaaataaaaagcaaattttagtgaattaaaatgacaatggcttttttatattttgaaattcgaagctaataatcttttaggctttgtatatgggaagaaaatataaggcaaagaagggcaaacaaaacgaaagaaagtaaaaggaaaaatgaaaatgaaaagcgaccaaaagaaaaaggaaagtaaaatttaaaattaaaattaaa

SEQ ID NO: 84824 - DNA, 290 bp, Heterodera glycines
  Genomic contig location: Contig_ID=SeqID_3476; Location=769..1058; Strand=-
  SCN-specific regions: Sequence locations=1-102,125-290
atgctcgtcgaattggatgccgaacgcatcaccggcacttgcggtctcttcccgattgagcagaagacgcttcgactcacaactgacggattccaatggaatttgggtgattttgatcaaaacatttcttaattattatgtgatttttcttagccaatcaatgcgttgctttcggccaattggtttcctcctccaattgcattttgtgtccgcaaaaatcgcgcattaaaagcgacggcggtgccgttgtgttcacttttgaactgcgtgaacccaacaaaatgctctga

SEQ ID NO: 84825 - DNA, 323 bp, Heterodera glycines
  Genomic contig location: Contig_ID=SeqID_3477; Location=296..618; Strand=-
  SCN-specific regions: Sequence locations=1-323
atgtctccaaatgaattttcggaccgtccctttcaacaacccgacaatgttcaacacccgcatcaacaaccagatgaagacgccgagttgcgtgcacaaattgaagacgcagaggaggatttgctcttgaattggtggcgtgaagacctgaaaattgtaagcttcttttttttcaatttatcatttttttaaatttcatcacattttttcagattcgttttctttttggacaccgtcgagcacctaccatcgaagccgcgcttcttcagcgcgccgaacgcgaggccgagattttgcgccaatatgccgagaaccaacaatga

SEQ ID NO: 84826 - DNA, 426 bp, Heterodera glycines
  Genomic contig location: Contig_ID=SeqID_20048; Location=1720..2145; Strand=-
  SCN-specific regions: Sequence locations=1-90,112-426
atgaattcagacaaccatttgattcaaacaatgaatcgtggcgatgaaaggtccgctgacatatatttggtaatatttgcatattctttataatttccctcacataattttgtgaattaccacagtaattcatcaacaatttttattgctaccggaaaacacattttgtatttagcaagagcaaacgctgatgatcacctcaagccaccaacccgtgcaattgttatatgatggagccaatggacaatactttatacctgttcagaatgggaatgacggttctgtttgtcatattgctctgaccccaacacagtcaaaagtaattgagaatcaagataaaacgtctattggataagactgtagtttgttccccctttttgaaaaaaaagaatcaaatccacctaaacagtttcaaatagcattaaa

SEQ ID NO: 84827 - DNA, 929 bp, Heterodera glycines
  misc_feature (180)..(180): n is a, c, g, or t
  Genomic contig location: Contig_ID=SeqID_20049; Location=1..929; Strand=-
  SCN-specific regions: Sequence locations=1-51,84-111,136-301,323 -335,357-450,497-726,748-929
  Gene Ontology: Mol. function=ATPase activity; Cellular component =spliceosome complex; Biological process=mRNA splicing
atgtccaaagcttaagctgatttttaatgagtgccacgttggattctgcccgattccaaaaattatttaaaatattgtgaaatgctgataattcgatggcgcacatttccagttgacattttggtaaatttgtttgcgtgtaaaattcttcaacaacaatttcacacaataaaagcattntaattcagtattctccaacaccagtaattagctacacacatgctgcggtggaaacagcattgcaaatccatttgactgaaaggcgtcctggggatattttaatttttgtgactggtcaaaaagtaataatcattttatacctgaaagttgaatagaatatttaattaaaattttaaggagactgaaaggtttgtcggctaattcgcaaggacatgaccgatgagacagtttcacaatatggacaattagtaataaataattttaaatatcatatatatatatatatatataatttatttattttcccttttgtttaattacagtattgttttcctttgtatgcctcaatgccattggacaaacaacaacgtgttttccaacaatgcattccaaacaaaaataacacattgatcagtaataagcaataaatagtcttaataaaattttcgcaactttttttattagatcgtaaatgcattgtcgctaccaatgttgccgaaacgtcaattactattgatggtattgcctttttttgttgacactggcttttgcaaacaaaaaatttacaatccacaaattcgtgttgatgtaagtaggttgtttggtgtgtttgtataacatgaatttggttgtatattaattttttatatcacagagccttctggttacgccaatttcacaagcctcagcaatgcaaagagcaggtcgtgatgggcggacccaacctggacaatgctatcgtttgtata

SEQ ID NO: 84828 - DNA, 1398 bp, Heterodera glycines
  Genomic contig location: Contig_ID=SeqID_20051; Location=23..1420; Strand=-
  SCN-specific regions: Sequence locations=1-81,107-145,168-193,241 -576,598-1398
atgataattcgttcgccgccattgacacgacaaagagcgttgaatttgcgaacctttgcgcaaaaccaaaacgcagcggttgaagagcagcagcaacaacaacaggttgaaggagttcatggtgaaaatgaaccattgtttaacgctccgatctcgccaggacttaaccgaaatttgagtttgtcggcggaggaaaacgaacaccattttagtgaaatggcagcagcagcagcaaatgacgatgaaattcggcggcgccttttgcatgtgtccatccaatcgaatttgccgccgcgagcaaacggtggtggcaacaatggcgccgagcagcagcaaattcgcaatgaaaatgttggtcacgaggactttgttgaaggtttgcgaccaaattttggaagctttttggtgcgtgaagaaggagtaaggatgagattcgttgagagtggcaccgaaaataggcgtttcgagcaaattaacagaaatttggttcgggaaacggcgccaaattcgcgtcatgtttcgcaaagcgaactcattgggcgtacatcgacgccaataaattttaatggcgaattgcacaactttccaattgtaaacaaccaaatccggcaccgagaaatttatgaggattttggcccttaccgggagcatgaaaattttcgctccagccaaattcaaattcgccaacaacctgcgttagcgcggcaacaacaaaacgcaaacttcggctttttgccatgcgaacggcaacacaacgaattcgtcggacgacatatttttgagggtgggcgtcggatgatgcacccaacggagatgccgaggcaaatgcatcaacaaccgccaagagaagagcgtggatggcagcaacaaaccagtgttttgtaccgtccggtggcgcgacaacagcaaaattttccgaattacgaaaaccaaatgctgccaccccaaagccaaaatttagcggttttaagtagtctggagtacaatatggtccttgaaaggatcccagacctcaacggaaaggaagggacggacgaagttaagcgttttttcaaaaaattcgacgcttacaccgacagttggccggatgaaaaaagaattaagggactagaaagcaaagtgtatggccgagctgaaagagcttttgaagtggcgaaagcagtcattccgataaagtatgaactgcttcggggtgaaatgatgcgacagttggaggaaacggactcaaaaaacttgaatgcttttgatgagctgatgttaggggtccgacgaaaacccaacgaatcgattgatgatttggcatgtcgaatttcggggttggtgaagagagcctaccctggtctttctttcaattgtcagacgatttctcatccaatatttgatccgatcaattggtga

SEQ ID NO: 84829 - DNA, 508 bp, Heterodera glycines
  misc_feature (238)..(238): n is a, c, g, or t
  Genomic contig location: Contig_ID=SeqID_20052; Location=301..808; Strand=-
  SCN-specific regions: Sequence locations=1-215,238-487
atgaatgtaagcgaggcgctggacaaattcattaactcgtgaaacaattgaactgtgagtagtattgatcatagattgaaaattaatgatgttaggcagacgatttataaacgcaaaaactgaagaaatatgcgcataaatatgtgattttgaggtgaaattgtctcaaattttaacaattaggttttagcttttatgatgaaaaaaaatctacaaattgatgacaaattttcacatntaaagcaaaagcagtcaaaaattcaatttaaagtaaataccaaataaaaaaaaataaagaaaattagcgagttttgcaaaatcttcgcatttctcaatgaatgatttttttttgaaatattgtaggaaattttgtatttaatttccgacttcgatccttcggactaggattgcgccccgctcctctggggcaaaagttggggaccggaccggtcggagaatgattaaattttccgaaaaaccagcattttttactttcaagaaaaataaa

SEQ ID NO: 84830 - DNA, 576 bp, Heterodera glycines
  Genomic contig location: Contig_ID=SeqID_20052; Location=1952..2527; Strand=-
  SCN-specific regions: Sequence locations=1-128,172-190,213-258,292-576
atggggctccgaattttgcaccaattcatccaatttgtgaaaagccggaaaaggttaaataaaaatcaaaaaaaaatttacttgcccgtcgtcaggaaggggaattcggtatatgtcggtgaacggggaatgaggaaagaatgaaaaacactttttcaaaaattttttgcagattttcatataaagagaattcaaaattatttaaaaatatagaattttgtggtacaaacggtggtgccgactagggttgtgacccgcttaattaaataaaattccaatttccttaatttaggtcaaaatttttgccgatgagtgccaaagaaaatgtgttgacattaaatcgccaacaccaaaagtaaaaatacaataaaattatttttcttttttccaaacttctttgagttcagagcaaagaatgggcaaaacgtgcttttcattgtgaaaaagttttgtgtaccgaaaatgggattaaatgcgatgccaacaaacgtctgataatgaaatacgatgaaacgctttttgcaagtcgacagcaaaatgtgcaaaacttttgcaaattttgataaaaaaaataaa

SEQ ID NO: 84831 - DNA, 808 bp, Heterodera glycines
  Genomic contig location: Contig_ID=SeqID_20053; Location=191..998; Strand=+
  SCN-specific regions: Sequence locations=1-321,344-808
gcttttcgggccgtccccctaccgatgcgctcagatttatggggagaccgaatcctccgggaatagcttccctatagcctgtactttaattctgcgttggatttttgctccccataattgtttgagtaccccaaacggacacttgaaaaaatcgatttttttgttttcggtgcagtccccccgaaccgatgcgcccagatttatggggagaccgaatccttcgggaatagcttccccatagcctgtactttaattctgcgttggatttttgctccccataattgtttgagtaccccaaacggaaaaaatcgattttttttgcttttcgggcagtccccccaaaccgatgcgcccagatttatgggagaccgaatccttcgggaatagcttccctatagcctgtactttaattctgcgttggatttttgctccccataattgtttgagtaccccaaacggaaaaaatcgattttttttgcttttcgggccgtccccctaccgatgcgctcagatttatggggagaccgaatccttcgggaatagcttccctatagcctgtactttaatttctgcgttggatttttgctccccataattgtttgagtaccccaaacggacacttgaaaaaatcgatttttttgtttttgggcagtccccccaaaccgatgcgcccagatttatggggagaccgaatcctccgggaatagcttccctatagcctgtactttaattctgcgttggatttttgctccccataattgtttgagtaccccaaacggacacttgaaaaaatcgattttttttgttt

SEQ ID NO: 84832 - DNA, 679 bp, Heterodera glycines
  Genomic contig location: Contig_ID=SeqID_20054; Location=44..722; Strand=-
  SCN-specific regions: Sequence locations=1-135,180-303,326-516,538 -561,583-679
atgaatgaaacttttcgcgatgttctgttaatcaaggaattgcttataagacaaccccagagcgaagaatttcatcttttccaactgagtggagaggtaagtagcaatttttataggttttaatggtagtaatacaataattattaatattttacttaaattattttaattatttatttgtttcctaaaatacatctacctaataatttttccatatttttgtcattcgtgtttcacaaagcactcctcagaggagaatcgcagtatagcaatcatcctaatgtcatttgtattttgatgagcccaattgtttttcatggaaaatattttctaaccccaataaatttttctttcgaactaccccgatttttcagattttttatcgacaaaaactggggatgtaatgcattttggaaaactcaactaacactgcctaaaatccaggtttctgttgtgactgaaatgtatatactattattcctttgaatttataaaaaaaatcaaaagcaaactaacatttattttttattttaaaatgacaaatctgagtgaaattactctttataaaaaataatgaaataagcatttgtatttcccaaagaaattaatcacactaatgctttgctaatataattatgtttccttttttcagacgagctccatccctgtcagtagctag

SEQ ID NO: 84833 - DNA, 180 bp, Heterodera glycines; identical to SEQ ID NO: 51454
  Genomic contig location: Contig_ID=SeqID_20054; Location=933..1112; Strand=-
  SCN-specific regions: Sequence locations=1-180

SEQ ID NO: 84834 - DNA, 872 bp, Heterodera glycines
  Genomic contig location: Contig_ID=SeqID_20055; Location=1314..2185; Strand=-
  SCN-specific regions: Sequence locations=1-515,538-872
atgtctttccgtctgctgggcattctctgcgttcttctcttcgtggcgcaactcacaaacggcgatgcagcgtaagtgattcgcttctgcactttctgtctaattgtaaatcattaattttaacaaatttctagttggaacgatgccaatgatgtgaaccccttcaaaggtcatcaggaacgcgctctggcattcaacgagaaactcaagcatgcggaagagaacacacccgaaaatgtcacccctacgccgacgccgtccatcaacgctacggagacgcctgatacgaacgcgacgatgactacctccgaggtgactggcgagacgaccgaaggcccaactatcaagacgaccgcaaagcctgctccgccctcgaccagcagcttccaaatgacgatcctcaatatcgtcttaatgggacttatcgccgtgtaagtgtgtacggagtctaacagatgatcataggggactttcacgctttttagctatgcaaaaacagttatccttatgtgcacgggtcaaattcttccttttttccgtgtatttattgtatgtccattctaattcattgtttacaggattcttcttgtcgacatcgtcctggctgtggtcaagtgtaagaagtaggaagaactgaaggaagaaggaaggaagagccgacctaccgctggtgtaaacaattgctcgataccaaataatctgtgtggcctgttcatcgtgatcttttatatccatgtgtcttgtttggagaccgtattctccctattctgttgtctaattgtatgtatatatacctataaacgatgtgcacacaattttttgggtactttccgttttgttcatacatctcaaagtttaaaaaagccaataaa

SEQ ID NO: 84835 - DNA, 273 bp, Heterodera glycines
  Genomic contig location: Contig_ID=SeqID_20056; Location=123..395; Strand=+
  SCN-specific regions: Sequence locations=1-273
atgggcaatgaatggcacggattggcacgggcgaacattgcgatggtgccgttggaacacttccaagttgtcaaggatcaggcaaacctttgcaaacaatggagcaaagcattggcgagagcggcagaacggacttaccaagttgattttgtcagtgttcaaaaggccgccgactccgattttggacgaaaagtgatcttcaccattgagatcatgcaaaaactgaacagggaaccaatgaacggccaaagaatcgtcggatggtcaccttaa

SEQ ID NO: 84836 - DNA, 1037 bp, Heterodera glycines
  Genomic contig location: Contig_ID=SeqID_20058; Location=1..1037; Strand=-
  SCN-specific regions: Sequence locations=1-119,142-288,310-425,447 -471,493-496,519-524,546-555,578-1037
  Gene Ontology: Mol. function=receptor binding; Cellular component =mitochondrion; Biological process=fatty acid metabolism
gctgaaggaggccggtgccattctgttgggcatcaccaatgtgcccgagttggccctgtggtgggagacgaacaacaccgtctacggggtcaccaacaaccgtaagccgaagccatcccaattttttaaaatttattttttgcatttcggggcggggggggaggctttagccccacaatttttgagtgtaatccttttttgttagcctacgatttgcgccggacgcccggcggcagttcgggcggcgagggcgctctgttggcagcggccggctcagtgatcggactcggcaacgacgtgggcggctcgttgcgcgtgccggcactgttttgcggcgtgttcggcctgaagccgggtccaggtaataattaaaagccatcgttctctctctatcagtctgtaaaatctcaaaagattaatggttatttttcaaaaaagttatggccaaacaattaagacactgcttttcgaaattttaggcctcaattttttaaaacctattctaaaaatgaccaaccttggagcttgagaaaatgtgtagtatttttgataaaatataaaaatttaagtgaaaaatggccattttttgagggttttgaacacaatttaataattatgcaatggaatgaatgtcttacattttgctcaatttgtaaaggaattttaacctttttccaactgccaggcgttgtgccatcatccggcattttgccgcgcgtccacggcggttatctgattcaaatggccactgccggtccaatggttggacagtttttttcataaatttttttaataaacaatcattttttccagacaagatacgcaagtgacctcactctgatgcttagggtacatttttttttacaaataagcaaaaaatttaaaaaaaaaacattcgaaaaacttttgggaaataacgtttgaaaatcaagcaaacaaaagatgatgaagaaagatgctattttcttcattgagttcaaataatttgtatggcatttaggccgcccgacaagggcgtattatctaggggggggggg

SEQ ID NO: 84837 - DNA, 606 bp, Heterodera glycines
  Genomic contig location: Contig_ID=SeqID_374; Location=4151..4756; Strand=+
  SCN-specific regions: Sequence locations=1-290,326-606
atgcaacctgtgctggcctcttttccgagcaaagatgccacaaaaaaggtgggttaatatcaaaaacaattttgtaaataattttgttttctttttattcaggtcatcaaacgtttgcgccgtgaggaaaatgcaccgcgagtcgaacctctcaatttggagcagttggagattccgaatacctatcgtgtttataagcgcactgagattgacgaggagcaattcctgttggcggacactggcgtttttcaaattcacggatactgaggttgaattggacaactcaaaaatgatcaattttgatcattttccattgaaatacggtagaaaatagttttttttataatcatcaaattcaaccaagtataactttatgtacgggtcgtagccctaccattcaaaaggcaattcggtagacaattttgtgctctttctggcacccaatcaaaaattccaaaaaaatttcctagccccctaggaaatgaattatttcaggtttttaaatgaactttaaggtggtttttcatgtttgagtcaagacttttttccgcccttttttgagtcaagtctgatcaaatgaattaatctcgggaatgaataagtcaa

SEQ ID NO: 84838 - DNA, 342 bp, Heterodera glycines
  Genomic contig location: Contig_ID=SeqID_375; Location=1930..2271; Strand=-
  SCN-specific regions: Sequence locations=1-6,28-102,125-342
atggcattcttctgtaatgaattttttcgttaccacggtaacggaaaggatgcgaagatgacgacgatgaattggcaccgccattgtgagactggagaaaaacaattttaaatttcattgatttaaaatagttatgaatttattaacttatcgatttggaggaaaaagaaaaaaatttcagttttcaggcaaaaaccgaatatttaacgtttgaaaaaaatctgacattttgactattgctaaggccgggtggcggagaatcaaatgacgcaaatgaagtgctggactgtaatggagcaacagtacaagtgccataaattgattgagatgactgaaaataaa

SEQ ID NO: 84839 - DNA, 489 bp, Heterodera glycines
  Genomic contig location: Contig_ID=SeqID_375; Location=1941..2429; Strand=+
  SCN-specific regions: Sequence locations=1-207,230-304,380-489
tcatctcaatcaatttatggcacttgtactgttgctccattacagtccagcacttcatttgcgtcatttgattctccgccacccggccttagcaatagtcaaaatgtcagatttttttcaaacgttaaatattcggtttttgcctgaaaactgaaatttttttctttttcctccaaatcgataagttaataaattcataactattttaaatcaatgaaatttaaaattgtttttctccagtctcacaatggcggtgccaattcatcgtcgtcatcttcgcatcctttccgttaccgtggtaacgaaaaaattcattacagaagaatgccattcattgcctataaaattttagaaaaaattttatattttgaaaaaaaaagaattgcgtgctcggcttatgcgtttgctgtgctgttgttgctccaacaatgcacaacatcatcagcccatcaaccgggaaggacaagacgaattaaactgaagatttga

SEQ ID NO: 84840 - DNA, 185 bp, Heterodera glycines
  Genomic contig location: Contig_ID=SeqID_375; Location=1063..1247; Strand=-
  SCN-specific regions: Sequence locations=1-14,37-126,148-185
gtcaaattgatacgaaaaaacaaaagcctaaaataacgcatgaaggccagcttcggccggtgggctgatcgaatgaaagaatgtttcggagacggcacattctcattggcacctccaatgttctaccaaataaattgtttccatttcttcattttgttaattattatatttaacgaaaaattcat

SEQ ID NO: 84841 - DNA, 671 bp, Heterodera glycines
  Genomic contig location: Contig_ID=SeqID_3478; Location=502..1172; Strand=-
  SCN-specific regions: Sequence locations=1-70,92-371,394-671
  Gene Ontology: Mol. function=co-chaperone activity; Cellular component=vesicle membrane; Biological process=receptor mediated endocytosis
atccctgcacaaggatatctgccacaattttgtcaagcgatgcaatcgaccctcagtgatgatgtggcgcgatctgctctcagagtgcttaaccaactctcagaaaatttggtaaatattaacgattggaaaattgtcacacaaattcattacactttgaaactagtcataaattttcaatttgggctttaaattcatttccgctgtttaagaattgtgcttctgcgttcgctgctgtcccctctcttccaaaagggcttttggtttgcatgcgaatgcagcccgagttggcccgggagtcggcccatgcactcaaaatgctctctcaaagatgtactcctgaaatggcggaacaaatgttgttgagcggaatggtcgatcacttgttgaaaatgttgggcagttcgttaccaggtgagtctctttttgggacattttccattcctttaaattcaaatcaatttaaaacgttattaatctcttttcaggagtaaataatccgtccgctgcaaaagctgaaattgccgacgcactcaaagcttgctcaagagacgcacactttggtgaacgtatcacgcaattgctacaaaaatcgcaaatctgggcacagtaccgagaccaacggcacgacttgtttttgcctaccatcactcaaacacaagccataacgg

SEQ ID NO: 84842 - DNA, 1977 bp, Heterodera glycines
  Genomic contig location: Contig_ID=SeqID_3480; Location=232..2208; Strand=-
  SCN-specific regions: Sequence locations=1-571,594-607,655-899,929 -1538,1564-1625,1659-1687,1709-1977
  Gene Ontology: Mol. function=co-chaperone activity; Cellular component=vesicle membrane; Biological process=receptor mediated endocytosis
atggcagcttttgcttttttgggtgtaatttttggtttatttaggatccgcgagaagctcggttcgctggtcatttcggtgctgaagcggcgctgcgaagcgattgaccatgccacggttgagctgttatgtgcactgatgcagccaatgcatgccaacttcgacttgcgcatcgagcagctgaacaaacaatcacttctctccagccgtgccttcgttgaacatttgcttcaacttgtggtggaacacgtggcaagggggactggtaaacaaatcaaatcaaccaaagttatcgtttttcaaaatgattgcccaggtgcgttggtcatcgcctcgatgttggactttctcacattcaccgtatgcgccccgtacagtgagacaaccccgggcgatacgttcgattcgattttggcgatggtcgcacagcggggacgaaccttttacaaacttttccagcatccgtctatgaccattgtgaagggggcggggatggtcatgcgagcgatcatcgaagagtcgggcagagatgtaagagacataactgaaaaagaggagggagtggcaatatcaaacataaaatgattaatttgtacattttagctacattttaaacataataaattaaatcatttaaaattaaattaaaaatttgctattggaccactgcggaacataaaaacaatccggttttaccaactttgtctttagatcagtcgtcaaatgcaacttttggccctcaccgaaggagcctttctcaaacatttggagttggcccttctttccactggcaaagaccttcgcgttcttaccaacaaacaactcagcggctatttggtggcactttggattgcggaaaaccaagcagcgaaggatttgctgcaacgatgcttggtataaaaaagccaaaatataaattttaaaaagtgctttagccccgagggctcattgattatttggattcgaatgagcatgtgcctgcctctgcggtggccgaggaacgtgacttgctgactattcgcaataatttggaaatggccaacaattcggagagagagcgtccgtttgcacagcttcaggatcaattcaggtctttcgagcaacttccggattatggccattttaaatgaaaaacaactcgtttcagaaatgtgcaagtgacgctggaggcaaggctcgactcgttgctgcaacattggaatttggaacagaagctcaactttttacagagcaatcgaattcgtgaggaacaccagcagcagaaaatccagcaaaggccagtcgtgcttcgcaagcgaaggcgactggtcaaagcgactgcaaattggaagttgttttggtatgcgtggcttctgcttcataattaattgcctaattattgtaaatttgttacattctttgattacgatttgcatttgttatttccgtcccattaacttattttagctatcaatttggccaaaatcacgcccgtgccgatttaatttggaacgaaaagactcgggatgaattccgacaatcaattgagaatgagtggcgccaattgcagcaggaattagaatttattcaacccggaactaccgtatcatggaaccactcggaatttacggtggttaccgttttgattaaaattgtcattttaataaagttattttattttaggtaacttatgactcactattggacgaaattcgaattggtgattattatcttcgctttttattgaccgaagagaacagttcgaacagtgcaacgcccatccatcgccccgaggactttttcaataaaatctaccatcgttttttactttctcaacgtaccgaaatgcgatgcatttgccttcgagcgatggcacttgtctacgaaaggcattgcattagcattggaccgttcgctgacactcgacacattgtggaaatgttggccaaatgcacaaatgttgctgaaagggaccacttcttgttccttattaacaag

SEQ ID NO: 84843 - DNA, 977 bp, Heterodera glycines
  Genomic contig location: Contig_ID=SeqID_20059; Location=137..1113; Strand=-
  SCN-specific regions: Sequence locations=1-23,46-977
atgaccatgactatggctctgtcccctgcgcgtcccccgactcgggaatgttctcggcaacgcagagcagcgtctccatcggacaaaatgacatggcaatggtcgaaaatggtaacgaacacagtggagaaaggtaaaccaaaaagcattcgacattttttaacggtcaaattatagtaacttaatcaatcacaatatttattgtgcaaattccagcgaaggcatttggccattgcatagcgacgagacggacagtgtcacaacgacggccccgccaacgccgcccaaacacagagagacgggccttcaaatgtcagcggaaacaatcgattgccaagttggtagttttagaaaatgctgaaactaaatggaaggaacccttttcagggatttgtgaatgaaatgggacaattggatcaatccgtagagaccaaaacgaacatccaattcagacagaatgtcacaatggcagatacaaatggtaagtgacaagtttattcattttgagagaactttttgaaaacggtagaaactgtgggcctatttacacaaaaaactaaaattatttattagaaactagttaaatgctaagagaatggctaaattcgttatggcatagttttgttaatgaaatcgcaaatcctttttttaatttagggataagtcctttggattcatttcgacaagatgggaatttccatttgaacggccctcaacaatttcgccgtctttcaccaggcgcaacgatgacacagcgcaaaatgaatgtcgttgggtcggcttcggcgagtcccatccaattctgtgagcagcggaaaccttacggtcaaaaacagtattttagtcgagccgtcgttggtgaccgaaactcaaatgccaatgagtggcgcaatggccgttacaaaatgcaagaaagtcattctgaacgacgaggaacgcaaactgtgcaaaaaggtccatttttggttatgatttga

SEQ ID NO: 84844 - DNA, 757 bp, Heterodera glycines
  Genomic contig location: Contig_ID=SeqID_20060; Location=299..1055; Strand=-
  SCN-specific regions: Sequence locations=1-107,129-147,170-757
atggctgcatttaggttgaatctacaaaaatcacttttccaacaagacggcgaaaggttattgggactggcaaatgttaaaaaagactccaaacggaagaaagagacgttttggtgccttgctggtcggtttggcttggattagggcgaaatgaaaacaaaaggattttgtaattcatcataacctatgcattgctttttagttacaataagtcaacccgtggcggtaaggttttatattgtcaaattggaaaaggacgacacttttgcgaagaaggagcaatttgcgttgagggaattgcgcgtggtcgacggagttcacccacgaaaagttttaagcagaaaatttcaaaactaagaataattcagcccgtaactgatattattctgacaattcgtaacaatgtgtaccatttggactcgaatacgctcgaagaaaaggaatttcttatccgtcaaattttcaaggtgtttccggtaatcctgtattttattggtcccataaaaaaaaagagattaaaaagttgtttttatgcatttcggagtaatactcgggggttttcgggggcgctgatcacgaatatgatatcaattttgacctatttcgaatcccgaacccgaattcgaacacaagtcggaagttaatttttcaccaaaattcacatgtattgtccaaaatcgattcaaattcactaaatggccttgaatctttattttctattatattccgttcatttgaataagtttgggacaataaa

SEQ ID NO: 84845 - DNA, 1107 bp, Heterodera glycines
  Genomic contig location: Contig_ID=SeqID_20063; Location=404..1510; Strand=+
  SCN-specific regions: Sequence locations=1-997,1020-1048,1098-1107
atgtggagcaaaacgatggttggctacggaagtgaggacgaacactttgtgttggagtgagtgggggtgggggggggagaggtgaagaatgggcaaaaaggcattggttgggctgacccctacatgaaatcaaggttgttttgaactgcttgaaattgtgctttcctcattaaggctcacttacaattacggtgtccattcttacgaactcggcaatgatttcagtgtacgaatttaacccagggatttgcttccattttttagttcattttcaggccattctcattgaatctgacgacgttttggcgcgcgtggaaagtgtgggagagcggacagcagaagggactcttttgctgaaagaccccgacggacattcttttttcgtcgagggcggaagcgctgcgcatccgttgaccaaagtgtcactgaatatcaccgatttacacgaatcacgcggtcctttccgctaattcggttagcttttagtcccgtttcaatgattttcagaattttggtgccaactcctcgggatgaaattggtcgaagggacggacaacggaagtaaaaaatgccaactcgcatatgaccaaaatcaggttgaccaaacaatctttatttccatatttgctgacttttaagtgtcacctcgagctcatttcgttagcaaatggagaacctttggaccgaaagacggcattcggtcgaattgcttttgccacggcgacggaaaatgttttatttaaagttattaaaacaacacgcaattgccgctcctttcagttgaggccactcgaagagaaagtcggcacaaagcgcattcattcgccactcatttctttgggcacacccggcaaagcgaccgtttgggtggtcattttgaaagacccggttacttaacctcataaacgaatctaattacttgctttttaggatgagcatgaaatttgttttgtgggcgacgaaggtttccaagaattatcgaaagtcgacactgaagcggagaaactgttgctgagtgcgattgagaaagacgacagttgaagcagagtgataataatttatttaaaattgtgcttgtattttatataaatatatatgggtgagata

SEQ ID NO: 84846 - DNA, 295 bp, Heterodera glycines
  Genomic contig location: Contig_ID=SeqID_20063; Location=1597..1891; Strand=-
  SCN-specific regions: Sequence locations=1-194,216-295
atgttgcttccgatgggacttccggaagacgttgccgtggctgggttcggtctctccctcgagcggtggggagtttggttcggcttaaatcagtctctaagcccccttttcaggccaaccatgatcagatacggcatttccaacataagagagctttttggccataaggcattcaccatttgctcactaacagataaattttttatattttcagattgatctcgaaatgatctacagaaaccctttgtgcaggttggagcagaaaaactagtgacgaaatgggagtgccaataaa

SEQ ID NO: 84847 - DNA, 116 bp, Heterodera glycines
  Genomic contig location: Contig_ID=SeqID_20064; Location=195..310; Strand=+
  SCN-specific regions: Sequence locations=1-116
atgacaatggctttattgcccctcgccttggctgacctgaaccggctgaccatgtgggccgccttcgaggatctgaaccgggtcgaactgaccagtcatttggcgaaccccaacca

SEQ ID NO: 84848 - DNA, 968 bp, Heterodera glycines
  Genomic contig location: Contig_ID=SeqID_20064; Location=1..968; Strand=-
  SCN-specific regions: Sequence locations=1-137,209-256,293-321,343-968
actgttcgaccagggcgggtgccgatcggatgagcacggacgacaagtgggcaaacaaacacaccattaagcatattatttttctatgaaatttgcaaggttttcggttcttttggggaatagagatttttcagaacaaaaaaaattatgtcaaatttataaattaaaaaaataataattttatcaaatttatttaacaattaaaaatgatcggagaccaatagacaaaaaatcagccaattttgagttcaaattgattataaaaattaattcaaaaataattataataattccaaattcaaatatggtttcccttttcgctttttcttatttcctaattttctggccataatttattttgttctgactttccccccccccccctgttcaggttgccggcattgagttgccattcgacacgtgcaacgtggcacgcacccgttcgctgaacccgaaaggcgtgttcgtgtccaccaccgtggtcatctccttccacccgcaattcgtcaccaaagttgaccgcgcctatcgcatccaatgcttctacatggaggcggacaagaccgtctcctcccagttggaggtgtccgagatcaccacccaattccaaacgcaagtggtgccgatgccggtgtgcaggtacgaggtgagtactcactggttggggttcgccaaatgactggtcagttcgacccggttcagatcctcgaaggcggcccacatggtcagccggttcaggtcagccaaggcgaggggcaataaagccattgtcatgttgaaattgggcagttatagtcaaaaaacagatttaattacctataaattaatcaacatttgcgagtgttagatctatcaaaatttattaccattattaaaatgaaaaacccttttctaattgctttttattcccttcagtttgccaccattaaagacaggtgtaccacaaatggacttgcgactcggagacg

SEQ ID NO: 84849 - DNA, 486 bp, Heterodera glycines
  Genomic contig location: Contig_ID=SeqID_20065; Location=1368..1853; Strand=+
  SCN-specific regions: Sequence locations=1-138,161-258,281-348,371 -378,401-486
atgataaaatcgactggctcggccgcttcgcgccctcgcatcattttcttggcttttctccaatctctgggactaaacccaccagcaattcaatcactgggactcaacccaccaacatttcaatcactgggactcaacccaccagcattccaatcactgggactcaacccaccagcatttcaatcactgggactcaacccaccagcatttcaatcactgggactcaacccaccaacatttcaatcactgggactcaacccaccagcattccaatcactgggactcaacccaccagcatttcaatcactgggactcaacccaccagcatttcaatcactgggactcaacccaccagcattccaatcactgggactcaacccaccagcattccaatcactgggactcaacccaacatcatttcaatcactgggactcaacccaccagcatttcaatcactgggactcaacccaccaacatttcaatga

SEQ ID NO: 84850 - DNA, 168 bp, Heterodera glycines
  Genomic contig location: Contig_ID=SeqID_20066; Location=1384..1551; Strand=+
  SCN-specific regions: Sequence locations=1-168
atggaggaccgacaaggccaattgagatcacgaagggcacaaacacaacagacagaaacaacggtggaaggaccaactgacaacagaaatgggaggactgggggagaagaaacgacggcgaggactcatcgaaatgggggaccgaatgaggcgagttttcatggatat

SEQ ID NO: 84851 - DNA, 710 bp, Heterodera glycines
  Genomic contig location: Contig_ID=SeqID_20067; Location=899..1608; Strand=-
  SCN-specific regions: Sequence locations=1-160,203-397,424-474,496 -526,550-710
atgtgccgaaaaattgttagaaatctggttttttgattctgaatgcactgaaattttcaaattgtttatgtttcccacaaaattgtttaaatcgattgacctataaacttagaaaaaaatcagaaaattttttatgaaaaaattccaaaattacatgttgtaaaaatttttgaaaaacttattaattcaaataaaaaaaaatgaaaacccccttcaaaattttttggactttttttccaaatgttatgttttttggaatttattatttcaattgactgattttttttcaagtttatcaaaaaatgataaatagatttaaaaacacattattattacgaaattgatatttttagacattctcaagcaattaattaattttttcaaagatttttttgcctttttaaaacaaatttcaaaaaatccaggtccaggcctggatccaggtctcgaggagcctggatttttcctggacctggattttcctggatttttgtccaggaaatccagctccaggtccaacatggaatccaggttcaggtccaggtccagacttttttcaaaatgtcgagcttgactaatgtatccaaatccaaatccaacatcaacactttttcctcatgtgccgcaacacaaactacacaatgagcgaaaatgtttatttgatgaaacgtaaacgcaaatttataactcatttaattatcaaaaataaa

SEQ ID NO: 84852 - DNA, 125 bp, Heterodera glycines
  Genomic contig location: Contig_ID=SeqID_20068; Location=435..559; Strand=+
  SCN-specific regions: Sequence locations=1-104
atgaaattgagtctgtccaacctgcttgttcaaaacgtggtgaaggtgttcgatgccctgttcactgatccatgcgaaccacccccagcgcttggcaaagtctggcccatgggcgagaagccagt

SEQ ID NO: 84853 - DNA, 416 bp, Heterodera glycines
  Genomic contig location: Contig_ID=SeqID_20068; Location=1171..1586; Strand=-
  SCN-specific regions: Sequence locations=1-21,43-141,163-364,388-416
gtttcactggcgaacacgcaattgcctgccgagaagatgaagtgtgtggtggagcattcgctccgagattatcttatggtctctctgctggccaattgagccaagactcagttggccctgcaggaaaaagtcacttcctcgtaaagttttgaccagtcaaaccgttgcggaaagagggaaagcggaccaataaacgtgattcgagattattgctttgtgtccattctgtcattgttttgttactccattttcgttattcgcagaactgttatcagaaattcatgtatcatatattatcattttgacaaaaattgcctaaggacaaaccgccaaaaaccccactaatttaaaaattttgccgatattttcccttgtaaaaactgaagagtcgatctcgagttaaaaagcattttgac

SEQ ID NO: 84854 - DNA, 141 bp, Heterodera glycines
  Genomic contig location: Contig_ID=SeqID_20069; Location=1..141; Strand=-
  SCN-specific regions: Sequence locations=1-141
gcgattttttgctgctttccgttgaagaattttccccaaaattaggggtgcatataagaacaagcagaaatgcaattttcaagggaaacattttggtggtttttgaatttggtggggaattgcaagcttttctcgggtatt

SEQ ID NO: 84855 - DNA, 1330 bp, Heterodera glycines
  Genomic contig location: Contig_ID=SeqID_20070; Location=62..1391; Strand=+
  SCN-specific regions: Sequence locations=22-214,236-462,556-751,865 -899,1148-1330
  Gene Ontology: Mol. function=structural constituent of muscle; Cellular component=striated muscle thick filament; Biological process=striated muscle contraction
tcaaagaaaaagctggaaaccgacatcaatgatttggagttgggcttggacatggccaataaaacaaacatggaagcgcagaaaacgatcaaaaaattgattggccaagtgcaggatcttcagctgcaggcaagtgaaccacaaaatttggttttttttgtcgtgttaaaatttgttgccactagtgattaagttgtccaggcatgttttgtgctctttctgattttgggtgtctcgattatcatggagtggtctgatcaaaatggttttctagtattcccgttgatcactcactgatcaccggcatttttacttgaattacatttttggcggagaacggaaaaatttgctagttttttttcataattttttttttcaaaatggttcattcaggttgaggaggagcagcgtcggcgtgaggaacagcgagagaactttttgatgagtgaaaagtgagagaacaattaaaaatataattaatattttaatttataaattattcaacaaaaaaaaatcttccaaaatttaaattatttaataaaattaaaaatatttgtttcaggaaattgaacattgtgctgtccgaacgcgatgaacttgttgtgcgccgagagcaaatggaacgggataaacaacgggtggaagccgaagtgcaggaggaacgggcgcgcaagacggagctgcaaatggacaactcacagctgagcgccgcacgacgccaagtggacaatgacctacaattgacgaaggcaaaaaatataaaaataaaatttgaataaaatatatttcaaaattgaaaaaatgacaattttaaaaggctataaaatgaaatgaataaattttttttattaattttaatttttagatcagattatgtttcttaactttagcctgcaaacaaaaaaaaaaaataaatttaattttaaataattatatttattaaaaaaggttttttttattaattatatatttttttattaaattatgtttctttacaatagcctgcaattaaacaaaagaaatttaattttgaatttttgttaaataaataatagtaaatttatgtgaaaatttgtgaaatgttgaaatgtttaaaaaaaatattttgaaattaatttaataaattatttaaaaaatgaataaatatgcatttgaaataaacaatttttagactgagttggacaaaacgctaaacgaactgaaaatggcggaagaatcgtccaaaaaagtgagcgccgatgtgacacgacttcaagaagaatatcgcaatgagcaacaccacaatgaccatgtggagaggcaaaagcgaggattggacgcgcaattaaag

SEQ ID NO: 84856 - DNA, 229 bp, Heterodera glycines
  Genomic contig location: Contig_ID=SeqID_3482; Location=159..387; Strand=-
  SCN-specific regions: Sequence locations=1-229
aatttgccgcccatccctttgcaattccatttgctccatttggtggacggaaggaatttggccggatgcaacgaggaaagcggccgcgaaaatgaaatgtgagagagtcaacgtccgagaactgaccttttggctaacaattacccaagctctcatataacttacccttttaatttgcttccatcttattccaatttctgttccacttcctcccgtcccccactcattg

SEQ ID NO: 84857 - DNA, 448 bp, Heterodera glycines
  Genomic contig location: Contig_ID=SeqID_3482; Location=1441..1888; Strand=-
  SCN-specific regions: Sequence locations=1-119,148-306,349-448
atggttatgcgagacggcgttaccacggaaactgtgcaagatgaacacaatgataaaggttgacccgttgatcttgatcattgccaaatcagttttacgatcactttttatgaaattggattataaaaatgaaatttaaatttttatggaagccttgaggatagatgctaatggaaatgcccctctattttatactgccaaatttgttgtagacctacacatatacagatagactttttgctgattttttcacgtgttcttcaacttgtttactctgtcttcaaggagtatttcataaacatttcctttaatttattttttttaaataattttattatttatattttagcgttggctcggaagtttcctattttccacgcataattttttttatttgtctttctttggaatatcattttatcagattatgcaatattttcataataaa

SEQ ID NO: 84858 - DNA, 1163 bp, Heterodera glycines
  misc_feature (1160)..(1160): n is a, c, g, or t
  Genomic contig location: Contig_ID=SeqID_3483; Location=85..1247; Strand=+
  SCN-specific regions: Sequence locations=1-186,208-733,758-773,795 -824,846-865,887-930,952-999,1040-1163
atggcattatacattttgaaggtggaggtgaactgcggtgcaattgccagtttggcattggacagcaaaatcactgatttgcacaccgcgatgctgaaaaaagttggcataaatgcgtccaaggatgttgtgccggtcaacaagccggaccaggagttcatcaacatgttgcacttggcttggtaaaaattaaataaacatttcttactttgtttattaggcttcgaattaatgatttttaattcgagactcgtacttaaaaaagcgggaattttctcgcctctttacggacaacttaaaaagagtcggaagacaaaatgaaatattcaatgaatttgtagagtcaaaaaatgagaatttttgcggccaaactaaggaattggcctacaaatcaagagccaaaaaacaatttctcgcatggatctttagacttcaaaaatagattttcatggattcattaattgctcagctaaaagcatttaagcaaatacaacgtataaatttaggcaaaaattcggtgatccaaatgccatcgttgtgatacttcacttcatcaattcctcgccatacaaccttgattacacaaatgttgaaatggaattggcccgtgtgtcgaatggccaaataaaaatggactttgtctcattgaaagagggcaaaaggtagcaaattcaaattattaataggaatcggattttagatgattttattaagtcgcaaaaataagtacctaaaaaatcaattactaattattagggctgtaaattatatggaagaaaaattttaaaaaatgcgcataaaatatgtaaaaaaaaatcccgaaatatataagaaatatgtacaaaaacctcaaatatgtaccaaaatatgtaaataaaaaattatatggttttttggataaaatttttttttacaatggcgtgaatgttgaaaaaatgccataaaaagatatggttaggctttgaataacgcttcagctttttaagaaatagtaatccctaaatttattttaaaaataatttaaataaattttaaatttcagactgaatcttgaccccgaaacattcacacttcgtttggatggccgtgttgttgctgttgtcaactccggaacatctgcacttggctatctagcgaatcgagccgaaatggaaactcgntaa

SEQ ID NO: 84859 - DNA, 911 bp, Heterodera glycines
  Genomic contig location: Contig_ID=SeqID_3484; Location=80..990; Strand=+
  SCN-specific regions: Sequence locations=1-73,121-507,529-816,840-911
atgcatccgcgaaacattcactggcatgtggcactggaaacagacgaccatttgaccgaaaaaataatacaggtaaaaaaataaatcaaaattaaatttttttaataaatgatttattttccaggatgccattcaaaatcccggcaattatgtgctcaaaccgaaccgtgaatgtggcggaaacaattatttcgatgatgagattccaaaaaaactgcaacaattttcgcttgagcaacgggcggcacacattttaatgcaacgattgcatccgttgcaagttaaagtgggtgaaagttgagcccggcgcgggaatttgtaggatagaaaaattttgaatattcgattttctcttcttaattgtgtccgggattcctaattggccgtaatggatgtcgggtttgtgatcaacgacccccgaaaatcctagaaagggtgtttttcacggcattttaaaatgtttaattttttcgaaatattgggcgaccaacgccagtataaaaaatttttggttccaattgctggaaaatggattttttaattagttttccaaacaatttagaacttctttttgcgaccatacgctaagccaacattgtgcaacaccagcggcgagttgggtgtgtacggttttctgatgggcaacatggtggacggtacggtagaccgtaatgtgcaaagtggtcatctgttgcgcaccaaattggcccatgtcaacgagggtggtgtgattgaaggcgccggtgttggggacacgccatacttattctgaccaacagtatacctcaatgctagcagcaaacaattttgtattagacaaaattttggcatttttcccgatgaaattagtgtccaaaaaatgatgaatattttgtattagtgttgatgttgttttgattactaaatattca

SEQ ID NO: 84860 - DNA, 847 bp, Heterodera glycines
  Genomic contig location: Contig_ID=SeqID_20071; Location=1587..2433; Strand=-
  SCN-specific regions: Sequence locations=1-13,82-100,148-165,372 -413,448-482,556-669,693-724,781-781
atattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgt

SEQ ID NO: 84861 - DNA, 2110 bp, Heterodera glycines
  Genomic contig location: Contig_ID=SeqID_20074; Location=1..2110; Strand=-
  SCN-specific regions: Sequence locations=1-2,28-81,115-176,201 -236,262-286,312-368,494-523,545-677,766-919,941-946,993-1352,1419 -1558,1609-1760,1782-1909,1931-1988,2010-2076,2100-2110
  Gene Ontology: Mol. function=kainate selective glutamate receptor activity; Cellular component=plasma membrane; Biological process =synaptic transmission
aaaagtcagtcccggtcccggtcccggtagggtttcctataaagaaaatatgattcctcatagtttttttttaattgatacatattttatcattttttaaatgaaaatcctaccaatttgagcttaataatcgcaaaaaccaacctttttttgttgaaaatctgttaacaaattgcacccaaatttttaaaatttcccccggcggcgcctatcggcaccgccggaggggggacttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattaaataaaaaaccaaataattttgtattattttcacttgatataaattaaaatttgaatttttttttaaatttttaaattttttttgaatttttaaaatttcccggttggtcccggttcccggtttttcttgcggtcccggtcccggtcccgaaaaaaaatcgaggtcccggttccgaaaaaaaatcgaggtcccggttccggcttctcaggtcccggcaagtcccggtcccggttttggcaaaaattcccggtcccgtggcactctaaaataaattgaaccacgtaaataattaaaaatatttaaataaaatttaattaattaaaaagattttaaattattttcgaaataaaaaattaataataaataattacattcaaaaaggtgtcaaatgagttgaagccccgtttccgtgtcacaactattttggaacggccttatgtgatgttgaggacaaacattgaccacaatgacaaccaccaagacgcacatgaacaacaaaatgcaaaattcgaaggtggcactcgtttttggcattttttgtaaaatattggaaataattaattcttaaaaataataatttatataaatcatttaattgttttgctaatttgtaagccaatatttcatttttgtttaaggcttttgcattgatttgttgtctgagttggcccaagatcttggctttacctacacggcatgtcaaaaataaatttttttttggcattttcaaaaaacaaatttctgtgaattgaagatccacgttgtacgggacaacaaatacggtaaagacaacggtaacaacagttgggacggaatgattggtgaactgttgagaggcgaggcggacatggtgatggcaccgttcacggtgtgtgctgtgacgaaaatatccggcataggttttggacaatgactgaattatatgcgtccgtacaccacactaattaaaggaatttgaaaattaaaatttttcaaattttattttgggatttaaaaatttttaaaaataaaaaattaaattttgactctgggagaaggaatgaactaaaaggggagctattatagtaagatttatcctcctaaaggcatgcagcatattttttaatctaaaaattctggttctaagaaaatatttgcgattattcattatgaaatttgaaatctattaatttaaattttattataataaaaataaataagtaaataaatttttgactgtgtgaaagtagatgaacgaactgctacggcatttcaggccaattttcggcgtgccgaagtggtcgacttcaccaaacccttcctgtcgctgggcatcagtattctgtaccgtatcccggaagactaccaaccggtacagtatgccagccattccttctcccctctgctgtaaatccaattattttccaggacattttttccttcctgaacccgttgtccttggaaatttggctgtgcattttgctgtcaatttgtggcatcacttttggaatgtgtgtggaattattcgggaagggaaaattttcaaaaaattctcacccctccacgatttttcaaaaattaggtatcttgtagccaacgtaacgccgtatgaatggaatttgaatttttcctgctgcaccgcccgtcggccccgtccggcggcccgattttccaccgttagtgccgcgactgctccaacttcttctgctgctggtggtgctgcaccggaagaaaag

SEQ ID NO: 84862 - DNA, 718 bp, Heterodera glycines
  Genomic contig location: Contig_ID=SeqID_20076; Location=427..1144; Strand=+
  SCN-specific regions: Sequence locations=1-614,636-718
taatctctcatcgcacttcaactaaagaaccggaatccgcaaccccttcggcggggtgaccctcactttatacaatcccttatacttcaaatcctccggtctcatccaattaacattaatttcatcagtcttcggtataataatttcaggtaatccaatcgggtaagctgtaccgtaattcaccgacggatacagactcacaatgtcataaacactaatctttttcttctcatccgatttcgcatacaatttcatcggtccggtcctccctcccgcataagccatccgcggatcaataggccccttctcgttccctctgtcgtcgaagaagtcccgcatctcttcatcctttttcaactccttctcaatttgacagccctaaaaattcacaataaaaatgtaaatgtcaaataaacttacacaaacttcttcgacgtccaaagtcttccgcagctccgccaatctctcctgcgtctcatcattcaattcctgggccgtccttcctccaatcagttccgccgccgggtcataacagttcatacatccatgtatatagcatcccataacttcaatgcatttgtcgcgccctcccacattcgcaataaaaatccatccaatttatatttcccaactttgacctcccgtccgttccccgcgtgccgtatctcaattccatcccgcttgctccgccactccaaatactttattgccatcacgc

SEQ ID NO: 84863 - DNA, 1369 bp, Heterodera glycines
  Genomic contig location: Contig_ID=SeqID_20076; Location=1162..2530; Strand=-
  SCN-specific regions: Sequence locations=1-495,517-574,597-731,758 -1069,1091-1104,1126-1369
aaatacgtctgcttttttaatcgagggaggaagttttgtattgactgtgagtgcttttacgatcaggatgtttaccacaccttggagtgccgggcgagatgttattattgtaacaaagtgggaggagtgccatgtgaaaaggagaatggagttaaaattgagtgcccgaagtgccatcgctatttttacaattgggagtgctacaattatcatcagggacatcagacttgcagattatggagacgttgcatgatttgtgaaaaaacgtatcgatttaacccgaagaaggatcatgaatgcggagagacttattgccaactttgtagtgtgagccatgaccccaagcggagttgttatattatgccgatcgaggaaaatgaggacaaggatgtctacagaattgtagtttgggtaagatttaataaaacaacacgttaacaaaatagatattgattttcaggattcggaaacatcgcaggatacaatttacacgggggatcagaaggagcatgtaatcaattatatttcggtgagagttacgtgtacggaatgctgtgacgacaaacataggacgaattgtaaaatttgtggggaggagaggaccaaggattggagtgaggcggagggacatgacccaacgaaggattttgtagagtggatattaacggcatttaccaattacgatacgtacatttttgcgcacaacgccggacgatttgacggtaaattatcttttaaaaatgttttttattttgaaaatttcaggacattttgtatttaactatctctgccgtaccgggaagaacccgataccgcttatcaatggactcaaaatttatgaattcaaagtgcgaaactcgaagaaacattcaatgctgatatggagagactcatgcttattaatgccggtgaaactcgagtcgcttaaggcgaccttcaatttgggctgtgaggacaagccctttttcccgtattactacaataagaaagaaaattatggagtttgtttggaacatctgccaccaatggaggactattcaccggggtctatgaacaaggagaaatttgcaaaatttgaaaaatggtaagaaaagaaggacaaatcataataaaaattctttttcaggtacaacgagaacaaggggacgcccttttatttggatgaagaattgagaaattatagcagaaacgacacggagatattgctgttatcgattattgagttcaggaggatattgattaacgatattacgaaaggatttgaccccttgccgaggagctgtacaaatgcgggggttgcgatgaatatttttaaggcaatgtttttgttgacggagcagttatcgattgtgccggagaaaggctatga

SEQ ID NO: 84864 - DNA, 858 bp, Heterodera glycines
  Genomic contig location: Contig_ID=SeqID_20077; Location=144..1001; Strand=-
  SCN-specific regions: Sequence locations=1-118,141-156,178-251,273 -383,405-522,551-858
atggcccgcgctcacctggcggcgctcacctggctggcgctcagttggccgtgcacccctcccataggtatgggaggctaccgtaatccggaccttttgtgtgcactaactactgatggtttcaatctgcaagaaattagatcggcaatatgtggttgtaaaaaacttttgggtaatgaattattttttgaagtgagtcaaacaccgtattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaaccggcaggcaatggatggctttcaatctgcaagaaattagattggcaatatgtggttgtaaaaaacttttgggtatgcaattattttttgaagtgagtcaaacaccctattagtgctttgctgtgccgagaaccggcaggcaatggatggctttaaatctgcaagaaaatggaaaatatgtttcatattttattgctattttaggtgaagggtttcttaaggcaagaggacggcacgagccaaaaagtggtcaacgaatattatgaaaaatatgatggactaaatggatttgctgaatttattcggaattgggcctttacttttttctgtttccatgcctttgatgatgatgacacatctgatgaagactaatttcgttaatatttattctatgctctttgttacaaaccgataaacaaatccatcagggttatttgaacgattcaaaatttgcataatattttcgaaacccaatccgacggacataaaataaa

SEQ ID NO: 84865 - DNA, 388 bp, Heterodera glycines
  Genomic contig location: Contig_ID=SeqID_20077; Location=470..857; Strand=+
  SCN-specific regions: Sequence locations=1-128,150-260,282-355,377-388
tttcttgcagatttaaagccatccattgcctgccggttctcggcacagcaaagcactaatagggtgtttgactcacttcaaaaaataattgcatacccaaaagttttttacaaccacatattgccaatctaatttcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatacggtgtttgactcacttcaaaaaataattcattacccaaaagttttttacaaccacatattgc

SEQ ID NO: 84866 - DNA, 504 bp, Heterodera glycines
  Genomic contig location: Contig_ID=SeqID_20078; Location=72..575; Strand=+
  SCN-specific regions: Sequence locations=1-201,228-504
atgaacacagcaattgggacaatcaatccggagaaggacacggtggcggttgttgaacagaccaaaaccggctttgcccatccgttggacttcgaatttgaggatttgggtcagtccgaaaagcatcgaaaaatttttgtttactcaaaatttccaccgcaaaaaagacatttctcggtttttcctcctatgggacacggcatttttatatttaaaatatattttttcaagtttatagatccaaattaggcattttgtattccccccccaccctcccgaactgtttcaggtgacccggctgatgttctccaggacggcgccgaatcatatgacggcgccacaatgaaacgcccgtcggacaaaggcaaaggtgccaatgggaagagcggcatgccgaggaaacagtcgttgaaattgttcggcacgtccaacagcaacggcaaggtgtcgttattatggtgctatgacgttagtcaaaaaccatcaaatgaaaatattttttga

SEQ ID NO: 84867 - DNA, 469 bp, Heterodera glycines
  Genomic contig location: Contig_ID=SeqID_20079; Location=581..1049; Strand=+
  SCN-specific regions: Sequence locations=1-44,66-67,104-469
atggaatgttgggatggctatgctcttaatgataaggcgggagagggttgggaactcgctattaaggattgcggaactcctcaaaaagacatgcaaaatcagatttgtgcatattttcactgtacgacggcgggtaaatgttttttttttggcttaaaattgcgctcaggtttcgaaaaaattctttatcaaatatttttcggaatcggaattgctaggcccaaaaatatgtgcaattggaattcctatgccaaaatttttttcggaaaccggaattcctaggcccaaatttttttcggaaaccggaattcctaggcccaaattttttggtgttacaattaattaataattatgtatatgtgtagaaggtgacgaccatttggatatgtggtcatgtttcgctaatattaatgcgggaggaggatgtgccagcgatgcttttgctccacgcatcacacagcctgagtag

SEQ ID NO: 84868 - DNA, 84 bp, Heterodera glycines
  Genomic contig location: Contig_ID=SeqID_20081; Location=497..580; Strand=-
  SCN-specific regions: Sequence locations=1-34,58-84
gcgacacacactttctgcgacgactgctggcgacagcacattggccaatgtttgagcaacggccgagtgccaatcagctgcatg

SEQ ID NO: 84869 - DNA, 2933 bp, Heterodera glycines
  Genomic contig location: Contig_ID=SeqID_3485; Location=55..2987; Strand=+
  SCN-specific regions: Sequence locations=1-197,219-891,913-1368,1390 -1403,1425-1551,1574-1659,1681-1871,1893-2246,2268-2308,2341 -2392,2426-2488,2510-2632,2657-2815,2837-2933
atgagtgtaatgcttaataccgaccagcagaagcagaatttggacaccaaaacatctcaggtgaagaggacatttagtgatttaaacaacaccttatttatgggtgtaaagtctgttggccagggatagggagacctgaaaacaatgacattcagaaactcgaagtgatagaaaagtgatttaaaaaaacaaatttaggaaaacggccaattgtcagattcacacgaaacggcagttataaaagcgccgagtggagggaacagaaaagtgccaaagaactgctggaagaaggttaacattgacttggagtacaacacgagcagagaaatttcgaggaggcgacagttggcatggcgtggcgaaagacgcggcggcgaaacgtacggacggagggatcagccgaaagagcagaggaagggaagcgcaagagtggcggaagaaagcagcgccaggaaagacgaagcagccgaaaagagggacagaaacgaggcacaaaaagagacggcaggggaagcggaagacggacgagcggagggaggaggagacgaagagacggcacggaagaggacgacggccccgacaggcggcacaaagacgaagaacggaccgaatgaggacgggacggagacaggcacggaccaacaacagcaacagtcgagggactactggtaatggcagacggggaaacggcacggcatttggaggggggtgaaatatggtaattataaataccagtgtcatttgtcaatatttttaatttaagtgtcattaattttcgtttttttgcagtgccgggccaagaacgacaagaatgccttatcggtcgggcggcggcggaggcattggcggaccgagacggtccggcggcggcacagattattggcacaagaaaggcggaggaggcggcagtggtcaatcggggagaggaagtgaagacgacagggaacgacgtccgggcggcagttattaccaacagagaaatgaccgatggcagcggaatcaccacccaaatgcaccgccgccactgaatgttgcacaacgacgggcgcggggtccgttgcccgactgggacgaggtgaactttgtcctttctatgttatatcatttatcgtattgcctcaggtgcaagaagtcgcggaagacagctttgattacatggaaataatggagagccaatattcgtaagattgcgtatcattgaagttaatctaaaatattgtattaaattcagtcaatactatgccctttccgccgtttccccttttgacccttcgcttggagtcattgcttcagtcgcacatccctcgacacctatcatttcgtctgttgccgttaccgccgcgcatgccaacgtggtcagtgcgtcgaccgttccgcccgcctctctcctgtcccccaccggtctcatctcctttcctctgacttctcccactgcgcttcctccgaacgcggtcgtcgtggccacctctgaccaattcccgtcctctacgggcgccactcagttcactcccgtcgttctgactgcgcaattcccttcgaatgcgctattcgccacgcgaccgccgaccaccgctccttttatcgacgaacaaaaactgaaggacatcgtgcggtcgcaaatgtttgtacacctagccaggcccgtaaccgaaaaatggatttggcaagggttttttaatgtcaaaaacccagactggttatgggcctgatgccacgtagagtaaaagtgttcttttcgttaagtgagtactacttctccgctgacaacctccagaaggacttctttttgcgccggaaaatggacatcgaaggctttttgccactcggtttggttgccacttttccgcgcgttcgttcacttacgctcgaccagaatttcattgtctccagtttatgtgacagtgacaacgttgaactgagcgaggaccaccgaaaggtgctgacaattacagtctgatcaacatatttattaattttttgaaggttcgaccccgtctaaatccgcaacaatggcccctcgtggagtcggcgacgcacaccgaagcgcaaaactccccaacgacggcgagcggtgctgttgaagaaattgctgtggacaacgaggaaatggaacaaaaagaagaccagcacgaagaaaaggagggggcggaagagggaaaagagttggagcgaccgcagtcaaatgaacaacagcggcaaccgcagccaaattcatccgaagaaatggagacaacaatcggcacatcagaagaggaacagagacaaagcgagacagtcgaagagataatggaggagccaaaacagcagcaaaaacaggaggagaagggggaggaccaagaagggtggaaggaagtgcgcaccaagcgcggaaaccgcaagaaacagcagccgaacaacaaacagaacaagggcaaggagaacagcacacaccaacctcaggtcaaacaatgacataaaacagagacgaatcatctggaaaagtcccaattttcactttctttaggttatgcccgtcggttgggtgcaaagtacaaaatgattcgaagtttggaaattggcgttatgtgatggtcagcgcgggcaaatattattattttattctttttttgattctgacttgaaatgccttccgttgtttgttttctttccttttttgcgtattagcatcccttccgttgttgacttccatttccattattttatgctgtttctccatgaaattatcaccgctcatcgaaaagaaaaatcaaaaatttaagtcacattttactcagtctttcgagttttctttgctctgtatttcgagagaatgtcatggcaaaacataaattacaaaacagtttaatttatctccctcccctccacgaaaaatttactttcgattgccacccacatatatcatcaatttgaaaattgcctatcattgtataaaa

SEQ ID NO: 84870 - DNA, 1869 bp, Heterodera glycines
  Genomic contig location: Contig_ID=SeqID_3485; Location=3311..5179; Strand=-
  SCN-specific regions: Sequence locations=1-578,600-602,624-688,717 -885,913-1622,1645-1869
  Gene Ontology: Mol. function=5'-3' exoribonuclease activity; Cellular component=nucleus; Biological process=cell growth
atgtgccagctggaaatggtactaccccttcactacgcgccgtttgcctccgattttgaactgatccctgatttccaacccgacttcaacatgcccacgaaaccgttcaagccattggagcagttaatgggtgtgtttccttctgctagcaggtgtgttgatatgttttgttttgttccccgactggcacttttataattattcatttgcagagctcatattcctgacgggtggcgttggctgatgaccgactcaagttcgccgataattgatttttacccggaaacttttgaaattgatctgaacgggaagaaatatgcttggcaaggcgtcgctctgctgccatttgtcgaggaaaaacgtcttttggatgcacttgactcggttttacaatttttttttcaaaaaacaaaaaatattttaggtgtacgccactctcacaaccgatgaaattgcgcggaatgccaccggaccagaccgtctttttgtcggcaataaacacaacttgttttcgctcgtttatgaggtgcactcccaaaagacgacaacttcgataaaagatgaactaacaaatgatgacacaaaagaaacaagcgaagggacgcgagaaactgaaggagaagccgaggaaactcaacaggcggaaaatggtaaattaaaattaaattttgactaccaatcatttgccatataaaattgttttttaattaaaaataggtgaaagcgaacaaatagcgaaaaccgaagaaacgacggcacaagaggaacaagcgaatgaagaagctatctcaaaacctgaacaggcaccgaaacagggtaagccatttaaggcatttcctctttaaatatcgagatttagaattcgagactgaaattgaatttgtcgatgacgaagaaaagaaatgggtgcacatcgacgcagtcaaagcgtatgggatgtctggcgaagtgtcttatgacgtcgaagcactcgcttttggtgaggcgcataggtcgctgttcagaaattcgttggagtttggcgacatcaaagtgagttgttttacaaatagcctatgtttcaataaattgcatctcttcaggagaatacctgcattatggttcggtttttatcatttacaatgttcgatttatattttttgtgcacaggttgagttccgagatccccaattcccaatgcacttcatcttcaaagccaacaggctggacggcatcaaggaattgcctcgtgtgctcaaaccgaacgattgggaccaacgacggcacggctccttccaaccccaaatcggattcaggttcatcgtcaaattgttgtctcgtgagacaatgagcacttgacatttacagtcgtgacatcccacgtgcaaatctctccatggcgggccatcgtacgctcaaccaccacataaacgacaaccgtcgcagttgtccggcctctcttttctcagtgcaaacatcgccaccagcgcacacacttccatggcacatgagcacaaactcaccacaacaacaacatcaaatgcagtaccaacatcagcaacaatggcagcagggtcaattttacaacgggcaacagcagcagcagcccgtgccgttgttcagttttgggcagatggcaatgcccccgcctccgccgctcccaccgcaaaattggattactagtcacccgccaccacaaatccagtctcacgtgccgtacgggcagcccccacctctaatatcacagccaaggaatactcagcatcaccatcgcagaaacgacaacaacagaacttacaataggaaataattttcatcaaccgctgaatagcggtcacgatgtgattaattttctacgaaaatggtgttgccagaccctttctgaataaa

SEQ ID NO: 84871 - DNA, 350 bp, Heterodera glycines
  Genomic contig location: Contig_ID=SeqID_3486; Location=2888..3237; Strand=+
  SCN-specific regions: Sequence locations=1-350
atgtgtctttcaacggctgcagctgacaataaagttgtttcaaaatatgacgactatcagaaggaaatgcgtcttaagcaaatcgaacgcgcttttgacgaggcggtgagtcaattgggcttaattttcacacattcgaatttgtcaaaagattagttcagatgcctaaactgttgcacggctcctacaacaatttgatggcgttcctcgacacgaattccttccgttttgaagacaaagtttggctctttgagtcagagtgagtgaattgcgttcttatgagaaaaaactaattaaaacaaaggcaattttagtagggtaatactggagaattggtgtcccggagaaaa

SEQ ID NO: 84872 - DNA, 451 bp, Heterodera glycines
  Genomic contig location: Contig_ID=SeqID_3487; Location=214..664; Strand=+
  SCN-specific regions: Sequence locations=1-241,264-284,316-451
atgctgaacttccgcaattttaaccgccagtacagactgaaaaatgtaagtgaaatttggttttttatttttccgcatttcgatcttttcagttgaaatggtacgacggttactcaattttttacgtcaatggcgagggattggtctacaaagtgaccatccagcggacaatgcccgacgactcgctgaaaattgcctcgcttaaggacaagacgaaggagttcgtccaacgggtaatgacagaaaaatggggaaagggaaaatacaatctttaaaatgtgagcttttgttaagatagaattaaactaaaaatttccatttttagaagattttgccgaatccgagcccaaactgtgcgggtcagcaccagcaacaacagttcacttcagcaaattgcgcttcggaacggccgccgcgacaacagagaaacgatgggaggaggaaggaatga

SEQ ID NO: 84873 - DNA, 348 bp, Heterodera glycines
  Genomic contig location: Contig_ID=SeqID_20086; Location=806..1153; Strand=-
  SCN-specific regions: Sequence locations=1-15,64-172,194-348
atgaggtgttttttgaataatttaaattaaatttaaaaggttatatatttttttcaaattttagcacggaatatcgtcaagcatttcgggaagaatttccaataatattcaaacgaaatttaaatgtaattcaagtttctccgcagcaaaatggaaccacattcgctgcaaacaaatgattttcaacgctataaagataaaaattattttcgccgtttaaattgaaacatttttagtattgtgtaatctttaaattcgtaaactccaattttcatgtgcttagatttttttctcaaaaaaaagaatgtaaaatttcacacaaacaaattgagggctctaattaataaa

SEQ ID NO: 84874 - DNA, 353 bp, Heterodera glycines
  Genomic contig location: Contig_ID=SeqID_20087; Location=5..357; Strand=-
  SCN-specific regions: Sequence locations=1-37,77-209,241-312,334-353
atggctgatttgagcaatttaacggtaattaaatctgttaattataagtattatttttattaatttagtttttattggaattcgcaaatgaaactccaaactggaaattgatcagctgtgctgccatattgggtatcatcgcgaccatgggaattgtcctcaatttttcagtcatttatgtcaccatcaggacaaagtaattaaatacctttttaattaatattaatatttattattttaggtcactcaatggcaccgttaattaccttttgatactttgctcattttttgaaattattcaccaatctggtcattttttgtttgtttataccgcattttctggacaaatttaa

SEQ ID NO: 84875 - DNA, 850 bp, Heterodera glycines
  Genomic contig location: Contig_ID=SeqID_20089; Location=1668..2517; Strand=+
  SCN-specific regions: Sequence locations=1-251,296-325,348-461,490 -514,546-804,826-850
atggaagagcaaagaaaaaaaaccgaagtaaaacggcggaaaggacgaagaaatgaacgacacaagcagccaacttcaagtgttcttgccggaattcttgaggaggacgaagcaagattatggggagaagaaggaagcaccgcttctctcgaaggaggaaaagttagcattttgttggtgctattggagagcttttcctctcatcaaagtaatttgttagggaggggacaaggaaatttgcaaaaacatggaattttaatttgtaaatttatttatgatttaataaaaataaattcgtaggttttgaaacataacattaggtgcattttgggtttttaaaatttaaagttgctgaaataatcaataaatttgaaattcaagtcactggcttcgggaaacaatgtgcttcaggttaaggggatttttaaaaaaatttactaattaatacatacagtctgttcaaaaattattgaattttttataatttttgggatttttatgactttttttttcactttttaaggcaaaatttgaatttcagcaaagattgctgaaaaataaagatatgaccggtaaaaaggcaataaaatccggcagaataaattgttaaaaaatttgattttttttaacttttggctaattaatatttaagaacttttttgcttgtttctgacttttttgcgattttttatggcttttttagtcgacttcttggagatttttcgtaatttaaatttccagccctaatcatggtagaataggtcaaagtcccctgtggtgctaaattttgatcattgcagatcaccctgatggagtgatctggtcacggtggtgcaagtgccttttttga

SEQ ID NO: 84876 - DNA, 486 bp, Heterodera glycines
  Genomic contig location: Contig_ID=SeqID_20091; Location=646..1131; Strand=-
  SCN-specific regions: Sequence locations=1-21,270-270,325-325,401-486
atggcttaccaattgacgccgatcattatgttgcgttggttgttcgttgggcttgtcctctcctcgcatcaacagatggcacaaatgggtcgaatggaaggggatcaaaagcgcggcatggaaatgggccaaatgcgcggcatggaaatgggccaaatgcgtggcatggaaatgggccaaatgcgtggcatggaaatgggccaaatgagcggaatggaaatgggccaaatgcgcgggatggaaaggggccaaaagcccggcatggtcataacacaaaaatcagaaatggatatggcacaaatgcgcggcatggacggcgatgatggccagatgcgtgcttcatgggcagcatcgcaaaaattgttacgcgcagaggaaaaggaaaaagggccgaaatcgcaaaaaaatgaaactgaaaaggtgaagaagacatgcgaaatgagatgagtttggtaaaacggaggacaatttcaattttaaattaaa

SEQ ID NO: 84877 - DNA, 437 bp, Heterodera glycines
  misc_feature (356)..(356): n is a, c, g, or t
  Genomic contig location: Contig_ID=SeqID_20091; Location=18..454; Strand=-
  SCN-specific regions: Sequence locations=1-437
atgctacgcacactcggagtgtggcgcaaggagcaaatgcgaaccggcgacgctggacaggaagaagaaggtgggcacgtgcgactgcggcgtgtgcgggggattccaactgttattgctgtgtgagttgggctaattaatgaaaatacattaaataatgatttatgaaattactgcgttttttgttttgtcatttctattcaatcagcgaaaaggtcgatcctatggatcactttttgacttttgttttgcttaaggcggtctcaacagtggcgccctttcccttgacaaaaacattgtgccgcgggagtgtgccggactgaaagatgcttgtgtcgaaaagccattattcgtgngcagcaaatccaaaaagtgcgactgcgaagtgggcttccaaaaagcgggctttaaagaatctgaggggatgacagaggaaa

SEQ ID NO: 84878 - DNA, 2656 bp, Heterodera glycines
  Genomic contig location: Contig_ID=SeqID_20092; Location=119..2774; Strand=+
  SCN-specific regions: Sequence locations=1-22,48-133,155-158,200 -485,507-1000,1023-1270,1292-2029,2051-2304,2327-2502,2525-2656
atgcaacaaattaacggaattattatgaaagtgtttcctttttaaagaatggccaacatttttgagacattccatcatataaaactcagatttccgtttcaatttaccgtagtatttcctaaaattatgcccatggctcacaaactctacaaagagggccttcaataattcacaatttttgaaaacccaaaacccttttcagcctcctcccgccagtgagtacgaaattcggtgttacgcctccgcgccaaccgacgaaagcggcgaatcgtcgccggcggctgccaacccaaagccaaaagcgatgcaaaagttggaggaggagcagcgcaacgaattcctcggcgagtacggcctctaccgcagttcggcacttcaaattgcgaagaatgtgatgtccaaactgttgcaggcgcacctagtggtaagcagccacagtttctgtgttcttggatgggttttggcatttaattttgaaaaatgatggaatggttaaaaattaatttaaattgaccattccgtgcattgcgatggggggggggggagtcggggtgtcatgacaattcgtacacagacaatcgtacaagcttaaggcttaagcctaagctttaggcctaggcttaagcttatgctttattttgcaaaaatttttattgtatgcgttgcaattgacccgaggagtcgacggacgactaaccataattatgttttccgatagtggaacctatgtttttcctccactaacatttgtcattatttgccaaaatctattccgcaacaaatgtgtttaggacgacgattctctggagacgagtctgaaccaatgggacgccatttttgaggccatgaaaaaggcgggtgccgcggcacaacaaagaggcgcacagccaccggcgggtgaagaacgggcgacggagccgaggggaggcggcggaggggaccaagggtcgtcgacgcccccgcattcggtgatttaactgtcataattcaaattgcataatttttcctccctttttaagcctccgacaaactctgacgctggtccaatgtcgcaggcgttggtcgaccgtttctggcgcggggacgtgtgcctgcagggcggcacggggtggtggaagcacgaggtgtgcctgggccgtacggtcagccaataccacgaggagacggcggaggacggcaccaaacagcgacggcagaccattctgctcggcaaatttgacgaagcggtgcacaaagtggggattctttgcggtttcgaaacttttttttgttggaaaaacccaaatttagtggcaaaattctaaaaaaaaatttttaaaggcatgggccacagaacatcctggcaaagccgtggagcgcaaggtggacggatcggtggttcaagtggcacacatgtacacacagggcgatgtgtgcacggagacgggtgcccatcggtgagaaattttcaggagggaagagaagagcacggttttggtgcatttgagaaactttagatgttaaactgttcatgtttgttttttgaattttaggctgggaagaaatgctcattcttaatcattcccattttttatatttcctctatttttctccagggactgtcaggtgcgcatgaaatgccgagaggacatcaatgcccagaaggtgttcatctacatgttggaggttggtttctttacttgtatcattaaaaataaataaacgaaaagcggttttaaaagtgctttttttgtacgttttgctattttgatttcctcacgttcacggtgttcatttcaaaaccaacaatacgtttttacattttgcctttttttgtcgttgtacgttttgccatccccccccccgccctcaaattcttttgcttttttccgtttttcaatcacttttttttcgctactaaatttagcccagcacttgctcctacgtggtggtgctcgagtcgtccctgttctgctccaaactgcagcgtgtggacgagttcggactgttgtcagtggacgaagcggcgaaagcgagcgttgccgaaaaggaaacggcgcccgaacagcaaaccgacgaccggttgatgaagaaacgcacttttggcgagaacacggtggtgttggacctggcaaatcaggtgggccgagccaaacggcagtttattttggtgttatcagaccaatgttcacaaatgggttgccagagggacggtccccatggaatttagggcttccagtagggaattgagtggaggtaccatggcgagtgttttccaggcctgggtttttttctgggtccgggtccagttcattttacggcaacctacattttcctggttttttatccaggtccaggctttttaaatgtcgattagtcaaaaatgatgtgatgccattttcaggaggaaataatgcgcgtggtgcgacaactgctcgaaggggccggcgatggccaagtgtttgtcagtgcggccaaactgaaaattggcaaaggcgaagacagtgaagaggacgaagaagcggaacaacaacagcagcaagagggaaagagcagagaaacggcggaagccgaagcagaacatggccaagggagtgaggcggaaaaaggcattggacgagaagagcaacagggacagacacaggtgacgacagacaacgagactgaccgcgagaga

SEQ ID NO: 84879 - DNA, 755 bp, Heterodera glycines
  Genomic contig location: Contig_ID=SeqID_20095; Location=467..1221; Strand=+
  SCN-specific regions: Sequence locations=1-478,532-755
atgagcaaatggacagaagtgagagggacaaatgccaaagttattaacgcaattaccgaattataaaacatttgcaggatggcggccaacgagttcaaatgcgaaatgacgaaaggacggcgacagacaaaggaccgccacggctaaatttgtacagaaccagccaaatcattgcgcagttgcccagggatcctccgcccgaattagacgaggccgacgaatgggaagacgaacggggcacaaatggactgcacggagatgggcaccatgggcagcctcctcctccgccgggtgagtcacccactttttacaattcctggccaattacacttgagtcctttttcatgtccagttcgtccccttccccctaaatgcctcgggctttagccaattagcaactcgctaatatccattccatctctgtccatttcagcaccggcccctttcgctccgttggaagtgtttccgcttgcgcttccctcctcctcccgctccgccccgtcctcctcttacctccgcttgttctcctcccagccgaccactcctcgccacgctcctcccaatcatccgacattcgctcaaccgtttatggacgacgaccaatactatcagaggcatttgcgacaacggcaacttctgaacgcgctggaggggtcgattaatacgccgacagtgcgcacggaacagagacggattattatggagacagaaatgacaaatttggtctcaaaaagataacaaaatgaaattgaaga

SEQ ID NO: 84880 - DNA, 151 bp, Heterodera glycines
  Genomic contig location: Contig_ID=SeqID_20096; Location=579..729; Strand=-
  SCN-specific regions: Sequence locations=1-151
tttacgcgtcccatgacactttacgcgtcccatgacattttacgcgtcccatcacattttacgcgtcccaacaacactttacgcgtcccatgacactttacgcgtcccatgacattttacgcgtcccatcacattttacgcgtcccaacaa

SEQ ID NO: 84881 - DNA, 137 bp, Heterodera glycines
  Genomic contig location: Contig_ID=SeqID_20097; Location=300..436; Strand=+
  SCN-specific regions: Sequence locations=1-137
atgatggcttttgtaaaatctgagctcgcccagcagcacgccgtacgagcccaacaattggcccgtcgaattcgcgccgtcgctgaggcggcgccgtcgtcgcttcgactcgccagcggcgccgtcgaacttcaaca

SEQ ID NO: 84882 - DNA, 1753 bp, Heterodera glycines
  Genomic contig location: Contig_ID=SeqID_20098; Location=19..1771; Strand=-
  SCN-specific regions: Sequence locations=1-388,411-545,567-899,940 -1205,1246-1301,1324-1487,1538-1753
atgaggaatatctataattttttggaaaccaatttgttaaatgaagaggaattgaattacaaaatgaaagaggaaaaaagtgaggaaaatccatcaaaaaatgaaacggaaaaaaatatttccaatctccgaaaagaatttgacggattaatggaaaatatatgcaaaaatgccaaagaagaaaaggcaaaattggaaaaagcaattgagattgaagtaaaaagttcctgtttatttttggcatttctatacaaatgtcccatttttcattgatcatgtttctgtcttcttctcccattttttccaatttttcgatttattttggaattttcttttccattttcactgatattctttggaaaaaagtaaatttacaaaaatgggtcctcaaaaacattaactgttttaaaacgtgcagcccgaagaaagggtaaaataccataataaaatttaagtttgaattttgtttattgcgctaaaaaaccgccgcacactcgactacggcggccagtaggtggggcgagactacgggctccggaagcacctaaagtatttttgtgatttggcttatctaatattttttatgtcattttcttagataacttttgtaaatttctttttttccaaaaagttctttcggattcgtgggttacctgcagagaggaatcgattggtatttattttgtcgcaattccatgcgtttttactagttggacggttcagtcccaaaggcatttggccatttcagtcccgggtctgtaactcttcagggattggttgccgcaaaaaaattctttcggattctttcattacagaccgagagctatcgattgatatataatttggccattttaggctccgggccctatgaccgatatttaccgagccaacttttggggattttaatgaaaaaaataaataaaaaatatttcttaaatacctatataagtaactgagcccaaaacttaagacaagcgaaagacaagcgaaaggaattggagcaaagaataatgaagctttaccaaattcgaattgtaaaaaaatgattaattttaatgaaaaattgtttcaaaatcggagattgccaaagttagacctttttttaaaattttgagagattttttaagcccgaaaatgagcattcatatttcataacttatgaaaaattgaaaattcggcgtttaaattttacaaaaaaaagtccgaattaaaaaaaaattacaagaataaaaatttaaaaaatttccaagatggtagatcaatgtcaaaataaatgtaccaaattataattattgtactccataaataatgtgacttaaactcatcaaattaaaaaatttattcaataaaatcaggataaacttttttttgttgttgagtttttggattttattaagactcttattgggcagagtgccaaaaatatcgtaattaattgggcatttaatataaatatttattccaattacatgctgaaggtttgtttgaaattttcaatttttgaaataataatgacaataataaaataatttattaagctaaaagtccgaaggtgccgaaacaattgccaccactgatcaagccaatatttattgaattatattctccgaagaatttaattgatgttgttgaaacattgaatgataagtcgaagtatttttggaaagaaattgaaaatgaatttgattatttcgataacaatttgaataaagaggggaaaagtggagaaaacaaattcatcaacccaaaatga

SEQ ID NO: 84883 - DNA, 114 bp, Heterodera glycines
  Genomic contig location: Contig_ID=SeqID_3490; Location=540..653; Strand=-
  SCN-specific regions: Sequence locations=1-114
atgtgcaagagaaaagagttgaggaagaaaaattatgaagaaaaggaagccaatgaatacggtaagggagcgactaactacggtataataactgtaattaattatgatgacacg

SEQ ID NO: 84884 - DNA, 111 bp, Heterodera glycines
  Genomic contig location: Contig_ID=SeqID_3490; Location=5135..5245; Strand=+
  SCN-specific regions: Sequence locations=1-111
ataaaagtcgacgtagaagcctcaaaccaagtggaaaatgtgttatttatgcttaatatatcgaaactagtgcgcagaaaaaaaggcatatgcctcaaaagtcggtctcta

SEQ ID NO: 84885 - DNA, 2584 bp, Heterodera glycines
  Genomic contig location: Contig_ID=SeqID_3490; Location=1743..4326; Strand=-
  SCN-specific regions: Sequence locations=1-38,60-113,137-344,369 -786,808-1178,1201-1272,1392-1404,1521-1530,1558-1579,1620-1622,1644 -1647,1671-1711,1733-2195,2231-2331,2371-2412,2455-2489,2511-2555
  Gene Ontology: Mol. function=GTPase activity; Cellular component =cytosolic small ribosomal subunit (sensu Eukarya); Biological process=N-linked glycosylation
atgtatgatattatttcagtgttcaaaaatgaaagtcggctttattcactttatcttgagtttttgaccatcaccaaatcaatgaattggctgaatgtaaaactaaaggtattaaatgcaattttaaaattaaaaattggccactttttaagttggatttgttcatttttgtccaatggaccgatgccaaaatttccaattccgccgcgaccatcgcccggaaaaaatgtgccaatgtttggaagcggcacaaatttttgttttaccaactgtacgaccgttggcatgacgaaccgctggacgaaatgccaaactttcaaatttatcaatcgatttttttgagtgaaatgaatttattttttgaaaaagttttggagggaaagcaaatgaaaagtgaaaaagcaatggacgaggaaattcggaaaataattgaaaaagcacagaaaaaatacgacgaaaagaaagggacgagaaaagtgaaaggaaaagcgaaagaaagtgacaaaaacggggaaaattatgcgaaatttgaagtcaaattgggcgaaaagaatgttgaaacactgagcaaattggtggaggaaaacgccattttcaaaaaaatattaaaaaccagtaagaaaaagaaaatggacaagagattactgtagattagagtttagcgttaccagcagtaccagtaattaattacctttggtacggtaccggttctttcaatttttctaatagcggcggtaccagtactatccggtaaatttacactggtaagaatgtgaatccgagctgatttttcatgagaatttgggaaaggggaaagggatattttgaacatttggccaatttttaaaataattctcttttttaaattttgctataattttcaatgaaaatctgttaagaaatcggcgcaattccaaaaattttcacggcacctaaccggtaccgctcaattgtactttagataattagaataagaaatggcaaaatgttaggcatcggcgggtggtaatcgaacccattcgtcaacccaatccgtgggcagatcaaccattgcgcttacgaggcgaggcatatccgccttttttatatcttatcaaccctcgctttaatgatttaactacccaaccagcttcttctttttttgaaaatttactttaattacctaattccagtttatgaatcatttgttgatgtaaatgatatgccagaatatttgggtaaagaaacgacagagcaaatttggaaaacattggcaataaaatattttgaaacagaggaaaaagaaaaagagaaagaggaaaaagaaaaagaggaaaaagaaaaagagaaagaggaaaaagatgaaaaagaaaaagcgggaaaagaagaggaagaagagaaaaaggaagaagcgaaattaaatgcaaaaaagaaaaaacaaaagagaaaaaagagcaaaaacggaaacaaagaaacgaaagaaaacgaaataaaagcggacaatgggaaaaacagcagagaaacagaggaagaagaaagaagatcattctcaacagcagaagaagaaaaagagagttttgcaatgggaagagatacagaaagaaaagagcaaatgaaaacaattactgtaacaaaaagtacggtagaagaggggaaaggaggaaatggtaagggaaaggaggaaaaagagacagaaccgccaaatgaagggttgatggggactgaggaagacgaaggcgaaaaggaaggcacaaaactgatcaactttgccactgatcagttcctcgcattgaaatatgccgaaattgtcaatgcatcggcaaaagaacagcaaaacgatgacaccaaaatgacaagcgcaatcgaattggcaaatgttggcattttggccaacgaaattgccaaccgattggaagcgatcgaatggctggacgttcagagaaaaagcgacaaaacaaaaagcatttccgatcagtgggagagactgaaggagatgaaatactcggcaaaacattcttatgaaggcatttcgaaaaggctttttcagctgctaatggaattgtcgggggaaatggacaatttggggacgaatttggaggacaaatcggacaaattggaccaggaaaatgaaaatataaaatgggaaaattggaaagaaattgtgggaaaattgcactttcgaaaatttggcattgcaattgttaagggacgaatagaaaattgggaaaaattgggccaaaaacagaaaacattggcactttcgaatattgtcgaaaaaagagaaaaaattttggaagaatttgaaagaaatttggaacaaattgaaaagtcggaaaaacagcgaaaattgggtaaaataaattaaaataaataaattaaatttaaattaaaaaaattcttagacaaaaatattttttgtcaatatcaaagcgacacaaatttatcggaatttattgaaaagaaagacaaaataaattttagtgagaaaaattcgcaattatttccatcagaaaaatggcaagaaataaattcagtcaaagaatttgagagaacaaatttagaggaaaaggaaaaagtaaaaatttaaaaattaaagaataataaa

SEQ ID NO: 84886 - DNA, 1175 bp, Heterodera glycines
  Genomic contig location: Contig_ID=SeqID_3491; Location=580..1754; Strand=-
  SCN-specific regions: Sequence locations=1-30,53-351,374-479,511 -530,552-1175
atgaacatggtcagaatcggtgaagaaaatgacaaaataattgtccaaaagacggcaaatttggaggaatcgctctacggcattttgtacggtttggagaaggaaaaccgcggcgacacaaacgacggactgacggcaattaggacgaaaacgatgctgatacatctgacggaacattttgtgaatttgcacaacggaagcgaacagctcagacaatgttttgaggggcaaacattcattcggttgcgctttaaacgattcgtcaaaatcatggaggaaaatgtggtggacgagggaaaggtggtggccgaccaattttggcacatattcaaaggtggcacggcacattcaaaaaataatcaaataaagccggaatcgttttctgcaatattgccaatgaacgatgaatgccccgacaaagagttctcccttttgcattcggcagaaaaggaccgcgttgacatgacctttggttggccaaattaaatattttttaaattttaataaattctttctttttttgcggcgctttttacaaaaactttttttttgggggggggggggtccggcggtgccattaggcgctgccgggaaaatttttgtaatttttaatgagatttgttagcaggttttgtcaaaaaaatgacaaaattttgaatatttttagcaaatttttatcaaaaaactgctaattttgtggattttcgggaaaatttagcaaaattttaaagaaaatttgactgagttacaatttaatattaatttcagattcctatgcactgatggagcagtacattcagttgttgtgggaagagaataagcaaaaatcggaaatggaaatgaatgaattgacaaaaagtgtcgaaattggagcggcacttttatactatgggcaaaaggcagaaaagctgcttaaatatgcacaattttatgtggaaaatgacatttttgcggacgaaattgttgtttatatgagcaaatttaataaactgatgaaagtgccaaaaagtgatgaccaaaatttggaggggaaactgtgccaaatttaccaattcatgcacaaattagtgaacgatgcgcaactgatcgaattaagcgaggaatggaagaagctgttggaggagaatgtcaaggaattaggcacggagccactggataagcaaattagccttgag

SEQ ID NO: 84887 - DNA, 507 bp, Heterodera glycines
  Genomic contig location: Contig_ID=SeqID_3492; Location=15..521; Strand=-
  SCN-specific regions: Sequence locations=1-95,138-199,221-288,310 -341,363-507
atgagatcaaataattgccaattcattcctttattttctttttatattttatttttggcaagtcaaactttttcgaaaaatttgttcggtaattgtttttataaattcaaaataaattaataaaaacaattttttttcaatgtttccgcaggcatcgacaccaatcgtttggatgaatattacgccaaattgcttttcgatgacaatttgtcaattaatgatcaaacgattctgatcaatcgcttgtctgcttctcatctgcaccggagaataaaaaaagattttgaggaatttgaaaaaattattaaaccgaaaaagtcggccgattggttaaagcgcattaaaatacttaaggataaatttgaagaaattgaaaaagaatttgctaaggaggataaatttatgcaaattgttctctccaatctgtgccatttttggcagctgacaattttattagacaattttaaaagcggactttcaacgatttcattaaatccaattgagtaa

SEQ ID NO: 84888 - DNA, 1142 bp, Heterodera glycines
  Genomic contig location: Contig_ID=SeqID_20099; Location=259..1400; Strand=+
  SCN-specific regions: Sequence locations=1-120,143-313,336-479,501 -734,756-826,873-958,990-1142
atggtccgcgccgaagtgaccccgaccctgatcaaaatgggcaaaatgggtttgccaaatgtgcgcaaatccatgagtttgctaggagcttattcctctgatcaaactccagcagcagttcatcttccctgcccttatttgttagggggggggggtgatcaatttggggaggaccatcttcccccgtgggaatgggagggatgcttccaagcggaccttgcgctggggatcaataaaaaaaattccatctcacgacggtgggattaatgggcaaccgatggacgacgacgattggtgctgaatggaatttcaaacataatattttcaaatattagcaatttagtgagccaatcaaaaccatagagggttcctaactaatttgttagcaattttttcgactttttttgccaaaaactatcatttattttccaaatgtgaacaattcgtgtcaatgttccatcaaaaatatatatgggtcaaattgtgccttctgttctctccaaataaatttcacttttacgtgcacatgtacataagaaaacgtgaaattacaaattacaattttgtgggtctaaaacgatttaacttttacgtacacttttacacaagaaaaacgtgaaatacaaattacaattcatttttgggtacatttcacttttacgtgcacatgttcactaaaaacgtgaaatacaattcattttttggtttttacacaataaaacgtgaagttgcgattaggcaattttctgtgtttttgtacactaaaaacgtgaaattacaattttgtgggtctaaaacgatttaacttttacgtgtatttgtacacgagaaaacatgaaatttaaaattacaattcatttttgggtacaatttcacttttacgtgcacatgttcactaaaaacgtgaaatacaattcattttacgggattttgcacaaagttttgcaggtaaagaatgaaaaaaataaataaactaaaaaaataaatatgtctatttagctccaaatatcatgaaataatgaaaaatgaatttccttgtgtcaaatttttgctgtgctcaaataatcataaaccgccggtcgttgttgtatccgtgtcatattattatgaattaagaatttagttttttagcaaaattatga

SEQ ID NO: 84889 - DNA, 611 bp, Heterodera glycines
  Genomic contig location: Contig_ID=SeqID_20099; Location=2129..2739; Strand=-
  SCN-specific regions: Sequence locations=1-159,207-214,236-407,450-611
atgctttcctattgggttcgacgatggtgctttaaaaattccagcgacaaagaaacaaaaatgcgaacggatttgcaaagaacagcgtcaaacaattaaatgtatcaatccgaacatcaaactcaaattatatgagcagctgggtgggtggtggaagagaattttttaataaaacttaaattatttttattttttatattaaatttgcctaaaaaattacatgttttcatgttcctaaaattagaagccctggggggtttaatttatattccatatgactcattttaaatgtttggtaatacaacttggctttgtcaccttgtttgttgccgctttcccattaacacctttgtttgcgctgatcaacaacatcctgggtcttgaaaattcgaattcctatggccgtcaaaaaattttaattttacaaaaattcttaattaaaattaattcagaaattacatggtttccttcaaatttactttttcatttactaaccctatctaatgattgattgatttcttttgatggtttttccactaattttttcaatgtttttatttatttaaagattactcaacaccttttcaatagaagttttatttttaaataaa

SEQ ID NO: 84890 - DNA, 1122 bp, Heterodera glycines
  Genomic contig location: Contig_ID=SeqID_20100; Location=173..1294; Strand=-
  SCN-specific regions: Sequence locations=1-1122
atggcatttggagtcagtcgtcagctgactttcgatgaattggccgtgctttgcccagacgaaaaagagttctgttacaaaacggcactgttgggcaattgttttgggaaatcagtgaaggcaaaactcggaaattttattttatcagaaagtgccaaaattaggcaaaattgctggccaaacagtgcaaatgttcttgtgaaagtgcacagcacagacgcattcagaactgttgcagaacggtgagtggtgaaagtcgtcggatatttttcaaaaaacggtgctttgaaggtcggagaccacgacatgaacttttgcctccccctctgcggctataacaccaccgttaatgaggttcttttcctaattgcccttattaaattactcaatgccattgtgctcattgtcagctggggagtgcccttggcctgaagtgcgtttcgcaactgacaacatgggcatattgcgccgggggttggccaaccttttaagcccaagaaacattcgctgcttaagatgccaatgacaacacaaagtgttgcagggggaaaggtcgacaattattggcaatcagaaaacactgtacttttaggagttgaggacaaatgtttgagcttttgcaagggcgacgtgtaaaaaacaattgggtgcctaattaagcttaatcccttcaattttcagcccgacctgcgacgtacaaagcatcttttcttatcaggtgaagaggaaagaaaaatgtttgacatcatttggtttctgaatttatagccgtgcctaatgaaccttaaaaaaattcttgaatgccaaatggagaatttggacggcaaaccgaagttcgacccgcaatggagaccaaactgcgattgggaaaggaagtgaaggaaaggagaccaaagagaagaaatgcaaatggatgaatgaatcattaagaaacaaagtgccataatttaccgtaatgatttatgcatgtacagtataagccatgtgcacttttgctgttggggacccccgaagaattccaacgggggacccttttgtagggatttgaaggtttaaatagatgtcagattgtgattatgaccccgaaaacccccaattgacaaaagaaatttgcaaaataaa

SEQ ID NO: 84891 - DNA, 1186 bp, Heterodera glycines
  Genomic contig location: Contig_ID=SeqID_20103; Location=234..1419; Strand=-
  SCN-specific regions: Sequence locations=1-69,91-472,494-1186
atggagacggtcctcagaccacaaactacgaccaacagagaagcggagaaatacttgctgaagcggggcgtaagttttctttctttagccgctctattgcactttaggcgtccattcgacttttaggcttccgtttgataccacaaatatagccattgatcaaataaaaaaagttatgacctaagaaacgatgagcgtggttgctcattggttggacgtctaaagtgcagtagagcctctttggtctttaactttcccagtgtaattggcatgactcattttttcagattgaaaagggcagcactgtaatggctgtaaaaaaggaaccaggaaaaggacacggatcaacaattgcgacaaatgtcgtcaccaatgtaagtgggaacatgacaaagcgtgtacgacggacacgccttttgtccaaaatcggattttaagtttttttttcattagagctcatagcaacattaaagctaagaaaatattgtcttttggttcaatagaaacaataatccgttgtttgaaacattttttttcaaaattttgctaacgatcaataactatcggatgcaaaattttaagctctagatcatatgggattgaaaattttaagtttgaacccgatttttgacataggcgcaaatgtcatgtaacctgacaaaatgactgtgacatgatgaacatagttttataccaattttttccccattttagctgttcggcatagacatgaaacaaccggcgaccgtgttccgttacgaagtgaaaatcaatggacaaattgtccgccaaagtggagaatgtttgctcgtcgacattaccgagacaaccaaattcgagtgtgtgtttcatcgcatgcattcggaaattccatttatattttaattgcttgttaagctttctgaatgtggaccgccgatatttgtgccgcgacgtcttcagggaatttgagcggcgaattgagacgaaaggcaacatgctgtactacgacctgtcgcacacactgtttgcgctcaaaaaattggacatcaatgaggtttgccacacttcgactttcctaacctaaatttctaaaaaaaaacctaaatcgaaaaattgtttgtttcaaaacatttgttagaattcggatttttggattggaaatgttccccccccccttgtttttcatatctgttttcttattaaa

SEQ ID NO: 84892 - DNA, 252 bp, Heterodera glycines
  Genomic contig location: Contig_ID=SeqID_20104; Location=893..1144; Strand=+
  SCN-specific regions: Sequence locations=1-8,80-252
atggagtcaatatttttttatcaattttaatatttaaaattattttttaatgttaattatttattttttctaaattttaggcatttgcctaaaaatggagtccctaaactttaccaatgcgcaaaacataaggatacatttcctccaacaaaaacaaatcaaacgaccccaataaataataaagccaatctttataattgtttatgtttttattgtagcacagataatgctgaaactccgtcgattccataa

SEQ ID NO: 84893 - DNA, 667 bp, Heterodera glycines
  Genomic contig location: Contig_ID=SeqID_20104; Location=1185..1851; Strand=-
  SCN-specific regions: Sequence locations=1-24,47-78,100-133,155 -207,248-317,341-357,381-392,420-475,498-667
atgggcgactatttgggaggaaagtggctatttgtcattttcaacatcgatgttggcccaaaattcagccaagtgagcaaaaaataataaataaataaagagaaagaaaaacggcacggaaattgggagaactattgaaaataaatttaaaaaccaattaaactcttttaatttagaaacgttttacataatagataaattgtcctctttttttagttttttttttttgctttttttatttttttttacttaagtgatattaatggcccaaaaattaaaataattaattcattgatcccggctaatagttgagtgtctgagtattatattaattttgtttttggagggtcattgggtatttaaatattttaaaatgtattcgagtttttagtgagattaagaaaaaccagaaaaaaaaacttttttttttggacaaaatcttttaaaaatcgtataaaattcgaaaaagttccgcctaaaacctcttttctaaaattaaatcaccaaattaagtactcattcaaaacgctaactgaagccgaatatgcggagcatgaaaaaaagtgtgatgaattggaatattcaaacaaaattgcgaacaaattgatgtaccaaaaatgcaaacaactgttttataagtaatcggctgaatttaaaaacaaataaa

SEQ ID NO: 84894 - DNA, 482 bp, Heterodera glycines
  Genomic contig location: Contig_ID=SeqID_20105; Location=992..1473; Strand=+
  SCN-specific regions: Sequence locations=1-97,119-140,202-271,294 -370,433-482
atggcattgattgcgctttcattttattgcattggcattttgttgttgcctgcaacaattttttcacaaaaccgacgtggaaattcagagtttgcgcatatttgtggcaaatttcctaatcgatatttttcttatgaacgtaatttattataaaaaaatatataaaaaatagttttttaaatattaaattttaaaaaatttcagcatgccctgaggatgagcggcaatcttcacagaatcaacgaaaccgaaatgatcaaccgccaagacgtgatcagcagcaacaacaacaagtttgcacaagacaaggatggcaaccgattggaattaaatgccaaaatgttaatgattgctatcaacaccgagaaagtattttaataacatttcaataatttatatttattaattttataatacattctattaaaaatagaaaatgcacttgccaaattcattttggaatcactggaaattaatatcga

SEQ ID NO: 84895 - DNA, 355 bp, Heterodera glycines
  Genomic contig location: Contig_ID=SeqID_20107; Location=148..502; Strand=+
  SCN-specific regions: Sequence locations=1-245,267-355
atagtagagaccggaaatttcaaatttgcggatcctgttgcaggattggaattcaaaattttttacaggacaggatccggcaggattaatcctgcaaatcctgcaatcctgcaaatcctgcatttaaaatctgcaggatcctgcgcaggattgcggattttaggaaatttcaaaaaattctgtattaataaaaaagtctttcaaagtataaaaaagtattcaaatatatttttaaactaaaaaatgatgaagatgaaaaattaataacgtatttttgcttacactccaagcaatcggctgattcttctttaatgcgtttaaaaagaccgatttgccaaattgggtggctcataat

SEQ ID NO: 84896 - DNA, 514 bp, Heterodera glycines
  Genomic contig location: Contig_ID=SeqID_20108; Location=159..672; Strand=-
  SCN-specific regions: Sequence locations=1-249,280-373,406-514
atgatcttgtcctcactcattcttcttttgctggacagtaagttaaaagtaattaatcagggctgccattcgtactttgatgccaagtatgtgcttggatttcggcgttcatgcttggaaaattttaacggtacttatttccaagattatgcttggaaaaagcggtatttttgcatatgaatgtaaaaaaaggtccattttatgaaagtttaaaattatggcattcttttttcccggcggcgctgccggaatctctctttctttctttttaatttggttcaaaagctcacccaaaaagcgtaaactttgaacaattttgtacaaaatcttttaataaaagtgcacatacggtgaaatgaggaaaatgatcccgaaaaaatcgaataaaaattaataatttttcattgcatataataattaagtgtatgtggatttcactaatttttgccattatgtccttggaaatcagtatacccttccttggaagcgggtttttccaatagcaaccctgtga

SEQ ID NO: 84897 - DNA, 65 bp, Heterodera glycines
  Genomic contig location: Contig_ID=SeqID_20108; Location=1..65; Strand=+
  SCN-specific regions: Sequence locations=1-65
tggggataattggagactgcgggattaatagagactgggcgataattagagcatttacggtaatt

SEQ ID NO: 84898 - DNA, 985 bp, Heterodera glycines
  Genomic contig location: Contig_ID=SeqID_20109; Location=220..1204; Strand=-
  SCN-specific regions: Sequence locations=1-393,415-661,683-731,753-985
atgtcgcctcgaactgaaagtccgtttggatttacaagtttccaaatatgggttatccgagcctttttcaaaaatcatgaaccccgtctagccctaaatttaatccgttttcacaggcggccatttgtgcttatttggcactgctccaaacgtacgttgcttttgttgaacaaattggggccggcatcgaatttgtgctggtgacattggaagcactgctccaactgttcacaatgatcactttttccacgaaccgatcaactgcttctgctgctgtccaagcgcataattcatagtgccgtcatttctcaagtccaagaatttctctgggtcgaaaatttttttgcatcgaagatttacatggattgaaaattttcagggactcaaaaaccttgagccccaaacccaagactgaaaattttcttaaacccaagacaacaaagaactctaacttacggaaacattcccggatcgagaattttataggactcaaaaacggcgaaaaccctaaaccccaaagatagcagagcactctaacttcaaggcctgctgagcccgagtctttgccaggaggaaaaagaccgagcaacacttaatccccaaaattggaacctgaaattttctagacccgagactgatgagatctcataatattgatgttcccaaaacaaacaaaaaccaatataaaatcttttttcattaaaaatgatatataatggcatcgtgaaagtgttcaattgtgaataataaatgttccttttacaatttttttctaaaaaaccagcataaaaaatttctatgacagaaaaattttattcgctacataaaatgtatacaaattatattccctattcagtgaatatgctcataggtagtggcattggatgaaagtgcataagcacttgtaaatttttattatccaatgtctatgtcacattttctattcatatgactaaatgccatattttatgtgattattaataaa

SEQ ID NO: 84899 - DNA, 1873 bp, Heterodera glycines
  Genomic contig location: Contig_ID=SeqID_20110; Location=5..1877; Strand=-
  SCN-specific regions: Sequence locations=1-129,166-286,310-649,677 -768,929-955,979-987,1069-1170,1209-1307,1331-1782,1808-1873
gcgatgatcatcgggaataatttgcgagaccatcgcgttttgatcgggctgaatgatgaaaacccagcctttcacaatgtgtacgagctggacttaatcaacaatcaaatgcgaatggtttgaattaagaaaattttgaaatttaaattattttaaatttaaaatgtgccccaaaataaaggttttccacaatgaacgatttcccgccaaaattgttgttgataatgaattgaaaattcgaatggttgtacaggaggccatggacgggtcgctgatcttttacaagtattaaaatattataaataaaatgaatgcctaaaattaggtgttactgtagtcagtttcattatggagaatgcttcaatggaattgcatgctttcaaaagtgatactgtaatataatatactgtactaagatggttgtatctaacgcgaagttgatgcaaataacaaaccatgccttagatagatgttttatataaaaaaagttatcaacactagaaaaatttaataatcttcaaaaagcgatatcgcaaaaattttcagactttccgacattgcaaaccccagtcgactgacctctgagccgcacaattgggtggagtatttgcgagtgccgccagatgaccgtgcgcttacactgtacatgaaatatttaaattaaaaaaaaaatattgcattaatttttgtaaaatttcaggccaatttcattcaccgctgacaaccgtcgcatttattggcaatggggcgcggatacagtaaacacagaaatttattaaatattttttgaaatatttatatggatttttttttttttttggatttattttggatgaattaacattcaattaataatattttttagataataaaaaatgaaaaacatttctcctataaaaataattatttctttttttctaattattttcttgatttttaagttcatattagccaatttttggtgtttttaaaaattttacaaacgggatttaaataaaaaaagattaaatgttttagaatgttaaattaaaaaatagattttaaactatttataaaaattaaatttttcactaggaccttggccaattggttgtgcacgattttgggcggcctgaacgcaacgaaattctttacacagcccaaaaagcacaaattggcggtagaaatcggaaaaaataatttttaaaaaaatatttgaaaattttaaaggtgtgattttccacccaaccgagcgcactgtgttgtcggtcaccgaaatatatcacaaaccggacatttatgtggcaaacacgacagtgctggtcagttttaataaatttaatatacatttgaaaataccccaaaaaaattggattcgaattcaatcattcaaggaccttttttaaggggcagccgagaaaccaaaaaaaaaaaccaaaccgagatttctgcccttttcggagtactgaaattagttgcctcactttctgggatcaatggccgggattggcacaaaatggttcgcacttctggactagaagttattcggtcggggtcacttaatgtttttggacgagatacctgattttcgaaaacaaaaagccgtactacgaccagaacaagatttccgaaaaggaccatgactggcagcttaaagcaaaaagtcttgttttaacataatgcgttgtactatatggggatcatgtacagtaccccgttttttttctgtaaatgaaatcgactcttaagaatttgagcctaaaagaaaatatttaacaaaaaaaacttttcttcgtttagaacttgaaaacaataatttttaaaatttttaggatgatatgcaatatttggtcaatttgcgaccatcaggaacaccagtcattgaaagcatgag

SEQ ID NO: 84900 - DNA, 663 bp, Heterodera glycines
  Genomic contig location: Contig_ID=SeqID_20111; Location=145..807; Strand=+
  SCN-specific regions: Sequence locations=1-146,168-251,276-371,393 -501,525-574,598-663
atgtatctgtataaatttgctcaagtaaattgtaaatcggaaattagtagcgtttatcaactccatacttccgcaacacttatacagtttattttgagggggtaatgagctgaaattgtaagaattatacaagctggccaaaccaaaataataaatggaaattattggcgcttatcgactcgatccttctgcgacgcctatacaatttatatttccatgataatgagctgaaattttgagaatttcaaagtgatcatgaaatgtaaatagagaatctcacaatttcagctacttaatctctaaataaatactgcagcaatattgtagaaggatcgggttaataatattctctgatttattattttcacgaccatccttgtgaaattctcaaaatttcagctaattatcttctaaatataaactctaacagcgttgctgaaatattgagttaatagcgccaataatctccgacttattattttcacgaccatctttgtgaaattttcacattttcagctcattttcctccaaattatctgtataaatttgctcaagtaaattgtaaatcggaaattattagcgtttatcaactccatacagtttattttgagggggtaatgagctgaaattgtaagaattatacaagctggccaaaccaaaata

SEQ ID NO: 84901 - DNA, 60 bp, Heterodera glycines; identical to SEQ ID NO: 58222
  Genomic contig location: Contig_ID=SeqID_20112; Location=1057..1116; Strand=-
  SCN-specific regions: Sequence locations=1-60

SEQ ID NO: 84902 - DNA, 4050 bp, Heterodera glycines
  misc_feature (3750)..(3750): n is a, c, g, or t
  misc_feature (3779)..(3779): n is a, c, g, or t
  misc_feature (3867)..(3867): n is a, c, g, or t
  misc_feature (3873)..(3873): n is a, c, g, or t
  misc_feature (3876)..(3877): n is a, c, g, or t
  misc_feature (3898)..(3898): n is a, c, g, or t
  misc_feature (3961)..(3961): n is a, c, g, or t
  misc_feature (3968)..(3968): n is a, c, g, or t
  misc_feature (3976)..(3976): n is a, c, g, or t
  Genomic contig location: Contig_ID=SeqID_3493; Location=1..4050; Strand=-
  SCN-specific regions: Sequence locations=1-528,551-654,679-784,807 -1165,1219-1230,1252-1958,1983-2305,2334-2509,2531-2566,2588 -2872,2895-4030
  Gene Ontology: Mol. function=organic anion transporter activity; Cellular component=integral to plasma membrane; Biological process =transport
ccccccccccccccctctgtctgtcaacagcatacattttccaaatagtcattatgtgaatattatgagcattttcatccgcagttcgttaatcgatgaatttatcatttcctactctaaattatttattaggtgcgcggattttttgttcctaaatttttgtgatttatcttaaacctaaagcgaagtgttgcggaataaagtcgattttgcgactaaacacattttcttgtggaaggtttcttgtcagtaaaagttaacttctcagtaattcacgcaaaacaatggattcccttcgggctttttgtcgactccaatgttacggtagtgctgactgtaacatcgaaaaacgacagcaacagtttttccttttgccaatttctccgtgcgggtgggtcggggctatatgggtggacaaggaacaccagaccttttccactaattgcatcagttccaaaaagcctctaatgatcatcacaattgttttgatggttggttctgatatttttcgtccgtttcccagggagttctctctgcttctgctgttccagttcgcatttctttgttccgtcgttgtccgtttcgccgtttcggtcccttttatgccaacaattagctaattatggatgcttcatccccccccccttttgctttatcccctcctttttccccctttttagctctcttcccctgctgccgatgcttttcccccccggcgttcgtcgcttctcttcgcctttctctccgcctttgtctgtgccgtcgcccttctccaattaattgtttccccatttccttctgtccttctcattgcctattctttggtcgctttcatttgggcagtgaatgccctcttttattttattacattccaacagaaaaggtgattttggtaatttatttgagggattaaattaaggggtgatcataggctgagagtgccattcgttgtcaactgatcagtgccattaccattgatcagctgcgatagtcagtcagcattcgtttcactaaaagtaatttctgattggttctcattgtttgacgcttggattcattgatcagttgtgattacgggtaatcaatcattgaccaatgctccctgctctgatcacttgataatgagtagcttgtgtttagcagctgatcagtttggtcaggatgatctctctctctttctcttcctccctctctctctcattctctctctccgtctcttcgtcttacttttgccaatgcctttcccttttcagtgtatcgtctgtgccgtccgtcttttcgctgtctctccatgctcttttctgcgctctgttcgccctcctctcgctcaatcgttggcttttccttggcccctccgtctcttcaactctctccattctcttctttctctccattctcctttgctctgtttgccaatttgttttgtgcctttgtcgtccttccaattctattccgttgttgtccaattccaattttggttatcttccgattggcgatgcttcgtccgatcatcagaatggcgatgatcctccgatcattttgttgtgcagtcacgagcactccaattggctgtcaaagctgttcttctgctggacaaatcccctgcttaggaagggctttcagggtcatctttcccaggttgtttttgtcttcttttgccgcccccctccccctttaaaattgtcttttctccaaaaggtggacgatgtgttccatcttccgcccagcctccacttgcccaggcttcagcgtgacatcctcggggactgccatggccaatccgaccatgccgatcagcggctgctttctgccgaattttcattcgctgaagcccttttccgtgcctatgggcgtacctttttgctcatcggcgttgtccgattcactggggacgcgttcagattcgcaagtgattggactaaatggctgactgatcaactgatcagcagaatcttttctggtcactccccttccccccttaggcccaattctccttcacttgctgatcacttcgcttcaagagtcttcccaatccgtggtgattggctttttgaaggtgtgccgtaatgatttgttcttggctaagaatttgggctacgtttgtgccgctctgatgtccgtctctctgttcgtttcctccgtctgcgactttcagttcaattattacatcgaaatgatcactcttcgcgcaaagagtgcgcttcttctcgccgtctaccaaaaattgctgcgaatcccagcctttcaattgaccgaaaagttttcgtccggcaatttgatcaatttgatgtccagcggtgggttaattgtttttcattttctttttctctgatgaattgtcattttgaagatgttgaccgtgttggcggccttatggtcgcatttcacggtttgtgacaaattaattggccaataaaattcgtttcagctttttggagtatgccgataaattttgcgattgcgctttatttgctttaccgcgaggcaagtggcaaaaaaggccgagggttttcagtcataagggactggaatcgaacacagaacaaaacgaagcgaggctcaaaagcatatttaaaaataattttacgcttaattacattagtgatgctcgagaccaaaaatttcccgagactcgagaccgagacaaaaaacccgagacttttctcgagtcgagaccgagactctcgagcattactaaattacatacgtaaattcttcggcatttgattttacaaaaccaaataattaatttgtgcctttgtcatttccgctttttctcctccttaggtcggaatggcttttctcgccggtgttctcgtctctcttctgctaatccctctgaacaaatacatcgcctccaaagtcggccaattctccaacaaaatgatgcaaatgaaggatgccagggtcaaactctgtactgcttcccccccccccaatgtttttaatttccttttttgaatacagtaaccgaattgtcccggtcaatgcgtacggtcaaactgaacaattggacggcctttttcgaagccaaaattggccacctcaggtcacgtgaattggctaatttgaagggaatgaaatacctcgacgccgtctgtgtgtacctttgggttggtgctgccgtgggttggctgttaccgtatgttccaccgtaggcatccgcccctaccgtaatcatggtgctgatgctcgtcacttattccgtcgttttgggcgaattgctcaccgctgccaaagtgttcacgaccctttccctgatcagcattctgatcatgccttgtgggctttgtctttgtttcggtcgatcactttccttcctgagttcccttcagtgaacgccttcccgtgggtgctcagtgcgattatcaacggaatggtcagcaaacgacgctttgacgcattcttcgccatccgttgcggtgaccagcgccaaaacattctcacccaagcggagggagggggtgagcggtcattccgttgctgaacactgaccaatgccatgccaatgtttaagtactgctcggacttgatggcaattcttttgcgtggaacgaaactaaaagcgctgtctccaatgtccattttaacgggaaaaaggtacaaaaaatgaatccaattggatttgtttattttccccgttaagggaatgctaatcggcgtcattgggccggtcggttgcggaaagacgagccttttgatgggtttgctgggcgagacaattgcgaccgaaccgtacgggcggtcaantgggcgaagtgtttcgacgagggatttgncctttgttggccaagacgtgtggctgagagaaggggacgatcagaaagaacgttttatgcgaaaggccatttgatcagaaatgtccanaatggncgnntgattcgtgcgcactgtcctnttgacattcagtgaaatgaaagcctatttgatcagtgacgggcaaatgaatgaatcaattccnttcaggnaatgcccngcaaagaaaatatcgatccaccggcgatggatcctcctgagcggagtgatgtctgggggggggggggggggggg

SEQ ID NO: 84903 - DNA, 1952 bp, Heterodera glycines
  Genomic contig location: Contig_ID=SeqID_3494; Location=1600..3551; Strand=-
  SCN-specific regions: Sequence locations=1-505,539-1086,1111 -1176,1199-1325,1348-1574,1597-1952
  Gene Ontology: Mol. function=UDP-N-acetylglucosamine-peptide N -acetylglucosaminyltransferase activity; Cellular component =perinuclear space; Biological process=O-linked glycosylation
atgttggctcatctgacggagagagtgatagtgaaggacaaggacggacaattgccggagagagactgcgtgactttggtgaacgcaacacaaaatgctcttcagtcgctgttgtccagcgcggcgtgtgaagtcaaagtgaggcaattgctaacaaaacaacaaaaatggaaataaatatttttttagacatttgtgcgcgaagccgaagttcaacacggacccgaaagagaggtgaaaatgactgaggttgtcgtgccagtcgtcgaagtcacttcgacggagccattgtctcaaatgatcggaagcggactaatcgcggccagtgtcagcggagtgcctgtccaaaacggactgacaacactgaacactcatgtgaaagcggcaaccggggaagaagtcccgcagacaattttggtatttaactctttgttttactaatatattacactcattcgatgtaggtgacttctcgtcagcaatacggtcttcccgaagatgcgattgtcttttgcaactttaaccagctttacaagatcgacccgcctaccctggggatgtggtgtgagattctgaagatggtcagcactttcttttctccattgctatctttctgatgcccttttcaggttccgtctgctattttatggcttttgcgtttcccttaccacggagagccgcacattctcaagttttgcatgcaaagaggcattgacccgaaaagggtggtcttttcaaacgttgcggccaaaggtatgcctttatcaaattaattgtttgggcattccatttcagaggagcatgttcgccgtggtcagctggccgatgtttgtttggatacgcctctctgtaacggacacacaacgggaatggacattctgtggaccggaactcctatggtcacaatgccacgtatgaataattatttttctattatttcaatcgaatttcagtggaaaccttggcctcgcgcgttgcttccagccaactttttgcgttgggatgtcctgaattggtggcaaaggacagagacgagtacatcggaatagccgtcaaattgggcaccgacaaggaattgtcagtcccttttaaaatttttaatgtttttgataattgctcttccaatttcagcctgaaccaaacgcgtgctaaagtttggaaggtcaaactttaaacttttattttaattataatttatgtcttgtgattattcaaaattgttattcaggcacgcaccacaagcacactttttgatgtgaaacagtactgcaccgacatggagaaccttttgcacagaatttggaaacgatatgaaaatggtaggtttatgaacattgttaaacattgaatttattttgtactgcatacaaaaagtgtggaggcgattcctccatctccccccccccccctctatcattcgccgtaaaattacaccgaggggagggggtataaaggagaggggagaatttccaaaaaattttcccatacaccgcttatcggcacagccagccatttgggcgctgactccccccccccctttttttaatgtgtgttgaactattaccattgaattttaaaaataaccctttcaattttgcaggtctaccacccgatcacattctaaacgctaagttggaggcctcggtttaaaaatgcgactgcgaattgttgagcttcttcgtttgtgggattcgtgttttaaaatggcgattgtcgattttgcacgtactcatcatcacatttattctgccccccccccccccctctgtctgtcaaacagcatacattttccaaatagtcattatgtgaatattatgagcattttcatccgcagttcgttaatcgatgaatttatcatttcttactctaaattatttattaggtgcgcggattttttgttcgtaaatttttgtgatttatcttaaacctaaagcgaagtgttgcggaataaa

SEQ ID NO: 84904 - DNA, 1471 bp, Heterodera glycines
  Genomic contig location: Contig_ID=SeqID_3495; Location=2168..3638; Strand=-
  SCN-specific regions: Sequence locations=1-129,151-426,451-818,842 -1017,1039-1352,1374-1471
  Gene Ontology: Mol. function=acetylglucosaminyltransferase activity; Cellular component=cytosol; Biological process=response to nutrients
gcgagctttggcttgcattgcatcattttgagaaagcaattgcattggaccccaatttcattgatgcgctcattaacatgggaaatgtgctaaaggaagcaagaatttttgacaggtaaagttaataaagggggctagaaaatacataaattccggtaaattaccgaattcctttagggctgtcgccgcgtatttgcgtgctcttgcattaaatccaaaccacgccgtcgtgcatggaaatttggcttgcgtttactacgaacaggcccatctcgatttggcaattgagacgtacaaacgtgccattgaattgcagccgaactttcccgacgcctattgcaatttggcaaatgctttaaaagaaaagggactcgtgacggaggctgaacaagcctataataccggtttacaataagcaaaaattgctaattatatttttaatttatttatcagccctttcactttgcccaaaccatgcggattcattgaacaatttggccaacattaagcgcgaacagggaaaaattgaggaggcgacaagactttacttggaagcattaaaggtaaagtggcaaaagaattaattaatgttttctgcccggcattcctttgcaattcggcattaatctcccgttttttaagatttaccccgaattcgcggctgctcacagcaatttggcgtccattttacaacagcaaggtttcccatgcatcccttttagtataattttcatgaaatttgaggccgactccaagaggcaattgaacattacaaagaagccatcaaaatttcgccgacatttgccgatgcttactcaaatatgggcaacactctaaaggaaatgggcgacattaacggagctctccaatgttacactcgcgccattcaaattaaccccgcttttgcggacgcgcacagcaatttggcaagcattcacaaagatgcgggaaacatccccgaggcaattcacaggtgcattggggggggggggaggggaattacgatacggaatttcgatttaattgtatttctatattcaatccagctattcgactgcgcttaaattaaaaagtgattttccggatgctttttgcaatttggcacattgtctccagattatttgcgattggtttgttttaacacttaatgcgtcattgtttaataaattaggactgattatgagccgagaatgaagaaattggtgagcattgttgaggaccaattgcagaagaagtaaaaaatgaaaagaaaaaattcgccatagccatgccaattttagacggctcccttctgtgcaccctcaccattcgatgctttatccgctaagccacgaacagcgaatggttaaagtgattggaataaattttaaaaaattgcttttataggcaattgctggtcgtcatgcgcagttatgcattgagaagattcaagtgcttcataaaccttcgtacacttaccccgacaaattga

SEQ ID NO: 84905 - DNA, 138 bp, Heterodera glycines
  Genomic contig location: Contig_ID=SeqID_20114; Location=969..1106; Strand=+
  SCN-specific regions: Sequence locations=1-138
atgttggatttggttgatagggaaaaagttatagccaaaaatatgctggggccaaaacgtgagggcccaactgaagtaaaccgctttttcgaaacaactaaaaaccgggaaaagcggagaaaatggtggcaagggaag

SEQ ID NO: 84906 - DNA, 572 bp, Heterodera glycines
  Genomic contig location: Contig_ID=SeqID_20116; Location=964..1535; Strand=-
  SCN-specific regions: Sequence locations=1-572
atgtccgctgggagggcactccgcacaagtgtcctctacaaaattggtgttgatcattttttgctacgactaaccgtattccgtgtacaagtgagcaaaaattgccaactcgaaaaccggaatttcgtttttcgggaataactctgcgggatttgcttatatccagtgcacatagaaaatgattatgtgtatttttttgagctctatccaaccgtgtttttggatttttaaaattttcagaaattttcgagctaggcctaaaaaacggttttttggttttttaattttctgattttttaacgaattttccaggaaaaacggagaccacttccaaaacatagtttttcgagctctatcgattggtgacattttcagaaaaattttggtttttttccggaaatagaaaaattttttgctctgaccgggacatttcagtcccgggcctataactcgtcgggagttgattttagccaaaaatcttacaagagcatttttgtagagaattttaagctctatccatcatgttttatcgcatgtttttagcatgagtataaaaaaagttataaaataaa

SEQ ID NO: 84907 - DNA, 450 bp, Heterodera glycines
  Genomic contig location: Contig_ID=SeqID_20116; Location=1..450; Strand=-
  SCN-specific regions: Sequence locations=1-450
aaaaaattaaaaaacgggcgcaaagcgcccgtcctgaggccgcgaagcggccgaatgttcccaacaaaattaaaaaacgggcgcgaagcgcccgtcctgaggccgcgaagcggccgaatgtcccccaaaaaattaaaaaacgggcgcgaagcgcctgtcctgaggccgcgaagcggccgaatgtcccccaaaaaattaaaaaacgggcgcgaagcgcccgtcctgaggccgcgaagcggccgaatgtcccccaaaaaattaaaaaacgggcgcgaagcggccgaatgttatcaacaaaattaaaaaacgtgcgcgaagcgcccgtcctgaggccgcgaagcggccgaatgtcccccaaaaaattaaaagacgggcgcgaagcgcccgtcctgaggccgagaagcgcccgaatgttcccaaaaaattaaaaaaagggcgggaagcgcccgt

SEQ ID NO: 84908 - DNA, 1395 bp, Heterodera glycines
  Genomic contig location: Contig_ID=SeqID_20119; Location=481..1875; Strand=-
  SCN-specific regions: Sequence locations=1-62,85-181,203-220,242 -242,271-357,380-425,447-1395
atggaggacaattcgctgttaagtcccaaagaattgaatgcaatcaaaaacggggctatgatgaaagcaaaagccgcttctcagctgtggagttcactcttttgtcctaaagacgaggaggccattttcgcaacggatgcttatgccaaactcaattcatggcttctttcatggatggaaaggctgaggaagaagcaacaaattgaaggagaaaatggacgaaaagggaagaaaaggcggacggatttggaagaggaggaagacgaagaatacttggacgatttgggggaagagccaccggaaaaccctgtgattttgactggaccgaccggttgtgggaaaacggcaatggtcggacatttacaaaaaggaagaaatttatttgttatccttttccatttaggtttattgtgcttcaaaaagaaatgaattccaactgctcgaaattccaccttatgagaaacgcgacaagcaatttttggagcagaaattgttaggggcatccgatacatacaatgttcgaagaatttatgtctgtccagtaaaatttcttttagatgaaagcgggaacaaaaatgccggacattcgcgacttgttcaatccacgacggaactcgccgacaaatttgaagaggaaaatatccatcggattcacattgattttaatagacgaggtcgctttgtttgctttgctaatttttttaattctcattttagtgtgaccttcactatttgccggacactaatttttggtcaactttgaaacaaatttgtgcaaattcgctggtaccaattgtgctcacctgcaacgattacgaagttgtgagaacaaatatgctcaaccgagagccggctcttgaaactttttccacaattcatgtcgataaaatgccctcgttccaatctttcaatgcctatcttcgggtttgtctttttacatccagaaatgtcatctttattcagcaatggctcattggcttcactggaaaaatcagaaagaactcgtatttgagcaatctttttgaacaaaaacgtggcgattttcgtgcgattttgaacgcgttgcaattggatggccaacattcgctgtcaatcattgaaaagccgacaggaaatggccagaaacaaatcgactttaaagaattcgtactccaatcaaagcgggcttctgctgttgactcaacatgcgggaagacaaatgaaatttcatggcgggcgaagcaaatgaccgatttggactaccggagagaaaagccaaccagagactggacaacgaaagtcgcagaaatggacgaacttcggatagaattgctgagtttgctgcgcgttgacgtcgattggtgtgaaattttggattggtttattacccgttttcacaattacctttattcttaa

SEQ ID NO: 84909 - DNA, 1383 bp, Heterodera glycines
  Genomic contig location: Contig_ID=SeqID_20121; Location=7..1389; Strand=+
  SCN-specific regions: Sequence locations=1-763,785-785,817-1161,1183 -1383
atgcaatcaaaacaattgatgtggaatcgacgtatagggagacatagaagtattacaacgcttctacccccaccaaatcaagtctgggctcgatcattatctgttggatatgattcatggattaacatcactgggttttggatcaacatccctgaccacttcataatagcgtcggaaggtaaaaatttgttttatgctaaaccaatgtaccatcaaaatagcctaattcacaatcaacagcattacattggaacatgcattgaaacggcaattcggatgtactcacgcgactgggaccccgtggaggaagcgaatcgtgaatggtttcgttccctccagctcggcccaccaaattccgatcgcgaaacatcatcccgtcacctgcgctagccaatgaacaaccattcaacacagaaagacgaggacgtcttgcgtcggtgattggaggacactggtaaattcggcgcagttcgtggacgtgaaaggtaggtcatttttgagaatgaatagcattaatttttgatcaatttagattaaccacacaaagatttctttcaaaattccatcacttcaataaggtaaaacggtaacaagaaaaactcaaccgaggggaggactcatctaacattcttaatttcaagataccctgcgcggcggtgatcggaggtcaactggacgatgaatgaaggagacatttcgttgaaacggacggatgattcggtggcattggcatttccattcatctcatccccttccttcaattttgtacacgtttgatttcctcatttctcttttccttttgttttgttccttctcaattgtttcttctcaatttcctttttttgtactggaattttcggctgctctttctttaatctacccctcaaaattttgggcaaccaaccctgtacagctcttccaactcggcccttcgtcttttgcaccgttccttcgcaccactctgggacggaatgaactctggttgatttcctccagcccctcaggccaagtctgttcataaattgagcagctggtgcacaggtggttggattgggaaccgaagggcgaaaccgttctcggactggcgcagcatcatcgacaaacttcgaggatcgaggacgatcctatggaaggggggagctgtaagggattggcacaccctcaaaaacaattttcaatttccctcagcagtcggactttccattctttattatcacattttctcatctcgtttatcccattcttccccgccccttttccgttcgcttcacacttttccttcccccagcgatcagttagtcagtcgtcagtcagtcgagtcgttaagcctaaccgatgagtcgttcgtcgatgtatatttcaatcaccatttatccggagaga

SEQ ID NO: 84910 - DNA, 978 bp, Heterodera glycines
  Genomic contig location: Contig_ID=SeqID_20122; Location=362..1339; Strand=+
  SCN-specific regions: Sequence locations=1-777,799-978
atgaggacagttttgaactgtctttccatcctttttgctatgtttgcattgggtggagcttatccaaccaatcattgcagtgaatgcaaacttctttgctttaacaaaggcgttaaagcaaagattccaaaagaaatcaataaagttgagctctgctgtgcagagaactgttacattcatgagaatgtaaagaagctcacttacgagctgcccaaggagatcctcctaaatgacttcaaatgcgaaggtcatttctggatggattcgaaacacatgttcaaaaaagacattttatgtccagcagttgatgagtgtgaactcatcgaatgctatttttgcattgaacagttagcgaatccaacctgttatccattgatttcatcaatgttagcagggggactttgcttatcattcataagcataagctttgtggctttttccatattaaaagtcctgttttcaggactttatatggtcatttggctgataattcaatttatcaggccaataatttatttagctggcccaaatcggcctccgaaagataggaggccaagggcaacagcttctcaaaattggacatcacgccgtgtttacagaacaatggcgtttgttgtccttatggttaactctctccagaatttgactggagcagagaccatagcagttatggccaaatcggaaaaatgcattaaaaatgcgacaagcatgagatgcattgtcgaaaactcggcaacacttacgttgctgccagctggccaaacaaacactcttcttctgaaaacagaggaaggtgttctccttggctcaataaatgttgtgcttaaggctttagctttggaatgccaaagctttactaaagcctggctgcgttcatatgcaattaatgtgtggccggcaaaaggtgccctaaaatgggctcctgcgaaggaaagtattgtggagaagttcgccacaatacttcaattcctgagctaa

SEQ ID NO: 84911 - DNA, 1590 bp, Heterodera glycines
  Genomic contig location: Contig_ID=SeqID_3497; Location=377..1966; Strand=-
  SCN-specific regions: Sequence locations=1-12,35-139,162-411,437 -539,561-1322,1360-1378,1400-1590
atgaatgcggcaatgatggcggccgcggcggcagttgccgcatcgagcggtggcaccgcctcttcgatgccgtcctcaacggacgtgccgccaacatcatcgcttgcagctgtgatggaaagcggcgcgggacgatacacgggcggtggtggcggtggcgggtcgtcccgcagcaaccatctccacaaccaccacaaccgtgtgcaatcggcagcggccggggaagagttcggcaccgccggctttgcccattcgtcgtctgccagtgcgtttatggcaccgccgacgatggtcccatttggccaccacaacgcgttccaatcggtcaacgcactggcggccagcttatacagacagcaacaccaccagcagcagaacaatgccaatgggaaaaggtgcgcgagtccgatgggaagcggcggcggtggcggcatcaatgaactgctgctccatcagcagcaacaggcggcaacgaagcggcggaggctgaacaccgcggacgcaccggcaacgcgcaatgtaagcaaatgggtgaggggaagtgaagactgatcaaaaaaggattctaatcgaagccgggagtgcgcaagatttgaaggattccagtccgcaatctcgcatttttttggaaattgagggattaataaaattttgagttcaaatcccggagttgggactcgcgataaaatttttggacagagttcaaggaagtttgatgatcaaagtatcctgctaaaattaaaatttcccatggctgaagcaattaaaattttgaatagacgaatcaaaaacaaagggggcgatcaaagaagcgatcgataaaataagaactgatctgatcaaggtcagaagtcatcaacatatttctcaaggatatgctgttcaaagccatagcttaagaaaaaactgttcaaatcttaaatttcccgtgatttgttcaaatttcaatgcatccattgatcaacacatcagccagccattaagaattgatcaactggatcaattgcattttttggcatgtcaattaacaataagtcaattagaatgattaaattgcctccggctaataggctcaatttatggcacgacacaatggtattattgtcgttaattttgtagctccgatcaccgccacgggaccaccacaacaacaatctgttggccaaccagcagaacaacagcaacacaaccgccaccagcaatagcagcgcgtataatttgcagcaaggactgctcgcgtttgtcaaccgccaccatcaacttcagcagcagcaaattgcggcatcggctaatgccttgcgtctccagcaacaacaacaacaggcggtgccgtcttcgtcttcgtcatcgtcttcggcatcggttgccggcggggtcccaacacaacaacatcatcagcaccaccatcacccgattttggtggatacgacatcgtcaggaagtgaaagcggcggtgctagcagcgaagcggctgctgccgcggcggcacaaccatcggcaacgagtcggtacgcaccgcttggcaacaacaagcggtgctcatcaccgccccattcatgctcggatgatgccgcttcgtcgtcagcgatg

SEQ ID NO: 84912 - DNA, 415 bp, Heterodera glycines
  Genomic contig location: Contig_ID=SeqID_20123; Location=987..1401; Strand=+
  SCN-specific regions: Sequence locations=1-415
aaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagacaatagggaagctactcccgaaggattcggtctccccataaatctgggcgcatcggttcggggggactgccccgaaaacccaaaaaaaatcgattttttcaagtgtccgtttggggtactaaagcaattatggggagcaaaaatccaacgcagaattaaag

SEQ ID NO: 84913 - DNA, 803 bp, Heterodera glycines
  Genomic contig location: Contig_ID=SeqID_20125; Location=1432..2234; Strand=+
  SCN-specific regions: Sequence locations=1-68,91-803
  Gene Ontology: Mol. function=translation regulator activity; Cellular component=cytoplasm; Biological process=transcription from Pol II promoter
atgcaagcagtgacgcgtccacccattgttttggagcgtggagtttccgggcgtgtaaaatggttcgatttcagtaaaggtttttcacattttctcgcacgttgattcaccagaacggttatgtttcttgtccaggttatgggttcatcacgcgggatgacggaggtcaagatgtgtttctgcacgcatcatccatcgttcgcaaagtcaatatgtacttcgtgctgattgagggccagcgggtgagtcggactgattttgagctgaccgagggattgggacacggagaatcaggggagtacaacgatcctcgaattcaggtagaattcgacgtcatcgatggtgagaagggcagggaagcggccgctgtgtcggggcccggcggaattcgcgtgggcaccgccatccaatacaacaacactgcgcgcagtcagccgttgccggtcaatgccaacaattccgccggacggatgttcatcgccggcagatttcggcgccccgttggcaaggttttgttcggtgttaaaatgcgcttttttggtcccctcacttttacaccaaacaaatcatttttcgggctatcaaaatggacttctaatggactcgtatgtccgtacaaatgtgtcctgccttcggctgattccccgccaaatttgttttccccatcagccgaacaacaaagccaagtcggccgtcgcttcggtccccgcggtggtcaatggcggcgacgacagtgcaaagtgtccgccgctctctctgtccagcgtcactcgcaaaggccgtcgcatgttcaaagcgaatga

SEQ ID NO: 84914 - DNA, 302 bp, Heterodera glycines
  Genomic contig location: Contig_ID=SeqID_20125; Location=61..362; Strand=-
  SCN-specific regions: Sequence locations=1-245,268-302
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctctacgcaagcgcttttgtgaggtataaaatttctcaaaaaaagagatagacatttttctgggattgagtataaattttaaaatccctcaaaaataaaaggtctattgcgcaccgccctccctatcatg

SEQ ID NO: 84915 - DNA, 170 bp, Heterodera glycines
  Genomic contig location: Contig_ID=SeqID_20125; Location=439..608; Strand=+
  SCN-specific regions: Sequence locations=1-170
catgatagggagggcggtgcgcaatagaccttttatttttgagggaatttttaaatttatactcaatcccagaaaaatgtctatctctttttttgagaaattttatacctcacaaaagcgcttgcgtagagacggagggctgtgcacaatcgccattttatttcacagag

SEQ ID NO: 84916 - DNA, 191 bp, Heterodera glycines
  misc_feature (168)..(168): n is a, c, g, or t
  Genomic contig location: Contig_ID=SeqID_20128; Location=1438..1628; Strand=+
  SCN-specific regions: Sequence locations=1-26,48-191
ggttcgattggtccaactgatcctcgtttttgtcattgctctgttttgctcaaatatttgcttgcttcgtcctccctcacctttggctttctctccgtcttctcaaaatgccttctgtttcttttgtggatgtccccgttaattcgccgtttacctttgagaatctcnccgttcgcgtcttctcaacaaat

SEQ ID NO: 84917 - DNA, 761 bp, Heterodera glycines
  Genomic contig location: Contig_ID=SeqID_20131; Location=177..937; Strand=-
  SCN-specific regions: Sequence locations=1-99,137-156,190-277,327 -553,575-725
atggacagccgatatgaagtcaatgaaagattgggtgggaaaagccaaaaaaataaaagtcttaaaaaattattaaacaattaaacgaagtggaaacccaattttattaaaaaaagtaaataaatttgaaataattgtttgattaaagtgccataattttcattgtttacttgttttttgtttcttttagcaagtgattttgccgaacgattaaatgtggtccgtgagtgtgtgatacgtgccgaagacgcattggccattcgaaatttgtagggacaaaatttaaattaaattcgtattaaattatttataaattaaatatttttgctaaattcataacttgagaccgcaaaaaaggcaccaaaaacacgaaaaaagcactataataggcaccaaaaattgaaaaaaggcttgaaaatcccgaaaacggcatgaaaaaaggcatataacattttttattagggatttttagggatcaaaatacgtaaaacttaacccacggctctctctattcataacagtgaattgcatattaaattgaaattttatgttcaaaagaaagaaattattatttttcgaaataatctggcatgattatcaaattttgttaagtgccgaatcccggcggctttacacgcgcgtggcaatgttaaaccgtgagctaattgcgcaacaggttaatgaccggtattatcagtgaagtaataataatcagcaccaaaatgatttatatttaaatttattatttaaatataaataaa

SEQ ID NO: 84918 - DNA, 1891 bp, Heterodera glycines
  misc_feature (74)..(74): n is a, c, g, or t
  Genomic contig location: Contig_ID=SeqID_20132; Location=1..1891; Strand=+
  SCN-specific regions: Sequence locations=1-276,300-507,530-883,906 -928,957-1891
  Gene Ontology: Mol. function=transcription factor activity; Cellular component=nuclear heterochromatin; Biological process=electron transport
cacgacagagacgggggcggatggtcgccttttgattaatgcgggaaagcccgactcggacccggaagtcttgntggcagaacatctcacaaatgttcttcagcctcatcaaattggcggtgtcaagtttatgtaaggggttgagagaaaaggcacagaactatgtggcatttaaagcgagtcagcttttgctttcttaaccaataccaaggtttaccaaaaaatcgttactcgattcggcacttttgctgtttagggccccgaaaaaagttcaaaggagcgacccttttgtagagatttggaattggttgaaatagcggtacttatcccttttgtgacaccctctaaatttttttctacgataattataggctctgaaaaggaatctgatgcatgcattttacgtgagaacatgaaaatgcgtgttaatttaaaataaatttcttgttcgttttcagcgcaaaaaattaccctaaaaaattaaaaaaaaaacttttgaaagggattcttgtttttatttttgttcttagaagcaaaggcttttctgaaattggctctcgttaaggtacgacaacatcatcgaatcgcttgaaacgttccacaagtctgcagggttcggatgcattttggcccatagtatgggtcttggcaaatcaatccaagcgatcacttttctcgaaattttgtttgttgaaggacctaaaccttcgatatatttttttttgttttagcattcgaattaccggcaaaaggcacgtgttgcttatttgtccagtgaacgttctgcaaaattggcacaacgaattcaaccgatggatgccagaaactgacgcggagacggcgcggcccattcggcactttgaactgtttgtcattggtgactcagtgaaaacattggaaaacagagcgcaaatgatcggtgcgtaggaaaataaataacattcattttaaaattatttattcagagaattggtatcagtcggggggcgtccttctgctgggctatgaaatgtttcgtcttctcgtccaccaatgtgaacttttgggcgaaaagagtgcgcaacggaaaaaggcatccaaaaagcaaccgttgcggacgatgtacgatttggcggacgatttggccaaaaccaacgagcaggaaaaggcacaaatgacgcagaaggacgaattgcagaggaacatccgccaggctttgttaagcccgggccccgacttggtcatttgcgacgagggacaccgtatcaaaaacctgaacactgaagtgtcatgtgcactctccgcaatcaacacaaagtaccaggaaagggcatttttgaggaatttagaccaaacacaaaaggcgccgcattgtgctgacgggctacccaatccaaaacaatctgacggaatacttttgcatggtcgaattcgtccgtccctcctatttgggaagcaaaaaggactttcaactgatgttcgataagccaattcgtaacggaagctgcacagactcggccaagtcggacgtcaaattggccaagcagcgcatccacgtgctctgtgacatgctcaggggatttgtgcagcggtactttaaggaacgaacatttagtcaattttgttgaataatttgtcaaggcgttctcaacatttgctcaagaaaattttgcccgaaaaccgcgaattcgttgtccttttgcgcaagtccgaactccaacattcgctttacagagcttttcaccactttgcaagtgaacaaatcagtgttggcgaaagttcattcaacccattgaaagcattcgcaatttgtttgaaggtattgctgatgcttttatattttctgtttcttaatttagattgccaatcatccggacatgctttatgccgccttgaaaaagcaccagataaa

SEQ ID NO: 84919 - DNA, 1355 bp, Heterodera glycines
  Genomic contig location: Contig_ID=SeqID_20133; Location=397..1751; Strand=+
  SCN-specific regions: Sequence locations=1-368,390-696,718-815,837 -1165,1187-1355
gtccgtctctttcatacgcccaaattgtgcggcctcctcaaaagtgcgttgcccgaacggaccaacgaaattcttggcctacagcacatgaaagaggaatggctatcactaacctaaggactgaaggtggtgatcacaatcagttcctttggaatgtacattgttttcctttttcggcattttccagtgcttcatctcgtgccaatttcagtctgatgatgatgactttatcatgccgttcggttttaccaatcaattgactggggagcgattggcgtttaaaagtgccaacattttggtgcgactgggatacaattgacattgcattaatcatgaagaaattggaggcgggtcagtaaattgagaacaaaataaattaaattataattcccatttttgcttttagtcttatcgaggcacttccgacccaagtgatcagtgtgaatgtaactggccagaattcggtaattttcacaaaaatgtaaaatgaaaaaaatgtgtgattttgaaggcgagttcgcgggtgtcaatgtgcgactcgaacatgcttatggcctgcgcatcgaaggccgattcgcgcggatgaccagggtaaaagtatccgctcactttagcaataaattttttatgaaaaattcaagaagttcagcgattttttttaaatttttgaaaggactaccctgtcgcgtgtatgtacctcccccaccaaaacacccctaacccgccgatattttgagaggaaaaggatctttgtcagaaaaaatgtacaattaatcgtgcataacgaattcagagtatatttagaaaatttataaaaagcaaaatatttcaaatttctgtttttcatgaatttttcaagcaataattttcgatgaacaatcttattactcattaaaagtttagataattttttgacctgttatttaaaagtctgttgtctgaaagtttttcttctcagcggtcttcatgactgccttccatcttgtgtgcgattacgccgaagctgaacttggaccggcggaacaaaaattcatgcgaacttaccgctttcgcatttcgataccaccaaaagatgaaaagaagtggggtactagcctcgcttctgccgcctacatcggcatggttgcgttgttgacaggcagagcagtgcgcgccgattggtgtgtcaccggcgcactggatagcgatgaagagtaaatgaagtcgctggaatcccgcaaaaagtggcggcggcaaattttaaacttaagacatacataagaattgaacgggaaatccaagatggatatgttgatgcatgcgataatttaaaacaaaaatagatgaaatgataaactaatgtattgttatttaga

SEQ ID NO: 84920 - DNA, 455 bp, Heterodera glycines
  Genomic contig location: Contig_ID=SeqID_20134; Location=431..885; Strand=+
  SCN-specific regions: Sequence locations=1-363,385-455
atgatcggaagcaattggaagaacggcgaaacgcatcggaaaacgtcaacagaggtgaaaaagagggaattcaatgaaatgcaattaataattggcgatttgcaagcctcgacgcatcctttgatgtgcccgctttggcacacattttacaaattccggacagtgacagcgcacgacggacattggaggcggagttccagaaactggtggccaattaccgtggcagaggcgagacgggagatgaaaacggcaaaggaggaagcggagagaagcagccgcaacagaagaagacgtgatctcacaaatgatctccatgctgtaattaaacttacccaattgatgactcaaatattatttgatgtttaaaatgtacaaaacataaatatattcaccacttcaacacgtcatttattagatttttggaccaggatttccaaggtttaggttcaacagga

SEQ ID NO: 84921 - DNA, 526 bp, Heterodera glycines
  Genomic contig location: Contig_ID=SeqID_20134; Location=1228..1753; Strand=+
  SCN-specific regions: Sequence locations=1-45,67-260,282-462,491-526
atggccgaaatatttgatagtcctcggtctgtaattgaagaatccgaaaaaatatttttgcggcaaccaatccctgacgaagtgggtcagttccgtctcgccagttccgtctggagccggttccgtctggcagttccgtctttgtactcaaagggccggttccgtctcaaaaattttggacccaattaaatttaatttttatggccgccaattttatgtaaatacatattttttcctggcttctccttgctctaaatagcaggaaaaacactttcttttttgtgtttgcgaacaaaagttgggacctttatttacatatttttacatattttggggtttttataattaattaccagggattctttttttatgtaagaaaaatcgtgaaatatgtaaataaaatatgtataaaaaaatgctaaaatatgtataaaatatgtacaaaaaccccaaaatatgtactaaaatatgtaaataaaattttttaaatggttattttttaggaaaaattcctcgtaaagagtga

SEQ ID NO: 84922 - DNA, 5354 bp, Heterodera glycines
  Genomic contig location: Contig_ID=SeqID_3501; Location=1370..6723; Strand=+
  SCN-specific regions: Sequence locations=1-147,170-519,545-655,677 -1018,1040-1121,1143-1334,1356-1404,1426-2191,2213-2503,2525 -3365,3387-3418,3440-3964,3988-4923,4945-5278,5300-5354
atgccttcaaaacaacataatttacgtatgaagatgaaggaggaccgacggcggacggagaaatctgtcagcccaggtcgctcacccgtcccagacgggagtgcagatgagaatggggtggtatcacacccgggcaacgtaacgcccaatattagtgctttgcaattaagcaccccggcttcttccattggaagtaaaagaaggggcagaccctcaaacgccggaacggagtcaattacggcttcgcaacacagtgtgtcatccgttggcacacaaattgcatcggccactcaaaatgatgagtcatcgcctcgcaacaaaaaagggaagatcgacgattttgatcgacccatgtctgctcttgaggcaattgcttcgacgccggtttccacacaaaggaaccgtggagggcgaccatccaaaaaaagaggcggtcatgctggctcaggcaggagcaaagctaatgattccatgagcgagagctcgtcaatggaccagagctctgaagctatcacaaatgtggttgttttgccaactgtgactgataaaataaacttcagcacagtgcaaatcaatttcgcaaccacgcgaaattttgcctgtaaaatttggaagtgggcagcaattggcctttacgaacgtgatggcgaaacagcgcttgccccaaggtctggtccaagattcattgaaacgtgctggaatgatctgacccagtttctcaatgacggctttgctgccacatatttggcatacttggcaagcatatcacaacgaaaagtggtcgttgttgacccaatggtatgggaaaatggcttggaccgtgtcatgcaatataaaaatatgacatttgggtatgacccaaatgttcaggcagaagtcatacttttgccagtacatttccctggacattggactctaattgtccatgatgttcaatgtggtactcattttgccgactctttgcctaccccatatggcagattggatgtgcaactgacggacaaaattataaagatcatttctgacattttgccgtccacagtgttgaccgggattgttgatgtccaaaatcttacggcccaacacgatggaaatagctgcgggtactttgtgtgcctgtatgctgaatcatggcttatgaacaaccgcacatttgttctgccagatttatccatcaattatgaaaaaaagcgcattttgtggcacatcaatgagctgtatggctctgataatgtgccatatcatccaagggaaggggtgccaactccttgcccaattgtctaccgacatgcggatgaagcgcagtcgacatccaaggccgttgagtcaatggaagttgatgacaatgatgacataatgatcatcgaaccacagacaagtggacaggctgctaatgccattctcacccaagcccaagtggctggtgaaaaccaagttgactcgcttgggttggtgtcggagtcttgcgcaccgcaagagcctattgcgcaggctgacgatgtaatatttgtcagacctaagacgcctacaaggcgatcagtgcgcataggtagacggcagtctgcttcgattagccgttctccttcacctgcaccaagacgtcgtttatcaacaaatgctgttgagcaagtcactgcatttacgcagcgttgctaccttgtccacaagggttggtgctgtgctgcagcagcggcaaagcattatccagaatattcaaattctggtaagcttggcgacaagaagtgctctcattgtggggcactactcttcccgcacgaggacagtagcctttgctgtcgtcagggaagagttgttttgccaaaactcaacccgcatccaaaagagcttaaagagctcatcgcatgcgacaaacaatcccgcgagggaaaggagtttgttcggcatatgtcgcgttacaacaacttgctccaattcgcgagtgtttcggctggaaataagccatgccctgctggcggcccgatggctgtaattctcaacggggaattccatcgccgcataagcagcatgcaggctggcacaacacagattcctggctttggtcagctgtacattctggatccagtcgaagccatggagcagcggcgaaaaaatcccacctttacgggagggaaaatcacaaacgatgaagagtttgtgcagggtcatcagcttaatgatgagacccttgaaattttggaacaaatgatccaagaaaatcacccggctgcatctgcttacaagcaggctcgtgaacagctccaagagttgttaagacaacaaaggactgaagagctccggttcttcagaatgactttgttgaacgagcgctcagctccgggtggtttgaaagacccgaagttgcatccccaccaaataatcaccccctcaacgggtgaagggatgtttgcaattcatgcagatcctactggtgccccggcacctaaagggatatgggtcgaaaacaagcaagggcagttaaacgaaatagccccgttcagtccatggactgatagcttgacttatccattaattaagcctaagggcgacgatggatataaaattggcataccatatgccaaacccgcacaaaaaaagcggagaagtgatcaatgtgtcgatctgtttgacactgatacaatgtccgatgatgacatatgcgagaccgagtcaattgcatcgtcagatgccggatctgaagcatcgatgcagtcagtgaccagtcgctatgacaaatcgaaaaaatttgtctccctgcgagattactgcaagtattatctcgccataagggatgaaaatttggagtggcattaccaccacattctatcatgtggcggtggtcttggccagcgctgggttttggaccaagcggccaaaattgattggcaaattgccacttttttgcgccgtccagacatggacctgcgcataagcactccaaaaaatttgctgctgtatttggtgaatcaatacaataagcagcaagctcggcaaaaccccaatgcacaacaaaagagtgttgatgacattggcagcgttgttcgcctttctgagagaaatgtaaattctcttcagtattggaaaaaaatgtatgaagactgcaacaccatttttgcgcgttgccatgacgcaaaaaaggcgcggctcttcatcacattcacgaataaccgtgagtggccagagttcaaggagaacatttacaaaaatggtcaaatgttcactgatcgtttcgacatgtggatgcgtgtgtggtccagcaaaattgctgttttccaccaggagctctatgaaaagagtttcttcggaacaatccttggctcaggcgagtcaatggagttccaagggcgtggtggcccacacgcacacattgtagcccagactgacctggacgcagtcccagaagtcatccaggaatacatatgggctcatattccacctttgccgtgcaaagacgatgactcacccatagcgcaaatgcatcgcgaagtccgcgaactaatgcatatgcaactgcacagatgcagtgatagttggtgtggtccatgtgaccccaactttgggcggtgtaaaaagggcttcccagccccgtactcgaaatgtacgatactacacccggacaggcccgcattgtattaccggcctagcccaaccgacggtggtgcccaaattgaggtgaacggcttaatatacgacaactcgcaagtcgtgccgtacaacccatacattttgctgcgttaccgagtacaccacaacgtgttattcgcatacggtaacaaagcgaacatcaaatatgcactcaaataccctttcaaagggcctggacattgttatgtcgagtgcaaagaggagtccggcagcaaaatcggtatcgatgagccggctcaatatgccaaaatgaacttccgtggtgctacggaagcttttgcagttgtgcattcaatgccatttgcaaaactctcgcatcacgttgttcatttgtccattcatttgccaaaccagcagcccgttgtctacagggcattccaactggtgagcaaagctgaggaaattcagcgaggcgaactcccagagacgccatgctctgcttattggaagcaatggcaaaatgaatggcagcatgttccttcgcttaaggacatgctttttgaaaaagtcccagagcaattccgatgggcaaaagaccgatgggttccatataaaaagaagcctgtcaagaggcccccaatcggtcgtgttgtacctgtccctccaacggaccgggaaagatttgcactttatgcgttgatgcgtcactttcccggtgatccagaccacttgaaattggtcaatgggcagcagtacaacaccttcacagaggccgctctacagcatgggcttcttgaagatgaccaaatttggcacaaaacgctcggcgaggcagccttgcatcgctggccagaccagatgagatggctcttcgtgagcatcctcgtctttgggcagccgagcaatgccctagaactgtggaacaagtacaaagaccaaatgtactatccacagggcattaccagtgcggcaatacgccaagcacgcgagcagcaagccttagccgacattgattggcgtttgcacttctttaacttaagctgcgtgcactttggcctgccagatccaccaaattcaaaagccaaaaataccaatttggctgttgaagaatttttctttggtgatgatgatctgaatatgccgcctggccagccaaatcgaaagccacaacaatacaccccacctccactcaacagcgaccagcaaaaggtctttgatgctgttgtgagggcaatacagtcggatccaaaggatcaaactgtgccgcgccgtttcttcattttcggcgatggaggcacaggaaaaacattcctgtttggccaaattatcaagcgcttgcgaaagcccccatacacctacaaagtgcttgctacggcatccactgggtgtgcggctatcttgctgccatatgggaaaacagcccattccacgttccgtctcggcagagaagtgtcgctagacaagcttccaagcattccgcttgaaagcttctttgctagacggatacgtgaggcccaactcatcatcattgatgagatcaccatgcttcacaacactgtgatagaggtcatcgaccgagtgtgcaaagaaatggcaattcgccagcacaaggacctcctcttcggaggaaaaacggtcatttttagcggtgacttcaaacagtcactgccggtcgtgcctcacgaaggcctaactgcacaagttttggcctgctttcaaacctctccattgttcggtcaattcaccacaatgaaattgaccatcaaccagag

SEQ ID NO: 84923 - DNA, 218 bp, Heterodera glycines
  Genomic contig location: Contig_ID=SeqID_20135; Location=303..520; Strand=+
  SCN-specific regions: Sequence locations=1-218
atgccaaattcaacgccaactgtgccatttgaattggtgaatgaacggacccaagaaaagctgacattgttgaaagaaagcgatgcttttgctaatgattggctgttgaagcgatgcccaattgttggggaaacggcggcggaggtcaaatggaaggacgaatatttcttctccgcacgtgtcgacatttcacttagtgttgacaaccattgcattgg

SEQ ID NO: 84924 - DNA, 1799 bp, Heterodera glycines
  Genomic contig location: Contig_ID=SeqID_20137; Location=1160..2958; Strand=+
  SCN-specific regions: Sequence locations=1-594,617-653,676-934,957 -1007,1030-1044,1082-1326,1348-1537,1559-1754,1795-1799
atgaaaggctgcttaattggcacgagggagttgttctgcaacgaactgagggagtatcgcgtgttcgtcggattctggcaaaagcacgagtgcaacaagccagacaacgtgccattgggccagcgctgcaactttgatgcttattttaatggttcggtcttctcatgccaattgaattgcatggattgctctcgagaaaattctcgggttatttgggtgccgtggcacttattccaattgaattgcataatttccgctcgagaaaattctcgggttctttgggctcccgttttcgtatcgaagcgtcagcattcggtgccgccgagactcttgaaattttattgcttaaggaatttaacaaatcagcgcattataaaacgtcggcggaacgtttttttacatagctctttaaattgttaacgaaattagcattctttgttgtgacgatggcaattctttattatgtcaagtttacgaaatgttaaatttaatcgtctggcgccgttttgtccggcaccgctcattaattgcaaatatttccaaattaagtccaaatgggccaatcgatgacgattttttcttttaataatattgaatttttctcaatttcagaaatccatggaatttacattgcctatttctgtgagctcgatgaggaccagcagcaggacgagaatttgctctgtgacgtgtttctgccagaatttgacaatgcgccaactttggttcggcttaatgatctttagtgttcggaaaaatatggatataaaatcgcaaaatatggccataaaatatggaccaaaaatcgcgaaatatggacataaaatggcaaaaatatggacataaatttttccaaattaagcgtgtaatttctcaaaatttcttcaaatttgctatatgtaaagtaaaaccttcaaaaatggctaaatatggtattaaaaatcattttagaagaataaaagatgataaagctaaaatttactcatttttagcgaaaaatcaacccgaaaatcgaaattttgcttttttacgcttatttttgacataaatttaacaatttttaagaaaatttaaatttattcaatatcatctggaaaaattttgtgaaaaactgattttttgaaaaattttccgttttttgaggtcaaaacggccaatttatcttttgggggccgttatattagaggttttttggaaaaatgccaaaatatgggcataaaatatggacataaatgccaaaatatggataaatatggaaataaatcgcgaaatatggaaaaatatggatatggaaatacagcctagaagctccaaaccaagctaaaaatgtaacccacaacccccctcccaatttactcaaaaaccccgggactcaattaggcgaatcttcctcgtcccgctaatacatttctcttttcccaccttatctcccattcaatctccctcatccatttcacatccgttccccttattccgtttccttccgccacttacggacacttttcacgtacaaaaggcactccgatcacaccaatcggagagggagagaggaagagcacataactccataattcactcggcctctccccctccgtccctttcccccagggcttcttccccttcccctcagggcttttctcaccccaaggaattcaatcttcaatccctccagggcatttttcatcaccaatgaccaatggcactcctaaaatccaatcaatctttcccttttcaaatttcaatcaacacggcacttattttaaacaattatatttatatttattttcttattttcgtta

SEQ ID NO: 84925 - DNA, 896 bp, Heterodera glycines
  Genomic contig location: Contig_ID=SeqID_20138; Location=1682..2577; Strand=+
  SCN-specific regions: Sequence locations=1-636,689-819,841-896
atggctcgacttctgcttttagtttttggcttggccttcgttttcgccgttttggcttttggctctgcgcagcccccgccgcccttccaagggagcggttcgttcagagaaggtgaagccatcaatttaaatatttaatttgttatttttggcattttaaggccaattcggcgcccctccgtttggtggctctccgccgtttggtggcaattcggcggacgtttcagtctcggcgagtgattcgtcggaatgcagcggagaaggaggaaatggagtgcaaggaggtgaaacaaatgcgcatttctactctataattcattaattcaggtggggaatacggtaatggcaatggttacggtaatggcaatggttatggcaatggcggctttggcggaggcggtgccgaaggtggccaagggatggacatcgatgtggatgttcagcagtcatccgaggaggggaaacgacgccgtaaaagacatagcggattcggacaattgatcgacaaaatcaaaaactttgttggcggcaaagaatcgatggagaggggtaagccaaattagcaaaggaacaattagtgaacgattaattgacccgggattattatacaatttgcataattgtaaggttgttaagtattttttaaaacttttattttttaaacatttttcatttttttcaaaataaagtcatttttgccccttattttttaagaaaatgataaaaatgggttccgtccaaaacgcaactataaccctttgatgatgggagcaatgggagcatcgcaatatggtcaaattgatcatcaactaattgaaaaatacaaacatttgttcccaatttgcaggttcgatgtacggctcgccttatcagtcgaactcggcttatgggaataa

SEQ ID NO: 84926 - DNA, 1581 bp, Heterodera glycines
  Genomic contig location: Contig_ID=SeqID_20139; Location=835..2415; Strand=+
  SCN-specific regions: Sequence locations=1-254,289-401,424-529,551 -936,958-1222,1244-1495,1533-1581
  Gene Ontology: Mol. function=insulin-like growth factor binding; Cellular component=soluble fraction; Biological process=signal transduction
atggcattcggctctttcgacggtctgtcgaccagcggagtttcgtcccttcagcgactttcactggccggaaaccaaattcgtgagctggtgcgcttcattactgtattatatatcgaatcccaacatttgaccacccattattaaccttttactctccaaaattcgcgaaattttccgcttgaggctttaccctaaaacagcacattaacaaaaatatcactaccatgttgcgaactttttcaaaattccacatattaagaatattataattaatataaaatttttcgagataaaataagaaatgcctaacttttttagaccaattccggcgcgttcatctacctttctaatgtgggctctgattttgtttttgtaacatggcattacataatgactggccattcttcagcttgtccaccttgaccttagccaaaatcgcatcggtcgcctaacaaaagacgtttttgaacgattggactctttggaatggctttcattggacgtaattagcccaattatcatttttacgttaaattttaatccagttcaacaaaatgcttgaatttccccgcaatactctttctccgctgaaccggcttaagcacctctcaatggagtcaaatttgttgcaaatgttgcccaattatgcctttcagtaatattaaattgcttttgctttttaattacccccttttttggtggcttgtccatcttcaatggctttcattggcccgtaatcggtttgtttaatcccggttcatttaattaattgccatttcctaattctcaggttgtcttcaattaatgcgaaaatgttccactcaacaagtgccattcaaattcggtggctcaatttggccaataatcggatcagtcggatggagacagccgcttttcaggccccacttggaaatgttgtccattaaacatgcgtcttttcctgttttagaatttgccgaatttggaacgcctttatttgtccaacaatcggcttacaactttgcccactcaagtcaattgatcatggataattagcaataatacttttctgtcatttcattaaattttgagtttagattctttcgtcactgaagaatttgcgacaattgagcttggctcacaatgacatcaatgaaacgcaggaaagcgcgtcagtccgacgctaatttgctcattaatgcaaatttatgcttattttcagtttcgccaatttgccccaccttgaagagctgacaatggcacacaatcggttgcgcactatcaaagagggtaacacacaaatcattaattatttaaaccgaccgattgatcaccttcacaattattagctttgttacgcttaatcaccccaggcgttttcgacaaagtgccgagtttgagccgacttgacttgtcgcacaatcgcatcgaagcattcgacttggattttcttgggccaactcaagtgtaccaattgcgagtgcttgatttgtctttcaatgtcattcgaaagtaaaataattaatttaaatttattatttaaaaattttcagattggaaattcaatcggccaaacattcgcttcggtcttggacataa

SEQ ID NO: 84927 - DNA, 1086 bp, Heterodera glycines
  Genomic contig location: Contig_ID=SeqID_20140; Location=46..1131; Strand=-
  SCN-specific regions: Sequence locations=1-448,471-1086
atgtctgggccaatacaaaaagggatcatcaatgcactcaaagctctggacaatgccaaaagcgccacctcactccttctacaccccgacccggacctgtcaaactgggaaaatgccatcaacttggaggctcaatttgatcgcgtcgtcaaggaaatccgtacaacggaaatgcagatggacagtctacgagacttatccaacgcttggattgaacttctcgcccgcctgaccggagacgacaaagacaacggcgaaaaagaatacatcaaattcgacaaaaatgagaaaatcgccgaacgatacgacgcagcatcaaccaaacttcgggatttgcgagatctcgaagcaacactcagtgccgcagccaaactgcacagaggcagagccgacagggaagcaaaggcggatcaattggccaatccgcagcaacaaccgcccatgccaccagcaatggcagcaccaatgacaatgccaacattcacagcaccgctctaccaattccagccaattcaactggataaatttttcggccaaaagcgaaaatggcccgaattctacgaatccttcaaatcggcaatcggcagtcaatcaatcagtaaagcgcagaagctgaacttactccgcaatctactgggcggagaagcgcgagaactcatagcgggcttccgactggaagacgcaaactacgagacggtccttcagctgttaaaggacacgtacggagctccggaggaacacatcagaagtcttcacttcgaactggccaatctcaagccgtgccgaagcctccgtgagaccaaagactttatgcttcaacttgagcggcttacaagggagctgaacaatgccggagaggacatcgaaggtcctcaagtgttcctcatgctggagaagaagctgactccaccattcctacgaagcatcctcacaaagaaaggagaggatccggcaaactggacgacaaccaaattcctggatgtgctaaccgaagcagtccggaaagaagtccaaatccaagaagtgatgggagaatatggccatcactacgtccaaccaaaagcagaagtcgtctcagcagcacct

SEQ ID NO: 84928 - DNA, 629 bp, Heterodera glycines
  Genomic contig location: Contig_ID=SeqID_20142; Location=190..818; Strand=+
  SCN-specific regions: Sequence locations=1-362,400-629
atgggccccggacacctgccggtaacagctgttttcacaccctcaaaggtgtgaaaacacatgttttcacaccacccccggagcccgtggggtcactgtccataactactgaaatcatttgcgcctcgtacatttgcggtccatttcttcagagcctttttcgcacatttgcggccacatccaaaaacgacacttgcggcccgactttttcgacccgaaccaaaatgggcgctgatttaccgaaaatccttttttgttatcttaaaatttacgcgaactttattcaaccagggcaccgcaactcacatgagtcacgtggtccaccgaaaaaaccaattctgaattcttcaatgatttaccacaaatacaaaaaatgaaataaaatagaaaaaataaaattttttgggttgagaaaatttcgtaattttcgaaccatgtcacgcattgttgttgaaaattgtctttttttgcaggtgattgttgacgaaattgtccaagcggattgtgacaagcttttgttcaaacacacttcgtccgtccctctccatttggataagttggccgacaatgcaataactgacatagtttttcgggattggatcgacaatctcacagaatgggtactgtag

SEQ ID NO: 84929 - DNA, 604 bp, Heterodera glycines
  Genomic contig location: Contig_ID=SeqID_20143; Location=47..650; Strand=-
  SCN-specific regions: Sequence locations=1-604
atggagtttgaagccgaatgtgtagatgcaatgcaaaaatgcatggaatgcggatgggcaaaatgcattccgcaagagggaatcgcagcgagccattgctgcgccgcagggtacaactttacctgctgcaccgaggtgaggttaacgaagccacaacagtacactgagaaattggtaaaatgctaggcctcgggtggtaattgaacccaagcgtctcgtccacccaatccgtagaaagccctaccactgagctaccgaggcacaacggtgctatgatgacgttactcaaaaaccatcaaaatgggcgttcaaaaaactatcaaaatcaaaaaaaaaaaattttcatataactgcataaaagcaactaaatttttttttcttaatatcattcggtagcactaagtgttttccattatcatgcaaactttcaaaaagtttcattaagtttaaagaaagttatgacgaaaaatgttcaagaaaacttgggtttttgggtttctcaggtcataactttttttgaaacttaataaatttttttgtaattttgcaggataatataaaacacttagggctatcgaaagatatcaaggtttttaaaatttga

SEQ ID NO: 84930 - DNA, 1040 bp, Heterodera glycines
  Genomic contig location: Contig_ID=SeqID_20144; Location=538..1577; Strand=-
  SCN-specific regions: Sequence locations=1-323,359-603,625-924,946 -1040
atgccttcgtccgcccaaagaaagcgtgccgaattgcactggggtatcatcggcttggggaacatcgccaatgattttgtgcttgcgatggcttattgtcaacacccgaacaaagtgccgcaaaaatttggcacttttgcaattccttttttgaggtgaccgccgtggccacttccaattccgtggaaagggcgcagcaattcatccaaaaggttggcctgaacagcgaacaggtcaaggcttatggcaactacgagcagttgctgcaggacgccgacgtgggtgagttcggtttgggtttggccgtgtttcggtcggttggcaattaactaattaattaattaataattaattaattcgccgttttcctttcgtcagacgtcgtttacatcgccaccattaacagcacccatttgccccttataatttccgcacttgaacaccacaaaagtgtgctgtgcgaaaagccaatggtttattcaagtgccgaactttccgttgtccaaacggtgcaaaaaacgatcaatcgaagggagggaaagaaactctttgtgatggaagtaatgcaaagatggcggtaatacagctgaattttggtcccgacaaaaaataaatttcattttccttgggttcggatccgcagccaagctatttttcgtcgggagtacaattctgcaatattaccgagacggcaaagtccaacaaaccaggccaaaatgtccattttcagggcttttggtctggtttctttccgagttggcagaaaatccgacaaacggtgcgcgacggacagatgggcaaccccaaattggtctcggtggatttcagtcaaaaattggtgagtcgaccgatggggtgattattggtcagttagtgcattttgtccccttttggttagcccgacaaacggcgcgacctttccaatggcatttgtcccctggtggacatcggctgttacaccgtcgatttcgccacttttgtttttgagggcaaaaaagtgatcgacgtgaaagtgatcggagatgtgtctgctgaggacg

SEQ ID NO: 84931 - DNA, 901 bp, Heterodera glycines
  Genomic contig location: Contig_ID=SeqID_20146; Location=62..962; Strand=-
  SCN-specific regions: Sequence locations=1-50,73-172,202-763,786-901
  Gene Ontology: Mol. function=signal sequence binding; Cellular component=signal recognition particle; Biological process=signal transduction
atgggcgacatcgaaggccttgttgaaaaggtcactgaaatggggctggaggacaacgaggagctgatcaagcggcttaaacagggtcaactattgccgaattttttcaataaaatttattcaaaaatgcaattttgtcaggcctatgaccaggcggggggacaattccgcgaaaaaatttttaattttcaaaaaaattttggcagtgttaatttcaacttttttttcatttgtacttattaatttctttcaaatttcatttcccttcggtgcttgagacatgcccctattttcactataattttttcgaaattttatcacaaaaatcgtccaaaattcatatatatttttttggcatttatcgtttgtattaaacaaatttttaggtcaatttacgctccgtgacatgtatgaacagttccaaaacattctcaagatgggcccgtttggtcaaattatggtaaaccaaaaaaaattcccaacaaaattttctaatcccccccccttccatttttaagagtatgatccccggatttggcaccgattttctgtcaaagggcaacgaacaggagtccatgtccagactgaagaagttgatgaccatcatggactcaatggctgacaacggttggttcagatttatacaaaaattttttaaattttccattttttgtagagttggaccacccaaaagccaacgatttgttcaacaaagagccaacacgggtgtgatatattttatatatgttttttgacaagttcaattataaaatttatcataatccatggataaaaaaggggaggcgcaaaactgtaaatctaacgaggggtgggtaaaaattcaaaaaccgattgtcaaagattttttttttgccattttccgtcaaaaattcaaattaaa

SEQ ID NO: 84932 - DNA, 483 bp, Heterodera glycines
  Genomic contig location: Contig_ID=SeqID_20147; Location=1394..1876; Strand=+
  SCN-specific regions: Sequence locations=1-483
atgagcgggccaatccgctcaaaaatcgggccttgtgccgcccgtaccaaggcctacattgaggcggccacggtcaatctcggaaaggacacgacagacgtgagcattcaagcagacctcacagcggagcgccgtggactccgccgagcgattcagcttttggaggattgcaatgacaaatggcaatccctcctgctcaaattaaatggagccgaccgccaacaagaggagcaacgctacgatgactttaagccatcgggaaagcacttcatggaatgggcggacaaagcccgaggtgcagtggacacgatcgatggagtgatcggtccagaggatgacgacgaaataactgagagcattatctctcagcccgccaatcctccacaaattcaacatgttcagcctcccccacctcgccatgaagtgaacttacctcccatctctctcccaaaaatcaccgggagagccaagggaagggccaag

SEQ ID NO: 84933 - DNA, 84 bp, Heterodera glycines
  Genomic contig location: Contig_ID=SeqID_20147; Location=87..170; Strand=-
  SCN-specific regions: Sequence locations=22-84
cagcagcagaaatgaatgaatggaaatgtggaagtgagcatataatgaaaagggtgccctttttataggccaaaaatgtgaggg

SEQ ID NO: 84934 - DNA, 1674 bp, Heterodera glycines
  Genomic contig location: Contig_ID=SeqID_3502; Location=22..1695; Strand=+
  SCN-specific regions: Sequence locations=1-165,187-1011,1033 -1288,1315-1356,1382-1674
atgggtgataagctggtatttgatgagtttaatgaggaagcatttaatattatggggaaatctgaaagtaatcaaggattataatcaatgattacgagttgttaattattgggtaatattaattaagaagcaattaatcattaaatggtgataaattaataacaattttttgtcaaaatgattttacggaggaattttatggcatgggtgtgaaataatattaatgatttatgacaaattaccaataatggtgagtagcggtgtagtggggtaattgtctcattgaccaactgtcatttttaattatcttccttgaaacagtctggtgtaagtttaactaactatcagttcctaacatccaattattaaatttgggaaatttatgaattaattattttttattgggatgattttacataggaagtttatcgtttgggtgagactcttcaaacttatgtgattaattatgacaaattaccaagaatggtttctagtatatgcttgtgaataatgagtcctcgccaaccataaggtctaattagtgtcagtttgtaacgacatgatatatgattcacaactaatcactatctatatgccattgtttttagatgagaaggtgtagtaattgatgaatttaatgatgaagcattgaacatattatgagtgggaagtatgaaaaaatcaaagaattttaattattagtgacagttgttaaatcaatttttgggtaatttaattaagaaccaattaatcaactaatcactatctatatgccattgtttttagatgagaaggtgtagtaattgatgaatttaatgatgaagcattgaacatattataagtgggaagtatgaaaaaatcaaagaattttaattattagttacagtcgttaaatcaatttttgggtaatttaattaagaaccaattaatcattaaaatgcgggaaaattattaacaaagttttgatcgagatgttttacatatgtgttttggtatggtcgaatcccatgctaaaatactccaattgctaatagggtatgacatctgcattaattataattataaccaattattctttaatttttacaaactgaatatttctggggaaagaagggttatgatggaacttaaattatgtgccacatttttgttgtaattcaatgaagcagaatacttgaagctgagacaaaggaaatgatgaacactaaatgagtatgataattgttgacagattaacttaattatggtattgatggctaggaaatatggcaattaattctaaaatatctgaaaaagaatgcaactttttgggtagcgataaaccttttttaagtaagtaactaattattacagccgcaaggattttagaaatgtataaaaacaaggaaaataataaaagatgaattttcggtagccaatactcggctctccggtcaccaatacctcacaaggctcggatctccggtagccaatacctaattaagcttggcccgccagtaaccaatacctcataaggctcggctctccggtagccaatacctaattaagcttggcccgccagtaaccaatacctcgcaaggctctgacaccgaacactgaaaacttcattcttttgactatgaatttttatttttatgcaaattgttatcctcgtggtctaaaatttatatgaga

SEQ ID NO: 84935 - DNA, 1862 bp, Heterodera glycines
  Genomic contig location: Contig_ID=SeqID_3502; Location=1970..3831; Strand=-
  SCN-specific regions: Sequence locations=1-98,120-350,375-462,484 -999,1021-1069,1091-1137,1258-1308,1330-1581,1606-1829,1855-1862
atggaatatgtgcttaaactccgtggattgacactcaattatgatgtgatcaacaaccaaggctttagatataaaaacagcaagtcaaacgttatgctcaaacaggagagattgaaccaattaatgtaatatacccaaactttattagacccaatattcgtgatggtggatctgtaatatcaagctctatgcaaaaatgttatcagccttatattgggaagggtattgtaggagccgattataatgttctcaattttggacacactttgtaattgctcacccattataatgtcttttcaccattcattgtaattgttcacacattgtaataccttcttcaccaatcattgtatctctctcacacatacacatatgtacccttttgtattttgttcaccatttattgtatctctcttccacacgcataaacatataccccatacacacgtacacatacatgtaccccttttatttctctattttataccaaaaattgtgttattttgtcgttttattcacgtttttaataaaaatgcatacataattaagcaatggaagacacaatttgtaaattattaagcatttgggaacgtcatttttaggtagaaaaatgcataattaagcgaaagaagttacaatttgtaaataattaacgagttgaagatacattttgattatgtgcacgaacttgtcgtttttaggtagaaaaatgcataattaaggagtgaacatgcatgcagaattaagcaatggaagttacaatttgtaaattattaagcatttgggaacgtcatttttaggtagaaaagtgcagaattaagagaaagaagttacaatttgtaaattattaaggaatagaagatacaattttaaaatatgcacgagcatgtcgtttttaggtagaaaagtgcataattaaggagtgaacatgcatacagaattaagcaatggaagttacaatttgtaaattattaagcatttgggaacgtcgtttttaggtagaaatatgcagaattaagagaaagaagacacaatttgtaaattattaaggaatagaatatacaatttaacaaaaattaagaaaaataatgattaaatgaaggaattactcaaaaatgtgtaaaaattacacatggggtgtgtgtgtgtgtgtgcatgtgtatatgtgtaagtgtgcgtgtgtgtgtgtgtgtgtgtgtatgtgtatgtatgcatgtgcgcgtgtgtgcgtgtctatgcgtgtgcgtatgtgtgtgtattgtatgttttttcgagggtgaagataagtgtgtttgaaagttctgcataatatttattaacttatataaaactagttaattttaatcataaacacaaacaatgctccttgcctaattcaacgtaaaataattctaattataataagcaacagacgagaaagggtagataagggctaaatgtatgcgtgaagcaggtcttgtaataggaataaatgaagaaatcatatgaggatattgtagtgcaccatagaatcaatgacaattaataatgggtgtaagagatagagatagagaactcagaaatgtggttgaagagagtcaatattaaatattgagaatttaatgtgagttagtaaggcaaacattaggtaatgtatagggaagagaatagtttgataaagaacaagaatacgaacacttggaagataacggttcgagaataaaacatagtgttggaagaaaagatattgaaaaatagctaacggaaacgattatttagacaatatgtaggtctgaaattaataaggaataacagtgaaagtaaacagatatagaagagtagagaaagtgtattacagagaaaaggaaaataattcaaataaa

SEQ ID NO: 84936 - DNA, 382 bp, Heterodera glycines
  Genomic contig location: Contig_ID=SeqID_3502; Location=4057..4438; Strand=-
  SCN-specific regions: Sequence locations=1-382
atgacaaacaatgagatggctgagcaatctgcatttcaatcgaaattaatgttactacggttgaagaaggttacccatttaccaattgacactgacataaaaggaaatggtgagaaggaagctgaatttgtaagagagtgcaaagagaaattagaaatcttaacccaacaaagatagttgtgaaccaagaagagtaggattgttaaactatgcttgaacaatttgtgcgacatatttctttacgaaattacagcctttaacagactttacttcaataatgatgtacttgattttggagaatatttgggataatcgttcaatagacgtaatgaccatcgaggattgaaaggtgtatcatgttttgattacctacgaaaataaa

SEQ ID NO: 84937 - DNA, 708 bp, Heterodera glycines
  Genomic contig location: Contig_ID=SeqID_3502; Location=4926..5633; Strand=+
  SCN-specific regions: Sequence locations=1-291,313-459,481-514,666 -674,696-708
atgctaaacatatccgcttacttctattgcagttctctctgtttccaactattcatccacagaataatgatcaatttgccaagtgttcagttgaaaagttattgatctagaaatatcgcaaacaggccttatactagtcatacattcctttagtacatcaatgggtactaaaagacgctgccttccttaataatgccttagttcctttgagacatcaaataattccctcctaaacgataccagcgctgtcattaaaattttcaatgtcattacattttttctcattaattgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttaggtataatttacttaattttaatcaatactattgtatttattatttttattatattttaatacaactttaatttaattttttaatttagttttatttatttttatttttatttaacatttattttcttttaattttaatcttatttttattttactttttatttgaattaatttgaattttattttactttatttattattcagttaatttaaaggagttgttcagaacctctatcca

SEQ ID NO: 84938 - DNA, 703 bp, Heterodera glycines
  Genomic contig location: Contig_ID=SeqID_20148; Location=310..1012; Strand=+
  SCN-specific regions: Sequence locations=1-200,222-703
atgatgaatgaaactggcaatgaggactggtttgataacgttgagaatttgcgtccgattcgtggagggagacgggcagatactttgaatgatattgcaactgggaaagcaaaggttttcataacattttttgctttactaaaagcctctgtttcaagatttccattgaaagagctgagcaaaaatttctcactgaattcgcaaatgcatccaaagggtccgacccattggagccgatgtaccgcttcacaatttggttcgaggaacatttcccaagcggaaaacaaaaacatttctgtcaatttctttataaaatttgcacaacttattgcttggtgaatgcctacaaaaatgatgatcgcctgatgaaactgtggctaaaattgacagaaaattttcccgagagtggcttcgctataatggaattcgcattttccaaggggtcttgtcgccaattggccaagttctacatacattggagcaccatgtatcagtccattagtacgttttatggtatttgaaattgaggaattgaactgcatttacaggttggtggaacaaagcacgggagaagttgcagctgggccaaaaaatgtgtgcaatgccattagatttgttgcatcgggcggttgacgaattggaagcgtcagtgatgaaagtgacgcgaagcggggagaacagcgaagagactgaagcggacgag

SEQ ID NO: 84939 - DNA, 444 bp, Heterodera glycines
  Genomic contig location: Contig_ID=SeqID_20154; Location=1602..2045; Strand=-
  SCN-specific regions: Sequence locations=1-87,142-169,303-444
atgcatggtggcaagcggcccagtggtcaagtggttagtgtgcctgccttttatagtgggttcgggtcccactgcttcagggtaatcttaaaaaatattatatataattctattttttgctttgtttttttatttaattaactttatggaaataaaatattagttattttaaattaatgaaataagatttatttaaaaacaaattcaaaaatgaatttaatattaatcaaataaaataggtaaataataataaaaaaataatataataaataaatctaaataatatttaagataaataagtatttacaagtacaagacaagcaatccggtgaacaagtggttggtatgcctttctttgttggtgtagtgttaaagttcgatcccattaattctgattatcaaactttttaattttttttttgataattacgtttaggaaataaa

SEQ ID NO: 84940 - DNA, 669 bp, Heterodera glycines
  Genomic contig location: Contig_ID=SeqID_20154; Location=2237..2905; Strand=-
  SCN-specific regions: Sequence locations=1-453,485-594
atgtggattaggaagatgagcccagtggcaaaatgccataccaaaaacaaagatgagagcggtaaatgccttatcaaaaatttattccgtatataagaaatttatacccatgatccaagcttaaaaactaatttaaggctttctagcgagttttacggggcgcgagtggtatcattcgatagggttttgtactggctataaggaaaaactatcggcatcccaatcggttaagcattgttcgaactgtgttcgaaaaacgagtcaaaatttgcactttttttgggtgtcccatttttgaacgctttttgcatgtcttaaaaagggtcaaatcaaaactttaatatgtttgtgcacatctacaaactcttggctttcgaatgataccagggttgttttggtccgggtccgggaagtgctctaaaaagggaggacaagcacttttggtcgggatttcttccaaaaaagaaggaaaaggaaaagggaattaaacggggaagaggcaagcgacccggtggtcaagtggttagtgtgcctgactttggttctgtcatggcggggggttcgagtcccattgctgatgtttgttttctattcaatatttattttaaataattcatctttttttctttttagatttatttattgttttttaattaattaaaaaataaa

SEQ ID NO: 84941 - DNA, 415 bp, Heterodera glycines
  Genomic contig location: Contig_ID=SeqID_20156; Location=268..682; Strand=-
  SCN-specific regions: Sequence locations=1-19,41-125,178-298,370-382
atgccaaaagctgaaatgatcccaaaaaatgaacccaaaaagtgtctcatctgtggcggattgtcttctttcaaatattacagtatccctagttgcgaaggtaatggcgcaagcacttcttaacgaaataaattcttatttaaaaaatcgatatttttaaaattttattttaaatttgtggtttaataatttcagtaatttcagcgtgtaaacagttttttcgtcgcacagttatgctgcagataccgtacgtgtgcaaaaaacgcggcaattgcgaaatgtcaactccatacaacagtaaaattcttttaataattttcattataaattatcaaaatgtatgaatgaaatataaataacataattaatggactgctataagtatatataattattattaaaaaatttaaataaa

SEQ ID NO: 84942 - DNA, 1624 bp, Heterodera glycines
  Genomic contig location: Contig_ID=SeqID_20159; Location=253..1876; Strand=-
  SCN-specific regions: Sequence locations=1-332,355-559,582-732,760 -906,928-1019,1054-1076,1098-1218,1263-1624
atgaatttacaaaaggccacctgtctttttggcactcattttgttcgacaatcgtccgaccaactcattcgagaatgggtgaatgagaatttcaaaaacacaaatgatttcgggtcattgcttgaaaaggtaaagcaattttaagtcgatgggatgcttatgtatatcttaccttggttaatggttgaataaataatcttttttgaattaagcttaatcttcagattgagaattttattgcatattatattgtcgcattgccgtgtaagctgaacgaaaaaatgaatgaacagttaacgaacgaaatgacaacggaaattgggtaatgaataatttaaattgttactttttaattcagtttgatttcaaaattttaaaatcctcatttcagtcataaaaatcatcatttgccactaaaatagctcaaaaaaaaaatcctcatttgaaatgaaaaatcctcattttttaaaacataaaaaattgcaaacaaaatcaattaagagtcatatttttcgtttaaagcaatcatggcgcctatcagcgccgccggaccccaataattcctattttttcttaaaaaatggcacaaaatcacaaaataggtaattttggtaaaaatctataacaaatcacatttaaaacctcaaaaatagaaaattcgatttctattattttaaataaattgacaatctcttaaatttttcgcgtttaaattgcttttttgtggcacggttttccaaaaaactttttgggaacattgggaggagtgggtccggcagtgccggtaggcgctgccggaaaaaattggaattttgagtgcgatttgttaacagattttgccaaaaaaagatcggctcttctatttttacaaggtaaatcctaaaaaagatttaagtgcaaagttttggcgttatgattactaaattaaaaataaacttacactgggagcccaacattgactcggaatgatcaaaagaccacaaaaatccgcaaatcgctctttggtcaaaagtttaaagatttaaaaaaaaattttttaaataatattttatagcatattttcgcatctaaatgaccaatttaacattttagtgtcagtttttgaaatttaatgatcttagtctgccgacggtgccgtcggaaaactttttttcaaacataacgaactttgttaagaagaccgacacattttcaaaaaaaacacaatttaactttaagaaatatttttaaaaattattaattacaattatttttaaattttagtggggaaacaattcgtctgtcggagagtcaagtgaagcaggtgaacgaaatgttgtcggatgaccaccgatgggagaatggcaacgaatcggaggccttccaaaagctgaagcgagaattgggctgggacgccaaatacgacccaattttgagcaaaattgcccaacggacggtgggcatgacaagccaagtggagaagaacatggacgaccacgcggcacactgtgccgcagctttgctcagcgaactgtcaaatcggcacgattgggtgcggatgaacccaaccgaggcggaatacgcaacaatggacggaataatgtgtgtacacgtccaaatccaagacgctttgttccaaatttag

SEQ ID NO: 84943 - DNA, 479 bp, Heterodera glycines
  Genomic contig location: Contig_ID=SeqID_3503; Location=168..646; Strand=+
  SCN-specific regions: Sequence locations=1-404,427-479
atgtcgagttggcctggcacgcctgaggcactgctggctgggatgttcaaacattgtatcgaggaggcagttgctgacagccgtgagcggggcattgaacctacacacctcggctgtatgatcagcagtcctctgctggaagacggagacattccaaccccgatacaacaaatgacaaacaacactctcgacaccattctgagccagttcaaaaaaatggctcagagcaaagaattggaagatgtgatgctgtgtggtgaacccttcaccgtcaccataacgacattggaccgtaatggactgggacgggcctaagaaaaaatctacgttcctatccgtctcaattcgtattcaacttgtgtcacataatgtattgtttttgtctaccctatatcacacgatcattcatttgaacaatttattgagaaaatggagagaaaattcgacaaactccaatttttatgtaataataatgatga

SEQ ID NO: 84944 - DNA, 2623 bp, Heterodera glycines
  misc_feature (1829)..(1829): n is a, c, g, or t
  misc_feature (1977)..(1977): n is a, c, g, or t
  Genomic contig location: Contig_ID=SeqID_3504; Location=1864..4486; Strand=+
  SCN-specific regions: Sequence locations=1-938,960-2101,2123 -2157,2179-2623
atgcggattcgaaggcagaagaagcgcaaccctaacattgttttccgggattcattcaacttgatgccaatgtctcttgcctcgctggttccatcatttggcttggacgtggaggacaagccattctttccgcacatggccaaccacccagacaactatggaaagcagatccatccaacaccagacgactatttggtcaagggtatgatgccagataaacgacagaaattcgacgactggtatgaacaacaccgtcaggaaccattcttcctcgacgaggcgttggcaagctactgcaccaacgacgtggagatactgatggcggcgctgatggcttttcgtcatgagtttttggatgtgacgaaacgaaatgaaggaatcgttgcggagcgtgcggccttctatgagcaccacgacggcattgatgtgttgcgggagtgcatgacgatcgccggcgcatgtatgaagcattttcgcaccaaccatctgccgaagaagcatttggctatcgtcccggaacgcggctacgacaacgcccaaaaccagtcgttgctggcacttcgcttctttcattggtatgcggaggagcatggtgttgtggtgcagacggcgcattcggctggcggagagaagaaaattggccaatattccgtggatggctgggtggaggaagaaagaagagcaattgaagtgaatggatgtgtatggcacggctgcaaggactgcttccccaatgacaacatgatgatgccgaatggaaaaacggctggagaggtgcgggagcgggatgagaagcggctggaattcatcgaaagtcaagtgtcacgagtggacgtgtactgggaatgtcaaattaaaagaatgctgaaccgtgacccgtacatgtgcgaaagttttggtgattatgtggatgatggcccgttggacattcgcgaggcgttcatgggtggcagaacaggaccactgaagctgtaccacaaggcgggagagggcgagaaaatctcgtactatgactttacgtccctctacccgtacgtaaagtgagttttgtttcgatcattattcacaatttataattttttatttccagtttctccaccacttacccgattgaacacccaaaagtgctcatcttgaatgaaaatgtggagtggacaagagcacgcgacaacccctacaaattgtctctgctcaaggtttgggtgattccgccgcgaaagtgtgatgtaccagtgctacccgtcaaagtcaacaaacggctctgttttccgttgtgcatgcaatgttgtctagactacccgaaaggaggcgttgattttgactaccattgtgaacacgacgaccaacaacgcggatgggtcacaacatgcacatcaattgaattggacgcagcacttgaagagggctaccgcgtgaccaaagtgttccgggtgctgaagtacagacatggcgacgacaaacttttccgcccatacatcgctgagttcatgtcgcagaaaattgaagcttccggatttgacgccagcattaagggaaatgcggagttggagcagcagcagttcatcacagaatgtgcggagaaattcggaatttcaatcgacaaggacaacatgaaagtgaacaagggcaagcggtcgttggcaaagctgtgtctcaacaacctgtgggggcgcttctctctgcgcaacttcggcctcgcccagaccctcatcacagacgacccttcagtgttgactgaatacgtggaaaacagctcaattgacatcatttccgttgatgagctggacgaaaaacatcaattgatcagctacgtccagaagaaggagggngtggaggagcacgagtgctccaacattagtgagattttttcaataatttttgtataattttgggatttttcagtaatctcactctggacaacatcaaaggcccgccttctgctgttgaaagcgatgcagaaggtggtgagaacccccnggatgtcggttgctctacactgacaccgactcgctgattttcgtccacccgatcggcatgaacccgttggagacaggaccacacttgggacaattcaccgatgaatacccaaagcatgaaattgtggagtactgtagtggcggagcgaagcaggttaatttaccgtttatttagtgcataataatttatactttatcattttagtatggactcaaactccggcgtaatgggcaggacgaatttgtgctgaagctgaggggcatcacactgaactacgacgtgatgcagaaccaatccctctgctacgacacattcaaagaagaagtgttgcggtatgcccaaaccggagagtatgagcaaataaatgtgatgtacccaaactttttgagaccggacattaggggtggcggacacgtcacttcaggccccctccaaaaatgttatcgcccatacgtaggcaaagggatagtgggccctaattatgatgttctcaatttcggacacattttgtaaatttatcgtttatcattcattgtatctctcacatacacataccccatacacacatacacacgcatgtaccacctttgtttttcatgttttataccaaaaattgtgtaattttgtcattttatttgcgttttta

SEQ ID NO: 84945 - DNA, 1028 bp, Heterodera glycines
  Genomic contig location: Contig_ID=SeqID_3504; Location=4830..5857; Strand=-
  SCN-specific regions: Sequence locations=1-1028
atttgttctgctacaatggtccttgtaatcgaattttgtgcccaaattctcggctgttccccgaaatcactccgcgacaagctcaatcatcctgaggaccgagtgaaggcattgaaggagctggtcggaaaaaaggttcggacgacataccaggaccggaatggaatgcagaaaacattttttgtcgacggaatatcggacaagggagcggctttaaccccggcgtatggcagactcagacaaccgtacaacattaacattgctgcccatttctacgctcgccaccgtatcaagctgcatttcccatacgtgccgtgtgttgtggagaaatactccgggtgtggcgaagacagatactacccaatggagctactcgaaattgtggatgaggactacaccaacaaagagcgatggcttggcaaattgtttaccgaaatcgaggacgacttcattcctgtcaaacgccttggtcgagttgacgaagtcgaagaaattgacgacaatgatggtggtggtcgctacgaatgcagtcaaccatcttacgtttattggtaaacacatgtatgttaccttaataatgcacttttctacctaaaaacgacaaattcgtttttaagtttatacaaattgtatcttccactccttaataatttacaaattgtgtcttctttctcttaattctgcacttttctacctaaaaatgacattcccaaatgcttaataatttacaaattgtaacttccattgcttaattatgcatgcatgttaatgtccttaataatgcacttttctacctaaaaacgacaaattcgtttttaagtttatacaaattgtatcttccactccttaataatttacaaattgtgtcttctttctcttaattctgcacttttctacctaaaaatgacattcccaaatgcttaataatttacaaattgtaacttccattgcttaattatgcatgcatgttaatgtccttaattatgcacttttctacctaaaaatgacaagttcgtgcacataataaa

SEQ ID NO: 84946 - DNA, 402 bp, Heterodera glycines
  Genomic contig location: Contig_ID=SeqID_3504; Location=5990..6391; Strand=+
  SCN-specific regions: Sequence locations=1-402
atggcagatcaatttgtacaacccgaaactgcggaggagcaacaagtgaaagctaagaagccaaacgttgatgagcgatttctttggaaaatcacgcggggccaatttgtgcttgcgattcggctgtgctcaggttaatcaaatttctgacgacaaattaattgacagctttcagaggactggaacaatttatttcacaacaaagacaagacacgtcggctggaagatgggcgagtggcgattggactcgagatgtgtgaagaatgcgctaaacttaattgttgtgtcagtgatctgatcgctggccaaaaaaagaaccagaaaaagccggaatgaaattgatttttaccgattaatatttttaataatcactcccactattttgaatttatcttgttttta

SEQ ID NO: 84947 - DNA, 2296 bp, Heterodera glycines
  Genomic contig location: Contig_ID=SeqID_3504; Location=7175..9470; Strand=-
  SCN-specific regions: Sequence locations=1-188,223-317,341-404,449 -567,598-774,804-1071,1093-1170,1192-1516,1538-1611,1633-1757,1793 -1806,1829-2066,2101-2128,2150-2296
cccaaaacaaggatcaagttgccaagagggaaagtcccggctcgcgtgcagccgatcacaaacaacgagcaaaacggtgcggaggaggagcagatgtacgaagtggagtccatattagcaatgtcagttttgacaactggagaacggctgtattatttggcatgctgtggtaataattgtattttacaaaattgaaaacattttttgttttgggttataggatcgcccggtcatgacagttgggtacggtcgagttggtctgaagcattggagctgaccgtcaacttcattgaagatctaacgatcaaccaagtgctgaaggcactgctcaacgaggaggcagtggaggcgcaattggtcgtaaaattgacaacacacccgttgtttgtcagatgtgggttttcaaaaaaaaaaaaaaaataattttttaataattcaaataaaattagtgcgcgagctgctcggcaaagccaatgacccactccccaccacaacaaacatcgtctatgctaaggacaccacacaagcgcaacggacgaaagtgaataataatttgtccatatgaattaaataaattaaaatcatcaattttgtctctcatttttatctgatccccactctggctgaccttcctttgtgttggtcgtccagagtggggatccttattttctcacaatctttttaagtgatggctgaccttttttcatattggttgtcctctcttattaagattgtttcattaatctgataataataactataaaattcgtcgacataatttttaaattgatttaattatttaaggccgtcgattctcttatacagttcaaggtagctgagaaaattttcgagtagtgactgaccgttttgctcggcttcgctcattcgtcggtcggctgcttcacactcctccatgcaattcttcgacaatccaacattcactcattttaattatgtttaaaaattcactcattttaaatattttaatatcattttgatcaatccgttgcacacatttactcattttaaaaacacattttcatcaatccgttgctcacactcactcattttaatcattttataaacacaattttcatcaagccgttgcacaacattcacttattttaattattttagaaaccctcaacaattttcgttttcaataaatatcatcttttatatatttttggtgaaaacatttgttaaacggagatcgtccataagataagcactgaatgggctatagtggcgggtcatttgttgttgttatgatctggacgggtcaattgtatgggccattcattctttgaagatgtgccatatccattcattcagcggagttggtctatggccattcattctttcattttccaaacaattttttagaaatggaatatccttcaaatttgacttgggtggtcgtgccccagtgcgaatgtgtagctccgttgaatgtttgcgttagaccagccgattaccgccacccaatagtttgtgttcccacctttctggtcgaaaatttcccgaccactatttcccaatgtgttcccaatggaacagacccaatgttgaaagtttgggtcacacttgtgttcttgcttttgcttgaggtccaaatttgaatcaccctttcttttctaacttacacccattgttcagctgtccatcttgctgttgatggttttgatgactcgtcgtctccattctgtcaaaaatgtgcaccgttcaccgccaaaaagcgaatacaaaatggtgggtaataatttcaataaatttctatatttaatttaaacattttccacactcaatttaatttaattttttttttcaaaggccgaatttcattctccgcaacgccgcaaaaccaacaccaatgttcagcatcgtcgcaattttccggtaaaattcagtgtgatttttctgataattttttaatcagccattggccattcctccgttcaagcaccgcactgctcctccagaggcaaccgatgagaatggcgatggattcattgaggatagttggatttccgactcaacggaccgtgaggtagacccctcagtttaaaagttttgaaattttttctttaataaaaattcaagctcgatgccggtgttacgagtgacaaaaacgtcgttgatggtttgccgccgaagccgaaggaaagaaaatacaagtcccattacggtaatctcccacatttctgatcaattaataattacagtaaaaatgtttacagttttgacccccatccccgaagaggaggacaatgaacaggaggacaaggaagattaa

SEQ ID NO: 84948 - DNA, 1920 bp, Heterodera glycines
  Genomic contig location: Contig_ID=SeqID_20160; Location=44..1963; Strand=-
  SCN-specific regions: Sequence locations=1-54,76-168,194-309,353 -464,488-647,675-709,731-828,850-928,952-953,975-1610,1651-1790,1819 -1920
atggaaaaattaagtctcgatttaatcttgagttagagtctagtttttggtcacaatgttggcgcataaaatggtatcaatctcgaaaaattcaccgtttaatttgacaacattcattagcaaatttagctgatgaggaggagtcatcagcagatggtcaacttcaaaaagatgatggtgatgaggatgatgcgtcagtgcgcgaaaaaaagctacagtacaacaaccttggctattttgcgcgatttttgaaaactgagttggccggggcctgtgccggtgccgtggacaaagtgagcgtggcgacacaaataattttttttttgttttttaatttcaatttatttttaatcgctcaggtggtcggtgacttttctacaacttcatcctcctcctccgcttccaacggttcgtcagtggacaataaccgtgaccatgttgacgaacagtacgcgcaacaatgccagcagcaacaacaccagaatgcggttcaacaacaacaatttcaagcagttcaggtaaagtcagttaataacaggaaaattgcaagcgccctaattagcgtaataaaattttgatgcccgggggaggaaaatagcggcctttaaaatcttccaaatttcgaattgtgaatttaaaaagagacgaaaataaaattaaattttaataattatctcatgggccaaagcgacccaaattgatccatttgatcaatttattttgaaatcatttttccttaaattcatgtgatgattagggctggcaaaaatatgcacataaaatcgcaaaatatgcacataaaattttccaattgagggtgtaatttctcaaaatttcttcaaatttgttaaacataaagtaaaatcttcaaaaatggctaaatgtggtattaaaaatcattttaggagaaaaaaacacgatacagcttaaaatttactcattttagcgaaaaatcaacctgaaaaacaaaattttgcttatttttgacataaattaaccattttttgagaaaatttatttattcaatatttttcgtgaaaattttgctaaaaaattatttttttggaaaattttccggtttttgaggtcaaaaaggccaatttgtctgttgggggccgatctattagaggttttttggaaaaacgccaaaatatgcacataaaatatgcacgaaatgccaaaatatgcacaaatatgcaaatatgcacataaatcgcgaaatatgcacaaatatgcaaaatatgcatatggaaagtcatcctagaagcttcaaaacacgctaaaaacatggttttcgtgcgtttcaggcctcccacagtccaggaaaaaaatatgcatgtgcatatttttgccagccctagtgatgattcatcccgcccctcccttcccctgcgggtgctcctctataaaaggcgcaccgctcactcaattgggggtgaagaagaagcgacatctttttcctgattaatcaattttgcatttgtatgctttttcctgtccctttacatttaattgttaaaataaatttttaagtaaattgggttaatttcccgagaattaaggagagaatgaaatagcacccttcgaaatcttccatattccgaacagccaatttaaaattgaatacaaaaaattaaattttaataaatagacctcccctaaaatcacaaaattttttcaaaaaaaaaaaaatcaggtctaataaattgacaatcccccaaaaatagtatttttttctggccaattcaggcccgtttatggacagccgcgttggcattagccgccactagacagcaacaacagcagcagcagcaccaattactgcccgaccaacagcaaccgcaatttgtgccagccgcagctggcacatgccgaccacctgcatcacaaccacccttttcattggcatcgtcaatggtg

SEQ ID NO: 84949 - DNA, 669 bp, Heterodera glycines
  Genomic contig location: Contig_ID=SeqID_20162; Location=178..846; Strand=-
  SCN-specific regions: Sequence locations=1-669
atgtcttcgccaccgactgagcctaatgcttttgcaatctttgatcgggacgaatgttctgattccgatgaggaaaacgacgaaggcgaggtgaacgccgcaaaattgatttattattacattcacatttttaagtccatgctaattgagacgggacatgtgtacgcccaggcagcgcgcaacaactctgaggcggcgcgcgacaacgctgcggcggcacgcgagagtgcccgggccgtacgtgacatcaccgaccttatggtcaaacagctcgagtccaaggaccgtcaaatcgtcgacaaagagtttcaactggcacaaaaaaatgtgctgctggaagaaaaggaccttcaattggaagaaaaagaccggctgttacgccagaaggacgagatgatcgcacgtcttcagggtatcattgcacatggcaaaagggaaaagaaaagtattgaaaaattgattgctcacttaatcaaattttaatgccgaaaaaaatgtagagaaatatttattttttggcaattttgaaaaaaatatttaaaaaatctaatgaaatacacgaaacgattaatcttcttccttttattatccatgtaaaaatttggtgcgattctgatcacttttactctttagtaatggaaattatttgaaactgttcttttcaataaa

SEQ ID NO: 84950 - DNA, 54 bp, Heterodera glycines; identical to SEQ ID NO: 53113
  Genomic contig location: Contig_ID=SeqID_20165; Location=345..398; Strand=-
  SCN-specific regions: Sequence locations=1-54

SEQ ID NO: 84951 - DNA, 76 bp, Heterodera glycines; identical to SEQ ID NO: 51235
  Genomic contig location: Contig_ID=SeqID_20165; Location=1152..1227; Strand=+
  SCN-specific regions: Sequence locations=1-76

SEQ ID NO: 84952 - DNA, 909 bp, Heterodera glycines
  Genomic contig location: Contig_ID=SeqID_20166; Location=1379..2287; Strand=-
  SCN-specific regions: Sequence locations=1-140,178-227,251-321,343 -487,529-648,670-779,818-909
  Gene Ontology: Mol. function=voltage-gated calcium channel activity; Cellular component=apical plasma membrane; Biological process=male courtship behavior (sensu Insecta), song production
tggtcgcattcattacacggatatgtacgaaatgctgcgtaacatcgccccacccgtgggatttggccgaaaatgtccatatcgtcttgcttacaagcatctgattcgtatgaacatgtaaagcctttatattgcattacaattaatataattttatgtgtttttttttaaataaatccaccgtggagatcttaaaaatcctaaatgggaggtgccgtgcgcttcagaatgggggaaaaatttttaaaatggggacaaaaggggccatataatttttcacattttgtgtcatgtaaatcaatcaaaaacgcataggattgatcaaatattatattttttgatagacaaattcgcttacaatgcacaaaaaattggcactttgtaaattttcaaatgtttaacatgggtgggccaaaattgggacaaatgctccccccacaaaaaaacggtcaaaatcgccaccctgacaatgagtaaataaatcctcattttatattaaaaaaatttttttttgattattcattttaaggccagtttctgatgatggcactgtccatttcagcaccacactttttgcgcttattcgcgaatcgttgagcatcaaaatgaggccaggtggataaagcaaagaatttcgaaaaatttaccttttttaaaaaaatttttatagtcgaagaaatggatgaagcggatgaagaattgcgacagacattgcgcaaaatttggccattgaaagcaaagaaaaatatgatcgatttggtggtgccgccaaatgggggtaaaaaaataattaaaaaatttaaaaaattcattttttcagatctttgcttccaaaaattgacggttggcaaagtttatgcaggcctactgattttggagaattggcgagcacgaaagtcgggcgttgag

SEQ ID NO: 84953 - DNA, 1566 bp, Heterodera glycines
  Genomic contig location: Contig_ID=SeqID_20167; Location=353..1918; Strand=+
  SCN-specific regions: Sequence locations=1-112,159-182,214-246,298 -467,506-537,562-698,720-781,807-851,873-1061,1083-1306,1400-1566
  Gene Ontology: Mol. function=structural constituent of muscle; Cellular component=striated muscle thick filament; Biological process=striated muscle contraction
aagaaaattcgccaattggaactggagaaggaggagctgcaacatgcgctggacgaagctgaggcggcgctggaaattgaggagagcaaagtgcaacggttgcaaattgaggtaaaaaaaataatgaatcaattataattaagtaattaattaataatcctctgttttgtccacttactaaattttttattaaaagaatttatgaatagattttaatttgttttgctcaacgaactcgattttgagaaaaaatagaaaataaaatttaatttacggatatattttaatatattttttgttcgaatccaaccaggttcggggttctgagttggatgaattttaaatattgttgttcaattgaaagtttcgaacattttttgcaaaaaattggccgcactcttttatttttacattttttaaacaaactttcataaatatttttattgaatatgaatacattgtacccctaaatatattttaaaaaagtttaaattatgaataaaatcaaaaatcgaataaatttaaggttatctccataaaatccaattaattaattaatttcaaaatttcaaattgaatcaattaaggttggccaaattcgtgcagaaattgatcgccgagtgcgcgaaaaggaagaggattttgaaaacacaatcaaaaatcatcaacgagcaattgaatccattcgtacatcattggagaatgaacagcgaggaaagcagcgattatgcaggtaattagattaatgatgatattaattaaatagtataatagcactggctaataatatttaattaatttttaatggtcgcagtaattagacataattaattaatactctataattgcagtcaaagaaaaagctggaaaccgacatcaatgatttggagttgggcttggacatggccaataaaacaaatatggaagcgcagaaaacgatcaaaaaattgattggccaagtgcaggatcttcagctgcaggcaagtgaaccacaaaatttttttttgtcgtgttaaaatttgttgccactagtgattaagttgtccaggcatgttttgtgctctttctgattttgggtgtctcgattatcatggagtggtctgatcaaaatggttttctagtattcccgttgatcactcactgatcaccggcatttttacttgaattacatttttggcggagaacggaaaaatttgctagtttttttcataattttttttcaaaatggttcattcaggttgaggaggagcagcgtcggcgtgaggaacagcgagagaactttttgatgagtgaaaagtgagagaagaattaaaaatataattaatattttaatttataaattattcaacaaaaaaaaatcttccaaaatttaaattatttaataaaattaaaaatatttgtttcaggaaattgaacattgtgctgtccgaacgcgatgaacttgttgtgcgccgagagcaaatggaacgggataaacaacgggtggaagccgaagtgcaggaggaacgggcgcgcaagacggagctgcaaatggacaactcacagctgagcgccgcgcgacgccaa

SEQ ID NO: 84954 - DNA, 92 bp, Heterodera glycines
  misc_feature (13)..(13): n is a, c, g, or t
  Genomic contig location: Contig_ID=SeqID_20169; Location=13..104; Strand=-
  SCN-specific regions: Sequence locations=1-14,40-92
atgttttttcccnccatattggtcgtcctcctcctcatcggagggctgcgatccttttgcggtgccatagaagccaagatgagtatcaaatg

SEQ ID NO: 84955 - DNA, 1319 bp, Heterodera glycines
  Genomic contig location: Contig_ID=SeqID_20169; Location=319..1637; Strand=+
  SCN-specific regions: Sequence locations=1-70,92-487,516-1319
  Gene Ontology: Cellular component=mitochondrion; Biological process =lipid metabolism
acagcattgaaccgcttcctactgtggctccggcgcatgcgaaatgagttgaaggacgactttggctcaatccttctgttactgctcctctatttgctccaggtttgtgaacttaagtgaacacaatgcacgaaatcaaaaacaattctcctttctccatttttgccatgtcaatagtgaaagcctatattatagggcattaaaattaaaaattttgtccattgttaattttccgaattttaactcaaaaatggtcgaaaactcaaacaactattaattttctctttccataatttactgtttttagatgtcaaaaaatatattcattgtttttacatgttttttggatttccagggcgttcccctcggtttgatcgcggccattccgctcattttgcagtccaaggaaatcacctattcccagcaggcggtgttctcatttgcttattggccattcaggttttacttcgaaattatggcaattttcttttttagtttttttaaaaaattaatttggtcctttgtttgccctcgtttttttacatttcccgttttcagtatgaaattgctttgggcaccgattgtcgattccatttactttcggcgcattggacggcggaaatcgtggatggtaataattttgcattgaccgattttgcatatttcgttataataatttaatcctgttctgatgtaatgctgtttcctttttttatttgaaattatttttcataatttctcattcaactagggcgggggttgctaattttcttaattatttcactaaaattacaaaaaaaaaaaaattttcaccttgacgcctattatcgacatcgccctcaaaatcggtgtttgggtcaaaccttcgcaaaatttatgtcgactcccccccccccctttttaatttatgcatatcatcttacaatgtgttcgtctcgactttgtgtcttaaatttgtttttcaaatttcaggtgccttgtcagtatttaatcggtctttttctgctcgtcatctcctaccatgttgaggaaatcctcggcaccgaggacaaaacggggagcagtgagttcatttacaaccttttcaatctcaaattaaattacataccaaaaacttgacctttcttaggaacctaaaaagcaacaaaaaagatttaaaaatttaaatccaatttagtccatcatttagaattgttgcactaatctgttcattatttttagaatttgacctggacctgtatccaggcatgaatttttcctgggcctggatttttgtccaggtccaaaatggaattgtcaaggcttttttcgaactctaa

SEQ ID NO: 84956 - DNA, 1224 bp, Heterodera glycines
  Genomic contig location: Contig_ID=SeqID_20170; Location=107..1330; Strand=-
  SCN-specific regions: Sequence locations=1-244,274-657,679-726,773 -886,909-939,962-1224
atggccaaatgcatcgttcggctgttgaacaacgaattccaaattgggctcaaaaatgccaaaattattgatggcaccaaaaatatgctgaaaagcgaaaagtgggtgggagaaattcgagtcgaaagcgaaagtgacgaagaaagcggacaacagaaaaggacagaaaaaggacatgatgaaaaaggacacgaaagcagttcaggggaaaaagaaagtgtgaatggtcagtaaaatgccgaataatgaaataattttttaatgaaaaatttttgaaactcagtttactattgtataattaggagtgtgattcttaaactacctaattagccgctaaaaaatgccaaaaaatatatgcaaactcggtccctgtaaattaatccctttaatttgagtttttttttaaattgccgacattatttagattcaagtaaaaccggttattacagcgcaatgccaaaattcgaatttgccaaagtgcggaaaagggaagcaatttttgccggaaatcagcggcatttgaacaaaggatttttggcaagaaaacgccaaaatattgcaatttcgaaaagtcattcatacaatttgcttgaagcaaaacgaacatttggcctcagtcccattggaggatttgcacgctttttgatgagtggcatattggaaaagaaaaacaaaacacggacaataccgtaagagggaaaaggaaattggaatgaaaaatatacgatattcaatttcataaagtaaatcaaaataaatattctttaattttaagttggcaaaaaacaatttcaaaaatacaaaaggcaaaaagggagcacaatcagttgaaaaaggaagagaaaaaatggagggattatgcgctcaaacaaatggtaatttgttgttattaaaaaaaataattatttgctttattcagcccacaaaatcggcaacaattggtacaaatgaaaaatatatgacaatgaattccgccgatgaaacaacggcgtacggtagcaaagtgggcaaattgaatgagcaaattgccaaattggtcaatgacggcatcaaagtcggcatgcgattggctgatttacaaagaaagtcaaagtcaatcgaacactcaaaatcggacgaatttaatgaagagaaaagtgatgaaatagcaaattatgacgaagacattgagggggaggagtacggtagcgaacagagcgagaattacggtaacaacggcgaacg

SEQ ID NO: 84957 - DNA, 647 bp, Heterodera glycines
  Genomic contig location: Contig_ID=SeqID_3506; Location=130..776; Strand=-
  SCN-specific regions: Sequence locations=1-39,73-274,296-499,521-647
  Gene Ontology: Mol. function=syntaxin-3 binding; Cellular component =cytoplasm; Biological process=intracellular protein transport
atgacactgaaagcaattgttggacaaagtaaaaaactgtattattaaaaaaaaaaaattaacaaaattttagaactcattaacgaagttcttcaaccacttcataacccgcagaagggcggagcatggaatgtactgattgtggaccgattggctatgcgaatgttaagtgcatgctgcaaaatgcacgatgttatggaccagggaataacaatagtcgaggacttaaacaaacgccgtgaacctcttcctgctttggacgctgtctatttgatttccccaacaaaagtaaaactttcttcaatcatttatgtttaactaaatattaattaggaatcgatagacaaattggttagagatttctccggccaaaatctttacaaatgtgcacatgttttcttcactgaagcctgtcctgatcagctgttttctacgctttcgagaagtcctgtttcgcgtttcattcgaacccttaaggaaattaacattgcattcactccttatgaatctcaggtttttattacctactttgttcgtcaaacattaaggttctagtcggttttatgcgtcccgtgaatgaccatacccagtttcttaggccataacttttttcttacttggtcaatacctatattcttggtattaaa

SEQ ID NO: 84958 - DNA, 716 bp, Heterodera glycines
  Genomic contig location: Contig_ID=SeqID_3507; Location=30..745; Strand=+
  SCN-specific regions: Sequence locations=1-172,203-396,419-460,483-716
  Gene Ontology: Mol. function=pre-mRNA splicing factor activity; Cellular component=intracellular; Biological process=RNA processing
atgcatgcgaaatcgcgttggcaaggcggcgacgtggagggagcacgacagatcctttcacaagcattcaaacataatccgaactccgaggaaatttggacagccgctgttaagctggaatcggaaaaccaggttaattcgggatgaatgaacgatcatttagactatcttaatttcttatttttgttgttttaaggaatttgaccgtgcccgaaaattattagaaagagcgcgcaattctgccccttctccgcgtttttggatgaaaagtgctcgattagaatggtgtctagacaacttagacagagcaaatgaattactcgctgagggaattggccgttaccccgactttgagaaattctacatgatgttggggcaaatactcactcaacaagcacagtttgaagaagcaagaaaacaatacttggaaggaacggtgatcactaagcaagcattttatttttaatcctttcaaaaaattttagcgtcggagtcctcatagtattgcaatttggcttctgctgattcgcttggaagattcgcgtggtcggcacattaaagcgcggtcccaattggacattgcgaagaccaaaaattccaaatgtgaccaattgtggctggaagggatccgtatggaattgcgcgccgggcaaaaggaacttgcacagtcaatgcttgcacgggctctccaggagtgcgaacattcaggcaagtag

SEQ ID NO: 84959 - DNA, 672 bp, Heterodera glycines
  Genomic contig location: Contig_ID=SeqID_3508; Location=554..1225; Strand=-
  SCN-specific regions: Sequence locations=1-672
atgccattcatcaaaaagcgccaaaatttggttctcaacgttctcaacaacgacaaaaatcttttggtagcgccacaacaaccgctgggcattcgtccattgagaaaaccgtccccgtcttcgcgtcaaatggcgcaagttcagcaacggtctgtcaatggaatgccaagctccaatattttaaaacgctttaagttctctcttcgaaatgcctgcgagccgccgacgacgcatccttcgaattcactcgccgacccttccgctcaaaaaggcgcttatggcgcgacgaatgcgattttcaacggcgaaagtaagcatttaatttttttagaatggaaggagctaattgtaagcatacagattctcctgggttccttttgactgcgttatttccttttctttgcaattgagttttagaatcctctttcaattgagttggttaatagaattttgattcttttttctccaaaaattgaactgattttgagaattaccatccataaaccattaaaaatctacgttgtagttttcccggacaatttgattcttgagacggaattgctaaccaacgcaataaagtctctcttgttggacctccaaaacgcgccatccaacagaaacaatagcggtggtgcgagtaccgaatccaacgcacttttccacgccgattcg

SEQ ID NO: 84960 - DNA, 1646 bp, Heterodera glycines
  Genomic contig location: Contig_ID=SeqID_3508; Location=2381..4026; Strand=-
  SCN-specific regions: Sequence locations=1-921,944-1282,1304 -1343,1365-1646
  Gene Ontology: Mol. function=GTPase activity; Cellular component =nucleus; Biological process=regulation of G-protein coupled receptor protein signaling pathway
gcctttcccatggaattttctggcactgtttgcgccgattgcggtgcctcttgtccgagttgggcttcgctgaatcacggcgtgctgatctgctccgattgttgttttgtacatcgaaatttgggtctgtctccctaattttgcttcgtttttcctttccaattgttcctctccttaggccgtcacttcagccaagtccgttcactgacaaaaggcgtttggcacgacaaacaattggctctgctccaattgctctgtcgtaatggcgccaacaatgtttgggagcattcgctgatcgattcgttggggggcgcaggtcgggcgaagaagaagcccgtctccaagtgggctgacatttggcaaaagcaatgcgcataactttgtcttccttcccctttaagtgatccgataattcccaaaaaggaggcgtttattacggcgaaatatgcgcaattggcattcgccatcagaccggccaaggacgaattcaatgtggacgatttgtaagcattcgaagcaatttcagcagaaagtgtccctttggaaggaatcgccagctttggtcgtgtgttcgcactgcgcacgttgaaaccgcgttgaggtgaatgaattgggatggaattgtgaatcgctttattagctgaaataattaagcaaacggccaataaactgattaaataattagattatttgctaatattcgccctatttacgtgattaaggcttttggcgcttggcgcgtgtccaaattacgcggacactgagaagggaaacactccgttgcatgtcgcggccaaagagggtcagaatttgcaggcggaattgctttggttgtacggggcggacattggccaacggaatggggcggggcaaacgccggcggaattggcgaaaacggagggatttgtaagggaacggtggaaaagggggcaaacaaacaaacggagaagcggacactttaacatttcagaacgaactcgcggaacgactcgtcgaattggagtacgaaatgaccgatcgcttttcaatgtttctctgcggtaagtcttgatttgtcatttctttggttttaatttaaaatttccatcaaaggaaggcgaccctcccacagagaaaaccaacactttctcatcccggatctcgtcgattcaaagaaaaacagccaagtcaaacagttcaaggattccattcagagaagcagtgggttgatactcgaacgaatggttcaggacgtttatgacgaggtgaccaaaccgcaacaaaaacccaccaaacgcattaattggctgttaattgttgttttggaaacatctttagcctccattttaaggtcgaccgacgcgaattgaatggccattggagtgccgttgcatctgagcatcaccccaccgcaagtgccaaccaacacgtggccatgtttttgcccgtatgttttcgacctttttccccacttaaacctaaattttcacaaattcttccactgagtttcttttttcagcccaacccgcgactctccgccactcgaaaccaactcagacaaaaacttgccaaattctcttcggccgatttcgcccacttaattattgatttgcttaaagaaattcgtcgtcggcgtttaaatttgcccctcccagcgacggattccc

SEQ ID NO: 84961 - DNA, 1692 bp, Heterodera glycines
  Genomic contig location: Contig_ID=SeqID_20171; Location=9..1700; Strand=-
  SCN-specific regions: Sequence locations=1-53,79-136,158-210,236 -324,346-489,511-896,922-952,980-1109,1167-1185,1207-1340,1376 -1399,1437-1567,1590-1692
atggtcgacgaaaaacagcaacatgaactgcaacgtgtccgagcagtgcatggagctgaggaagaggaggacgaagaattgtttttgcttcatgagggtaaaaataggcaattgaaaaaatataccgattttgggatttaaagaaaaaacatttttgaagaataaattattattaggaattaaattttcaaaaaattttgagttcttaacgggtgttttggtttttgttttactgcatgttctttaaaactttttcgaaattttttagaattttaggacctaaaaaaatcctaaataatagaatctacaatgtaaaatttgtaattaaaaaatatgaaatttagacacttcgacggaaccgatgaacattattgatgttgaagatgaagaagattttgaccaggatgagtatcagcacaacagagggataaagattttcgagcgtgaagaaaaaatggagggccaacaaataatgccacagcaaagggcaccttcatctgtctccaaagtagaagtgattatgatcagaattagcagggggctgcctagtgcccttatttccaagattgatttgtccttatttagatggtctgaaatctttgaaattggaaagaaattcgaatcaaacaaaaaaaaagaaatctttaaaatcctcaatttagttattttggacaaactatttacatttttcatgaaaattcaaaaaaaagtttgtccataaactgctttttggcattgccggacccatgcccttcaaaacattttttttgaagaacttctttacgggaggtctaatttgctcataaatattttaaaaaacttgacagccctggattagatttaaacgtatttcatataatagaacccctgggatatttttcaactcccttcaaaaggggggctttatttcaggggtgctctaattcaggggcttttattataggaaatatggtaatttaataattttttaataatttttcttaattgtccttcagatttccgatgaacaatctggtgccgaaatgatttcgggctctgtgtcggctggttcagttacttcttcaccagccaaacgtcagcagcatcgaacatcgcaggaaattgctgggtaaatttaatgtaaattttaattattgtaattctttttttttttttgtaaatttttagttccgccaatggaagtttgttggaatttgaacggattgagcgtgaaatccatgaagttggtgctgaacacggcggtgaaacatcgccaaaaaatgaaagggcacgggctgaaattgctgcagccgctgctgtcgctgcggcacgcggttcgggtgaggcattaataaatgttgttttttttaattaaaaaaaaatattttaaaaaattgggactaattggatattcaaatacttaaattaattttaaaacaaatatttattatttaaatcaccaagctctgagaaataatatgtttatttgttttctcatttacttaaatcaattagaaaagtgaaatattcaatgagattttttgaattttcatagtccaaccagccgaattatgttattttttttgagaattttttatttattattttttcgactgattgaaagtaagccgttttttaattgaagtaaatctcatttttgacttaaaatatgacattttttcaaatttaatcaacaaagcgcaacaaaataaa

SEQ ID NO: 84962 - DNA, 1432 bp, Heterodera glycines
  Genomic contig location: Contig_ID=SeqID_20172; Location=43..1474; Strand=-
  SCN-specific regions: Sequence locations=1-338,361-1168,1191-1432
gaccatctcatcaccacgccggcccatcaccacgtttcgccattggtccgttctcgttctcgctctgagactcgtgccggcacttttgtcggttaccgtcggacgtttgtcaattggtgctttgcattcaaatccgtttgcttcattcagacgatccgcctctttcacttcgaatagtgcgggcggtttcaccctgcccagttacggtaggcgcggcgattactgtcggcttttcactttcatttttcgtcgccaaacaatcaaatggactaatttgtgaccgtaattctctcttaaggctatggcggcggatttatggcccgatcgttgagcagatcaagtgcctgcccattgcttttcttccgattgcatttccccacttccctcagattcgtccttgtcactgttcggccgtggtctccattcgtccgccctcgacagaacgccgccctttcacaacatcgccgtccaacggccgacgccccattacacggacaaatgtcagactcacttcgaaactgacaaatgcttctcctttttgcagatccttttgtccgctacagttacggcaacattgagacgggacttagcatcaaaacgcaaacggaaatggtaaaggaaagcaacagaaagcaaatggcatattgccatttcagaagtcaccaaattattacggcataaaagacaccggcacaaagagatggctggaggggttggggggggggcaatgaaagcccaattaggcaccactcccattcagcaagttgaactcgtacaactccggcatcttctcgcgccccgtctcgagagaacggtccatcgaaaggccattggcgcccattcgttcgtatgtgaagtgagttgagcacaatttgaaccgaacagtgaacacatatcaaaaacatgtcaagatatatgccaacggaggatgccgttgatttgttcaagaaaagatgtatgacagtgagcacattgtccaaatattggtgggtaaaagggggaaaagcggcgccgaaaaagggggggggggggtaattgccaaagggaatgccaaaaaaggaggggcaaattcaaggcaaaggcataacatttggccattcttgaacaggctgcagtccaccgggtccaccagccgtgccaacatttcggcccaccgctcttacggtcgcccctcctccgtgtccacgctgaccggctcgtactccacgcgttacaatgctccgccaacttcgacaagttatggcgtttttcgtccgaccaaatattactccagggtggccaattcactgacggccttctgaccaacggaataagtgtcgtcgtccctttggtctttttcacgtgaaagtcggcttcactcttttgccggtgtcgtccgatgagttcaaccctttccttccttattttatgacaattgtctaaacaaattttt

SEQ ID NO: 84963 - DNA, 269 bp, Heterodera glycines
  misc_feature (174)..(174): n is a, c, g, or t
  Genomic contig location: Contig_ID=SeqID_20176; Location=1..269; Strand=+
  SCN-specific regions: Sequence locations=1-229,251-269
agctcagcccatcaacacaaaccgcatatattgacaacaaatggtaacaaaattcacaaatttattgtaacccactgtttttaattctatgagatttcagttggcggtcacttaccacacgccgcccgaaatccgacggaagacgaattagtgggaccgaataaacgaaacatntaaattgaaaattaataacggattaccaagcgagaagcacatgtgctacagacgttgttttatttaaacgaataaagaacaaacggcggaaaaga

SEQ ID NO: 84964 - DNA, 706 bp, Heterodera glycines
  Genomic contig location: Contig_ID=SeqID_20176; Location=286..991; Strand=-
  SCN-specific regions: Sequence locations=25-104,128-510,532-591,613 -706
  Gene Ontology: Mol. function=chaperone activity; Cellular component =respiratory chain complex I (sensu Eukarya); Biological process =mitochondrial electron transport, NADH to ubiquinone
attaaatttatttcaaaattttgcagcttacaaattcactttttcaaaaaaaaaattccaaaatttttttggcattttgcaaatccacgggaaaatttcggcaaattcaatacaaatatatttacataatttaatggtactgctctgtcccctcccgcacatcatgtaatttacacgacgctttcataagcctcctaatttggctccaaaaaacactttttgtcccctcggggggggcggtacgcccatcttctgatcaaggtctaagcaacaaatccttgcaatttcaatattttttcttttaagtgccgtggcgatggtcgcacttacaaagtgatgttgcacattccgcagtttatggacatcacttggggcaattcctacacgtatttgctgcacacccacggcggcccccattggcaattcgaaatgattcccttttcacgcttcgttttcacagtcgaagggcgtgcaattgatgttcaatatccgttggaccctcgggcggcgaggtaacgaatcggtctgaatttacttccctgtgagcctaaaacttttgagctcgattggaatcactctcatggacagaattgaggggccatttcgtctggaaatcgactttattggtgccacacatgacataagtcacctcgaaaagcatgcttatgagaaatacaatattcccctaggcaatccgatgttgtaa

SEQ ID NO: 84965 - DNA, 244 bp, Heterodera glycines
  Genomic contig location: Contig_ID=SeqID_20178; Location=39..282; Strand=-
  SCN-specific regions: Sequence locations=1-244
atgattagaagaggtgcaacagtgattagaagagttacaaaaatgattagaagaggtgcaacagtgattagaagaggtacagcagagattagaagagttacaaaaatgattagaagaggtgcaacagtgattagaaaaggtagaacagtgattagaagaggtgcaacagtgattagaagaggtacaacagtgattagaaaaggtacaacagtgattagaagaggtgcaacagtgattagaaaag

SEQ ID NO: 84966 - DNA, 1179 bp, Heterodera glycines
  Genomic contig location: Contig_ID=SeqID_20179; Location=956..2134; Strand=-
  SCN-specific regions: Sequence locations=1-148,170-179,204-211,234 -724,756-1010,1032-1038,1061-1179
  Gene Ontology: Mol. function=transcription co-repressor activity; Cellular component=nucleus; Biological process=negative regulation of transcription from Pol II promoter
atgatgaaaagttctgctgatgctgagcagttcggccgtctttcgttttcgatcaacagtttattcagcacccaagaagtggcatcgtcttcgagtgcgtcggacccgacaacacaattaatcatttcatcactgaattctgtcagaaaaacaaatgaaggcacagtggaaaatgcgacgaaaaaggcaaaaagcaaaaccaattttgacatttttacttggctttgtttcagactgacaacaaagaattgagcaccgacgaggatgagcagcaaaatgtggcgagcacttcgacgccggaggacggagaattttcaaaaatcagtcgtattcgaaagcgccgctacagtcaggcacgaatacagccggtaattggcacgggaatattgtggaaaaagaagtaattactgaaaaaacattttggaaacaattgaaaacttcacgataatagtaaaattgatccccatttttcgacataaaaagaaaattggaaagtaatcaaaagatgtattcggacagttttcaggatcctgatcataaaaatgatattatttcgcatctttaatgcctgacccaaaattcgaaggaaatatcgttgaaatttttcgaaattcattaatttgttgtgttaaaacgagtttaaatgagcattttttgatgatgatttttcacctttttactgtttaggtattcatacaattttacaattagtgttaatttatccaattaataaaatttaataatctattttaattccctaattttttttagacgagagtgaaaaaagtaatgcaaagtgacgaagacatcggcagaatggtggccagtgtgccggtggctatcggcagtgccatggaagtttttgcggagaaattgttgctcgcagcggccgaaagtgtccaacacagttcaaccaaaacgctctctccaatgcacatgtaaaggaagaagcggcaaataagcaaatttttaaagggagaaggagaaattgctacaatagttagagtggaatttagacttttgcttccgttctttcaaatcccaactttcagcaaaatggccgtttctcgcgttccgcaattttcttttttggagcctatgttgagggatgttccgatgaacccgaaaatggccccctcttttggacagcaatcgtcttcaacgtccaacggcgaatga

SEQ ID NO: 84967 - DNA, 1831 bp, Heterodera glycines
  Genomic contig location: Contig_ID=SeqID_20180; Location=187..2017; Strand=-
  SCN-specific regions: Sequence locations=1-207,258-284,306-419,442 -623,646-810,840-882,906-929,951-967,989-1357,1418-1524,1553 -1564,1612-1711,1733-1755,1778-1831
gcgatcaagcgatgctacagcattggcggcacgccaacccaatcgccgatgcccaaatatgccgcactgattggcggcacaccatggatcaacagtaccaatacgattggcacaacgtcatcgtcaccgccatgcacagcggcggcggggacgacgccaccggcaatgccatttgggcgccaatttgaattgctgacaaagtgccatcaacaaaagcagcagcagcaaacaccaccgccgccgctgctgccgcggccaccttctaccgtattccccactactgtaatgcagcaacaacaacaaacgccgccgccaccgtcgccagtgacaacagcaacaagtacggtagtgaacgggccgggcaatttgtccgaattggttcatcacctttacaacacacaacaaatgcagttgcagctgcaacaactgcagcagcagcagatgcttgagcacataatgccaaaggttggcggcattattccaaccactcaaacgatgccggcaccagcagcggtcacaacgccaatggttgtgccaattcatgtgttgcaaagcttgctgaccacaaaggttgtgccaattcaattgacggaaagcattgcgccggcggcaccgattgtgccaaaggctgtgccaattcaaacgccgcagctgtccttgtcagctgacaacacaacgccaaaaagtgcatcgcaaattcgagaaactgctgtgtatatagcgccaaaagcgccgccgttttcagcggctggtaacacaacgccaaaaatgaaaggagaagcagtgccaattcaaacagcggcagctaaacaaacaccagcagcagcagcagaagaaaatgccaaagtcggcacttgcacaaacaccgacggcactgcttcatcttcttcctccactggaccatgcttttcctcctctaccaatgcttttgctgctgatgtgccaacaaagcaaaatgcttttgctgctgctgcttatggtgaaatgttaatgacactggtgagagcacatgaatgaataaataattcataaatttgaaatcgttggtaaaaatggatgtgctgctatttatgtaaagagaagaatgaggggataaagctaacaataagctgagttaagccaacaaaaaaacccatgctcttttgaaatttgttttttacagtatccacaggtcttggaaattccgaatttgacctcaaaattttttttaaagagatttgccaagaaaattaatacttttctaatgcctaaccctagaaatctgacagacctgagaatttttttcagtttccttatttctaagccagaacaaatctgaaaattcagaacatgaggagtctttgatggatggaaaacgaaaatttaaaaattaaaaaaaaatgaaaatttacaaatttttaaaactaaaaatttttttccccctaaggctgacaaaaaggcggaaaagcaaaaaaacagttcgcctacattcaacaaaactgttcaaccatcagcagcagttgaagtatcaatgcttcaacaattcaacccccaacagcagcagcaaatgcaggcaaaatttggcaaaaaataaattaaaaaataaactaagttaaaaaaatcttaattttagttcctcatgcaaaatttgctgcaactttacggcacacgatatgaccccaccgttcgctcggctttctctgccgtgccgccaaaggttgagcgacaacagcagcaacaagttcaagctgtacaagcaacaaaaactgctgctgcacaacagcaacaaatggaacaacagcatcaaaaaaaacattgcgaaaatggtgcccaattagtgcaaatcgattaa

SEQ ID NO: 84968 - DNA, 1263 bp, Heterodera glycines
  Genomic contig location: Contig_ID=SeqID_20181; Location=31..1293; Strand=+
  SCN-specific regions: Sequence locations=1-18,40-75,117-220,243 -257,280-412,434-470,504-556,579-722,745-1106,1129-1223,1246-1263
atgaaaacgcttcgcaaccaagtgggtcgccaaacgatgccaatggtggtgaattttggccgggtgggtaaaaacttttttttttttttttactattttaaattttcaaattatttcagactggggacgggcaaatacctggacaagtcgggggccgccaatcgtcgatgccaccatctgttgtaccggtgaatttgggcagcatgccgccgtaccaggtacaacaacaacaacaacaacaaaaaaatttccttccatttcttacaaccatttatttttgaaaagggcctgcaaacgcagcagcgcgaggtgatttatgatgtgcctgcgaacggtgtgccggaagacgacgatgacgccgacagtttttgaacagcgatgagccgacaaaataatgagctttaattctcataaaatttttataaaatttgggaattttcacaatgctttcacattaaacaatatttggcaaataaatgtaattcaaaatgacaaattgataatttataggagaccattagtagaagaaatttgaaatgtttttctcgtagatcattaggcgagattaaaaaattttgaattttaaccatgtgatataatctttttgaatgattaatgtgtgatatagtggagaaaatctgtcggtacatcaaatgagcaatttgagggtcacatccattatcgggaattcgggatgctttggtgcataataaagctgcctcccatttggagaaaaataaagatgttttgcaaggtcaaaagcgcaccatttaaattcatccctcccgtctcgctctctcatttgctcaatattttcacatttatttattctctacattttgttatatcgcaatagcattcaagtacaccaaatttacttcaaattaaaaaaaaaatgtccgacagcccaaccctgacgcccgaaacagaaataagcattgcatgggacatccttgaaaatgacaaagatgtaatgatttttttttctttcttcaatttgaattcaaatcttattgatcatttttgcagtggtacaactggttcactccaacgaccgtcaaacaagcgtgcgtcgaggcattggcatttgcgagagaaggaggactaaagcacgagaacattctgaaaataatcaagatgattgaggagagagaaaaccacgacaagaaatgaaatgtcgatcgatgaccgatttgttaatggtgatgtggatatatgatcattttttgggacatttaaaaatttgtgctaaaatttgtccaa

SEQ ID NO: 84969 - DNA, 612 bp, Heterodera glycines
  Genomic contig location: Contig_ID=SeqID_20181; Location=1493..2104; Strand=+
  SCN-specific regions: Sequence locations=1-19,41-372,399-612
atggccattaatatttcggacaccaaatcgcttttcaatcaaatcctcgcccagtccgatatcaccataaccacaagcggcataactgtcagtggtccacgcctatcgaccccccgttttttaccgtttgacgattgtggacgctgccgcgtttgcaaagcaaccgaggccgaggtggacacaatggtgaccaaagagggggtcacattgtggtgcactcgtatcaacaaaccccaatttgtgccgttcgatgtcgtctacgacctgccagggcactgctttttccgcgtgaagaacaaagcgagggtgttcaatgtcccctacggagacctgccctccgggacgtgtgccaaaaacaaaccgactgaccaccaacaacaacaacaacaacaacaacaggacttgaagcgcaaggcaaaggtagcacttgacttggtggaggctggactaatggcagatgctatgcaggacggcgcacggtggaagaaggccaaaaccgctatcaacgtgcttggcaatatcctattggctgaatcgttggacaatacttccgctcctccgctgaaaaatgatgccgtggacatcaaaaaagaagaagaagaagaagcaaat

SEQ ID NO: 84970 - DNA, 1026 bp, Heterodera glycines
  Genomic contig location: Contig_ID=SeqID_20182; Location=1379..2404; Strand=+
  SCN-specific regions: Sequence locations=1-66,89-180,202-428,451 -574,597-631,653-825,847-1026
atgcgggcaacgacaccggcggatggcaccggaggggcggcggatgggcacggcacaagtgacaggaacaacaacagcaaaaacaacatggaggcccaatcagtgatcggcatgtcggaggcgggcggaactgcggatgattctgtggaatcgtaagcatacggaggattaatcagacaaattgggacgagaatcccggggttacgatattttggggactgacatgtcgagaatcaatcagcacatagggaaaaggcccgaaagggtcaggaaaggatacagggaaggattttattcgaaaattttcattggtaatcttttgaacagtcgcccccaacggcgcgtctccgtcactcgattattttcactgcgaaatggccgtcttttttcgttgaaaagcattctgtcggggggcgacgagcgattgaggggaaaaggaagaaaatttaatgggaaaaacggcacaaaaacgcaggaagaaagtgcggaacaacagcagcagcaaaggtaaaacagcagcagaacaaatggaaaataaatattaaaagcgaaattcaactttagtgccggaaaagggaaatgaatgaaattttgagaaaaattttcaagaaaaacaaccggcggaatttaaatttaaaaatgcaaagaaaatattttagattcaaaataagtctcttttctgaactttccattgtttttgtgcttaggtccgtcactctgaccacccccgtggccatcaacggctcttcttcatgtgccgaagctgcggcggacgcattgccaacgccgcagccgcagcaattgcaagcggtgccaacgccgacgccccctccggcggagttttggccaaacggcgcgtgcaaccgcaaaagggaggcggagacggaggacggacagtcggcgaggaccacggcatttacaccggtgatgctgggcgaaagtgaggacttcttcccgttcatcgacgactcggcaggcacatcgttgcaggaggggagcaaagcggaaaaagaggaggtcaccagg

SEQ ID NO: 84971 - DNA, 196 bp, Heterodera glycines
  Genomic contig location: Contig_ID=SeqID_376; Location=1..196; Strand=+
  SCN-specific regions: Sequence locations=1-196
tgagccaatgttcaaccaacgactcatctccgttttctctgcacccgcctacacaggccaaacaaacgcgggcgcggtactggaagtgaagacgtcgagccactttaccactcactttttcccgccccaatcccagtgattgattgtactttgtattgttgttgttgttgtgtttataataaatgctcttttgtgc

SEQ ID NO: 84972 - DNA, 7221 bp, Heterodera glycines
  Genomic contig location: Contig_ID=SeqID_376; Location=1077..8297; Strand=-
  SCN-specific regions: Sequence locations=1-103,127-379,404-567,589 -812,836-1010,1032-1053,1077-1189,1211-1247,1269-1793,1817-2277,2300 -2486,2508-2716,2758-3430,3452-4072,4101-4164,4187-4286,4309 -4609,4639-5506,5529-6096,...
  SCN-specific regions: Sequence locations=...6164-6187,6209-6230,6254 -6587,6611-6863,6889-7052,7074-7221
tcttctccttcttcgtccgtctctctactcgccatcgtcacaattttctgtttgctgtgcaaatgttgcgtttcggcaccgcgtaattaattgttttcatttacaattaattaattaattgcttttctgcagatccgtgctgtcccggcagtcaaaaagtggtttcgctgatggccaattacgttggcactttcgcccattccttttcaaaggcatcgctttgttcggatgcccaaagtgttgcgggcgcattgaaaggccaactgatcggctgctcgaagggcggcgacgcaactcttttggccgacatcgaagcatctcttggcactcattctgctggtaataagtgggaatggctcagactaatggatcatttcccaataataataattattattattatgtttttcccctttttgatgagtgtgcccacagcctcggcttcgtccgtgccatgttcgtcattgccgcctccgcttcttcccatgccagcaacaacagcgaatggcaggcattgagtgcccagtttggtcagcaaatcagtgaaattgactcgaaatgtgccgagtttggcattggcattgccaaagtgccatatgacggccccaagggtaaaactaataagagacaataattcattaattatgcgatctcttaaggcgatcactcccaacgaaatgtgcctggcacggacagtgtgatttctatgcccggattgaccggctcacacaaacaatgaaaatgagtcaatgagatcattttggagttcattttgttatttgtccgtcaattagttgttggatttgtaatttagcaaaaataaataattattaaaccgcttaattggaatacattttgcatagacttatttaattgaaaatacgattattaaatcattggcatttatttgccggcattttctgcttgcaaattcatttgtcgcccaattttccaacttcgttcgccaacgcattgaaacataatttgttggctaagcccaacaaattaaattggaaaataaaatggctaatttcgaagaatggcattgttttgtcagcattatttgtaaagcaaaaggaaatgagtgggcgaaataatttttggcccaaattcaattgcaaaaacggaaatgcgtgggttttgcaaaggtataaaagggcaagaaattttaatatttcgacaattatgcaaataaaatcattttgccattcctttgattttccgccgctaaattcaccaaatttccaaaatttaaaaatgcttttctccttcggcagtttctccagcgaagaagcggaggccatcgttgtcggagtgttccctccgctcagataatccgagaggaaattcaactcaaaatggaaatgatagcgatggcattccgaggccccaaaaattttcgggaatcagaattccaaggctcaaaaaggttttggaaatcggaattccgtgccgtccctgctgtgtggccatcacattcggctgatggacaactcagccttacgagaatttacaaaaggctggcttaggctaggcctaggcttagacctaagctttaggcgaggcctagcttaggcttgcttgggcctatgcttaagcttaggctttatttgttgaatttctgtcattttctccctcttattcttccataatttcccccccccccccaatttccctaaaaatttcaaaaattcattttttatttcaaattttatttccgttttctctctcttcttttataaatttgttgaatctgtcagttttgttggccaaatgttgttgaaatttgtcagtttttgtttgccattttcaaaaattagcacaaaaagtgactaaatttatcgtttgcttgtcaagaaagaatttaatttaaatgttttcattaaacttatccaacagagaatttagatacaaaaaaattttggcaacattttacaattttagaattagggatggatccccatagaaaaaggcaattttagtgcaaaatctaataacaattctcacttgaatttcaaaaagtttttgccggcataggacgaccaacaaaagcagaaaagttgccaaattcaatttcttcggaatccctccaaaatttgctaaagatcggcggaaaaatgcaaattttgctgctgtttcatttttcataattttgcaacgaaaagcgatggaacgagagaaatccgttgagggaaaggtcccccccccccttctgctacatttttgcattttttttttgtttgttcctaattttggcgaatacacatgaaatctctctttatttaaaatgagaaatggagcaaaggatctttgttttggatgcctttggttggcacaaatttattttgagttttagtgaattggttttggctgttagtgaaaaccacaaaattgtcttctaaatcagcgctttttgggtgcttttggggccgcactttcaaattgtaaaaatttatatgctgaatggatgcacgaaaaaaatctatttcaatgtgaattttaattggaccattatactacggcagattgtccaaattttcgaatcggttacctaaattaatgactgaccaaacatacctaagtgaaaaattgaaactaatgccaaaaatttaaatcaaaaacgcagcgttaaaattaaacagttggcacgaaaacgcatacaaattgaagaatttcggaccaataattagcacttgggtattaaagaaaacacagcagagagagagagagagagaggtacataaacattattatgacggaaataacacaatagagatcttgacaatcacactttgtcattcgcgagttttgagcattcgacgtggaacgttttcccatgaaagttgaacttggaacactccaattccgcggccattctgcccgaaatggactttttgcacgctaaaacaagttgtgtaagtagccgaattgtttagtcgaaagtacgctttgctaccgttgcagtggggtagccacgcgctctccgtgatttcgaacaagtacatctggtcgccttttgcttgctgaaataggcaattcacatgcatgggaaatcgaccgacatttttaccgccacacagttgcaacagttgcgctgttcgcagccttcgtcgtagtcgtcgccggcaattaaacgtattaggagataaggcgtgttaagaatcatgaaatgaaaaagcattttctgaagggaaggaaaatgttcacactgaaagattaacggaatccaaatccccctccttcgtctccgcttgagcctgcaaatcacagacgcaaaagtccgttccgtgaatttgtcgtccgtgaaaaaaagacacacaaatgcgtaaaaagaatgagctgtttcgcacctgcacattgcattatataggtagttgttcccttctcgttggtaattagttagaaatttttaagaaaaattcattctttgaacacttgaaaagtttataaaaagggtcgaattttgattcatcatcactttgcctaactactccctattattttcctatggaaataattaaatccatagcagagcgcacgctacaggtgtaaaatttttttttcctttgtaaatttttttaaacaaactttttttgagaaagcggaggaggctttgggcgcggagacgactccgttgggagcagaactggaaaaactttgtgcaaacgccgaacggatcgcagtgcaacaggagaagctcatggaaaagatggaactctacaagcaaaaactgagcagcggattggcacatggcacagcaatgctggtggcgtccaaaatggtcggagagcggacacccttcggagaagccctgcagaagacggctcaaactctggcagctcttggcgcggcgcgacgacagctcagcaaaagcgacgtgaagctgggaggcaccaccacaacaatcagcgctatccgcgtgagttagcttgttctgtttttgttttttgctggtaatttcccatttttcagaaacaactggcactgctgcagacgaaacgcttggatttggacgtcttcaaagcgaaatttaggcgcgcatcaacaaccgaggaaaaaaatgccgtgagaatgttgttttgttgttgttgctgctgagttcacatttttcaatccttttcagattcagccccaattgcaacgagcacagagcgagttcacgcgccttcaaacacagctgaaggagctcgtcttggactaccagaagaaagtgcagaacatgaagaagagcctgctggacttcgtggaggcccaaatcaaattccacacgatgtgcgtccaaggggcaacaacaacagcaccagcaaagtcgatggcagaagctccgagaccattccccgacaatttgatccaaaaaattgtacggtcgaaacaaatggagtttccgaaagaggtgaaaaagcgagttttgcattgtcaatttcatccctttttgcaggtttccagcggagaaattcaacaactgtgcgctgccgcaactgacgccttcaaacgccaaccatcgctggtcgaaatccttccgcctgttatggtctgcggcgacgtccacggccaatttcctgacttgatgagaatcttcaactgcctcgggaccccgccggagaagaaatacctgttcctgggcgactacgtggaccgtggcgcgcaatccgtggagaccatcatgctgctgctttgctacaaggtgtggtttggctttttcagccaatactaaagaaacgtttccatttttaggtcaaatatccgacatcgattgtgctgctgagagggaaccacgagacgagcaacatcaacgcaacgtgggttttttttctcacacttattcatatttaaattttccccctctttttttaggtacggcttcaaaaaggaactggaggaacgctatccggcccattcgcaagccctgttcgacagcttcaatgacaccttcgcgtggatgccgctgaccgggctaatcggccaaaaaatattatgtgagatgctcttttttttgttcattctccacctttcaattttcaggcatgcatggaggcatcagcgacaaaattcgaagcattgaacagctcaaacaattggaacgcccgatgctgctaccgccgaccgatagtctgcacattgaccttatgtgggccgacccgatggaagcgcaaggacaactaccgaatccacgaggcgcaggtgtcctgttcggcgaagatgtggttatcagaacttgccagctgctgaagatttcgtgcatcatccgagcgcaccaagtgagtttaagcggccttcgttctaatcagagattaatgtttccccatttgcagttcatccaatccggatttgagccaatgttcaaccaacgactcatcaccgttttctctgcacccgcctacacaggccaaacaaacacgggcgcggtactggaagtgaagacgtcgagccactttaccactcactttttcccgccccaatcccagtgattgattgtactttgtattgttgtcgttgttgtgtttataataaatgctcttttgtgcttcaattgagatggttttgtagggaagagggtggcgagggcggtaaaattttgcgtctgtttggtcggagggttagctctcgaagaactcggtctgcttaattctagtaaattcatgtcaaaattatgatggattttcacttttttaccgttgttcacccactaaaaaaactcatctaatatactgttttgtttataccttttatgtatgtacttgaatatgcataaaattaattgacaacataaaatttgtcgaaaatgttttcatgtgaaagttggatttttgacttgtgtcattcgtctcgaacaactattccagctacatacatattgatggaatttatttttgtgaatgaataacagtaaaagtgaaaatccatcaaaaaatttttttgacgttatcacttgatgaaaaatcatagattagatgatttatatgataatctgatgtcagattcgtgatcagcgccatcgataacccccgaggataacactggtacaaaaatgacgagaagagcttgcaaaattcataaacaaggaacagaaacttttgatctctaaggaccgaaaaattttcaaaaatttcattttttggggtttttcaaaaatattaataaaaaatgtaactttttaaaaaatggaaaatatgtccaaaaattaaaaattttctatttttactcagattcttcaaaattaataaattttagctatatttttgcatttagctattttcgagatttttagcttaaatggaagctgttaaattttgcaatatatgcatagacttaaccaattttttccaaaatatttgactacaaatgccaacatcggatatgccattctatggatggcatttttccgactaaaaacgtatttaagcaaaacgaataagctaatcccatcaaccaatcagcatcattaattaattccatcaaatctgccaaagatccttcaaaaatgtcttctccttcttcgtccgtctctctactcgccatcgtcacaattttctgtttgctgtgcaaatgttgcgtttcggcaccgcgtaattaattgttttcatttacaattaattaattaattgcttttctgcagatccgtgctgtcccggcagtcaaaaagtggtttcgctgatggccaattacgttggcactttcgcccattccttttcaaaggcatcgctttgttcggatgcccaaagagttgcgggcgcattgaaaggccaactgatcggctgctcgaagggcggcgacgcaacccttttggccgacatcgaagcatctcttggcactcattctgctggtaataagtgggaatggctcaaactaatggatcatttcccaataataataaattattattattatgtttttcccctttttgatgagtgtgcccacagcctcggcttcgtccgtgccatgttcgtcattgccgcctccgcttcttcccatgccagcaacaacagcgaatggcaggcattgagtgcccagtttggtcagcaaatcagtgaaattgactcgaaatgtgccgagtttggcattggcattgccaaagtgccatttgacggccccaagggtaaaactaataagagacaataattcattaattatgcgatctcttaaggtgatcactcccaacgaaatgtgcctggcacggacagtgtgatttctatgcccggattgaccggctcacacaaacaa

SEQ ID NO: 84973 - DNA, 463 bp, Heterodera glycines
  Genomic contig location: Contig_ID=SeqID_377; Location=93..555; Strand=+
  SCN-specific regions: Sequence locations=1-74,96-127,198-463
gtggccgttgttctttcgtccgttcatctgaaggaagacaaaattgatgtgccgcaggtgaccaaatgcgctgactcatttatattcaattttcccctgtttttcagcgcgttaaacgcggagaatacggcggcggtgcctatggcggtgacggcggtggcgttggtgcgcctgccccgggcggtggcggcgcggcgaacattgccaatgtgaacataaaccaacagaacggatgcaacgggcggggaccgcagtaccaatgggcgtacacgcggaagacgggatgggtgtgcatcaacatcataaacgtgatcatcaaccagcaaagtggcggaaagtgatgagaggagccgaaaaaaaagagagagagggaaacggaatgccaaacggaaaaaaagcaatcgaacggtgtgaaaaaatcatactgtaacggatgtacgataaatgttttttggaatagtta

SEQ ID NO: 84974 - DNA, 736 bp, Heterodera glycines
  Genomic contig location: Contig_ID=SeqID_378; Location=601..1336; Strand=-
  SCN-specific regions: Sequence locations=1-103,127-379,404-567,589-736
tcttctccttcttcgtccgtctctctactcgccatcgtcacaattttctgtttgctgtgcaaatgttgcgtttcggcaccgcgtaattaattgttttcatttacaattaattaattaattgcttttctgcagatccgtgctgtcccggcagtcaaaaagtggtttcgctgatggccaattacgttggcactttcgcccattccttttcaaaggcatcgctttgttcggatgcccaaagtgttgcgggcgcattgaaaggccaactgatcggctgctcgaagggcggcgacgcaacccttttggccgacatcgaagcatctcttggcactcattctgctggtaataagtgggaatggctcaaactaatggatcatttcccaataataataattattattattatgtttttcccctttttgatgagtgtgcccacagcctcggcttcgtccgtgccatgttcgtcattgccgcctccgcttcttcccatgccagcaacaacagcgaatggcaggcattgagtgcccagtttggtcatcaaatcagtgaaattgactcgaaatgtgccgagtttggcattggcattgccaaagtgccatatgacggccccaagggtaaaactaataagagacaataattcattaattatgcgatctcttaaggcgatcactcccaacgaaatgtgcctggcacggacagtgtgatttctatgcccggattgaccggctcacacaaacaa

SEQ ID NO: 84975 - DNA, 1906 bp, Heterodera glycines
  Genomic contig location: Contig_ID=SeqID_3509; Location=806..2711; Strand=-
  SCN-specific regions: Sequence locations=1-76,105-168,235-300,322 -853,995-1087,1133-1159,1189-1496,1624-1710,1733-1906
atgaatgaacgaatgagagaagcaaatgacccattgccggtaaatgtctgcccttttatgcattttgaaccggccgagcagcagcagcaccaccagcagcagcacaaagaaaaggtttaccatttgaatcccaccaaagaatgcgttcagtccatgtgagtcccacagaattaaatagaatatgaatataatataatataatttttaagcatataatttaaaaagttattaattgttagggttttgtaaattttaaagggattttttttttaaagaaattatagaaaaagctaatgctccttattttagtttctctttaaactatttgtaaaaaagtatcaaaattttgatttggtaatcgttgaattaaaaattgcgttacagtcaaaaattcttttatttcgataattactttcagaaaaattcgtgttcttttccatatttcattcttaaatttgtcttcactacattctttcactttcaacattttcaccattttttttctttatatgctttcgaccatttttcatcattagcagtgccaatccgctgttaatccgtttctcgctctctccctccaatttttcatcggcaataatggcatttcatcagtgtcaaaaaatccccattttttcgtttcaataactttggtctcggcacaaacacttcacggcccctccccaacatcatcccttgggggggggggcgagagaaaggcaaatttgtcggcacggcacactcggtcacagtgccgtgccatcatcatcttcgctgtttggcttatctgtgcgacggtggatttttcacaccgcggcttttgccttatttttttacatcatttggggcgtaaagcaattaaaattttaatttataaattttattattattgcattttttcgattaaaaatattttctttttttgtacataatataagaaatttaaatcaatgaatttcgattgtttaataattttaaattaattcaaattttattagggtgcttcaaaagttcttccttatccatttagatgatattaacttattcaattaattttgtattaaaaaatagtccgatcaaatttcatgtgtttaaataaatattttttaaataagaataatttcaaatttataaacgaataaaatgctcttatatacacaactaattttttaaaatttatttcattaaattctccaaatattttagattaaagcagtgtccacccgcttttctgtcgaacttggccaaaaccgtttgtctgttttccatggccattttttactgttttcttgacggtggagtgctctcgtcgatgctattcctgctgcttgtgccattgtttgttgttggcatttgtgacgggctacagcaacggctgttgttaacccaagttattgacacaaaacgggacgaagccgtggcacaacaacggtaccacctgtttacggtaggtaaacaaagtgccaaaaaaaaattggaaaataaattcataatcctagaaaaatttaataaaaaattatatatttcgccgatatatgaattaagattttaaataaaaaagttataaatttttatttatttttagttaaaaaataaattttataatttttctctttttatttttttcactccaattatttttagcttttgcttttcacatcgcttggaccattttttgcatcgttacttatttaaactaatacaaataacacattaacaaacaccaaaaatttgtaattagtctgctaaatggtaataatttgcaatcaccaattttttcagttttggcatttgtccgctttccattcagtttggcattcgcttacagcagtttttttgatgttgcctttttgcaggtgtatattaacaaaaacacactcaaacaaatccatggactaattacaataaa

SEQ ID NO: 84976 - DNA, 989 bp, Heterodera glycines
  Genomic contig location: Contig_ID=SeqID_3511; Location=659..1647; Strand=+
  SCN-specific regions: Sequence locations=1-179,203-605,731-989
atgccggcactgacaacaccaatgaatggcactgctgaaggacaacaacgacagttttggctccctaatgagctcatccatgagctgctcatatgggtccggcccagctatttttggcgcgttcggcaaatgcttacaaccagtgccattctgtgccctttgcttatgggtggcaaacatgccatcacttggcatcagccttacgatgttggggtaatgcgttaaaaagtgatgtccatttactttggtgcaattgaagagcgttaaatcttattttgaacttagtgaatcgaatttggtaaaatagtgactaaaaatagaaataaatatgtaattagttgtaaaaaatccttagatgtttttttcaaaagttctgccaattaaccagaaattaatttttgccattttattttatttatttaacccttatctaataaaatttgcttaaaagacttgaagcttaatttcttattaaaaaataagttagctttatccttcttatatctctgagtgggttttattcttcatcttattctctgccttatcattcatttgcttattgcctagcgcattatgcgctgttaaattttcatggctttattaccatttttatatttaaaaaaataaatattttaccttttatatttaaaaaaataattcttttttcttttcaaatttggtaaaattgctccatatataaaaaatataataatatatataaataaattttgatttgatttatcaagaccaaagagatgagtcacgcggatcgtacatttggaagcgggaaacagtatgcgctattatgccgatcacattcacaaacgctacccggcaattttatgcgataccaaactcactcaaacgggacagtgactgtgtatgtgctccttatacttgatgagagcaaatttgaatctccagctcaccttgcgcaatcggtgcgtaaaatgagtaaaaaggaatatttgtttatttatcctatttaa

SEQ ID NO: 84977 - DNA, 1432 bp, Heterodera glycines
  Genomic contig location: Contig_ID=SeqID_3512; Location=987..2418; Strand=+
  SCN-specific regions: Sequence locations=1-279,310-363,385-386,408 -441,465-569,604-1308,1330-1335,1361-1432
atgccggcactgacaacaccaatgaatggcactgctgaaggaaaacaacgacagttttggctccctaatgagctcatccatgagctgctcctatgggtacggcccagctatttttggcgcgttcggcaaatgcttacaaccagtgccattctgtgccctttgcttatgggtagcaaacatgccattacttggcatcagccttacgatgttggggtaataacacagtgagggcaaatataatggaaataggtccatattttggtgatacttgagagcgttagattcagtttatattttattttgaaccaaatttgctttaaaaaatcggagatcaaacgattaaagcttgaagaattggttaataaccaaaaaataattttttccatttaaatttttatctatttaacccttatataataaaatttgcttagatgactttcaccatagttttaaggttatgttaaatgcgggactaaatgcgtccttttcacatgactttagctttattttttaccttttgaaatttaaaataattctttttttcaacttaaatttggtaaagttgctccaaaattaatataaaaaataaaataaataaattttgatttgatttatcaagaccaaagagatgagtcacgcggatcgtacatttggaagcgggaaacagtatgcgctattatgccgatcacattcacaaacgctacccggcaattttatccgatacctccaaactcactcaaacgggacagtgactgtgtatgtgctccttatacttgatgagagcaaatttgaatctccagctcaccttgcgcaatcggtgcgtaaaatgagtaaaaaggaatatttgtttatttatcctatttaattttatttaaatctaaatccaaatatgcaaaagactttttctcttgaattgttattttactttggcatcagtctaattaattgactttttttgggggggggggggggggtcaaaaagtccaatttagctgctgagggccgttttaatagagatgtattggaaaatgccaaaacatggacataaaatatggataaaaatgccaaacataaatttggtttttttagcgcaacttccttgattgcagtggctcgcttcgtgaagggcaccaaacacttgggcagggaattactagcatgacttttgttcgttgtcctggtgaggtgcgtaaatattacaattctttatttaatttcaaaaactataaatcttgtcaatgatttttccttttttaaattctgattgagttttggatggtaaaaaaataacttttaaaatttgcagtcaaacaaattatgcataataaattttgcttttaaaataaattttataaatttaggaataaaaccaattattttgtccccaaatttacaaatattacaattccttgccaaaattataaaattacaa

SEQ ID NO: 84978 - DNA, 1493 bp, Heterodera glycines
  Genomic contig location: Contig_ID=SeqID_20184; Location=557..2049; Strand=+
  SCN-specific regions: Sequence locations=1-616,638-1493
atgccaaaggatcgccaatcggctgaaagtgttgcccaaattctccgtcccgccgccctgccaattgccgcatttagcgccgcttctgcacaggcgttggtcgacgcaaatgtgcgccgattcaccacaacagcgccgctgttcacggattacgtcaaaactttggtcgaactgctgaaaatgctcggctcggacttggtaaataaatattatttgttttgtttaacactttcactttactcgtaattaattaatgggtttaatcctttaattatggtgataattaattattgggactgatcagttttgtttttcatctaaggtttcaatcgttgactttggagatgacttcgcttacactccgctgctgcaagagaaactccgagccgaaggcatttcgactgccgaagttggcattcactgatctgatcactctcattaattaattacgcgtattccctttaattgttgtcgtttcaggtcgtgtctcttgaccacccaatgctcccctcaattctttccgcgagtgatgccaaaattgtcgtttcgctcgtccctcaccgcattctgcgcaatgcacgtcttggcgagttgcgagcattgatagaattgcacaaactttgggttggcattgacactgaattggacggaggcactgacgcggcggcgacggacggcgagggaaacgcggcggtcgattttttgccggaagacagcgaatttcgacagaatgccaaattgcaggtgccatgttggccattttaaattgctaatggtttgacaaaattacctcaatttgcattttcacagtttgtgacaatccgtcgccgtgttcgacaattgaaagagttcagcgcatactttctgcgcgtgttgcagtcgaaccacgcccattatacccttttgagggcgtatgccgagcaagtgttcgactgcgacgtgaccgttggcaccggcagaaactgtacagacggattactgtcagccgaaagaatggccaaattgcacaggtgccgacacacactgcatcattagtttgcccggcattttgtttagacaatcgaacaccgccgaggcagcaattttgttgacctatgcattggcgagagcgaccgaatggattcagtcgaaaaaggaattggcccaaaaatggtttcagtttcatgatttctttttgcccatttcccccttctctttcagcacggaacgtggttcatttgccggttgccacgatgccacccgcacggcactgttaagcttttcgccaaatgatcggctgcttagtagcggttccgtgcgaatgccgccgggctttatcaaacaattgagcgaaatgaatttcttcgaaaccccagagggcgttgttcagctgacgggcattggcattgaggcaattttggcggaaagggaggacaaagacggagccaacctttacaggcacggcacaacggaagaggagcgaattgtgcagaaattaatggatgaatgtttag

SEQ ID NO: 84979 - DNA, 143 bp, Heterodera glycines
  Genomic contig location: Contig_ID=SeqID_20187; Location=52..194; Strand=+
  SCN-specific regions: Sequence locations=1-110,132-143
cgtttgacttcgcctcgtgtcaatgcaaacacttcggggaaaactgctgccgatccttcagacgaatggcaaaagctgaaggatttgcttttaaaggcttcgcccgtcatcgttttcgttgtgtttggttggcgcgtggataa

SEQ ID NO: 84980 - DNA, 997 bp, Heterodera glycines
  Genomic contig location: Contig_ID=SeqID_20187; Location=1108..2104; Strand=+
  SCN-specific regions: Sequence locations=1-489,512-538,564-674,720 -826,856-997
atgcagaatccgttggaaatgggcacctatcgcgtcgggtccgagacgtaccggcgcaactgtccgttggaaaaggcgtccaccgctgcgccagccgctggcgccgcttttggcgcgacgacggcggagaacgacgacggttccgcggacgaacagagttgagagagtttaattggcattttctagactcgttcttttttttagaattaaaatggccgcaatgattttttaatttcgaaaaaataggtaatccccgttagtttttttcttcctttgactcttgcatcagcttttcctattataataataatgtttttaatacatttttgtttttacgttttcaataaatgccaatgacattggcaatttgccaatgcgtcgctttgtttgccgatgcctttcctccctaaaagctcacttttctcaattttaccttcaaatcaatttccatcactttcaataacaaattgtttggcatgcatttccccaaaaaacaattttattatttttatggaataaaacattggcatgaatttacataatattttttttattttaaaaaagggttaatttttcaaaaatgcatttgctcttttgccttttcctcctccttttgtttgtcacaattgccaaatgtcctcagccttatcagcacaattttttcaaaccgaatgaaaatataaaaagtaaaaaataattttgttttcaatttttaatttgtttccatgtttagccctgagtccttcttcgtccggccgctgttcgtcctccgaagttcgtcaagcggattttgctgggtcggattatggaagtccgggaaaaagtaaacctaaaaaataacatttaaaacaattttcgacttttttcaggggcatgcatttcaactgagaaaagaaaggcgacgacaattttaacagcgaaagcagcgcaagaaattggcgaagtgtcgtcggccggagaaaatgtgccgttaattgtgcagcgaaaaactgtcgag

SEQ ID NO: 84981 - DNA, 1397 bp, Heterodera glycines
  Genomic contig location: Contig_ID=SeqID_20188; Location=318..1714; Strand=+
  SCN-specific regions: Sequence locations=1-504,546-667,693-785,917 -1029,1051-1087,1110-1136,1158-1397
atgaccaaacagccgatttcctccaacagccaaaccgtttgtcggcgccgtggtgtgccatcatacattgaagaagcagcggagaatgccaaaacggaagtgccaacaacatcatcgacaaacatggcacggcacaaggcagaagcaaaagtgagaaatggcggcggcagcgctcaaatggcggcgcacagtcagccgacgaagggcccaaggtgtacaacagcagcagaagaagaggaaagcagtgaaattgaacagtgagtagtttaagtactcaccaggatggcattcctaggccccaaaaattttcggaaatcgaaaaccgaccccaaaaatgccggaaatcggaattccgactccaaaaatgccggatgttggaaacagataatcggaattcgaaaaccccaaagaattttgagattttgaccatttcgtcagggactcagttggcccgaactaaaacgcaaattttgtgccaaatttgccgcttaattggctttctacatttaaaataattattttttaaataattattttttttattagcttcgcccatgagtacaagaagcagttgcgccgcatccttccaagcacatatgcaaaacggttgttgcccgcgcaactgtaccggtacggtagcaaagattttggcattttgaattatggcatttttaaaaatttaaattatttaagtacactgatctacatctcttatctgttctggttcgtcgtcggaatgtaaagccattttttccttcaactttaattattttgcttataaatccaaaaattattttttttttttttctaaaaaatattttaatgtttatattttcagaaaaatttttaattttttgtcaaaacaacaatttttcataaaatattgtgtaaataaaatgtttaaattatttaaattccattgatctcatcagaaaagttaaaagcactcgttatgatactgtgcattggcacttggtgaactgctgaaccaaaacatacagtatccttttttaaagcaccgtaccattgaaatttttctgggcgaaaaaaggaattaatggtccgccggtggtgtcgagaggcatttttaatgatttcaaaattttatgatgatttattgcttacattagtgttgcaaaaaaaaaaaaaaaaattttccccaaaaaaatcgttgaaaatttttcaatttttttttgtgaaattttcttttaaaaattttcccaaatttttttttcagtttggtaattcgcaagacgaagtcggctgttgtcgcaatgcgttatgtgcgtgcccattccgccaccgtttcgttggcatccattgaacagtcggcacaatttcagcaactgttacaccaaattgaagacgaccagcgaccacccgcgttgctaatgtga

SEQ ID NO: 84982 - DNA, 830 bp, Heterodera glycines
  Genomic contig location: Contig_ID=SeqID_20188; Location=1782..2611; Strand=+
  SCN-specific regions: Sequence locations=1-4,26-88,110-134,162 -693,722-723,765-830
atgcatgagtcatttttaaaatatgtgctaattgagtgccttattaacttgcaaataaaatttggtgagtttcagagcagtttctgaaaaaatatttatgaattaattttgctaaaaaaataaaatagtgaagctttaaaaattaataaaaaattttaaatcagaattactggagttagcatcatagcagtgcttttccttttctttttgatgctctcgcaaaatctggttcgcttctgatcagtttataaaaaaaaaagttaagcctaaaatttttcgcatatttaaaaagcaatttaaaatttttagatttttattcatctccctttttgatagtgtaagcatctgagtgcctaaaataacttgcaaataaaatttggtgcgtttcagagcagtttctgaaaaaatatttaagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaacgggtttaaaaaatctaggaaaattagtaagcatttgtagtgttccgatacgtatccctgcaaaatttggtgagcccctgatcaattacaaaattatttatggacgatcaaatttttagaaatttttatttatttttgcataattaatccataaatattttttcagaaaatgctctgaaacgccccaaattttattacatgctagtttaggcactctgatgctttttctatcaaaaagggagatga

SEQ ID NO: 84983 - DNA, 522 bp, Heterodera glycines
  Genomic contig location: Contig_ID=SeqID_20188; Location=2918..3439; Strand=-
  SCN-specific regions: Sequence locations=1-212,234-365,392-481,504-522
tctgggcgcatcggttcggggggactgccccgaaaacaaaaaaatcgattttttcaagtgtccgtttggggtactcaaacaattatggggagcaaaaatccaacgcagaattaaagtacagactatcgggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcattttctggaaaaaatatttatgaattaattatgcaaaaaataaacaaataatgaa

SEQ ID NO: 84984 - DNA, 432 bp, Heterodera glycines
  Genomic contig location: Contig_ID=SeqID_20189; Location=1286..1717; Strand=-
  SCN-specific regions: Sequence locations=1-432
atgtgtggaagaggtacagctgtgattagaagaggtacaacagtgattagaagaggtacaaaagtgattagaagaggtacaactgtgattagaagaggtacaacagtgattaaaagacgtacaacagcgattaaaagtggtacaacagtgattaaaaaaggtacaaaagtaaataaaataggtaaaaaatgataaaagaggtacaaatctgattaaaagaggtacaaaagtgattagaagaggtacaaggtagataaatggtgtaaataacttttttgaagagctaaaaattacggattttttcataattcaattttgccagtacccctcccctattctgaagggggttatgaattattttctgaaaattcgaaaattttcagaaatttcgtaatatctttttttatattagttgattaaataccaaataaa

SEQ ID NO: 84985 - DNA, 391 bp, Heterodera glycines
  Genomic contig location: Contig_ID=SeqID_20191; Location=330..720; Strand=-
  SCN-specific regions: Sequence locations=1-264,286-306,328-391
atggccataaaatatggaccaaaaatcgcaaaatatggacataaaatggcaaaaatcgcgaaatatggacataaatggcaaaaatgtcaaaaaatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaacataaaagctaaaatttattaatttttttagcgcaaaatcaacaacaaaagcgaaattttcgcttttttgcttatttttgacataatttattaa

SEQ ID NO: 84986 - DNA, 155 bp, Heterodera glycines; identical to SEQ ID NO: 51421
  Genomic contig location: Contig_ID=SeqID_20191; Location=439..593; Strand=+
  SCN-specific regions: Sequence locations=1-155

SEQ ID NO: 84987 - DNA, 653 bp, Heterodera glycines
  Genomic contig location: Contig_ID=SeqID_20191; Location=963..1615; Strand=-
  SCN-specific regions: Sequence locations=1-13,35-175,197-206,229 -540,565-653
atggaaacagagcaagatttggacagtcagaatgaagcgatattccgtcgttatcatgatagtattgggtaagcaaaaagatttgccttacttttgaatagagtgccgcgggaccgggaattttgggcaaacccgggaccgggaccttttcgggttgagaacccaggaatttttgcctgggaaacccgggaatagtcccaggggaccttggtactcaattgtactcagttgtccgctaccaggtcccggtcccgtggcactctacttttgaatagagcatggacaggagggtacagtagtgtcctccgtacagtactttaaatgttcattcatttcaaatttggtttatttaggccgctgtctccgcaagatcaaagcgatgaaaaagagttctcgactcccgggcccagtgatcagcggaagaaggagtgataatttgagagatgtccgactgttttatttgatgataattttgtttgctgttctgatgaccattttggcgatgaatattaaaaataggaatttgagttgggcggatagaaaaaaaaaataataataataattggcatttcattgtttcgggaaaactgagaatgttttgcgggattgacattggcaccaaaaaactctcacaaaaaagaaaattaaataaa

SEQ ID NO: 84988 - DNA, 2048 bp, Heterodera glycines
  Genomic contig location: Contig_ID=SeqID_3513; Location=74..2121; Strand=-
  SCN-specific regions: Sequence locations=1-58,92-201,223-754,871 -1129,1151-1222,1244-1297,1319-1372,1394-1447,1469-1672,1696 -1981,2006-2048
ttttgcccgatttgcttcgtcttttgcttttccctttcgtttgactccattctttgccgtcccttttccatttgtttccctctttgcgtgccttcgtccgtaaatttcccgactttctcctcgtcgagagtgaccaacaattgcttaccgcactttgtcagcaattactcagacaaatggcggccgaaaatgccgaagtgcggcagcaggcggccaccagtgcattggcacaactcaaaatcgcattccggcactcgaaggggtttgaatttagctgtgtttgaattgccatccctcttaattaatcacctttaattgccaggggtttcgtccgtctgaatcggtgtctgacctctgctctgtgttccctcgtctcaacttccgtcgcctctggcaaagcattggacgacaatgccctgagggcgtcgcttaattcgcttgtgcccgaagcgaagaaaagcgaaaaggcggaatttatgagccaattggaacaactcgtggtgaatctgaacgccattctgagcgacacgttcaaactgagcgcacatattgacgattttgagatgagtgtcgacttaatgcatcgaattgcacacggataccgtaacaaccccaagttgaggtatacggtaggggaaagaaacggtggcaaatggagggggcgaatgacggtagattaaatttaaaggattgcttggctgctgggcattgcgcgaaagcatttagaggaaaggaaaacatacgcggaagcgggtaattaattcattagccggataattcatcaattataaattaatgaattaagcggaaattatttttacgaaataattaatcaatgttttaggcgaattaatgatcaattaaataatttgaatttgtcaaatgacttaaaaataaatgtgtttagcccagtgttttttgcactgttgtgccattgtggcgacgactttgcttaacgcgggcaccgccgacgacgaattgttgccgcgttcggtgttcgaagcattcgaagcattgagcgaaaacattagcgaagaatgggaggacaaaaggggcaaagaaaggctgacggacggcgcggaaaactttacactttcggcattcataaaaatggtggagaaaatggccaatttatttgaaaggtaaaggacgacgggggagggagagaatgtcaatttgtactgtaacccctgggtgggatggactgtccatttgagtactgtaatcccagggaggcaggaactgtccatttgcgtctgtaacccctgggtgggaaggactgtccatttgagtactgtaatcccagggaggcaggaactgtccatttgcgtctgtaacccctgggtgggaaggactgtccatttgagtactgtaatcccagggaggcaggaactgtccatttgagtctgtaacccctgggtgggaaggactgtccatttgagtactgtaatcccagggaggcaggaactgtccgtttgggtactgtaacctctgcccttcccttagggcccaactcttcgaattggttgccaatgcgttaaaattggttcttccgctgttcgagcgcacgcacgcgcatgtcaagctgattcaggcgcacgcgcaaatcgtcagctgtttgagccgaatcgacccgccgatgctaattgacgaatgggaaaacggagaaattacagttcatggaaaagggcaaaggacggcgacggcactgacagtgccattggccgggtaacagaaaaacaaattggaaatgatcaataataattaatgccacagaatggacaaacgctgtttcggcacttattttcgggtgcgcttttacggcgtcaaattcggcgaattgaacggcaaagaatttgtgtacaaagagccggcaataacgaaattggcggagataagtgcgcgaatggagcaattttatggggagaaattgggccgagaaacggtggagacaatgaaagactcaaacgaagtgaaaattgggaaggaaaaggaagggaagggaccaggggatggatgtatccagcaggaaattaacaagaaattcc

SEQ ID NO: 84989 - DNA, 642 bp, Heterodera glycines
  Genomic contig location: Contig_ID=SeqID_3518; Location=162..803; Strand=+
  SCN-specific regions: Sequence locations=1-47,69-198,222-642
atggaattggactttcgtttggacacttttgaacgaatgttggcacttatggaaagaaaagtaagaaatcactatgattttcaaataaatggagaaatcattaagaactaattaagcttgaaaatgttaatgttgacgaagtgaaaaaacaatcggcggaagagaaagaaacggcggagaaagcggagggaatgacgcgcaaagaaaaaggggaagaaacgcccgaagggacgggggaagaaaaacgcacagacaaaaggcaggggaaggaaacggcggcggaagtgacaacgaaggcgaatgaacaccccaaattggccaagtatttcaaaatgctcaaaatggtaattggttcagaatcatggaaaatatttggaagaaacaattttagggcgtgcctgaggcggcggtaaggcaaaaaatgagaagtgaaggaatggacgacgcactcctaaagtgagccttatttgttagtccaaattgagtggaaggaatttttacgcggactttattaaatgctcaaaaaacggtttcagtgacccagagaaggaattgccattggaatcaccacaaaacaaagcgcaaatggtacatgatgcattggcagaggacgacgaatcgtcctcaaactcagatgaatga

SEQ ID NO: 84990 - DNA, 365 bp, Heterodera glycines
  Genomic contig location: Contig_ID=SeqID_3518; Location=924..1288; Strand=-
  SCN-specific regions: Sequence locations=1-148,170-299,323-365
atgtcaattgtggtgccgagtgacattaagccacgactgcgcggcagcaaatttgcccatgccacggaggaagagaggaaggccattgctgcgcaaatggagcaggtagtactccgaaaacccggtcattatctttatgacaccaaaactgttttcatttaatatttcatttgacactgtgtcagggaagggacgccaatcgcacggcgacgactgaggccaaacgaaacgccgcgcggcttggccaagcagaagccaagctggaccagcagattgaagcggagaaagcctattttgatgcacagttggagaagttggagaacgaactgcaatttgtcgcttcccttttgcccaaatctcagtga

SEQ ID NO: 84991 - DNA, 363 bp, Heterodera glycines
  Genomic contig location: Contig_ID=SeqID_20193; Location=559..921; Strand=+
  SCN-specific regions: Sequence locations=1-363
atgcccacactttaccaagctgtgccaggacggagttcagttcggagcagtacaatgccaaccaatcgtcaaaatgaacttgttaccgtcgacaatcgcccaggccttacagtacctcaatcttggaggaattttcttcagactctttcgatttgtattgcatattttctttatgggaaagagaagaggcaaaaatcgagagatgaaattgaggagggaacctatcccgtggaaaagaaaaccatacaaaacaaagcctcaaaaaatcggaaaaggctaacacgtacgcactcaatcccgctaacggaaagatggccgtctccggaacaaaaaccgaccataccaggaaaaatgggcttaaaa

SEQ ID NO: 84992 - DNA, 621 bp, Heterodera glycines
  Genomic contig location: Contig_ID=SeqID_20196; Location=843..1463; Strand=-
  SCN-specific regions: Sequence locations=1-75,97-124,175-291,313 -386,408-458,480-511,604-621
atggccaaatatgcatttattctcaaaaacctccaagatatgcttttatatctagagattggattttttatgttagttaagggaaaattgtttaaattgttttacaaactaaaaaattcttgacaaaaaaagaaatttaaaaataatataaaacccaaaaatattaaaaatcccttgttggtcgaggggggggggggtcgaaagcagggctggccgtgatcacggatcacggctcacggaaatcacggggttttgggggtgccgtgatctcggatcacgggtcacggattttttcaaattttccgtgattttgatccgtgattggcattttatatagggaatttttattgagacgaaaataggaaagtggtgtgaagaaatttttgagaaaaataaataatttcttttcttcttacaaattagcaagtaaacatatatatgtagtctggtggttaaaccttctgtctttcgttgtctgtcccttgggttcaattccccattgggataggacaatttatatattttgttttgataattttaattgaaatttaattaacaagaaatttcataacattgaaaattatttttctttattttttaaaacgtccatagaccaataaa

SEQ ID NO: 84993 - DNA, 1026 bp, Heterodera glycines
  Genomic contig location: Contig_ID=SeqID_20197; Location=127..1152; Strand=+
  SCN-specific regions: Sequence locations=1-222,244-398,493-609,631 -879,901-1026
atgtacatgtgggccaaagcgagcgttttcggagacgaagaagcggcatctgcaattctgcggacgtcaaatccgaaggaatgcaaacgcattggatcgcgaattcggttgttcaacaccactgcttggagacgaataagcatattcgtcatgacctgtgctaactggcataagtataagcaaaatgaagacctgatgcgccatctcttcaattttggtcccgatgctgaatttgttgaatgtacagcaaatgacgtgtactggggtgcaggagtggcgctttcggatgttgaaaaaatccgcgacataaaccgatggcctggtaaaaatatccttggacggattctctcagccttgatgaagaaattcctgcgtaagaaatctggtgaaatgaacacaaaaaaataaataaaataaaaaataaataaatccaagattttttttaatattacatataataataataataatttaattataattatattaaatcctatatattttttcaaataacaccgcaataacaaataatttattacagaaatgtcggcaccaacagcaccaccaaatgttcgggacctgagcgaattcccgccgttggaaaagttaacattggaggatgtaaggaaaaagaacaaaattgcctcggcaagcccaagtggaaactcaaatatttctaaggaaacctgtaatagtgcaataagtgtggatttagttgcttcggcaagtcatataacttggggaggggaaaaagggaacattgggcaagaaaaaggggaaaagaatcaaaaattaaataaaaatgttgcttcggcaagccaaagagtgtctgaaaattttgcgaatcaaggatttgacaaaaacccggatgaaatggcagaagaaatgatggaagaattttcaagttttaatgtgggagaaaacgaaggaaaaattgttgaatacctggtttgccaagtagaagaaaatatagtgattggaggaaaattgaggacaatgacaacaaaggctggccacattttgtag

SEQ ID NO: 84994 - DNA, 135 bp, Heterodera glycines
  Genomic contig location: Contig_ID=SeqID_20199; Location=15..149; Strand=-
  SCN-specific regions: Sequence locations=1-80,102-135
atgggagaatccgctccacaaaagaaaaagaaataccgtgatgctgatgctcgaattctccgactcttccaacgttataatgatgtcaataacaacattgtcccccaaaatgatcataattatgccaatgtcaat

SEQ ID NO: 84995 - DNA, 844 bp, Heterodera glycines
  Genomic contig location: Contig_ID=SeqID_20199; Location=213..1056; Strand=-
  SCN-specific regions: Sequence locations=1-69,92-122,144-240,264 -321,344-844
atggtaaaaacgggccaggccgttttcgtacggccgtttcgtacgagtggatatacccaaaaaaaacaattttgttattttttctgtttttcaggtaatcaaacgtttgcgccgtgatgaaaatgcaccgcgagccgaacctctcaatttggagcagttggagattccgaatacctatcgtgtttataagcgcactgagattgacgaggagcaattcctgttggcggacactggcgtttttcaaattcacggacagaatggaccccaacggtaagacatttatcgtttaaaccgttaaatgatggtcatttacactattaaggattctcatttttggaagagcgtctacggcagattggacccaccagatgaaagacatttacgcggacggcacttttgcaaagaagcaaataagggccctgggcctcacccatgtaatttagaatttttttattattccgttcccattcaaactcattaaggtttacaacactgatcctgccttcgctgagaagtctaagatgatcacatcattggccttcctgcctgtgcaccaccttcaaaatggccttaatgctcttcaagcacaaattccgccacaacttaatggcgttttcaattggttaagtccgaagacgaattttatgaatttttttttaggtttccggacaactacatgggcagaattcgtttcaatgttccaattacggcgcctctgttccacccacacgaatggagtgttcatcagcgcaccttggatagtgctgatcggaccaacaacttcgccgatgcattccatcgcaaacttcagcggctttttaattgcactcatccgactatttga

SEQ ID NO: 84996 - DNA, 581 bp, Heterodera glycines
  Genomic contig location: Contig_ID=SeqID_20200; Location=886..1466; Strand=+
  SCN-specific regions: Sequence locations=1-581
atggatgacaaatctttgccatttccattgcccgaccgtccgttgcccagcaaaatccgttttaagcaccttcagatgtggtaattaaaaatcagagctatcgcaataaaagcattcatcccatttttaggcacatcgatcactccgtcatcgcttttcttcgttcaaatcatcaaattttcgacaaaagaggcaccaatttatatttggcgattccatcatcacactctacgaatggccagccgatttgggatgtttttgttcgtgaaatttggcccattttttctgaaaacattcgccacttgcactttaccggtgatgatcatttggacaatttgcttcgtcgcacttcgccgacaattctcatcgatctcaaccaattgaattcaatccattcatttggtctgtcgcccgctgcgtttggtgatggttttgatgtgccaaattcaacaatttctgctggccaagcattgtccaaatggttgcactctccgagaaaagatggccaacccaagcgatttcgttgtggcagaaatttgaacgcacaagcggacttcgattgggtcaacagtttcaaggag

SEQ ID NO: 84997 - DNA, 1153 bp, Heterodera glycines
  Genomic contig location: Contig_ID=SeqID_20202; Location=5..1157; Strand=-
  SCN-specific regions: Sequence locations=1-101,124-549,571-604,628 -945,1003-1153
gtcaaattccctgaaaattcgaaatttgtgtttgtaacggccgccaacaacgcttatttcggaccacttcgcgtactaatcgcaagcattaagcaaacatttggctgcaagcaaaaaataatattttacgacttggaaagtgtcagacaaaataaagaatgggtaattaatcaaattgtcaatagagaccggacgacaggggtcggagggatcccgaatctgaatcaaaaaatcattttaaaatttttgtttgctgagaattttttcaaaaactttaggggatgaggccgccggtgccgataggcaccgacggaaaaaattttgtaatttttgatgcgatttgttaacagattttgcccaaaaaccccaatttttttagcgattttgagcaaatttttcaggaaaattaaggatttttagagtccggcggtgccgttatgcaccgaaggaaaaatacgtagacaacaatttctaatctaattttttagacaaaattcttagattgttgtgcatgaaactacctaataagatttaaaatattctttaaggaattaaaaaaaaataatttttgttaattcacaaaatggccaacctttgcgtcaaattttgaaaattttcacaagtattttgagagccgtgaaaattttttggaattttaacggatttttaaagaaaaataagcaaatttttaatttaaattcaaggtcttaatttaaaaaatgtgagtttttccaaaaattatcgtgacttcaatcccgcgggatcccgcgggattgataaaatggtcgggagggatctcgattcgggatcccgatgaaatcccggtcccgatcaatcccgatgaatttaaaaaatcgttcgggacggattccaaggtcgggatcccgaatttaatcctgcaggatcccgaagaaatcccgcgggatcccgatcccgtccggtctctaattgtcaattaaaaatgctttttaatttttaaagaaaaaattctttttactaattatcattgacccctaaaaacgattagaaggctgagttggatttggtctgtgaattggaagtgcgcattttcaatttttcccaaatggttgctggccgagtgcgccacccgaaaagttacgcgtggaaaatttttgtgatggcggtaaataaa

SEQ ID NO: 84998 - DNA, 1045 bp, Heterodera glycines
  Genomic contig location: Contig_ID=SeqID_20203; Location=729..1773; Strand=+
  SCN-specific regions: Sequence locations=1-182,204-285,307-499,521 -579,601-939,961-1045
  Gene Ontology: Mol. function=electron transporter activity; Cellular component=integral to membrane; Biological process=cell-cell signaling
ctaaagtttcatttgcttttgcacgatgaaaggctttttctgtttttggacgattttatgttggcttctgcgctgattacatttgtgactttcacattttttggaatgcgtgcttcttacggaagatatgcagctttgtctttcttttcaaaggtatttatcgctgtttggttttttcagccataaaattattattattttttcaattctaaacttttttctgatgttatttaattcaaatttgtcaggtcagattgctattccggcacggattggttggtttctccaggaaatgccttcttttgttttgccgactttcgctgtctgttggcagttgacaatacgttttcttcctcccgtcaatgccattgttctcctaatgttcattgcacattattttcagaggtagtaattggcaaatattattttcctggtatcttctgtcaaatccgttttaggtcattcgtttacccttttctgattaaaggagggaaagccattcctgcccctctcttctcgctgggcttcattttctgcacttggaacggcttaattcagggcttttatcatgcaaattgtgctgtttattcttccgaccatttttggactcttagcgctttgattggtttttttccattccaatttaaagtcactctccgtttcttcactttatttgtaggtttgccacttttcgctctcggaatgttcattaacattcaatccgaccaaatccttcgagacctcagaaaaccgaatgaaattggctacaaaattccacatggcgcaatgttcgaatttgtttcgtgtgcaaatttttttggtgaaattgtcgaatggtttggctacgcccttttcgcccaatcgcgagtcgcgtgggcattcgctcttttcaccgctgcgaatacaatgccacgagcgaaggaacaccacaggtcggagagaacggacggagctgacattgtaaaccaattctcttttcaggtggtatttcgagcacttttccgattacccgaagaaaagaagcgcagtcattccctttttatat

SEQ ID NO: 84999 - DNA, 78 bp, Heterodera glycines
  Genomic contig location: Contig_ID=SeqID_20203; Location=2012..2089; Strand=+
  SCN-specific regions: Sequence locations=1-78
ctccttcgaacagtgtgttccgatgttgccagcaataaatcctgcaaattccgatgggattgttttagccgcgcttcc

SEQ ID NO: 85000 - DNA, 4913 bp, Heterodera glycines
  Genomic contig location: Contig_ID=SeqID_3519; Location=345..5257; Strand=+
  SCN-specific regions: Sequence locations=1-2016,2038-2379,2401 -2609,2647-2907,2929-3121,3143-3578,3600-4083,4105-4213,4251 -4363,4385-4551,4573-4913
atggctgagcaaaattcttttaattctcaaaagggcgaaaatgtggtcctacagggacaaattggttcggatttcgatccaattttctttacccctgaggagaaccaaaatctgaacaatgtactgactcgaatgcgaacattcgaatccgctatttgccgccaatttcgtaaattggagcgagaatttgcagagttgaaaattgtggctcaccaatcagacgataccgatcgaatggtcaaaattgaacggtcaataattgatttggaggatcgagaagaaatggacaattttcaaatggaagaaaaagtgataaaaatggcagaaaaggctgaaactctcgaaatacggcaaaattcatttgaaagattgaccaaagtcaaatttaacaaggtggtggagaaaatgaaagtggaaatggcaaaaataacagaaaacattgacgttttgaaaataagagtggaaaatgaaatggagagttgtgaaataatggtttctgacccatttttgggcggaattgcaccattggaaatgtttgatggaaagccaagtgtatccttttcacgttgggcatcaaaatttgtggatatgctttctctgctaccccaattaacggaaacccaaaaactgagcagattgagaatactcttaattggtcaagtcagagcggaatatgaagcattggacccaccacccgaaaatttaaccaccgctttgaatcatttaaaatcaaaatttgaaaacgaaaatacccgttccatagcgagacaagcgctttcgatttgcaaacaagcgccaggcgaaagagtgagttcatggaaagactcattcccgagctccaatttgaggtaaaggcgggaagaccaaacagttattcgggtgcctacgaactcgcacaacattttgaactgtttttggcatcccggagaacaaatcaaagttctgtagccgactctgttgcagaattatcctcaaaagttgaggcattgagccttgggcaatatcaaagagaaaatgtcaaaggagggcccgacagacgaagatgctattattgcgtcgccctgggcatttggtgagggactgcaaaacaaagaaaagagatgaaaggcaaaatagccgcgggccacaaagaaataacgaatattatgggaatgagagacattggaacacatggccaaatggtggagaaaattctcgttttgtgaacggaagggaacaaagaaatgaacgagaattccgccggtcaccaactccgaatacgcaccctaggggatacagtaataattcgggatcccccgggagaagagtgagctttggtggaagatttgctgcggcaagaattgccagcccaattttaatggcatttattgcaattctgtctctctttcccccaaatatagctgctaatactgcagttagcccaatgatttgcctatcggatgctccctcaagtctctggtctattccttctgaccccttttgcccaacttggaccccaacagtggaaccgattcccgcaaattttgccatttttaggcaaaatacaatacagtacaaaactgaggctacggcttgtaaatgtgtgaaaacaagcatttcaagaagaatcggtttctttggagggaaaatcgaagaaataagtacaagcccagtggaagtcccaacagcgatttgccaccaaatgaaagaaatgaagcattcacccgccggagacttaattttttacgagggaaacaaaacatttagggcgacaaataattcccttgaggtgggatggtcaagctggcctactggcattttttggacaacaaatgaagtgacaaattgttatgtctatgagccagttgtgttcacccggcacggaatgccagggataagtacaccaataaatgattgtaatgcttgtgtgtaccaatcgggaaattgccattgctcacaaattagcctcatttggaaacctgatcaaacccaccaatgtgcttatgttgaagtcggaagatggggtggagaatattcaacgaggatttggacagcaaattacggagattttgctttaacatttctaaatgcctcgagaaaatcagattgtgatggtacggaatttgtgatttccgaccaagcattcgcggtcccagcggcacaatatgatgaaataattaagagaagtggtgaaccgaatgagaggcgtaaaagagaaattggcttagtgtactcttcacaattgtcagctcaattaacagcgcttagtgttaaaatttcacaaaacacacaacgattgttcacagaaacaatcagacagatttgcatgagtctaaaatttttagccgatcaaacgcttgcacttgctgaagccatccccacacttttggctcgtttttatttgggaaatccatttcttttggcaagattggtaacaaaagaaacgttggaaattaaaccgtgttttgccgttaatgaaagggaaatgcattttaattggcaaagtgggccctgttttgataagcttcctattattttcagtttgtatggaagacaaaagcacggctttttggatccaaatacaatgataattcatcagagagcaggggaaatttattgcaatcatgcaaaacatttgtacatattaataaaagggagtattttacaatatgaccaaatgacaggtgaaatgactcatattccgtacgggtcattacaccagctctcgagacacggaaaaatcgattttccagaatttccagtgcaatttttcaaaaacaaagtcatggcaaatttaaccgaattgtattccccagagaatttcaatgaaacaatggaagtggccaaatttgcccaagaaatagcccgtctctctaagcccaaatccccggaattgggaacagcaacaccccttcaaaggtctctaagatttaaagaaaatgaacaaagagtggttcaaattgcagttgccgaaacaaattgtgaccccaattttcggattgctggaatggcaaatgacaaaaaagtaatccatttgttggatacgggtgcacatgtgactttgtgtggcatacagacagcaaaaagacttgggataaccgaattggaaccagcagaaatcagtggagtaatcggcgtgagcgggaaaattgtcaatattttgggccaaaagaaaattgaaatgcaaatttttgggtgtactgtagagacagttatttatgttgctgaggcagaaattggtggcgttggcacctatgacattattgttggacggaaaactttccgccaactaccattgctgcttgacctgcagacgggtactttgataaggaaggaagatggccaaacatacaattgtgaaaaattcaatgaaagagacgtttatttttatgagcccgaaaataacagagaaaattgtggaaaaatcagagaagaattggaaatttgtttggacagaaataaaagtgtttttgctaggcatgaatatgaccttggcacatgtgcctattgcgctccgcctattctaacaacctccgaccttccggagagggttcggccttaccccgtaccaaaaaagtatgaggaggaattgaaggcacaaattgaaaaaatgttaaaatccgaggtgatcagagaaagttgcaccccgtgggctcacaacattgtccttgtcaaaaagtctaatgggcagttaagaccgtgtgtggatttccggccgctaaataaagtcacggtcccagacccttatccaattccccgaatggataaaacaattttacgggcagctggcaaaaagtggtacagtaccttggatttggcctcagggttttggcaaatcccattggacaaggaaagttcatacaaatgcggaattttgactccttggggactgtaccaaatgctgaaaatgccgttcggcttaagaaatgcccctagcattttccagcgggtcatggataaagtgctgaaggacctcccaaatgtcacggcatacattgacgacatattgatacacacagattcagaaaaagagcatttagaaacattggaaagtgtgtttaagaaattggaggaaaatgggcttaaaataaaaaagaaaaatgctatttctttaaaaatgaatgtacctatttggacatattctaaacaaaaatggttatcgcccatcaataaataatcgggaagtcattgaggcattcccagctccgaaaaatgtaaaggaagtcaaaagatttttgggaatgatttcatttttcagaaaattcatcccagaatttgcagtgatagcccatcccttaaatcagttaacggaaaaagagaaagaatttaactggttggaaaaggaggaagaggcattcgaaaagttaaagcaatgattgcttaaggcaccttgcctgagggcaccgaattataaactgccattttacttgttcacggacgcatccgcagtcgcatatgcaggcgcactaatgcaatcagctgatgagaatcaaatgcacgctgtcggtttttggtctaggactctaaactcgacagaagctaaatttcctccaacacatggagagttggctgccatcgtccatgcagtccaaaattacaaacccataatttatggagcagaactgattattttaactgatcacagaccgctcactttcctattttccaagtcaagctcaaaccccaagctgaaccggtggttaatgtcattacaggaatttgaacccaaggttgtatatttggaagggaaagcaaatcgggtggcggatgccttgtccagagtcccgattaaatgggaccaaattgaatcaaaatgtaaagaagacattccctttttgctggtgacagatgaagaaaatggttttgaaattaaccgggagaaaattgagaaagaaaccagtttagacccaattttgtcacaaattgtctcaaaa

SEQ ID NO: 85001 - DNA, 517 bp, Heterodera glycines
  Genomic contig location: Contig_ID=SeqID_3520; Location=99..615; Strand=-
  SCN-specific regions: Sequence locations=1-12,34-49,72-343,365-517
atgaatcggcggtaagtaattaattttaaaaagttaaagaattcatttcaatatttaactaaccattttcacaatttcagctggatttgtaacgatgtttggatggtaatgttccccttttttgaccgtgcccaactcggcctcaaattggcactgatttctccccgtttcgatgttttagtggacaaacatttcgatgccaaaacggaattgacaatttggagaatgattatacttagcaaggaaattgtaacaaaaccgaaactaactgtatgggattttgatgctgtggattttccattgcccgaaccgttccgtcatcgaatttctccgtgccaatcagcaaatttttgacaaaggcacccatttgacttttgcttatatgccttctttgtgcaacaccgctgaaggccaggcaatttgggatgttttggaacgtgaaatttggcccatttttgcaccaaatattcgccatttgagctttgttttttctgatcgtttgggtgaaaccaataaa

SEQ ID NO: 85002 - DNA, 192 bp, Heterodera glycines
  Genomic contig location: Contig_ID=SeqID_3520; Location=1142..1333; Strand=+
  SCN-specific regions: Sequence locations=1-192
aatattgatcataggccccaaactcaaaaatgcttaaaaacggtcagaatcgatgtaaaaaggtttgaaatgggttggaaaaatagaattaggggcgcgcttgccctttttcaggatgaaaagtgccgaaaatggagtgccaaactcaactgggactcaagtgaccgtgctatataaagcactcaaaataca

SEQ ID NO: 85003 - DNA, 411 bp, Heterodera glycines
  misc_feature (137)..(137): n is a, c, g, or t
  Genomic contig location: Contig_ID=SeqID_20205; Location=41..451; Strand=+
  SCN-specific regions: Sequence locations=1-37,59-242,272-297,319-411
atgtttttgatgattctgctgactaatgactgcgataatgatgatgatgcatcatcatctctcgtctttgtcgtcgtcgtcctgtggtcggtcggttggtcccctcccaaaaatttatttggcgaataaaccaaacncaacaaatttttgtgcttttatacttttttttttgtcgttatgcatttcccgaacttttcgacaaaattatttttttctcatttgtcagtttaattgaccgcaacaaattattttattttttatatttttatttggttaattgactcaatttgcaatttggatattaattttgagtaaaaatggagaaaggttccgcattttttgatataaatttggtttaaatttctcatttttagaatatacaaatattatttactcactttaaaaattata

SEQ ID NO: 85004 - DNA, 834 bp, Heterodera glycines
  Genomic contig location: Contig_ID=SeqID_20206; Location=1156..1989; Strand=+
  SCN-specific regions: Sequence locations=1-168,207-428,454-564,604 -702,724-745,768-834
  Gene Ontology: Mol. function=glucose-6-phosphate 1-dehydrogenase activity; Cellular component=cytoplasm; Biological process=pentose -phosphate shunt
ggcctccgtttcccggacgcgtacgagcgcctgttcttcgacctgttcagcgggcgccagtacaattttgtgcgcgcagatgagctggagcacgcgtggcgaatattcacgccgttgctgaagcgcatagagggcgaccgggtcaagccggaacagtacgaatacggaaggtgggaatttgggggtttcagttttacaaatttattatatgccttcttttcccgcttcaaaggtagggtggtgaagtttttcaacgaaaatttaccggtcccgagttttgactccaagcaagcttttcgagaccgaaatttgctctcttgaccgaaactaacaaaaacgacttttctctaggtgacgctcgaattgactctcgactatttagggaaggaggtcttggagagaggaggggggggggggctgccgacacgaaaaatttaaaaaatttggaaaacaatttttttccttaataatttatgatgaccgtccctctcttaggcaatgattaattgagataattagtatttagaatatttactctaaaataatcttttctaattgttttagaattttaattttcaaaaaaaaatttttttttttttttttgatttacccatttcaaaaaaatatcggtccttcataataaggggcatctcataagaaacgacgactttttgcaaaaagccctggattttaatgagtcagtattaaaaattttaaatatatccctcccccccatccccattttgaagtcgtggcccgtcctccagcgatgcgctgatgcaaaagcacggctttgtcttcagcggcacttacaaatggccatcggtgaacccg

SEQ ID NO: 85005 - DNA, 553 bp, Heterodera glycines
  Genomic contig location: Contig_ID=SeqID_20207; Location=584..1136; Strand=+
  SCN-specific regions: Sequence locations=1-73,96-553
atgtgtctccattgtgaaagcggctgtttcaaagatgagaaggacggggtgcacaagtgttgtgacgatgcgtgtgccgcgggatgcaccggcgaaggcaccgaccaatgcattgtgagaattcattttcatttttgattttatttattggctttttgattttttgattgctcattttctctaatttgtttcagctttatttgtccctcttcttaggcgtgcaaaaagttcgagcaggacggccgctgtgtgacggagtgccgcggcttcgaccgctacgatccggcggagaagcgcatggacccgctgccggaagcggaccgacgcttcgcctacggtcggcactgtgtgccaacatgtccgccgggcgctctgtatgaaggagcgcactgtgtcacgcgctgttcacccggcaaataccgtaacgcgacggaccattgcgtactgtgccagggcgaatgcccaaagggtaagagcattgcgagaaggttattgtagtggaacaaaagataaagctataccatttatgctaattgtcaaattttgtaaaaaa

SEQ ID NO: 85006 - DNA, 325 bp, Heterodera glycines
  Genomic contig location: Contig_ID=SeqID_20210; Location=901..1225; Strand=+
  SCN-specific regions: Sequence locations=1-220,242-325
  Gene Ontology: Mol. function=RNA binding; Cellular component=nucleus; Biological process=mRNA cleavage
ttggcaacattccgtacaacgcaaccgaagcggacattggcaatttgtttagtcagtgcggagtggtcaccaatgttcggtaaatattttgagttggttttgatcgtctattattgcattttttaagcattgtgtacgaccgcgagaccaatcgcccaaagggctttggcttctgtgaattccaggtgattgcatctttcaattgttggtcatgttaagccctctattcatttaggaccaacaaggagctcagaatgcggttacaaatctgaacggagccgagctcaatgggcgtgcgctgcgtgtcaattggaccaacaaataa

SEQ ID NO: 85007 - DNA, 199 bp, Heterodera glycines
  Genomic contig location: Contig_ID=SeqID_20211; Location=335..533; Strand=-
  SCN-specific regions: Sequence locations=1-199
atgtcatatttttccgctgacgctgatgcatctgagcttattactgcccaacgacgggacgatgagcaaattcagtgggtctatgacagaatgtccgattgcgtattgcgactttttggggagcggatttggatcagttaccatcgttggcttccatcgctggccgctttcatttatctgtcggcgaccaatttgcgtg

SEQ ID NO: 85008 - DNA, 2227 bp, Heterodera glycines
  misc_feature (21)..(21): n is a, c, g, or t
  Genomic contig location: Contig_ID=SeqID_20211; Location=822..3048; Strand=-
  SCN-specific regions: Sequence locations=1-301,326-551,573-794,816 -979,1001-1117,1139-2133,2158-2227
  Gene Ontology: Mol. function=protein-arginine N-methyltransferase activity; Cellular component=bud neck; Biological process=regulation of mitosis
aggtctggtcgtgggacattntggacgatatggcgcgatttccgccctcttctgtgccaattcgtcatgcttgtccgtcgcactttcgcttaccgctgacctcgactcggagttcgacttgcacaacaatttgtcccttcgccggtggcttgctgaaccggtgccctctctactctccccgtttatccacactatcatttccatcccttctccctttagatttcctcactttttttggaccattcgctgttcatttccgatgaaaatacttcgtctccaacacttccaaagtttgcatttgatttttaatttcattaattttaatcccattaaacagtgtccatcgtatgctgatcaattaccttttgtcaaactgtcgtcaaagtgtcgtccttttctcgtcgtccgttcagtctgatcacttcgctaattgtgagttgaaacagatggtcctctccacaaaacaactcatcttgtcgaatgaaaacatatgcaaaagtgaaaatccgatgtctggttatttcgacctgttacaggtgcttcggattattattttcctttcctaaatttctgaacctttccttcagacgcccttgcaaccgctttctgacaatttggactccgccgtttatcagacgtttgaacaggacaacgccaagtacgaacattaccagatggcaatcaaagccgcgttattggaattaagtcaacgacaaatggtgatcacataatgatagaattagcgaattgttgatttttgttaaggaaagtggagggattgtcgtttttgtgttgggcgccgggaggggtccattggtccaagcagccataaacgccagggacgaattggagagggagaaaaagcacagcgaacaatgctgcctcgtacatttgaaatggtattgaaattcaagtgtcattcattcactttagaattggaaaatgaaactgattgctgtggaaaaaaatcgcaacgcaattttaagcctgaaatactgcaacgaagaaaggtgggttagctacccaattgcaagagatgacgctgtttttgggcaggtgggccaactccgtccaaattgtgcacagtgacatgcgttctttgtccacttttgtcgattccaaagtcctggaaaggcccgatttgatcatcaggcacagtctttttcttctcttcgtccctcccttttcattcgtccgtcctttctcagtgaattgctcggctctttcggtgataatgaattgtgcccggaatgtctcgacggcgtttcgcccattctcaagccgggaaccatttgcattccccaaacatacaccaatttcattagtttgaccattcgtttgtctctcaatttgcatttccttcaatttcagctcccatccaatcgcttcaccttcatcagagtgtcgccgcgctcgaccaatgcaaaagtgaggaacaaagcgtgggacgatcgaaaaagtcagttacctatcagaatattcgcttatgttttgatttccttttagagtttttggctgtgcgttcgaccgttcttacgtcgtgtgcatggatcagttttgttacttggccggaaatgtggagccttgttttcgctttacccaccctaataaagaggtcgacacaattcgaattccttttggactaattgtgactatccatttccaggggtcttcgaattctcgacaatcgaaagttcattttgagttgccgcccaattgtgaagtgagtagcaatactgaggaagtctcctttttcttactatttcgcttctgtttttcagctgatgggcttttcggcccattttgaagtgaatcttttcaaggacatttgtctgagcactcatccgttgcgatttacggagaatatgcactcttggtccgtcagtctgtcattttcgaccgtcttttgctttaaaaattgattattacccaaatggcactgattgtgaatagattttaggttccctgctctttttccgcttcgtcgacttttccattttcgggacaccacaactgtgactttcaacattcatcgcaaaattgacagtgacgggtgttggtacgaatggaacattgagtacaaagtaggacaacacacactcaaatgcatgatcagagcatcaaatgaatttgttttttaaaacccaacttttaaagggaagcgacgggcaaacgacgcgcagcgaaattcaaaatgaaaggggcgagtcgcaatatatgaagttgc

SEQ ID NO: 85009 - DNA, 881 bp, Heterodera glycines
  Genomic contig location: Contig_ID=SeqID_20212; Location=1..881; Strand=+
  SCN-specific regions: Sequence locations=1-121,150-150,175-236,275 -799,828-828,853-881
tttccatttatttcaatcggctagtgctttaaggttttctgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctattttgtctttgactttgcttctttttccatttatttcaatcggctagtgctttaaggttttgtctttgactttgcttttttttccatttatttcaatcggctagtgctttaaggttttgtctttgactttgcttttttgtccatttatttcaatcggctagtgctttaaggttttgtgttttgactttgcttttttttccatttatttcaatcggctagtgctttaaggttttgtctttgactttgcttcggctagtgctttaaggttttgtctttgactttgctttttttccatttatttcaatcggctagtgctttaaggtttgtctttgactttgcttttttgtccatttatttcaatcggctagtgctttaaggtttgtctttgactttgctttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttat

SEQ ID NO: 85010 - DNA, 1248 bp, Heterodera glycines
  misc_feature (1201)..(1201): n is a, c, g, or t
  Genomic contig location: Contig_ID=SeqID_20212; Location=958..2205; Strand=+
  SCN-specific regions: Sequence locations=1-781,812-878,923-1052,1083 -1095,1117-1166,1201-1205,1231-1248
gtgctttgcgttggttaattggcgtgggtgagtgtggtggttgggccgtttttgcgatattgtggctggaaaaaagaagcgatttcgctgtggggagcgcggccgtctgggtttaagtgcttgcttgcgcttgtgctcggcattgaacggtgatggctgctgctggggtgccacctttgtcgtggcctcagtttctccagcgattggcagctgtcgaaatgaataaaacatgcagctcgtctgtgtgttaaagaaatttggcgagttaattgacttgtgtaaatgttgcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtcgccttcgccgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctncacgcgaggaggtagtgacgagaaataacgagaccgatctcttatga

SEQ ID NO: 85011 - DNA, 801 bp, Heterodera glycines
  Genomic contig location: Contig_ID=SeqID_20213; Location=327..1127; Strand=-
  SCN-specific regions: Sequence locations=1-98,185-195,233-533,571-742
atggacaaattgtcggaccggatgaaccgtttgttgagcacgggtgttgatgcggatgtgcactttttggtcggacaaggcgatgagcaagaggcgggttttatttaaattacatttttaatttaactttattaaattttgccattttataatctattaataataataattttagttttttaaagtcttctttccattttaaaattaattcttttaactttttaaatttaaagcttttgccagcacataaaccaattttgagagttgcttccgatgtgttcgacgcaatgttccgatttgacgaagaatttcccgttttggcaactccagaacccggcaaaaagagtttagataaaattacatttttaaattaaaatacaaaacagttttagcctctctaaaagagggaaataatcccgttgagatcccggatgtggatgttgaagcattcaaaacgatgttgagcttcatttataccgatgatttgagcggagtgaatggcaaaaatgccatcgacgtgctttatgccggtcaaaaaaatctaataattatttttaaattataattttagccaaaaaatacaatttgccctcgctggttgaagcatgtgtgaaaattcccataaaagagcttagcaacgttttcatcgctttttccaaagctcgtatgaaacgaaattatgcagaataataagaattttatgagaatataaatttgagaaaatcatgattccattgtttccaaaaaaaaatttattttataaagttttttaaatttgaaaaaatatgtaaatataataaa

SEQ ID NO: 85012 - DNA, 837 bp, Heterodera glycines
  Genomic contig location: Contig_ID=SeqID_20215; Location=411..1247; Strand=+
  SCN-specific regions: Sequence locations=1-837
atgcgcctttgcgaagtcatcgttggcaaagcccccgggttccaactgctcacgggtgccacgcatgtttcggtagctggtactgcacagccaaccgaaactcctgccggatgccacgtatgttcctttgcgccggtagctgctagtgcacagccaatagagactcattccccgaatgccacgcatgcgcctttagcgaaacgatcgttggcaaagccaccgggttccaactgctgcacgggtgtgacgcatgttccggtagctgctactgcacagccaaccgaaactcctgccggatgccacgcatgcgcctttgcgaagtcatcgttggcaaagcccccgggttccaactgctcacgggtgccacgcatgtttcggtagctggtactgcacagccaaccgaaactcctgccggatgccacgcatgcgcctttgcgccggtagctgctagtgcacagccaatagagactcatttcccgaatgccacgcatgcgcctttgcgaagccatcgttcgcaaagccctcgggattgccacgcatgcgcctttgcgaagtcatcgttggcaaagcccccgggttccaactgctcacgggtgccacgcatgtttcggtagctggtactgcacagccaacagagcctcattccccgaatgccacgcatgcccattcgcaaagcccccgggttccaacagctgcacgggtgccacgcatgttccggtagctgctgctgcacgagcacgtgttgggtcgaaggacaaaatgacaaaaagtgcaaaatttgctaagttgactaaatccactcataacttttctcagacgcaaccaaattaaaactta

SEQ ID NO: 85013 - DNA, 327 bp, Heterodera glycines
  Genomic contig location: Contig_ID=SeqID_20216; Location=149..475; Strand=-
  SCN-specific regions: Sequence locations=1-327
atgcgtggcacccgtgagcagttggaacccgggggctttgccaacgatgacttcgcaaaggcgcatgcgtggcatccggcaggagtttcggttggctgtgcagtagcagctaccggaacatgcgtggcacccgtgcagcagttggaacccgggggctttgccaacgatgacttcgcaaaggcgcatgcgtggcatccggcaggagtttcggttggctgtgcagtagcagctaccggaacatgcgtgacacccgtgcagcagttggaacccgggggctttgccaacgatcgtttcgctaaaggcgcatgcgtggcattcggggaatga

SEQ ID NO: 85014 - DNA, 1103 bp, Heterodera glycines
  Genomic contig location: Contig_ID=SeqID_3521; Location=1615..2717; Strand=+
  SCN-specific regions: Sequence locations=1-738,761-992,1019-1103
atggttgccaagcttcttccagtcatcctctgctgcttgtttttggtatgtttaatcacggtataaaatactgtaattcgagtagaaaatgagggattacggtatctataaagacaaaaaaagaattcagtgaaatattttaaataaagtaataaagcttaaacttcctttttaggcttctttcgccctctgctcgcccaatgctgctgatgtgctggtaaatggctgaattttttggcattccgtttcccaataattagaaatttaatatcttgaagtcgtaaaactcaatttcgcggattcagttgcaggattaggattcaaaatccgttgccggacggatccgccttattaatccagcaaaatgccaaaaaatgcaggattgtgggcccaataaatcttacaaattcttccgtctccactattatccatattaaaattgattttttcagaaatttaaacgagaagcggcgatcagcagttgtggagctgtaagacatatttaaaacaatagaaatattcgacaaaatattcatggaggtcgcttaatccctaaatttgttaatgaaatttaaatttatttgtaccactaaaagcgttagatgttttttaattagccatttttgtcctgttttctattttcggcacttttagggacagtttgaatacgggggcggctgttgtacgacatgcacaagcgatgctgattgtacgggcgggaaggtgagttagccaaattttgagaagcatttgccactgttagaatgggattaatcacagatttaagtgaacgattattaattaaatcattaattatgtccaatcggagtaaagtttgacaaattttccaactattttttgtcttaactttttcaattattttccactcttttaatgtaaacttttaatttgtttttatctaatttagctttgtgtgcccatcctcaacttgctcagcgtcagtctgtgctttgccccatgcggaaattaagacagaaaagaaagcagcaaatgagggtgttgatagtgtgataaattgataggattaaatggaaaatggggagttaataattacttaaatgcatttaaatagtgattgatca

SEQ ID NO: 85015 - DNA, 657 bp, Heterodera glycines
  Genomic contig location: Contig_ID=SeqID_3522; Location=472..1128; Strand=+
  SCN-specific regions: Sequence locations=1-499,521-657
atgagttttgtcaagactacagtggaagcattgaaacaactccagacctcttttacctccgaccaaatgccaatttttaataccctaattaccactttgtcctctcaaattgacctgcttaatggatcgatttcccaactccgctccactgctctctccactgaaggcatgccaatttcagcggaggaattggaaagacagagaagtgtcgtcattattggcatgccagagcacaacgacagctcaccagcaaagcgggcagagatggaccggtcaaaaatcaattgcttattcgattcgctggggatcgaatgcggtaccattgcctatcgcatgggtcgttcctttaacccagcccaaaaaagtcctcgcccattgaaaattctcttgccttcccgtggcttccaaaaacaggctctcgctgcatggcaaaaaaaacaaaacaccattcgggctgctgattcgtctctgcaccatgtccgtctccgtgaatcgctgacaaaggcacaattggaggaacgccgtcgcctgcatttgcaatgcgttgaaaaacgacagaaagatgggcaagattggattgtgtatgctgggaacgttattttgagagacgaagtgcacatcttccggagtcagacaattcgtgaatcaaatttttaa

SEQ ID NO: 85016 - DNA, 1818 bp, Heterodera glycines
  Genomic contig location: Contig_ID=SeqID_3522; Location=1311..3128; Strand=+
  SCN-specific regions: Sequence locations=1-232,254-410,432-471,493 -701,723-749,771-1015,1039-1080,1103-1425,1448-1524,1565-1780,1802 -1818
atgaacaaaactgatgaaatttcactggctttaataaataaaaaaattagcatattattactgacagagacatggacaaaagacaatgagggaattcctcttagtccatggattaaggagaattataattatatttttgcatcaagaaaatccgaaaacagttcacgtggaggtggttgtggtattttaatcaaaaatgagatagccttttttgtaaaattttctggtacaaaatttaattgtgaaattttaattattcaattacaaaatctgaaatcaataagatttgcattgatttaccggcctcccaaaaccactttaaaacaaacaaaagaactttttaaatttatacaaacattttggtgtgaaaattatataatcttaggagatctaaatttgtcaaatcgagaattggtatggaggcaaggccaaccacacgctataaatcatattggtgaaatattttgcgacttttttaataaatttacatttataaatgccacgaatgagcccactaggggtaaatcatggttggatttgatcttatcagcaaatgataaaattgtaaaacattgtactgttgaaggtggcatattttcatcagatcatttagcacagctttttgtgctgagtgttccagaaataagagcaaagcctaaagaaatttgcctaagacggtttactccgtctaatgtatcacatttaaatgctgtaatttctgctagattaagttctctttctctttcacattttagtataaatgaaaaatgctgtgccttcaatagcgccttgttgaatgccttgaatgagtgtattccaataaaaaaattactaaaaaaagatttagctccaaaatatccacaacatttattggcatccattaaagaaaaggcaaaattatatagacagtgtaaaattgatccaacaaaaaaagcactttatgatagcattactttacatataaaaatccaaaccaaaaaaatacataatttaattgaacataaggctatttcaaagggaaaaaattcaatttttaaatacattcaaaaacacaatgtcaatccctttgaaataccaaatttagtttttgaaaataaatgctatcatgaaagtgaagagaaatcggaattatttgccattttatttgcaaattcatttaataactccgaagttgtcctaaacgatttaagtttggacaactcctatggtaataatcaatgctttatatcggacataaattttaacatcattgagactcaaacactgttaagaaaattgccaaataaaaatggaacttctccggataacatttcttataaagtcctaaaaaattgccatttttcattggcaactgttattactgagttgtttagactatcattagacagtggttctcttccaaacatttggaaggaatcaattgtctttcctctttttaaaaagggggataaattcaatcctgaaaattatagacctatttctttaacctgctcactatgcagagttatggaaagaattctcagcaaaaatatttacaattttctattaaaaaataataaaatttcagagtcccaatttggttttattagaaataggtcaacaacaaatcaattaataacagttgtcgaagattggtatgaagcaattattaatggaaaaaaagttactatatatgttatattgacaaggagtttcgtttcaaaaactaattccggccggccgaaggccggcctgggtctgaaagtggtggaagggtcttacaactttttgaggagaatccgggaaaactatagagaaaaattcagtgcggacgactga

SEQ ID NO: 85017 - DNA, 622 bp, Heterodera glycines
  Genomic contig location: Contig_ID=SeqID_20217; Location=848..1469; Strand=-
  SCN-specific regions: Sequence locations=1-469,491-622
atgcctttcccttcctttttaattttcctttttgccacttttttcactttttctgcctttggttggtccctctacgaattgcccctccgaattggtccaacttcgccaaatgtttgctttccccccccccttttttttgcattttcgcccaatccatcgtagggtttgttcgaatttgagctgagtgtcgagccaaaactgagcatgagtgttgagaatgaccatggcgatttgtcagtgaacgactacgagccgaaaaaggtcggagaaaattaacaaaaacaaaagaaaaacaaaaaagaaaaaggggcaaactttgtgccattggacaatttgtcatttaaaaagccatttttgcgtttgttcagatgctttggacggagagagagaagagtcaattgcgtccgtgcctcgaacatcgccaacttttgtccgtttctccgcccgcgccgcaccaatgccaaacgaatcggtctttagtgctgcgcaagttggcactgagtgcggagcgaacaatgccagacctgattcagttcaatggacggcacaaatggctgaatgccgtaaacggaaagaggtggcccagccaatgatccttgctgtcgattggcacagagactga

SEQ ID NO: 85018 - DNA, 961 bp, Heterodera glycines
  Genomic contig location: Contig_ID=SeqID_20218; Location=45..1005; Strand=+
  SCN-specific regions: Sequence locations=1-350,374-380,402-404,429 -531,553-882,915-961
atgaaacggcggaagaagcagcggcggcggccacgttatgaagcagcgcagcagacgcagcagcagcagacgggaaaagagaagaacaagcggacgaagcgggcagagaagctgacgaagaaacgacggcattggaagaggcggaggaaggacactgaagccgccgggcatgaagcaatgaaagccaggaagacaacagtgctgaaggaacggcaccggaagtgccatcaaatccggcaccaacggaggaagaagaagcggtagcagaagtgccacaaaaactgttgcccgaatgcaacaatgttgacagatggccacatttttgaattgatgtcgacactttgctgcttaatgatgatgcagatgaagatgagggtggggaagaagctgctgctgctgttaaaattaaatttaaaatgggaaaattgttgttgctttttcttgcatcaaaagtccagaatgggttataattttttttaaaatgatttatcctgttcaaaaatgtttgcttgttttctctcccaactgatcaaaaagcaattttttgaataatttccttgatttcgaaccccccaaatgagtccaattgtgttaatttttgaggcagtcgttttgatttttaaaattttcagatggcatccctatattatcgccctcttccccgttttttaattgccatttccccgcccccccccattttctgctgatttccagtttggacggactttcatcccactctctcagcttccatgcaacaaattgccgatctcattcatttgtccgttgaaatgccaaatattttactttgaaaatgctcaatttctagccaggccagaaaaaaatacacatctccggacgagctctccctccggctggttcaattccctcatttatttatttacttttttgaaaacttaacattttaaattatttgagaggcccttgacgtaccgtcaaaaaa

SEQ ID NO: 85019 - DNA, 2517 bp, Heterodera glycines
  Genomic contig location: Contig_ID=SeqID_20218; Location=79..2595; Strand=-
  SCN-specific regions: Sequence locations=1-883,905-931,953-1458,1489 -1526,1558-1637,1670-1999,2021-2123,2148-2150,2172-2178,2202-2517
atggctatggaattgacctcttccgtagcaacaccaacagcaggtcctcgtcactgccatcacaactccggcttgttgatgaacagcttgaggaccttggagacggcatgccatcatggtcgcccatattcggacggagacggcaatgacgatgacgacgaagaatatgtcaaaaacggtggagaatggcatgctgacgatggcggcaccaccggcatggcgacgacgacgaattccaacacagaagtgcagcatgatggtgaagaaaatgccagatttggcggcggttccggtgccaaaacggtatcgggaaatacccaaggagactatgatgatgcaggccatggccattgccatgccgacgatggtcaacaacttttgcatcgaccagtgccacgaaagcaggcatttttggccaatgcttccgaagtgccgccaccgttttccccatcggcggtagatgatggcaccgaactgctgtttgtacaccgcttggacgaacagttggccacccgacgcacttcggcacccgcgtgtttggacacggcaccacaatttgccagcggcagagcggaattgagatatttgtccatagtctatgatctcgagtctcgagttaataaaatttcacactattttgcaacgattagagggatgtaataaatgctaacccgacttcggcattttgtctaagatttcgaatttacatacccttaaagacatcggaatcgatcaatctatccaagaaattgatcagaatttgatgggctcgcgacaatttgggctttttgtgttgttgatcagttccaggactcggagttgtcctgagaattttaaaatctctctttttttactgatcaggcaaaaagatttttatgacactaaaaaatagaaaaacacaaattcagttttctccaattgattcgaccacctttgccaccaccacccccggtgaagtgaactgcttgaaaaagttggaaacgcatttgtatctgtgccagcaattgatggacagaaagctgctgtacgcattgccaaacaataacaacaatttgaacaagcctaacacttctgctgtcagctgtagcagcatgtatttgccgaaaaactgtgtgtccagctcgtccagcccggactcgggtaggttcactcaacacaaaaaatggcaaaaaagataaaacaaatccagaaaccaatggttgagaataaattaatgccacaattccattagtgatagcctctaaaatctcgagttcgagaatttggtgggtgagagaggtgttttttcgggtctgtgataaaaaaggatcagtcagtgacagatcagcggcggtggggaatatttacttttggttcaatttactattttttggcttactctgatcattggtccgatcgactaagctaatccctgatcacaggacttggacacgagatgaataacagtagcaacatcttcaacaacaacaacaacaacaatagcaacaattgtgccgttgcagtcgtcggcggcgagccatcatcttcagccgctgcttcctcctcctcctgctgtggtctaagtggggtcatgggtaagttttattttatttttttgacggtacgtcaagggcctctcaaataatttaaaatgttaagttttcaaaaaagtaaataaataaatgagggaattgaaccagccggagggagagctcgtccggagatgtgtatttttttctggcctggctagaaattgagcattttcaaagtaaaatatttggcatttcaacggacaaatgaatgagatcggcaatttgttgcatggaagctgagagagtgggatgaaagtccgtccaaactggaaatcagcagaaaatgggggggggcggggaaatggcaattaaaaaacggggaagagggcgataatatagggatgccatctgaaaattttaaaaatcaaaacgactgcctcaaaaattaacacaattggactcatttggggggttcgaaatcaaggaaattattcaaaaaattgctttttgatcagttgggagagaaaacaagcaaacatttttgaacaggataaatcattttaaaaaaaattataacccattctggacttttgatgcaagaaaaagcaacaacaattttcccattttaaatttaattttaacagcagcagcagcttcttccccaccctcatcttcatctgcatcatcattaagcagcaaagtgtcgacatcaattcaaaaatgtggccatctgtcaacattgttgcattcgggcaacagtttttgtggcacttctgctaccgcttcttcttcctccgttggtgccggatttgatggcacttccggtgccgttccttcagcactgttgtcttcctggctttcattgcttcatgcccggcggcttcagtgtccttcctccgcctcttccaatgccgtcgtttcttcgtcagcttctctgcccgcttcgtccgcttgttcttctcttttcccgtctgctgctgctgcgtctgctgcgctgcttcataac

SEQ ID NO: 85020 - DNA, 2588 bp, Heterodera glycines
  Genomic contig location: Contig_ID=SeqID_20221; Location=26..2613; Strand=-
  SCN-specific regions: Sequence locations=1-1683,1705-2588
atgacaaggtgtacactaagcaaatagttttactaacccaaatctgaggttagttaggaaataagtttcgtacactttggcacgtataaagcccctatgcatttaagaagtctttacagttgacttaaacttaatatgtacttaaacttattttttaaatattacaaaattcaatcgagtcaattgtaaagatttctgtccttatacccttttgagaatcacatttttatttgttttcaaatcttatcggtctgctttgcgaccatgatgagatttgtgcacgtgccggtctgctttgcgaccatggcaacatatcggtctgcttagcgaccatgatatgtagtgcacacgccggtctgctttgcgaccatggcgaggctggtctgctttgcgaccatagccaaccgtgtcggtctgttttgcgaccatgacacagtgccggtctgcttcgcgaccatggcacacatatcggtctgcttagcgaccatgatatgtatttaagcgcagacttgcactcgccttagcgatgcatgtggctgggctgcccaatgggagcgcctttttctggccttgtatcccagctgaatgtttgtgaaaaggattgtcctttgattaattagcaatgctaattgttcgaaggtcacattttgtaaacaggaggttggctacggtgggattgtcctccgatcaacagcaaagcgtctgtcgttaggagttccctgcccctggctattcagagaatggaacaaacaaaggacaatatatgtggttcgctgactggccttcggggcatgtgtcgcaccaaagcggttcgctgactggctcttcggggcatgtgtcgcaccaaagcggttcgctgactggctcttcggggcattgtctcaccaatgtggttcgcagacaggcccttcggggcatagtcgcaccaatgtggttcgcagacaggcccttcggggcatagtcgcaccaatgtggttcgcagacaggcccttcggggcattgtcgcaccaatgtggttcgcagacagacccttcggggcattgtcgcaccaatgtggttcgcagacagaccctacgggcattgtcgcaccaatgtggttcgcagacaggcccttcggagcattgtcgcaccaatgtggttcgcagacaggcccttcgtggcatgagtcgcacctaagcggttcgctgacatcccttcgtggaacgtgtcgcaccaacttttggatctgcattcttaatgggatgtgtgagccctggctgatggatttcagcacaggacgactacacttcacggcgaagaatgatgtctttgatctttatttgtgcatttttgttaataaagttttaacgtctgtgtgcatttattggttaattacctcatatttttgccacacttgcgatacttttctgatttgttgtttcagatgccttctaagcaacgaaatttgcgaaaaaatgagacaagagcgtcatcagcggcggacggagcaatctgtcagtccaggtcgctcacccgtcccagacgggagtgcagatgggaatggagaggtatcggcatctctccggggcaccaccaccccaagcttaagtgctttgcaaataagcacgccggcgtcttccatcggaagtaaaaaaagaggcaggccctcgaaagccggagcgaagccaatcttggctacgcaagaaagtgtgtctctcattgacacacctcgaactgcggtcactcaaagtgaccagggttcgccgtgcaaaaaaaggggaaaggtcgccgagtgtggccaacccatgtttgccaatgaagctattgctttgacgcctgtttcgactcaaagtcgtggagggcgtcctgccaaaaaaattagaggcccaggccgaggcagactcactgattccatgagcaaaagctctgaaatggatatcaatcttgtaaatgccccaattccggcaacctcggacactgtgcctgaaaaaataaatttcagcacagtgcaaattaatttcgcaaccacgcggaattttgcctgtaaaatttggaaatgggcagcaattggcctttacgaacgtgatggcgaaacatcgcttgccccgagctctggcccaagatacattgagacctgttggaatgatctgactcagtttctcaatgacggttttgctgccacatatttagcatatttggctagcatttcacaacgaaaagtggtcgttgttgacccaatggtatggagaaatggcttggacagagtcatgccttacaaaaatatgacatttgggtacaaccctaatgttccggcagaagtcatacttttgccagtgcatttccctggacattggactctaattgtccatgatgttcagtggggtactcattttgccgattctttgcctaccccctatggcaggttggattggcaactgacggataaaattggaaagatcatttctgacattttgccgtcagcagtgttgaccgggatttttaatgcggtaaatcttacggtacaacatgatggaaatagctgcgggtactttgtgtgcctgtatgctgaatcctggcttatgaacaattgcacttttgttctgccgtga

SEQ ID NO: 85021 - DNA, 454 bp, Heterodera glycines
  Genomic contig location: Contig_ID=SeqID_20222; Location=165..618; Strand=+
  SCN-specific regions: Sequence locations=1-454
atgcttgaagcacgcaaaattttgaatttgttagtaattttgcaactctttttgggcataaatgtgctgcttttatcgtcgatttgctccactgaaatagtcaaaccaacagctgaaggtatttaaaatgcttttttctttttggtaaatataaaaaacaatttcttcggcacataaaaaagcttttaaaaataaatttcttcggcacaaaattctttcaaaataaagttttatttattgaaagttttcagagagtttagtgtgcttcggtagcacaatggtagtggtgctgccatgctgcccacggattgggcggacgagtgggttcgagtcgcacccgagccctaacaattttgcgcatttcttatcttacatttttaggttctaaaaactgccaaaattgttagtttttaggttctgaaaaactccaaaataggtgctaaaaatgaaaaaa

SEQ ID NO: 85022 - DNA, 306 bp, Heterodera glycines
  Genomic contig location: Contig_ID=SeqID_20222; Location=901..1206; Strand=+
  SCN-specific regions: Sequence locations=1-306
atgccatttttgaacccaaaaaccaacatcgtcggcgttggcgccgtaaacaatccaagaatcttggcagcaaatcggtgaggagcaaatcgtttcgatccaagtcaggccgacgtgtgtatgaggaaatgatgccagagaaagttgaaaaggaggcgaagaaaacaacaatgcaaaagtcagtttggcattttgtttatgtttttttttaattggcaaaaattcccaaatttcagaatcaaacaaaaatttaaacaaaaatttgtgccaacaacacggcagacattcgacagttccagcagtaca

SEQ ID NO: 85023 - DNA, 972 bp, Heterodera glycines
  Genomic contig location: Contig_ID=SeqID_20223; Location=648..1619; Strand=+
  SCN-specific regions: Sequence locations=1-55,77-79,143-369,391 -647,669-758,780-858,968-972
atgcaaaatgatttttcggaaaggatcagaaaaatggaagaacaacatcgggaagagaaggacaaaaatggtgggcaacaaaatatgaaaaattataaaaatatatttttatttgtaaatttaaaaaagttttttaaattatgtcataagtcacattttggaacggatcagcaccctggcgatatggaaattatcagtgaccagcaaaaggaacagcagcaacaaattgatcagttgagcatcgccattcaggaaaaatgtgccaaaattgccacgactgagaatttttatggtggaaaaatttggcacaatgccacaattaaaaacaaaaaattaaagagatggaaatagacacgagacaacgcatcggaaaaatttatgaaaaattttctttgttggacaattttgttggcctattttgtcgcagttccatgcgatttaagtcagtggacggtttattcccaaaggtatttgacatttcagtcccgggtctgcaactctttagggattggttgccgcaaaaaattctttggattctttcattacagaccaaaaggtaccaattatatatatattggctttttcggctccggacagaccacgggactaaatattcaaatacctagacgcatatttacctttaaaacattaaatttttaattgagttcgccaacaaagatatatttatttatccatcgtttgccctaattacttttcttatgagtaaccatttaattcttgaaatcactctcgttggcaaaaaatttctatttaattctgaattatttcaaaaaatttcattattataacaatgaaatagccaaaaaaattcgatgataatcaacaaagtatatttggtttataatttattaaaaagaataacaaacattctaaaattaatttaaaaaacacaaattttttttctcattttattttcaattttctgattaaattatttaaaaattatgcgaa

SEQ ID NO: 85024 - DNA, 1371 bp, Heterodera glycines
  Genomic contig location: Contig_ID=SeqID_20224; Location=115..1485; Strand=-
  SCN-specific regions: Sequence locations=1-1084,1111-1371
atggccgctgtcgactacatcttcatggccaacatcgaccagctgcccgtcaccgcggatgaagtcgccgagcacactcaattggacactacgcttaggaaagttttcgatttttgccgtaatggctggcccaagaagtcgcctactgatttatctgcctttttcactcataggcacaaactttccgaagtgaatggttgcctccttttcggtgaacgcgtcgtcattccggcagccttgcgtcagcgaattttgtccgcccttcatttcacacatcctggaatcgtgcgcatgagggcattggcacaacaacatgtctactggccccgcatggaccttgaccttgaacgttgggttcgccactgcgttgattgcgcgatggcagcaaaagcaccaccaaaaacgacactctctccatggcctcgaacaaataaagtctatgagcgcattcacatggactttgcaggtccatgttctgatggcaatctctatcttatcatcgtggacgcattcagtaaatggcccgagacttttcaagtgaaaagcacttctgcggacaatgtcatcgttcaactcgagtggctctattcgcgatacgggtttccacgtgaaatcgttaccgacaatgggccaccctttcattcaaaagatttttctcatttttgcaggattaaaggtatcaagcaaagatttagtccgacgaatcacccacagagcaatgggcaagccgagcgttttgttgacatttttaaaaggcaaatgaaaaagtgttcacacggagacaaaaagtggatcaccaattccctgttcgcctaccgcaacacaccaaatgccgcactgaaaggtcaaacaccagctgaactttttcttggccgctctcctcgaacacaacggtcactgctcaagcctgacatttcttgctcaaatcgcaatcaaaatgactacacaaacaacatgtcgaagcaattcgatcgcaaacatggtgctcgccaccgaacatttgcaattggtgacgatgtgctcatcatcaactaccgtaacaacaaaaagtcttggctacagggtaaagttgtctcaggttctggtgttatttgggaaattaaagtccccgtccttggtaacgtcattgtgcgtaggcacactaaccaaatgcgtaatttttttccaattccccaaaaaagtcaaaatggaaatggacccggcacacagcatggttctcctggtcttgttcaaaagcgccacgtacgtttcgctgatgaagtggatcaaaatggtaccattgctcgagaccaacaacaacaaatcgccgatgtcgccgacaaacaattcgaagttcgacgttcagaacgtcatcggcgtccaacaaagtaa

SEQ ID NO: 85025 - DNA, 765 bp, Heterodera glycines
  Genomic contig location: Contig_ID=SeqID_20225; Location=478..1242; Strand=-
  SCN-specific regions: Sequence locations=1-174,200-395,418-765
atggctcgaccgttttggcccgttcttcaggtggatggcaaggaccttccagacgcaatgcaagtgcgactgctgcttggaaagctcggtcaggaggagtacgctcgtcatacagaacgtgtacttccaagactgccgaccgacttcacattggcacagacaattgataagctcaaaattttgtttggggaaaccaaaagcattttcactcgtcgatatgagtgttttcagttagctaaatcaattttccagtcaccattagattttgctagccaagtgaatgccatgtgtgaacgttcgaaaatggacttgacaaaagatgaaatcaaggccctcattttcctcactggcctctcagatgaagacagagaacttagggaacgctgttttcggattttggaggaagccaaaaagaaaacaccgccggaaatgatcacttttgagaagcttactgaagagtgccgtgcgtttttgtcattgcgcaacacatctcaatctttggcaactgtttctggaacaaacgccatcactctcaagtcgcagaaattgaaggaacagcagctcaaaaagcgcagcatatcgcagcgcccatcggcgaaggcacaaagcaacaaaaatcgcagcccttccccttttcagcgccaaccaaagccgccatcaccgtgcaggttttgtggtcaaatgcattgggtgcgtgattgttcacgggcgccaacttgctcaaagtgcaaccgccgtggtcactaccgctccgaatgccgctaa

SEQ ID NO: 85026 - DNA, 462 bp, Heterodera glycines
  Genomic contig location: Contig_ID=SeqID_20226; Location=144..605; Strand=+
  SCN-specific regions: Sequence locations=1-114,136-462
atgtccaagaaaaatttccaagaaatttcaaaagacgtaaggcgctcgagaaatacccgtaattatttccggaagagcccagacttgggcaagtattacgaagaggtggaaaaacatgtgaaggaaaacaaaaaatttgggattaaagaatatgtccgcacgttttattttaaatgtccaccaaatgaggatcccgaaaacaattttaaaaaaatcctcaaaaaattgatgtccgaagcaataagccaagaagccgagccaggatggaaaatttcgaaaatttctgtcgatctgtactgcagtgccctgtcggaccccgtgatcattccggctcgccccttccaacaatcaaacccagacattgttttcaacgagttcatgcaccgacaacaatcatttggagagctgaatctattggaagagagaatttcgattaattgctacatatgcttttcctgaaaa

SEQ ID NO: 85027 - DNA, 677 bp, Heterodera glycines
  Genomic contig location: Contig_ID=SeqID_20226; Location=698..1374; Strand=+
  SCN-specific regions: Sequence locations=1-469,493-609,652-677
atgtactcgttcaaaaaatattttgaaactgctcttgagaaggaagactttttctggcctaagaacagagctgaggttgaagcgatgttgattgaatcatcccaatataaagtggccatacaccgggattatgaaagcccgttttccggctacatagaaatgcacgaacacacgtctgcgttttgttttaccatggttgagcgagatatgcgaattttttatgactcaggggcgggtactcctatgggtagatacacgttggtactacacggcatcgtacaggggaactatttgggaaatgattcgggattgggactccctatttttttcttctggttttactgggagggaaggagccagacaaaccgcaacggtttttttaggagtcgtctttttctggcaaaggtccaaatgctaaaggtcatggcattagcttggggaaaagaactgttgacttccccaattgaagtaaactaaatgttttctttaatcgtatggacaggtctttaacgattaaaaatctatatgtcattattattacagagaattgcttggctcttggtcgttgctctatcgggtccctccaagtctctttgatatttctcgtcgaattgttgcagaaaaaatgatggaagaatttttaaaactgccatcacactttcgaattgctttttata

SEQ ID NO: 85028 - DNA, 214 bp, Heterodera glycines
  Genomic contig location: Contig_ID=SeqID_3523; Location=900..1113; Strand=-
  SCN-specific regions: Sequence locations=1-214
gtgattttgtgcccttgtaaccaaaactattcgaatttgcgagtttcatcttttttcatgtgttagagacatgaaaatagtacgccaaaacgagagggagttgacccatagtgctggcattgcgctgtgtcaatgtgtatataagcaagcgctgtaagcaaaagaaatcatttggcttcactttcttttttcctctttttttctctttttttaa

SEQ ID NO: 85029 - DNA, 354 bp, Heterodera glycines
  Genomic contig location: Contig_ID=SeqID_3524; Location=169..522; Strand=-
  SCN-specific regions: Sequence locations=1-200,226-354
atggccgaattaaccaagagattggatgggccgatgtgggcaagaaaaatgttggcccgcgcgaaaatgggtcatgagtcggtgaccgaatttgcaaataaaattcgggattgggtggagcaagcgtctcctgatcccgattatacaaacgatgcacgcgagaatgaaaccgtacactactttctcaatggtcttcccacaaatttaaaaagaaaattattttttatgcaaaaaccaaagactttagtggaagcaatttcccagacaaaaaaggtactccaattgaaagaagaaattgaaaatgacgaaaagggagaagagtttaagcaacaaattgcagaattaaaggaacaa

SEQ ID NO: 85030 - DNA, 3741 bp, Heterodera glycines
  Genomic contig location: Contig_ID=SeqID_3524; Location=2405..6145; Strand=+
  SCN-specific regions: Sequence locations=1-8,30-368,391-491,513 -608,638-860,882-1064,1144-1517,1539-1559,1581-1658,1680-1895,1917 -1964,2002-2547,2569-2877,2899-3012,3035-3274,3296-3459,3481 -3712,3734-3741
agtgaacccaaatatttttgaaaattatctttccattagtgagggaaatgccctcattcttctcggcctttctctcaccattggcatccttttggggctttgtttctgctttttgttgctgatcggcttctcggattgtcttttccgtcgccgatcactccgacaacacaaaaacgttcgcaacaccgaacattccatcgactcaaatcggcactcaaatgctcggcttaatccctctcttccatctcgtcctttgttcattagggcgactggcactcctgtttgagtgagtctcttacccctttggctcactcatcgagtcattccgtcaacatctttatctggccattcattcactttagtggccattggttcatgtctctgctgttgtgtgcgctttaccgtttaaagatgattttatctccttttattttgttctcattttaaaatttcgatcaatatttgggcaaatattttccgcatttattttcgatgaattttgtcaaaatccaaattatttgcccttcaatcatactatgatgatttccactatttattaatattcatgaatacactataatcaataccgtatattttaaatctatccgttttattataaaataattttatttattttccattttattaactaagtgttcacggcaataatgaatattttcctctccctttcccgtggcgggacctccatgattatggtgaagtgatgtattatccctaattggcgaataatagaataatgatctttattgcgtaaggacaaagaaatacatcattgtgattccccaactcgtaacgggaaaggggaggttggtcgggatccggatccgacaaaagtgggaaggggagttcaaagggaagagtttatataagcggagtcataaggggcggggagagtacaaagggaccgcccccgtaaagcaaaaatgtggaaaagcaggaggggccaaactaactaaagagtaacaattggtcatcgggggccccaaaaattgaccgtctcggtcaaaacacaaaatcaattaagctaagaaaggagatgatggtttaatattttttgattaataaaattgttttattattattattattattttttttttttttttaaatattaaatattaaccatcatcactattctatggtcggtatttattcgaatcatctttaaattgatctttggtcaacggttaaatgcgccacttgttgatggttctgattgtgaatgatcatttctggcccatccttcattcccgcgccagttgtggtggtatgggcgctgtcgcccgcgtccacggctgttgttgacccatctgccgaccgtcccacgattacggtagcggaactcgtcatgttgtcgccaagtcgacgtatttgtgttggcaaatcggttcgaattcggatgaaattcttccgctttttccatttctttttttgcgattttcgtcagttcatccatttctttggctaattcctttaatcctccaaaagcctctgtcatttgttgttgaatttggtttattttttggcaaatgctgttctcaattttcttcattttctcctcttttgtattttgtgctgtttcctcccaaacacaattggcaaactgcccttgagttgccggtgtttttgctgcgaagcgttttctccaactcttcttctgtttcttttgcctccaattcgttccggactggaatttgtttcctcattccttcaggttgaatgatctctgactgcaaaatgctcttttccgcacttcttatgcaattctcggccatacgtcggccgttaaatccaagtccgacttttccaatgacgcttaatcgatcttcctttcttatgtccagggttgtcgttgttgaaacgaaatcactccaccctctgtctcgctcttctctcgttagcaagcggcgggtccaaacgtgctctttttgactcttggggtgcttcttcttcttcctcctcttcttcttcgtcttcctcgtccatatccaggacaatttcatctactggcctttgctcattattctcacttctctttttctccgcctccgccttccttttttctgtttcttccaatcggtgctttaaatcctcaatttcattcaaaagtcgcactttttcggcgatcaatccctcttcattgaatggctcttccgctggagcttttggcgcatccattgtctcgctgctaaaactttttgttataaaatccatgtttttatgacattcattagattttttgtcattaatttttaattcgtttttgttctctgatttttctcctttttcattattaatttcttcatttaaatcgaatatactcatgaacaaatctttttcagtaataacatttatgctctgtttttgcattaaatccccattttgatcactgtcccttttattttcaattttgctttcattacgggagattaatatttcgggaattctttgaagttctaaaatttggccgttaaattctccaactttttcccaatacgtctcattttccccattggttttcgaagtccactcatcattaattagaaattgttcacgaattcccaacaaaattttatcagcttcattgttcaaagacaattcaaattctgtcccaaaaagccacgcatttaaatatttttttccaaattcgtttgtgagtactttccaatgttcttttatgaaatttgttgggattgacgaattcaaaggaatcaaatttggttctggccagctcgtgtatgccaattttacttcaccctccaaaaatatttcggtaattgtacatggtaataaattttcgttaattacttcattttcttccaaaatttcgtgttcatcattttgatcactatcttccctctccttcagaaatgaaattttgggttgaggttattcgaatggaccctaagcaagtacaggcagtccaaaattttagaccaccgaaaagcctaacggaattaaaatcgttgctcggtgcacttacctattttcgaagattattaaaaattttgcccatatagcaaggccactccaaactttaacacaagacaaatttgagggaaaaatcgaagaaaattggggaaatgaacaagaagaggctctggaaacacttaagaaaatgttgacttctgccccggttttacaatccccaagatttggtaaaccgttcataattgagtgcgacgcgtccaaaaaagcaattggagcggtattactccaaacaaatggcccagtcgcatatgcttcgcgcgctttaaacagacatgaaacaaattacccgtcaatcgaaagagaagcattagccttagtgtatgcggtcaaagaattttcgccttatattgttggttcaggcgtaactaaaaccattacggattgtagcgcactgacgagcatgatgaaagccaaagaattaaaagtgcgactagagaaataccagatcactctccaaagttttgaccttgagatcgtttaccgccccggcagcaaaaacaaggcggccgattttctttcacgttataatataccaggcaatgagtccgaagacacaaacaaaaagggtaaaaaagaaaacaaaataaaaatttcaagtacagaaaataaacccaatagtgataaaatagtacaagaaaccgacaaacggacgaaagtagaatttctttaatgccaataattgatgctcaacgtaaagtcaaagaatagtaaaaatattttatatcctga

SEQ ID NO: 85031 - DNA, 998 bp, Heterodera glycines
  Genomic contig location: Contig_ID=SeqID_3524; Location=3606..4603; Strand=-
  SCN-specific regions: Sequence locations=1-198,236-283,305-520,542 -619,641-661,683-998
atggatgcgccaaaagctccagcggaagagccattcaatgaagagggattgatcgccgaaaaagtgcgacttttgaatgaaattgaggatttaaagcaccgattggaagaaacagaaaaaaggaaggcggaggcggagaaaaagagaagtgagaataatgagcaaaggccagtagatgaaattgtcctggatatggacgaggaagacgaagaagaagaggaggaagaagaagaagcaccccaagagtcaaaaagagcacgtttggacccgccgcttgctaacgagagaagagcgagacagagggtggagtgatttcgtttcaacaacgacaaccctggacataagaaaggaagatcgattaagcgtcattggaaaagtcggacttggatttaacggccgacgtatggccgagaattgcataagaagtgcggaaaagagcattttgcagtcagagatcattcaacctgaaggaatgaggaaacaaattccagtccggaacgaattggaggcaaaagaaacagaagaagagttggagaaaacgcttcgcagcaaaaacaccggcaactcaagggcagtttgccaattgtgtttgggaggaaacagcacaaaatacaaaagaggagaaaatgaagaaaattgagaacagcatttgccaaaaaataaaccaaattcaacaacaaatgacagaggcttttggaggattaaaggaattagccaaagaaatggatgaactgacgaaaatcgcaaaaaaagaaatggaaaaagcggaagaatttcatccgaattcgaaccgatttgccaacacaaatacgtcgacttggcgacaacatgacgagttccgctaccgtaatcgtgggacggtcggcagatgggtcaacaacagccgtggacgcgggcgacagcgcccataccaccacaactggcgcgggaatgaaggatgggccagaaatgatcattcacaatcagaaccatcaacaagtggcgcatttaaccgttga

SEQ ID NO: 85032 - DNA, 1634 bp, Heterodera glycines
  misc_feature (1628)..(1628): n is a, c, g, or t
  Genomic contig location: Contig_ID=SeqID_20229; Location=216..1849; Strand=+
  SCN-specific regions: Sequence locations=1-194,216-310,340-576,598 -604,626-699,721-751,773-852,874-918,945-999,1021-1035,1057-1269,1300- 1300,1322-1492,1514-1634
atgaataaaatcgatgaaatagcacttattttagaaaccgaaaaaatagacattcttttaattaccgagacttggaccaaagacggggaagaaatcaatttttgcccttgggtaaaagagaattacaactatattttttcatcaaggaaatcgaaaactagtggaggtggttgtggtattctaatcagtcggattcaaaatttaattctgaaattttagttattcaacttcaaaatttacaatgcatcagatttgttttggtgtatagaccacccaaaacaacactcaagcaaacagaaaatttgttcaaatttttgcaaaaattttttaatgaaaattcagtgactttaggagattttaatttaccgaataaggatttggtatggaaaaatgggcatccctattcaatgagtaaatatggtgaaatattttgtgactttttcaatagattttcttacgttttggccacgaatgagccaacacggattaattcctggctagatttgatttttacggccaatgaaaaaattattactgattgtactgttaaaggaggcatattttcatcggatcatttaacacaattttttacattaattactcctaaaacaaaactgaaaacaaagatcgtaaactttcgttggttttgtccatcgaatgtgttacattttaatatagtcatagcatcaaggctaaatgccttgtcatatgaatgctttagcataaatcaaaaatattccgcctttaacagtatgttgttagaaattttaaatgagtgtattccaataaagcgtttaaccaagaatgatttgactcctaaatacccacaacatttattagcatccatcaaagaaaaggctaaattattcaggcaagctaaaactgacccatccaaaaaagcactatacgatagcatttctttacatataaaaatacaaacaaataaataccatagccaaattgagaaaaaggctatttcaaagggaagaaattcaatttataaatatatacaaaaattcaatgtcaatccctctgaaatacctaatctaatttatgaaaataaatgctatcataacagtgctgagaaatctgaattatttgccaccttatttgccaattcatttaataatagtgaaaccgacccaagcaatccatgcttgggtaatattatagaaattgatcaatgctttatatcggatataaattttaacatcatcgagacccaaaatcttttgaaaaaacttccgaataaaaatggcacttctcccgataatattagttataaaattttaaaaatttgccattcttctctgtcaactgttattactgacttgtttaggatctcattagacactggttcacttccagacatctggaaggaatcaattgtttttccgctttttaagaagggtgacaaaaataatcccgaaaactataggccaatttcattaacctgctcactctgcagggtaatggaaagaattttaagcaaaaatatttacaattttctattaaaaaccaaaaaaatttcggaatttcaatttggttttgttagaaataggtctacaacgagtcaactaataacagttgtggaagataagtacgaggcaataataaatggaaaaaanagttga

SEQ ID NO: 85033 - DNA, 1439 bp, Heterodera glycines
  misc_feature (725)..(725): n is a, c, g, or t
  Genomic contig location: Contig_ID=SeqID_20230; Location=1..1439; Strand=+
  SCN-specific regions: Sequence locations=1-82,105-359,383-392,414 -777,802-1439
tttctctctgtggtaaagtgtttcgagattggttttccccccccgagctacaaaatgttgggcatttgttcaacttcttcaattcagtttttctccactttaatcgtccttctgtacacacattacacacgcgcaaagcttcgcctgcggcaacggctgattggccacggcggcggcgcaggcgccgcggggcattcgtcgacactaatgaaggcgcacctccacgaagtgattagtcataaaagtaattaatgacccctctctcctcaatttagttgggtctctacaacatttccatccccgtcactttggtcgctgccattctgctgggctatatgagcatagggtaataagcaaaattgctttttatttttataattttcgattaatcggggttttaaaaaataagaggggaggtaattagctcgagaattaatgtgtcgagaagcgaaacgcacccttaagctaaacattgttttgattttcaataatttgatctgtttttcttttaaagtgccgtccttttggccaagtgggaacgatggcctttgtaagtgaccacttttctgtcgattattaaaaacgggttaagccaattaaaattcgacgtcccaaaaaaggttcgacggcttttactactcattcattacgatgacaaccgtcggatttggcgacattgtgccggccaaacacgagttctttttgttcgatttattctacataantcgttggttggtaaatgaacggtggcacattttggcaaaagtggcgccgcttttcctttccagggttggccatcaccacaatgtgcatcgacttagttggcattgaatacatcgaaaaggtgaccactccgttttttgctaatagcccaatttggtcgggtcgagcaatggcacatcgagagtctcgggaaaagtactcaaagcattggaagaaattaaatggaagcttttgcgggccagcgaaaaacattgggccataatttctcttttggcattttcaaaccaaatgctgcgtttgcttaagattcactattttggccgtgccatttcgggcgctcgcttcgcccttgtcaatgtgggcggaagaatggtacgagtgcccgacttggtgcgctgtgcgcatgttctgcaccaaaagtatgggcaacgaaagccgacacgacaacggcgcaaacgaacggtttcggcatcgtcaacgcaaaacctttttatggcatggaaaggagcgtaagttagcgccaattgggggcggagtaattagggataattttatgctaatgatccttctttctaaaaacatattgaatttggtcagatacgcgcccaaagatttgccgtacattcgcttcatcgatttcggctctttggcaagcttcgagtcgatctcgatctcaagcctcttttctgcaatttttacgagtggtggtcagaagt

SEQ ID NO: 85034 - DNA, 303 bp, Heterodera glycines
  Genomic contig location: Contig_ID=SeqID_20231; Location=428..730; Strand=-
  SCN-specific regions: Sequence locations=1-45,67-69,93-303
gcaagtactcgaataaaatcaaaatttttatgtacaatttctccaattttacaaaaggccatttttggaatgaaaatgatcttttttccttcttcctcgtcgtctttaaatatgccgctccttaatcgcagcagggggtttgaagcagcgtgcatatcaacaacgagatagccatagggtttattagtcgcaatacgataggcagaaaggaaataatccagttttcccggaaaaagttgcactccaatgttacgaatcgccagtgcggaatttggagctcgcattaacaccaaatattgggca

SEQ ID NO: 85035 - DNA, 766 bp, Heterodera glycines
  Genomic contig location: Contig_ID=SeqID_20232; Location=147..912; Strand=-
  SCN-specific regions: Sequence locations=1-134,156-368,390-518,540 -591,613-709,731-766
atgacaagcttgtatatcgcattgaaaatcaaggacattggcaatgcttcttcttccaatccatcgaattctgagccattggcacaaattgtcaattggaattgggacaaaaatggggcacaacaaatcattcaagtaataaaatataaagaaatgatcagataaaaaatgaattaatcaattaaattgtttagacaaatacactcaacaagggcagtgagcttaattaccgcagcaataatgattcatcatttgtaatccgaattctcaaaaagcgcgagaaaaagtccgatgaaaaaaagtaggtaaatgtgatattcccgattttatcagtaaaaatgctcgtctaattgctctctattagcatgaaaaattaggttggaaaaaagatccgaggttgatcactaattgatttggcttccgtttttttcccatttttttaagtgcgttcccggcaccttccagcagctcacccgacgacgatttgaccgtgaaaattggtgataagcaggtgaaaaacagaaagaacaacagcaacattaagcctaccctaaagcaacagatttttcatggaaaaaaacaattttttgatacaataaaaattttgaaaacaatttgtgcttgcctggtggctgtactttaaggcctgctgctaactaaatttaacttccgcaaaaattcgtccgaaaatgtccaggatttgtaattagaaaacgggggcgggggagggctcgactttataggcaggacgtactgatcaaataaa

SEQ ID NO: 85036 - DNA, 841 bp, Heterodera glycines
  Genomic contig location: Contig_ID=SeqID_20234; Location=593..1433; Strand=+
  SCN-specific regions: Sequence locations=1-110,165-299,322-361,383 -614,645-805,828-841
atgcaaattctgcaaaatgagattatgcggggaaaagtcgaaaagtttggccaagacaaattgctcatggaattggccaaaagttgggccgaatacaagcgccaaaacggaaaaaaatgtaattcattaatatttcaatttgaaaaattatttttaaaatttaagcgcatggaaaaggcaaaaataatgagaagggcagaaaaaatgaaaagcgaatccttcagctgttgtacaatttgttaaatgatggcaccaatggattagcatctgctgatctgaaaagtggtgcaaaaagtaaataaattaaatatttgatgggtgattttggatattcgtgatagaaaaatccggggattggcatcaaagtgaaaattgtaaggagttgttatttaaaattaaaaaccattaatttgaaaattttcgacgaaaaattatttataactttgcgcaaaagcaattaaatttttaaaagtttcaaaaaagttatggctagaagaaaacttaaaaaaaaccttgtttgtcgaacattttatgaaaaagcactactaaaaaatttacctaaaaaaatttgcaataaaaagcttgaatgtgaaaattttcgaatttttcctgacataaattttaattttttaaatttttttaatgacagatcgtcaacgcagaagaaaaggccgtggcattatcacggaaagacacattgtcatcttttgtgtgattggcatcatcatttgcattttcaatatttcactattttgttattgccaatgtttcgaccatcgatcagccgccgatgacatagaagcaacagatagtcaaaccacagtcgaaaccgatcaccaag

SEQ ID NO: 85037 - DNA, 1891 bp, Heterodera glycines
  Genomic contig location: Contig_ID=SeqID_20235; Location=210..2100; Strand=-
  SCN-specific regions: Sequence locations=1-150,187-397,420-886,913 -916,955-1013,1037-1674,1696-1891
  Gene Ontology: Mol. function=sodium/potassium-exchanging ATPase activity; Cellular component=sodium/potassium-exchanging ATPase complex; Biological process=transport
atggtaccgacggaacagattgacacatttttaattaaggatgtggagatgacccaccaaatgcgcgaagacttcgaacgtgcctatttggagttgggcggaatgggcgaaagagtgctcgggttttgcgactttcgcttggaccacgacaaatttcccaaggtttttggagtcttaaggttctcccattgctttttatgttttttagggatttgagttcgatgttgaaggccccaactttccgatcgaagggttccgttttgtcggtttgatttcaatgattgacccgcctcgtgctgctgttccggacgccgttgcgaagtgccgtagtgcaggcatcaaagtggtgatggtcaccggggatcatccgatcacggccaaagcaattgccaaatcggtgggcatcatttcggagggcatggaaactgtcgaagatatcgccgttcggaaagaaatttctgtggaccaagtcgacccgaggtcggtgttaacggaaaacggtttgagattcgaaattcagagaagccaaggcgattgtaatccatgggagtgatttgcgcgagatgtaaataattgacccataattacaattcttccttttttgttttttaggaatgaggaccaattggccgaagtcatcagtaaccacgatgaaattgtgttcgccaggacttcgccacagcaaaaactgatgatcgtcgagggatttcagcgtcagggacaaattgtggcagtcaccggcgacggagtgaacgattcgccggcactgaaaaaggctgacatcggagtggcaatgggtgggcaaaaagtcggagagcgtaatgaaataaatttgttggaatttgtaggaattgccgggtcggacgtgtcaaaacaagcggcggatatgattcttctggacgacaactttgctgtgatttattattataattatttgtttgttattttttaattctttgaacattcagtcaattgtgaccggcgtggaggaaggccgtctcattttcgacaatttgaaaaaatccattgcttatacgttaacttctaacattccggaggtgtgtgttttttaggtttcctaaaaacttccattttaaagatctcaccgttcctgatgtacattctgttcgggattccgcttcctctcggtaccgtgaccattctttgcatcgatctcggcaccgacatggtcaaaataagcctttcacccctgatttgatttttcgatttttcaggtcccagcaattagtttggcttatgaagaggccgagtcggacatcatgaaacgcctgccacgtgatccggttcgagacaaattagtaaatgagcgtcttatttcattggcctacggacaaattgggatgattcaagcctcggctggtttctttacggtttgatgatcaaacttattgttagtttatataacccccaatatttcagtacttttggataatggctgacaacggttttcttccaaaggacctttaccaattgcgtgcgcaatgggattctcgtgggattaacaatctcgtggacagttacggacaagaatgggtgggttaagcacaaaccaacttttaccgataattttcaaaaataaaaaaattatagacttacatggaccgaaagattctcgaacacacttgtcaaaccgcttattttgtgtcaattggtagcgtttgtttgcttactttgagtttgttatttccctactccaagtgattgtgcaatgggctgatctgatcatttcgaagactcgtcggaattccattgtccagcaaggcatgtccaattgggtgttgaacatcggcttggtcttcgagactttgttggctgttttcctctgctactgtccgggtttggacaaaggtcttcgtatgtacggactgcg

SEQ ID NO: 85038 - DNA, 142 bp, Heterodera glycines
  Genomic contig location: Contig_ID=SeqID_20236; Location=403..544; Strand=-
  SCN-specific regions: Sequence locations=1-142
atggacacctttagaccatgtgcaattggagaagaagtcgagcacagtgcgagtgaatttgtactaattgacgggccattaaaaatgggactgattggaagagactcactcgtccggagaggaaacggccgtacccccgtgg

SEQ ID NO: 85039 - DNA, 86 bp, Heterodera glycines
  Genomic contig location: Contig_ID=SeqID_20239; Location=749..834; Strand=-
  SCN-specific regions: Sequence locations=1-55,77-86
aacattatggaatttttgattggtgtttctcgaaattaccagatggatgacaaagaattttatgaataaatttttgggatgttgaa

SEQ ID NO: 85040 - DNA, 825 bp, Heterodera glycines
  Genomic contig location: Contig_ID=SeqID_20240; Location=486..1310; Strand=+
  SCN-specific regions: Sequence locations=1-360,382-465,487-825
atgaatagcagtgaagaaacaacggaaaatgttgggatgggcggaaataaggacgaacggcagacaacttcaaaagatgagaccgacgaaagcagcagcgaaaatcaacggaatgaacaacgccaacgacaaatggacagcgaaaaggaggactcgaggtgagcatgggctggacaatgcaaaaacagtcaatgaaaaactgaaaccgaaacatcggaggggggggtgagacgaatttgaccaccgaaaactaaaactccatgctttgaaacccaagacgaattaacaaagaaggaattgggctaattgagcatatttgagggcaattaacgcaccaaatgtgtatttttccaattaacatttgttttcatttgtccaggttcgaatgcaatatttgcttggacatggctaaagatgcggtcagtttaccagcgacgatgccttttcactacgttttcatcaatacgttccatttttgccttaggtcgtttcgatgtgcggccatttgttctgctggccgtgccttttccaatggatggacacgcgtccctatcgccagctgtgccccgtgtgcaaatcggcgattagcaaagacaaggttttccatttttactgaatttatcggaatggacaaccaaataaaaaagccaattcacagtctcagtcacattccctctaaaattgcattttttgccaaggtgattccgctctatggtcgcggtggtggggacagcgacccgcgcgagaaaattccaccacggccgcaaggtcaacgcacagaggagacaaatcaggtggacaaaagacatttttaataaatacgca

SEQ ID NO: 85041 - DNA, 1330 bp, Heterodera glycines
  Genomic contig location: Contig_ID=SeqID_3525; Location=270..1599; Strand=-
  SCN-specific regions: Sequence locations=1-155,189-356,389-530,581 -612,634-1047,1070-1131,1153-1330
atgaacaagtggttggcacttgtgtaagtaattaattgggggtttttaatacatactaattaatcatagaatgaatgagtcaataaaattccctgtaaactttgatcagtaatcataaaaaacgatttcaaatgcttttcaattggtccaaatcgaaaaaattaaattaaataaatgaatttttaaatggtgtccaaatgggaaaccctgattagataattttgactttctgcattcttttttagtgtgttgatcgccctgatcagtgtgctggacagcgctgttctgcgacaacggctcttcgtcaaagcggaaaatgcaccgaaagcggagccaaaggaaaatccaggtaaatgataattaaaaaaactaattaatttttataattgaattagcaactgcggacgtggacgaccatggaaaattggacaaaatccaaggatcggatacgcaaaattgggacaaatgtgaaccgattgaaaacggcacaacaatcattagactggacaaaggctgtaaaaagtttgtacaaattttttattttggatattttaatttataaaaaattaaattaatattagtcatctgatctgttactcgagcaaattggccaaaaattttggaaattggaaagccaatggacggatgagagttgcaaaggtggacttgcaggaattgagcaagaaatgtgccgaaaatgatgggcctaatcagagcaacggcggatggcacggcttaatgattgccaaacaaagtgacgggcaattggaattccaatcatccctcaggcgagtgctttttcggtttaattacctattttttagttaaattaacattttagcgccaatttatccggcaaattgggcatggaattcttcagcgatgccgactttttggagctgaatttcgccaaaggtccaatctcataataatatttttttcattttgtattatttcgtacagtaaagtatgcgtgatactgtagatttagcgatttgcatttaggtaggtactatctacaattaaaaaagcatcgctgtgaattgacaaaaatatttgtttattttttcatctatcaaaagtaataaggacagctaaataaagtactctctctacctttgcacgctacagtatctgattttaaaaaatacagtactcgatgaattttccgcttccttttgcagctctgatgcagcaaaatgggccactttcagcagctaactttgacgaggcacttccgcttggcgcattcatcaaagattttgaagggatggcattgcgccttgtggcactggaacttaccaagggcattgcgacaaatgcacggtga

SEQ ID NO: 85042 - DNA, 906 bp, Heterodera glycines
  Genomic contig location: Contig_ID=SeqID_3526; Location=2090..2995; Strand=+
  SCN-specific regions: Sequence locations=1-703,725-906
atggtgtgccgtgtttcttcttctattggttgtctgtgccatcattctttggttcttttttggccatgtcaaaaaacgacgccctcacaaaaacgaaatgtaaataaattaatcaaaaatttcgaaaaaattctccctatttttccagctttatctgcggcgactgttggcttttggtgttcgattttcttgcgccttctcagctcggcctcgaaattgcgctggtcaaccgccgctttaactgcatcgtcgacgaacacttcaaaacacgcaaatggaaattgggcggaatgcaaatttcccacaaaattggagaaaatggcaccaaacaaatgcaaattgtaaattccgatggaaatccattgccaatcccgcaaaatccgttgcccaacaaaatcatcggattcagacgcattcaaattttgtagaaattgattaaattgggatttttcatctaattttctgcttttcagctacatcgatcaaaatgtcgtcacatttctccgccgttttcaccgttttttcgccttttcttcaatattcttggtcatcactgaaaatgtttgcgtttcggaatttgttttgctcaacatttggccgatgcttcgtcattcaatgcgtgcgatgtttttgaataccatcgcttttcgccgtttccgccaattggccccgtcattgctcaacgattgtccatctcttcacactgtcattttcaaagatgccattctcccggaatttccgcccgatgaaagtgccaatgcgacggatggtcaagcggtggtcaaatggctgttttcgccttgtccggacggtgtgctgccaaacgtgttgcatttccatgacttttcggttgcacaatggtcgtcaacgattgaacagtttaaagcggtgattatccatatttaa

SEQ ID NO: 85043 - DNA, 2487 bp, Heterodera glycines
  Genomic contig location: Contig_ID=SeqID_3528; Location=583..3069; Strand=-
  SCN-specific regions: Sequence locations=1-175,197-253,276-682,720 -764,795-840,876-972,1001-1432,1455-1595,1617-1818,1840-1994,2016 -2074,2097-2184,2206-2487
caaaaaaattaagaatagttttactttataggccaccaaacacttctgctagtctcactaaaaagattctgaacctcattggtaattatttagaagaaaattttatcattatgggagattttaacctaaatgcaaaagatataacctggaccagtggaacaccttttgctaaatcggaaaaaggaaacattttttgtgaattttttaataagtatggcttattccttatgacgaacggcccaactcgtggtagtgcttggcttgatctgattctctcttctaaacctgattttgttaataatgttttaattgaggatatttttagttctgatcatcttaccactaacttttcactatcttttcccagtaatagaactaaaacaaacacatttacagtacgcaattataattctactaaacttaatctactaaatttaaacttatcttcaattttaccctacaaattactacaaaaatttaccattgaagataagtttaatcatttttaccttctttttagagaatatgtagaattatacttgcctaaaatcactgtcggtcaaaaatccagaaagcctaactacccattgagtcttaaactgtcaattaaggaaaaagccagactttataaactacaaaaaataaaccgtgataaatataggcatttgtatgatagcatttcattacatataaaaattcaaataaataactttgttactaaaaatgaaaataattttctgaataaaggaaaaaatgctatctacaaatatataaataaatttacaaaaaattttgaacaaatccactctcttagttacgagaaccaaattatttttgatgattatttaaaagcagaaacttttgcaaaaattttccaagaatccttttcaaattcagatgttccacaaattagcagttgtccttccaatcccaatggaccttctatttctgatgttgaatttaatgccgatgaaatttctaaaattttaaaaaatttaccgaatcgagaatccacatcccccgatgaaatttcctttaaaatcttacgtaattgccaccttactctttctcctgtaatttccgaacttttcagaatatcaatggacacaggcaaaattcctgaaatttggaaaaaatctattgttatacctctctttaaaaaaggtgaccgaaatgatccacataattacagacccatttctcttacttgctgtctatgtagagttatggaaaaaataattgcaaaaagcatttataacttccttcatctgaataatttaatatccgaacatcagttcggttttgttaaacaccgatctactaatactcaactaattacagtattagaagattggtacgacagcatatacggtaagaagaaaaatattgactgtatctatgtggactttcggaaagcttttgattcccttcctattaatattttaataaataaacttcataacattggcattaggggaaaactgctaagttggttatctgaatttttaaaggacagattttacacagttaaaattaacaacaaattttctaatttatatccgattcagtctggtgttccacaggggtctgttcttggcccctctgttatttttaatatacattaatgacctcccgcaggtaatccctccgggagttagcatcaagctttttgctgatgatgtcaaaatttatgtttcttacaaaactcgtgatgaaagaagcaaattaaatgttgctttagacaatattggaaaatgggctaatgcatttggtttaaacatctcccaaaataaaacatttatattatttctcggcaaaaataattcaaaacaacaatataaatttttcaacaatattattaatgaggttgaatctattagtgatttaggcattttaattgataataaattaagattttcaaatcattatactaaaattattaaagctgcttatttaaggattcgcaatattgccaaaattttaaaaacccgctctatacgtatttggaccaaagtattcaagacatacattcgtcctcttttagaatatgcgcccgaaatttggaatccgacatacaaaaaagatataaataaattggaaagatgccaaaaatattttacaaaaattgctttatttaaatgtaggcttccgtatataccttacgaacaaagacttgatttattcaaacttcaaactttagaagaaaggagaaaaacaattgatttagttcaggcattcaaaatcatcaatggtctcactcatcttaaaaaagacatattcccccaattttctggtcacatcccttacaatcttagacgtaaagttgtgttaaaaccacaatccagtaaaacttcaaattcttttatcaacagaacggccttaatatggtctaaactcaacaaagatataacagatgctccatctgttgacagtttcaaaaaacgaataaataaatggattgagttaaacaaaaatttagtctgtaaa

SEQ ID NO: 85044 - DNA, 605 bp, Heterodera glycines
  Genomic contig location: Contig_ID=SeqID_20242; Location=223..827; Strand=+
  SCN-specific regions: Sequence locations=1-241,266-339,364-548,570-605
atggaagaaaaattattcaaaatttgtaaggaaattcgagttggccgtgccctaattgaaaaatggttgcaacaatttgaaatgtttggaaaaagaatgacgaaaaaagaaaaaatggagaaaatgaaaatatattggaaaataaaaggagaaaatcaaaaaataattgataaagaaattgcaaaaatgttggaaattaaacgacggacattttccacttggaaaaaataatttggagaagagaatatttaattttagatggaaatgaattttcaagaattttgaatttgtttggtgttgttaacaaattttattcaaataatttctctatttgaatttagttgttttttaaaattgcataaatttgttaagggtgattgtcattacattgtattttattgcctatgctcttgacttttctcgccccactcgccccgcccccccttctcattaatctgttcccctctcttttgttctattcattctgatcggggggattgggccaagtgcccgtccgatccttccctccccatctgtcccgtacgaatcgggggccgctcctttccctcatttactcattatgtaattgtgtgcacaccttcgga

SEQ ID NO: 85045 - DNA, 611 bp, Heterodera glycines
  Genomic contig location: Contig_ID=SeqID_20245; Location=2709..3319; Strand=+
  SCN-specific regions: Sequence locations=1-414,436-532,554-569,594-611
atggggtaaggaagactcaaaaaatggggtcggggaacaaattgagaaaaatatatataccgtatttcctaaaatatccccccccctaaaatacccccccccctttttttgaagggtttgaaaaatagagccaccgggggctctattttaggaaatacgagatatattctctctcgtatatgtaattcctaaaaattgaaacctctctatttgtataccagcgtattcctaaaatataaaaatattatagtagccccaagaggagggacgaatatttcagtgaatacggtacatattttcttcttttgtacagtaggatgggtattactgtggcgtttgacaccattttcactgccgcaattcgacaatttgatcaaaaatatagcagcgcaaaaaatgttgttcaattgccaatacaaaatgtgcacatttatgcatttgtttatgaacgaatgaacaattttctttcatcgaatgtcgaaaatatattttcatcaaacgaaaaaatggaatattttttttcattgatgaagaaattttttcaaacaactttgaaacaattgaacaaatttgtggaagagaatgaggaaaaaatggccaaatttttgtaa

SEQ ID NO: 85046 - DNA, 956 bp, Heterodera glycines
  Genomic contig location: Contig_ID=SeqID_20246; Location=123..1078; Strand=-
  SCN-specific regions: Sequence locations=1-3,46-319,341-378,416 -503,540-682,706-722,763-956
atgaattattatttcatttgtatattttttctaattttattaaatcatcgcaatttcaatgccttcccaagtgtaaatgctgcggttgtaagttgtcattttaacaaattagctaattttaatacttttatcatcccattattacaagattgaagatgacgctttggttgcgcttgcgaaaggcccgaaacattttgccaatttttgcgcaatttacggcttaaccattgatgagaaaaaccaatttttgtctgaaaaatatgaagcacaccttggccttttgtattatttaagaaaagattggtatgagatgcattcgaccgaagtaagatcatttgctgaatgttaatttaatagctgtaaaaaaggtcataatcgataatttaaattgattttttttgatttataatttattcctacgatttcgtcttttataattttgttttgcaaatttttgtttatttcgtgaaaaataattattatcttttcgttttctttttctgaaaatatatattttttggatttaattaaaattttatgaattgtttattgtcgtgctttaaggaaaacattttgtatgagaaacaatgggaaatgtcacgcaaatttgctttcattctgtacgagtatttgttccgtgaatatgttgctgaatatgtaaaaggttcgtataattttcaacaaataattttaataaaataattaggctgcatacttatttcatttttaaaattattttaagaaattttaagattttaaaatccaaattttggaaatagttaggcattttcattatttttttgtgccattcagcagttgacccagcgatggctgaacaaattcccgcagttatgaagcccataacagcatttcaatacatagaaatgggatacagtattagcataacattttgtgaggctatcagcgaaaggcaaatattcggattagtgtcctaa

SEQ ID NO: 85047 - DNA, 1261 bp, Heterodera glycines
  misc_feature (504)..(504): n is a, c, g, or t
  Genomic contig location: Contig_ID=SeqID_20250; Location=495..1755; Strand=-
  SCN-specific regions: Sequence locations=1-144,181-212,234-354,494 -814,849-907,930-1001,1023-1036,1058-1070,1092-1261
tcaacaacgacgacgacggcggacagtttggacgagttttcactgttggtgaagaacatgtaccgctacggggaagtgaaggtgttgacaacactcaactacaacatcgacgcgtacaatctgccctcaattgtttcgaggcacaaaaaatgaattttaagaaaaaataaataaataaatcagcagggtttcagaaaattccgattcccgaattttttaaatatatgtctctccggtgaaaactcagtcaatctttctgggtattgatcgaaatgtttggaattgttgaggtcccatcgcttagggcgacttagtcaggaactgaaaatattttttttaaattcaaactcagagatttaaaaaaaatcagaaaattattttctaaaaaaatttttaagaaaaaactaaaaatttttcgtgcgtttattctttattctataatttaatttaaaaattcaattttttagtaatttttcaacaaattaataaaaatctctcctttcntcatttgtgttattgcagcattgaatttaacaaggacggtgacttttttgtgatcgccggtgtgaccaaaatgatcaaactgtacgacttcaacgcactgatggaccattgcggaggcactgatcagccgccaacgacagcgggcaccaacgacggcattacgactccggcatttgtccatcagccgatggttcagcttcggtgcaactccaaaattaggcacggcacaccttcccgcccccctcatttcaaaaactgatttcgttacactttttagcaatgtttcatggaacccatacaataaagtaagaatttaattttaaaaaattatttatcataaaaatgccttcataatttttgttgttcagcacatgttggcaagcagtgattacggtaatatgtattcttttactgttttttattttcctaaatatcacgaatattaattaaaatacaaattcagacggcacagtgcaattatgggacactgctggtaaaaatttaatttaaatttcatttcacgaatatgactaaatattaaaattatccatttcagagggatttcaaggaaggggggaggggaagaatcattaggaattattagcttccttctaactcatttttgggggctttttagccgcaaaatgtacacggacatttggtgagcatgaaaaacgctgctggacagtccaattcaacagcatcgacccgcatctgatggccagcggcagcgatgacggaaaagtgaataaatact

SEQ ID NO: 85048 - DNA, 962 bp, Heterodera glycines
  Genomic contig location: Contig_ID=SeqID_20252; Location=1393..2354; Strand=+
  SCN-specific regions: Sequence locations=1-103,125-462,505-527,559-962
atgactgacagggcaattaggaaattatgggacggagtgatgttcgatggtgtgtggcagaggaacgaaacggcatggggaagtccgcagagcgcggcaagtaagtaaaaaagcctcgatgaatgaatgggcatgagcagtagggagctgctggagaccgagatttcccaaggctcgagagcgaggccagaaaaaagtcaagaaattcaagaccgagaaattcacaagcagcgccactaatgaacaggaggggggggggagggaatgaaaaattgaaaaaacccaaaaataaaaagggatgagtgagaaatgccgaaaactgagaccgtaaccccactgtgaaacaaaaaaaaattaactgaaaattccatttattctttgaaagtttctatgagaaatggaacaagtacagagaacatgtaaaaaaataaaaatccgttaaaattcgaaggataattttggaaaatatttaattattaatttatttaacaaatgtttatttatcctggcgcatgcataatttggagttaataactttatttaatatatttttttttacttcagcaaattttacgcgaaacccccagtactttgttcaaattgggtctcagcagccaaaaaaagtgctaatgatcatctcgttgatgcaaaagtacagaagagaggagggcaaaagcctaatgtcaataggctaccatgtttatcgtgtggtaaaatttggttagggcccggatttttagaggcaaaaaaaatatcaaaataatggcctaaataagggcgaaaatatatgggggggggcaatttaatgatttgcattttttttttatcttttattgccatttgattaaaaatttaacaaaagccaaaatatgtgcaaaaataaggggcgaaacgaaaaaaacgcaaaaacagggaagaagccctacagaaaaacaaattaaaaaccaaaaaatctgggccca

SEQ ID NO: 85049 - DNA, 1162 bp, Heterodera glycines
  Genomic contig location: Contig_ID=SeqID_3529; Location=349..1510; Strand=-
  SCN-specific regions: Sequence locations=1-402,424-1162
atggagaccgagaagccaacagcacaaaaggatgccgagctcatcgccagaagcagttccaaagtgcaaaatctaacggaaaggcaatggatggtcaaatggcaggggaaggggcaaacctcgtcgattgtgctccaaattggtgtccttgtgggcaccaattcgtcagaatccacaaaaaccggaacacaggcggtaatttgcgctgcagccgaaacggcttttttagggttagcggagaaaagggacacaatttgggcgggagggaccaccggacggagaaaccttcaggcaaaggaaattcggttggatttagcttgaatatctgtatgaattagatgaggaagctttttagggaaaaactatgggcccaactttgaagcggtgtctttggtcttccaaatcagggttcaacaagctgactaccgacccttcccttctccgcctctcaatttgctcgaccatatcgaataattatggcctcaattgatccattaagcttctgcttgcctcgaggcagtgaaccgttttccctcagtggagcaaacatttgccaacacgcggcgatttggaaagcgttggcggaagcgattttcaaaatgttccccctcggaaagcagctaaaagacgaaaaattgaagtcgtcttcctctatgttctcacattgtcattctgtccaaattgactaacagacggcgattggagcggaaagggtggggacggatcgatgctgatcaaaagtcggacagtgatcggacgatcggacggatgacttcttaagggggggggggggttgagcagaacgaacggaaatcggagcatttgctcgacctgtaatcggtgtgaaaaatcggtgactgaagtgtcaaatgtccgtcggcctttcccagggcgaccaatgccctgaggggcacccgtgccgtgcccaaccatcgccgctcctcgcgctcgtgccgcgtgtccctctcgcggtcgtcactttccatgggccgtacttccacgtcgaacatgtccacctccaaacagtcgccctcctccccctcgtcctctttctctctgcccatttccatcgccaaagtctcttgccaattcgcgtgtcttccgtcgacaatggtcgtactaagcgaactcacctgcaaaacgttccaattattaaaataaa

SEQ ID NO: 85050 - DNA, 520 bp, Heterodera glycines
  Genomic contig location: Contig_ID=SeqID_3529; Location=1..520; Strand=+
  SCN-specific regions: Sequence locations=1-333,363-520
tgctgatcagccgccgccccttcgacatttcacggcgtttaaagccaatgcatcgacatccgctgctctctttaagacgcccaattctctcagtcagtcggtggcactcaaacaaaggcattttcaaaagaattccaaggattgaaaattaaaaaataaaaaggcataattttttcaaattattcggttgctcgtccattattttccctttgctctctcaggagcaacagttgtccaagcggaagctgattctgaacattcaattcgccagtttcatcccaaaacgtttcgttaatggcggcccttcccaaattttcttgcacttttcgacaaaggtttatttttatgtttattttaataattggaacgttttgcaggtgagttcgcttagtacgaccattgtcgacggaagacacgcgaattggcaagagactttggcgatggaaatgggcagagagaaagaggacgagggggaggagggcgactgtttggaggtggacatgttcgacgtggaagtacg

SEQ ID NO: 85051 - DNA, 1248 bp, Heterodera glycines
  Genomic contig location: Contig_ID=SeqID_3530; Location=422..1669; Strand=-
  SCN-specific regions: Sequence locations=1-218,378-408,684-708,735 -799,821-1248
atgcgcatgttgtgcagcagagaacaactttggcaattggccttcgatgacgtcgactcggagagggtttggcggggaattgcgacgcttttggcaatttgaagaatttttgaggatttccgcgcgatgagacgccggctgcagaagcgcttcaaatattatgagaagaagcaaaagttggaagagacggcggcacggaaaaaagcgacggcagcagagaaaagagcaagggaaacggaagaggagaagccggacgagacgaaaaaggttggaaaagagagaggaaagggagagtgtgggagagaaaaagaggaaatgggagggaaaaaggaagagggaaaggaaaagaaaaagagtaaatgggaaaaagggagaaaaaacggctaggaaaatgtgtgggagggaaacgaaaaagagagaggaaaacgaaaaagagagaggaaagggagagagtgggagagaaaaagaggaaatgagaggaaaaaaggaagaggaaaagaaaaagagtaaatgggaaaaagggagaaaaaacggctaggaaaatgtgagggagggaaacgaaaaagagagaggaaaacgaaaaagagagaggaaagggagagaaaaagaggaaatgtcagggaaaaaggaagagggaaaggaaaagaaaaggaggtgaagggaggagatggaaagaagagaaagtaatcggaaataatttggactccaaaaaggagaaaaggaaatattttcccaaaaattggtggatttttgtcacaaaaaaaaagaattttcatttttgtcattcgtcccttaaaaatttcctttccctcaaaggcgttttctgccgcttctctccgtccgtcctccgccgccgccgccgttcaatcgccgccgcgtccgtcgcctccgagttcgagcggttacagcacgaccacgacgacgagttcggcggcggacagagaccgctcgccagcgatgggcgtgcgacaaagcacgagaggcaccgcgcggaggcccaacgcggggacgaagcggcagcggtactcgccgggcgcggaggcgctcctcccacagcaggaagcgagacgcggcaaagccaagcagtgaacggagtgacgggacgaaacggacggacagcgagtgaccagcgacggacgaacgaacgaatgtttcggcattcggtcgcttctcttcctcccgatcctcttttttggtctgtgatcaccgaaccaacccaattagtcttttattgttcgtcggtcgaat

SEQ ID NO: 85052 - DNA, 108 bp, Heterodera glycines
  misc_feature (14)..(14): n is a, c, g, or t
  Genomic contig location: Contig_ID=SeqID_3530; Location=1883..1990; Strand=+
  SCN-specific regions: Sequence locations=1-108
atgcccttgcttanactaatggtcaatcaaatcagtggccaggccattctttgcttctttctccgccgaacgtacgatttctacgccctcctcgcttcgaaacacgcg

SEQ ID NO: 85053 - DNA, 712 bp, Heterodera glycines
  Genomic contig location: Contig_ID=SeqID_3532; Location=147..858; Strand=+
  SCN-specific regions: Sequence locations=1-270,292-712
atgctaagggcacttttgtcgccggaaatcttcgtggaaattgtgaattgttaccaggaactgatggtggtcgaaggctgtcttcagattccctgctgcgtggagtttccaccgctcagaaaatttgtggctgccaatgcgattcgttctcggcaacttcggcaggaaaatttggaacggaaggtgtgcagagaacgcatcaaccaatgcacatttgccattttaattaaatcattttcctattttcttggcacccttttcaatgctttcttcatttcagtggcatttggagttggcccgtgatgcatgtgtctcaaaattggcactgtccgaattgtcttgggacgcgagcctttccttcgaaactgtgagggtttgcatggaaaaactacgacggattggcccggaaaagtctgcccaatttgctcgtcttagcattcacctttcgaacagtccgaaattatttgtgatgttcaacggtcgcctctcagtgcctatcgattgggtcaaagaactttaaatgcaactgataattagttaattagccaataatacacttctaaattttccactcttttccattcgcctttatttgactcaatttgcaaaaatattacgcaaactgtgaaattaaaacaaattaccaaaattaatgcatttcaatggccatgccggtgattctctgttctcatttttgttttgattgtttgaa

SEQ ID NO: 85054 - DNA, 388 bp, Heterodera glycines
  Genomic contig location: Contig_ID=SeqID_3533; Location=2842..3229; Strand=-
  SCN-specific regions: Sequence locations=1-388
atttcctcgcactttgtgcccattccattggcaaatcgccgctttcctttttcttccccaccttttcgatcagttgctgttgcatttgccacaactgttcctcgggaatgccgcatttgtccagtcgcgaatttttgcgcttcaggcgcttctcagccgcaattttgcactcgccaagcacagagttcgccgcgtccacatattcacgcggaaagccaagatttttgagtgctaaaaggagacgacagaacgaatgagaaaggaattgcaagagagattatccgaatttggttttaatcacttgagaggaaaggctattaatcctttgttttacgaatgttcaaaatcagggctttttccacaaatttaaaatcaaaagcgcagtcaa

SEQ ID NO: 85055 - DNA, 509 bp, Heterodera glycines
  Genomic contig location: Contig_ID=SeqID_3533; Location=641..1149; Strand=-
  SCN-specific regions: Sequence locations=1-113,135-509
atgaaggctataattgttgcttatttgctgcctgctttcttttacatcccctacggcatcggacggtacagcgtgaaaagaaatgaattagccaatggcgacgtgctttattacccggacgacagtgccgtgtcaaaaacgatgggatggcaagtgagcagaaatggccaaatgcaaagaaaaaaggtcaatcgccatgaaaacggtgttcccagatctacaagtggaccagggaaggccttctccgcttccttccgattgtcattctattcgtgctcaactctcaaattatggtggctttccgacgcaggcaaaggatgttcaaccgattgcgaaatcgcgaccaaacgactatcgcacgtgatgacacattgctgtacattttgggtggcatcgcagccatggtaatgcctttgatgttcaaagtcaaggagttcacaattttgcttgcatttaaagtttttcgtctgcaatattccggctgccatcaatctgttgttcatcaatga

SEQ ID NO: 85056 - DNA, 1057 bp, Heterodera glycines
  Genomic contig location: Contig_ID=SeqID_3533; Location=2112..3168; Strand=+
  SCN-specific regions: Sequence locations=1-668,712-1057
  Gene Ontology: Biological process=regulation of transcription, DNA -dependent
atgacggaagaggagaacgaagtcggacttccgcagaagggcgtcaacatgatcatcaaggacgccctcccggacatgcgtatcgccaacgaaacgcgcgaattgctcaaccaatgctgcgtggagttcgtccggcacgtgtcgcgcgaggcgcaacacatctcatcaaaggaccagcgcaagaccatttaccacgaccatgtgcagaaaggtggtgggagtgggcgattgtgatgcgttgaggaataatatcaataatgggccaatgggtggcattttcggcattatgccctcaacctcccccctcccccttttttttgcttgactaattattgggctcaatttgggggttgtgtcgcagagggcggcaaagcgcggaagtaccggcgcggaagggactgttgactcactttgtgacgggcaatttatccgaattttcgcctctgccgcgaaatcccccggggaattggtgggatggcttcccccctcccccacggcatttcgctgacatttccattcatcgtctcccgtcaaacccgcaaaaaagcagcactcccaaaggccaaataatcgcaatgttcacttccatttcacgaaacatttttccatggatttctcctccaaattggcttcaatttgtgattttttttcgcttgttggcactttcctttttttaatataaataataaatagtaaaataaactaataaatgttgagaaaaagggagcgattgactgcgcttttgattttaaatttgtggaaaaagccctgattttgaacattcgtaaaacaaaggattaatagcctttcctctcaagtgattaaaaccaaattcggataatctctcttgcaattcctttctcattcgttctgtcgtctccttttagcactcaaaaatcttggctttccgcgtgaatatgtggacgcggcgaactctgtgcttggcgagtgcaaaattgcggctgagaagcgcctgaagcgcaaaaattcgcgactggacaaatgcggcattcccgaggaacagttgtggcaaatgcaacagcaactgatcgaaaag

SEQ ID NO: 85057 - DNA, 930 bp, Heterodera glycines
  Genomic contig location: Contig_ID=SeqID_20254; Location=256..1185; Strand=-
  SCN-specific regions: Sequence locations=1-14,41-299,321-522,544 -811,847-930
gggatgggatgacctgaaacagagcatcataatggcatatgaagcgctgacagacaaagtgtcgcaggccttctgttggggcaaatggcttggtcaaaaatgcgtacactacggcaaagttttgctcggctttttggtcaaactgctggtggagataatcccgaaattggaaaaagccatgaaaaaacttaccgacttttttgccggtggcaaaaatccaattgacgtcaaagagggaatttctgtttgtgaagtggtgaagcagtacacgacaatgcaagtcaagagtggattaactgtgcccaaagttgcacgtaagtttgtccgagggttgaaaatttgttaaaaaaaggggtcaaattgaaattttggcagaaaatttaaggaaaaattagtttttattccaaaactgagttaatcacaaaaaacgtcgtcgccataggaaatcatcttctgaaaaatagcaatctttctgaatttaacgaaaataaatatcaaaacgaccgaatttaatgatttggttaattgattatttatttgcaccaaatttctgtccacttttttcagtactaaaacaaatatctgaaaagtttttgttttgctttcttttaatttatgtctaatttatctgtgtttttgtctaaggaaacgtcgcaattcgattgcccaaaggcaattgcattcgaaaattctatgaagaaaacccaatagtgattcagcacattgaggcattctacaacgtttccagcgaggtcagtacgacactcaaatttctttcggtcttgatcagcactatgatttattacaatagaaaaaaattaaacaaattaatatatatcataattacagcaaatcaagcgaaaaattgctaacaaaaaagctgccgcctttctccagtcaaagttgaacaacggcaacacagcatcgtcg

SEQ ID NO: 85058 - DNA, 545 bp, Heterodera glycines
  Genomic contig location: Contig_ID=SeqID_20255; Location=344..888; Strand=-
  SCN-specific regions: Sequence locations=1-198,221-322,353-472,501-545
atgtatgtgtcaggcgcacccggagaagagtgttgggtattggccagtgataccgaatgttccgaatctgttggcaagtttaattctcgcgctggaattgacgcggtattacgcctgctcttgggagagcgcgtggcgggtagcctcatgagcgacattgaggctaatccccgctaccaaaaaggcatttttaatgacattaaaaaataaaaaattttttccttttcgtttgcaacaaacatacggtcccagtgccgtacattcgaggattaaatgttacttttgggtgcgacgtggaagccgacatgaaaaaaaaggtgtatttttaaaggggtttttaaaacaaaattttgaaggccaaggccgaattgacacgggaatttattcccaattgcatggcgaaatgtgttagcgaggatggtcataaagatgttgatgaggaagagcagtgaatgaatgatttgaaatgatgttaagtaaatggatggatggatggacaatcaaataattaaattattacattttcaagttaaatgatgaataaa

SEQ ID NO: 85059 - DNA, 677 bp, Heterodera glycines
  Genomic contig location: Contig_ID=SeqID_20255; Location=968..1644; Strand=-
  SCN-specific regions: Sequence locations=1-181,204-421,443-677
atggcagccaattcacctatttttaatcccggacccgaattcgaaccaaaagtcgaaattttgaagaaaaaatttgttgggacattaaagcagaaaagaaccatgaatgaattattactaagttgcaattttcctatcaggtgcgttggtcatccaccttccaaatgcttgatcgtttttgcaaaacaaaacagttgttgggcttctgtgtgcagaagacatttcgtttccgaatctaagctatcaaaaaaatatttctcagccccagctacatcgactgaaagcgaacggcttttctccaccgctgggttgattgtgacagatctgagaaaacgtttattgcctcagaatgtggacaaacttttatttttgcatcacaatcttaaaatttatgattttgattatgaataaaatttttgggaaaaaattatttaaaaaaaatcggaatcgcaattaatcggattttgggccataatcgtaatcggttttaaaaccgtatcggatttttggccataatcggaatcggcgatttaatcggaatcggattttgtctggctcggcacatccctggtgtgcgggttggctgattgtctagcctacactccggtgcgggttagctgtctgactagcctacatgcttcactcaaattgaacaaatgtgagagttaaccaataaa

SEQ ID NO: 85060 - DNA, 833 bp, Heterodera glycines
  Genomic contig location: Contig_ID=SeqID_20256; Location=1338..2170; Strand=+
  SCN-specific regions: Sequence locations=1-12,34-163,186-194,218 -252,274-360,382-413,436-466,488-531,554-833
atgaacacaaaatcccaagagaaaccacctgctgaaatctacacatttctccatgatcattttgtctcattggcatcaaaacaacaatcatcatcaacatggatatggaggtgttatggcgttactcaaaaacaattaaaatgggttactcaaaaacccattcaaaataaaaatatttatattaactgatcagaagcaatcaaagttttaatatttgatttcattcgatagtgctaaattttctctattagccttcaaaatttcaaaaaattttgttgactttcaaaaaagttgtggtcagaagaacgcaaaaaacaatgtttttcaaacacattggtcaaaaatttttttgaacttaacaaaaattttttgaaattatttaggctaacagaaaaaattaattaaggcaatcggaagataaaaatcaaaaatttggttgtttcttaacaaaatgatagtcaaatatttttatttggatggtttttgagtaacgcccaatttggaggtttatgagaatgacctattaaatacagacacggacacggtggatatgaattgtcggaacaataaaagccacggcttctctaggccaaaattctcataaattttcttaattattttacagtggaaaaaagcgcgaaataaactgtgcatttgtcaattttggacgagtgttggcaaaacgtttgaaatttgttcatgaaaagtttaacacatttgctgatggtaaagaaaaagaatgtggcggcagagacccgcacacaacaaattattatgattataagcatcatcatgctttcatcagtgataacaatacaccggcggaagggtaa

SEQ ID NO: 85061 - DNA, 964 bp, Heterodera glycines
  Genomic contig location: Contig_ID=SeqID_20257; Location=173..1136; Strand=+
  SCN-specific regions: Sequence locations=1-175,197-259,281-964
gaagttggtagagccattgtagcagaattaactgattgttcggtggtgttgatgatgaaaaagagaatatatttctcgtgggatatacaaactctacatatatctgctttcctctcctcagcaatcttctataatgatcaaactgaaacagaaaatttaaatggttggacctacaaacaatacttggagattggtcccaatatgtgggtaggccgaagaaacaatgattcagttactttcaaattaaatcagcaacaggttaatttaaaatataattaatgtcataagacataaagtaaatttgaaacgtgaccggaattcgtaagtctaaatttcgcaattagcacttttgggttcaaaatcggtttaaatacatggaaacaaactaaagccattaatcctgcaataagcgatcatttaagcagtttttgaatcaaaaaagctaaattcgaaaaattgggctttcgaattttgtacgaattcgggttcacgagttcagaattgaccgaaatggttgccggatcatgttcagtgatctttaaacccccagggaacataatattagtatcgctgacgcattttctactgacgcattttccactaacgcattttccgggcgccaattgaaaatatgtttttttttacttaagtttccgtgcagtggcatttgccgaacataaactaataattaaaaaatgtcatttaggtgattggtcaaataagcgttcgtgagttgcgcaaaaccgccgccatcaatttgatggtgaaaaagagagtgtatttcccatattttgatggccaaccgtacagtattaatgcttggactgagaatggccaagaaatttttactgaagtagcattgtgggatttttcaaataataaacggtatttggagattgatccagaccaatttggaaatatgaattccaatgattggatttatttctatattgctgggcaacaa

SEQ ID NO: 85062 - DNA, 1903 bp, Heterodera glycines
  Genomic contig location: Contig_ID=SeqID_20259; Location=38..1940; Strand=+
  SCN-specific regions: Sequence locations=1-92,114-380,402-998,1020 -1190,1212-1385,1407-1903
  Gene Ontology: Mol. function=microtubule binding; Cellular component =microtubule associated complex; Biological process=protein biosynthesis
aagagaaggctaaaaaggatgccgaggctaagcccaagaaagacgcagaagagaaggctaaaacggatgccgaggctaaagccaagaaagacgcagaagagaaggctcagaaggatgccgagactaaagccaagaaagacgcagaagagaaggctaaaaaggatgccgaggctaaagccaagaaagacgcagaagagaaggctaaaaaggatgccgaggctaaagccaagaaagacgcagaagagaaggctaaaaaggatgccgaggctaaaaccaagaaagacgcagaagagaaggctaaaaaggatgccgagtctaaagccaagaaagacgcagaagagaaggctaaaaaggatgccgagactaaagccaagaaagacgcagaagagaaggctcagaaggatgccgagactaacgccaagaaagacgcagaagagaaggctaaaaaggatgccgaggctaaagccaagaaagacgcagaagagaaggctaaaaaggatgccgaggctaaagccaagaaagacgcagaagagaaggctaaaacggatgccgaggctaaagccaagaaagacgcagaagcaaagaaaaaggaggaagaaatgaagaagcaaaaggctaagcccgaagaaaagcctgaggcacctgccgaaggcgtagccgtagtgccggaagcgaagaaggcggaagagacaaaggaaaagctgaaagaggaagagaaaccaattgaagtgccaccatctccagcagaaaagaagagaaaagaggctgaggagaagaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagagaaggctaaaacggatgccgaggctaaagccaagaaagacgcagaagagaaggctaaaaaggatgccgaggctaaagccaagaaagacgcagaagagaaggctcagaaggatgccgagactaacgccaagaaagacgcagaagagaaggctaaaaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagagaaggctcagaaggatgccgagactaacgccaagaaagacgcagaagagaaggctaaaaaggatcccgagactaaagaaaagaaaagacgcgagaagaagaaggctaaaaaggatgccgaggctaaagccaagaaagacgcagaagagaaggctaaaaaggatggcgaggctaaagccaagaaagacgcagaagagaaggctcagaaggatgccgaaactaaagccaagaaagacgcagaagagaagaaaaaggaggaagaaatgaagaagcaaaaggctaagcccgaagaaaagcctgaggcacctgccgaaggcgtagccgtagtgccggaagcgaagaaggcggaagagacaaaggaaaagctgaagcaggaagagaaaccagtggaagtgccaccatctccagcagaaaagaagagaaaagaggctgaggagaagaaggctcagaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagcaaagagtaaggaggacgcagaggagaagcaaaaggctaatgccgaagaaaaggctgaggcagctgccgaaggagc

SEQ ID NO: 85063 - DNA, 1021 bp, Heterodera glycines
  Genomic contig location: Contig_ID=SeqID_20260; Location=203..1223; Strand=-
  SCN-specific regions: Sequence locations=1-102,124-312,334-1021
atggtcgcacgcctggaaaacaattcagtggagaagccaacacataaacctcttcttgtggtttttgggaaatggcaatgtgccaatgactttgatcatcctaaatatctagaaaaaatggcgcgccaacgattcgtcaactcgacgattcgtcaacccagccaaaatgtgacgattcgtcaactcagccaaaatgtgacgattcgtcaacccagccaaaatgtgacgattcgtcaactcagccaaaatataacgattcgtcaacccagccaaaatgtgacgattcgtcaacccagccaaaaatagttttaaaaagcagtttcaagagcttttaatggcgcttagcacaattatagcattcttttaggctaatttagaaacaagaacacataaaatcacgaccttttcgatgaaatattcaataattgctttaagttccattttttaagtaatattgattgagttgacgaatcattgagttgacgaatcgttgacatttggctgagttgacgaatcgtcacattttggctgggttgacgaatcgtcgagttgacgaatcattgagttgacgaatcgtcacattttggctgggttgacgaatcgtcgagttgacgaatcattgagttgacgaatcgtcgcattttggctgagttgacgaatcgtcacattttggctgggttgacgaatcgtcgagttgacgaatcattgagttgacgaatcgttgacatttggctgagttgacgaatcgtcacattttggctgggttgacgaatcgtcgagttgacgaatcattgagttgacgaatcgttgacatttggctgggttgacgaatcgtcacattttggctgggttgacgaatcgtcgagttgacgaatcgttggcgcgccgtgcaaataggtttattatttatttagtaatcagaacgccaaaactttgcaaaacttaaaatttttttgggattttcccttgtaaaattagaagagccgatctcgagttaaaaacataacttcgaaaaaataaa

SEQ ID NO: 85064 - DNA, 1028 bp, Heterodera glycines
  Genomic contig location: Contig_ID=SeqID_20261; Location=217..1244; Strand=-
  SCN-specific regions: Sequence locations=1-188,225-364,386-418,456 -1028
  Gene Ontology: Biological process=amine/polyamine transport
atggctttgaattatccaattcaattcattaatctgatccctgaaaagggctctctgctcacttctctgctaatgaatcgacttttgttgggccgagaatatccgttaaagaaatatttgtccgttttggccatcactttgggcattattctctgcacattggccacttcgaatttggaaaaagtgggaaaaataaaatgaaaatttaaataaaaataattattgaatttcagaaaattgagtctgtcctttcacttgaagaagcggaaaagcattacagagaatgggccgtcggtgtgctgatgctttcggcagcccttttgatctcttcttatttggcaatttgtcaggaaagaatgtacaggtaaaatgggagaaagaggcaaaccaaaacagttcaataataattaattgcagcaattaatattttaattgttttttattttagtaaatatgggaggcatccgcgggaagcgatgttttacacggtgagacaaaaaaagggaggatgggagagggggggggggggtaatggatgatcggaactgaattttcgacactatgatttgacccaagactcgagaaagggagaaggaggaatgataatatgcccatactcgagaagaggaataagacggcattgtggaggggggggggcggcggcgaagaaaatgccaaacaaaatgaggtgccaattaacgaagtcaaattggtttttttgtgccatgctttcgttttgatcagcgaactgttcaatttcagcacgccgtctctttgcctttcttcgctctgatgggcggcgacattctccgcagtgtccgtcgcttttcctccgctccctccgcccttttcctcggcttttccctcccaatttcggcactttggctccgtcttttggccagctgtgttttgcagtaatttttgcacactttccctgctgggttttcattggaatttcttcagatggctttgcattatgttcgtctatcgtctcaatgccacaattgactctctttccgtcactttgg

SEQ ID NO: 85065 - DNA, 1432 bp, Heterodera glycines
  Genomic contig location: Contig_ID=SeqID_20262; Location=243..1674; Strand=-
  SCN-specific regions: Sequence locations=1-70,98-312,335-424,448 -514,536-595,628-809,841-944,966-1010,1032-1432
aggttggaagacggtctgtaggcggtggacgtgttgcgcaacggcaacaacattttacgaatgttggcgctggtggtggtggtggtggtggcggcggcacaccgttgtcatcgtcgtcccacaatcaacaacagcgagcagtactcaccggtggtggtggtggtggcagcggcagcaacagcgcttcttcctctccagttcgcgcatttcgtccaacaacaatgtccaacaccgtcaccagctcatcctcaccgtttcatcaccgtcgctactaccaacagccacatcatcaacagcagttccatttgagtactgcttcagcttctgctggttcatcaccggtgctgttggctgctcgaccgttgcgcatcaaaccgtccgccggcgccgcctcctcatgcccccgtccgtcatcaattgttgtgcaacaacaaccacaacagcagcttcggatagttcagcagcacatgaacagaaatgagtaatcatttgaaaaataataaatttggcatgaaaaatatataattttcatcttttttcaccaaaatattcccattttggattttgatttattgttagatagcaaaaataactcaatattaaaattaattactataatttattaaactgttgtttatgctttactcggactgaacacattaaacgagacccaaaatcgtgtcactaaaccaaacttattacacatattctttctttttttttagcattgcatcgaccgggaatgttgttggtggtacgacggacgctactgttgctactgcttcatcatcgcctgtctcatcactgcaccacccccaccaccagcaccagcaacatcagttgaacatgacaacgcctcgtacaattgttgtgcacaagtcgtcttcgtcgttgatgccctcctccgatgccgagggcggtggcggcggaggcgtcgctgacccggcaacaacaacaatagcaccgcttgttgccggtccgaaacggttctacgttcacgcatctgggccgccccaccagcagcatgtagcagccgttgctggtggacaaccacctgtgatggtacgacgacaattgccaaactgtccgccacgacaacagcgacaagccatggtaaactaaaaaaaaaatttttttttcaaacctggaaatttttcaagaaaaaaatttcaaaaattttcttgtagatacggaatgggtgacaccaagttgacaaaatcaaaaaatttttttcaacaatgaaagaaaatgatctttataggcaacttcgaacacttttgacattcttccaccaccggccaaaatggtcaaacatatggaatttgtgccgactgtgtccgacattatttctccaactgaaccgccgttgagctcaacgaccaccacaaagactaccacttattcggttcctgctgcaccggttgtcattgat

SEQ ID NO: 85066 - DNA, 1321 bp, Heterodera glycines
  Genomic contig location: Contig_ID=SeqID_20263; Location=198..1518; Strand=+
  SCN-specific regions: Sequence locations=1-994,1016-1197,1227-1321
ccaggctgctcggtcaaattctccatcaaacaatttcgtctgtgccgttttcccaaccaaggatagccgcgaaaacttggagcgctatggaagcacactttgggaacaaattgacggaataggcacattggcgggcaaacgagtcaagtggtaaattttaaaatttgtttttttccatttttctgaattcaaaaggtttatgggcggagacgtcagttttatttggtcaatgatcgggcattgtggttctgcagtgacaacatttccgtctccaatttgcagttgcagaagtgatcatttggtgcaggagggcgaaatttgtgaactccggacaattgatcaaactgtgcagttcgcggagcagttcaccagagccatggtgaatggcgaaaaggcaaacgcagcggtcagatcggcgatgatgggcatcacgaaaccaccgcttctcctgtccattggatttgaccggatcatccccgcgccatttcacgttttccaggggcttggaaatgccctaattcgggaactcgaacagcaggacggatgtgccacaattgctcaaaacttttttcggagattcggcgcgcggagggagcaatttcgtaaacgagacatgaccgggaattcaattagaaaaattcttgtccatgcttctgaaatggaacatctcttttcgacggattggccaattacaatttgcagaacccttgtgcacctcgggaaaattcaaaaattttcaaaagtcattttttcttttttctcaaacttaaattcgaaatttaggcagaaccactgtcaccgaatgacatagatgagttggagaggcgcgtcgacgaatttaaatcttttttgtctgcccaggagcggatgcgcgggtttctctcaaagaagcccaaagcacatcttttgttgagccattttgttcccttcgctcgcgagcacaaatttcttggccttttagatgaacagggttgtggtgaaaaatgttttctatcccattaatctgaattttaaggtgatgaggcgctccattccgtttggcgccgacttgagcaactgtggaagtgtatgccggacgcagaccaaattttgcagcaactggagcaccattttgtcaacaattggctcctcgactctggcaaaattgatgaactgaagaggtatgtatgtttggagggggtaattgcgttaaacttgttttatttaaaaatttatatataataattcagagaaaaagtgatcagagggaagagtatgatgagttcgatcaaacggaagaagaaactgacgaaatttcgcttatcaatgtcattgattgatg

SEQ ID NO: 85067 - DNA, 1237 bp, Heterodera glycines; identical to SEQ ID NO: 3534
  misc_feature (80)..(80): n is a, c, g, or t
  Genomic contig location: Contig_ID=SeqID_3534; Location=1..1237; Strand=+
  SCN-specific regions: Sequence locations=1-40,72-267,289-773,796 -942,1013-1237
  Gene Ontology: Mol. function=palmitoyl-protein hydrolase activity; Cellular component=extracellular space; Biological process =neurogenesis

SEQ ID NO: 85068 - DNA, 839 bp, Heterodera glycines
  Genomic contig location: Contig_ID=SeqID_3535; Location=419..1257; Strand=+
  SCN-specific regions: Sequence locations=1-192,214-317,343-481,520 -539,561-659,705-839
atgaattaccctactgatttttcttggcttcccgtcaacaattgtgtttgtcctgtgaaggacaatttatgttatcactttcccggctacaaaaagccggttatttgtgcccataaactggtgcaaaacattaccgcattcctttcaactccccctcacatttctaatggtattttttctgtttgtttatgatttaatttttcaaacaattttccagaatcggcacctgcgtctctttcctcgggctccgtgttgatgctgcttactgtgctccaaattttcatcattttgtttacggtgagtaaaaatggtttatcattaaatttaaaaatattttaatttctttaagatggctttgtgctgctgtttgattgtctttgccgcgcgaggccgaacttacacggtgaatggtcgccgttccactcggcgccgagctgccgctgcgactttgagcgccttccaggcgcgcacttcgggtgggaattttaaaattgttataataaaaatattcattatattcggggaagggatgaatttcgaatttttaaaaaaatttttttccattttcagcgcttggtcttggcagtgctgctggtccattggcgattccaaaccgccccgcagggtgcacttctcatcgtgtgccgggtagtggggcatttcacatttatttttttttttgttttaattttcattcattatttaggctgaatggtgtcagctggtcaacgaaagaatgatgtgtgaagaaaaggcggataaaatttaaaaaaaaaggaagatcgaataatatttttctttttttattctcttcattttttttccaaataacaatttaa

SEQ ID NO: 85069 - DNA, 448 bp, Heterodera glycines
  Genomic contig location: Contig_ID=SeqID_3535; Location=1487..1934; Strand=-
  SCN-specific regions: Sequence locations=1-253,286-448
atgtcctccccaagcaaattctctccgacaaaaagctcccccatcaaaaaggagaacaatgttggaaaagctgaatttgtggttccttccttgaaagcgcccacccgtaagcagccgtcaaaaaatgtgggaatgaatggtggtgaggagcagcagccgtcaatgaaaaaacgaaaagtcgaggaccgagacctgtggaaactcgccaaaggaaaatacatgctgggcttctacctctgcgttggtgaataactatttattttttattgttaaatatttataaatctcagatgattggaacaaattgtacaacaacaagcagagggtgttgcgcaaggatgatgaccgtttcgctgtcaattttgaactgtgcgaagaatgcgctctggccaatgttcgcgcaaccgacattttggcgccgccgaaagcaaagaagcgcatcgaataa

SEQ ID NO: 85070 - DNA, 806 bp, Heterodera glycines
  Genomic contig location: Contig_ID=SeqID_3535; Location=2128..2933; Strand=+
  SCN-specific regions: Sequence locations=1-659,682-806
atggccatcaacatgagcgacaagcggggcttgctccgacaaattctcggcgaagcggaaattaccgtgacaacatcgggcctgacgattagcggcccccgtctgtccactccacggttcctgccgtttgacgagagtggccgctgccgctcatgtaaggcaactgaagtggaggtcgacacaatggttacgaaggagggggtcacgatttggtgcacacgcatcgacaaagtccaattcgtgccattcgatgtggtctacgaattgccaggtcactgcttcttccgactgaagaacaagtcgcgtgtgttcaatcttccatacggcgaccttccatctgaatccagtgaaattccgctaacccaacacgtggacgaagaacgggacctcaagagaaaggcaaaagctgcgctcgaattggtggaggccggactgattgcggacagcactgtgcaggacggggcccgtttgaaaaaagccaaaactgcgatgaaagtgatcagtgacattctgctctctgaaccggtgggagatgatcaaaagaagacggttgaagtggcagttgtcgacaagcagccacaagagcagcaaccagcccctgtacaagagaagcccgtcacggcacccgctgtggaacagaacactgttgaagtgaagacggaagaagaaaagaaggatgatcttggtgacattgacaaaacactcgatgaattttttgcgagccttaaagccgcaaccaccagtatgtaaacgaaaacatatttaaatccttcgaatttatttgcgcaccatttcacttgatcaca

SEQ ID NO: 85071 - DNA, 619 bp, Heterodera glycines
  Genomic contig location: Contig_ID=SeqID_3535; Location=4026..4644; Strand=+
  SCN-specific regions: Sequence locations=1-5,27-312,375-584,606-619
atggctaataaatttttgcttgttccacaagaaatttaccgagggctaacctcagcgtcagatacgggagtcattaatttggatgcggtaaggcatgacctggagcgtgccaggcgtgaacggactaatccaacaacaaaaaatgtccggtacaatcaacagcttaggcgttatctgcaaatgagaagggagcttgccgatagacctaccaaagttgagttaaccaagggcttgagtgttttgctcaagcgagatgggggtgttgatgatgacgacggcgaagtcgtcaacactcagccacggcctcccgctccaccaccaccaccaccaccaccaccacctcctccacctcctcatcaataccaccgtcaccatcccagccctcccgatgagcaatcttcctcgtctgacgatagtcatccgcctcgcccccctcgtccaccacgtcctcagagaacaaagaaaaaccatcaatcttctataaaacatggtcggctgaatcaatggaagcaaaggcgtcgtgacttgcaacaacaaccggtagtacgtgatctactcgctgaggcagcagctgctcctttacctgaaagtgacgatgacgatgaacaaatgctggaag

SEQ ID NO: 85072 - DNA, 1348 bp, Heterodera glycines
  Genomic contig location: Contig_ID=SeqID_20265; Location=1..1348; Strand=-
  SCN-specific regions: Sequence locations=1-861,883-1224,1247-1348
agaggaagagtcggagacggacatccgactgaacccggacgcgtggagcacggcggtgagacacgcgccacaggaggacgttcaggtgaaaacaaagggacgattgttttttggctggtgaagggcgactctttaccttctttttttgtaaaatattcatttgttccgattgattcaagcattttaaaaacaggcccagcgaaagttgatcgctgaggcggctgaatttctattgactcaccaaatccctcaatttgtgcgcgactccgtccaattggcagtttcacccatcgatggagttgccctggtagaagcaatgcacgcccgtggcattaacattcgctatttgggcaagttaattgaagctacacagcacaattctcgactcgattacctcacggttcgttcgctgttcgtaaaaaaacgattttcggattgcaatctttgttttttgttagactatcgctaaaatggagcttctttgtcggtgtttgcgtcacattttccgcgacttcgtccagggagtggaagtgcattttatgggcacggcaattgcccatttcctcaattgtttgattggctccggcaaaaacgtcagtcagatttcgcaatttgacaacgaccaaacaaatggtgtggccctgaagaagtcaactggagctagaaaaaagcggagatacggctatttcgataaaggaactgtcattggcgccggctcgggcccgacaccgaaaacgatggcatgggctaagctgagccaagagagcctatggaaaagcatcggcgacgattcgtacgcgcacttcggcctttgcattccttccgattggtatttccgttttgaatcgcttaatctgtccgttgccattggcattttctttccccgttcagttgtgacagtttcgtcgaatggagtggcggtgcccaacgctcggcgatcattcgtcgtttttgtttaatgaacggtgtccaaataatgctcaaggtcgcctttttgcttcatttattgtcggcattgtttgtcttcgcttttagaattatcagctcaacccattaaagtccaagtcacaagcgcctttttctgaggacgacattttcaatgtgttccccgtaataaaacgtcttaatccgcgttcccaaagtgcctacaacctttatctgagtgctctcatcaaaatgcagcaagggttcatccgtactggctacgatttgatgcagcaggtgtcgcttttgtctttatgattcaatgatttacctctgttcccaggcccacagcatgatgaatagcatttacggacccctccatcccgatttggccttgtgccttcgttttatggcgcgtatggca

SEQ ID NO: 85073 - DNA, 2386 bp, Heterodera glycines
  Genomic contig location: Contig_ID=SeqID_20267; Location=851..3236; Strand=-
  SCN-specific regions: Sequence locations=1-305,339-555,577-1081,1104 -1146,1168-1426,1448-1753,1776-2179,2219-2291,2313-2386
  Gene Ontology: Mol. function=caspase activity; Cellular component =intracellular; Biological process=activation of NF-kappaB-inducing kinase
aaaccagtgaaaacaaactcatttacaggcagaggtttccagcagctcggcttcaaaacggtcacacttggcgacctaaacttggaggaaatgcgtgccatggtttgcgaataccgcaagctgttgggcgaaggcgtttacggtatgtatatggtatccaagggacggacccctgggggggggggggtcccaatgatccatccaaatttttaaggcaaaaatagtatgttgtgttgaaatttttcggttttccttatttgtaccccctccaagactccctcacccaaactttcaaaaaaaaattcgctaaattttttcaaaaatcaaaattaaaaagtcgtcgtccttgaggcggaaccccctctaatttaggcagaaatcctggaaccgtccctggtcgtaccacgcaaacaatcatttcttgctatatcaaatcagttaagccgtgttttactttgtcggccacggctttgaggcgaatggtcagtgctatttgctgccaatcggagcgcccggcgaagactatgggcccgagcattgcctcagcatggattgggttggttggtctttcgtttgctgtgcattccattgcatttggccaaagtgctgcaattccccctcaggtgatgggccaattccgcgacttccaacccgcgctcaacctcattctgttggacatctgccgcaaatttttgccctccaatttggtcgcttttaccgcttacgcggaggaattacgacgcggcgaagtgcgcgtcaatcggaacaccgtttatggtgggaaattggcggcaagaaaggcattgaaaatccgttaaaagtgacaaatatttccccattttattttttcggttcccttaattcgtttttccgtcgttcaaatcgctttttcgaattcccttaggctacgcgaccagcggcggtgtcggcgcgtatgaggtgaagggcgagcagaacggcgtgttcatgaagtatttgaagcgacgcattcagcagcccattccattgctggacatgctcaacaaagtgttccggggtgagcggaggttggggattattatgacaaatccggattaacaataagcattttcaggagacttttttaattgatgcgatttgtcaaaaatggcaaaaaaaatcccattttttaagttagaagcagaaaaagccattgttggtgcactctaatgaccatttttgaacagagaaaaatatttttctgatccatttccgatgttgaacgtgacccaaaggtccgcgacgtccaaattcccgaattgcgctccaatttgacaaagtcgcgctcgctgcacgacccgttggtgtacgatgggcacacgacgtcgtacgaccaccacacttatcactggcggacaatgcacggcaagcggaattgaagcatttattactaatatatgtacaaataatatttcttctgtgtccaatttgcccttttggccctgtaattagtgtcctaaatttgcagaacttccgatgccggtcaccgtcgacttcgctgaactcggactccaagtgacaatttggttcgacttctgtggccatttcaccaacaaggcacgtttttggacaatttcttccgtatttactccaaacggattgacggggttaattggatctttttggagagagtttgatttaattgtatcccaaattttgtgccgatagccttggagttttcgttggtttgccaactttagccaattcatttgccacttgagatgcctttctgttggcaggtgtacgtgttcagcagtgtggacgacatgtcaacacaaagtgaagaaatcggttgtgaccagcagcgagggaatggcacaattgcgcgacgattgtcaagtgacggtgccaaaacgcactcgcaatgggcgctggcacatttgaagttccccgaggtgattactttcgcacaacaattgcaacatttttgtatctgtcgtcttgggttggcacttttctgcccttctcgaaaatgttttttcggaaattcgctaattaatcatttgttttgcatttttatccaataatgtccgaatccatcgaaatttttttgttttatgtctttttaaggaatttgaatcatcgaggcccaaactttgtgaggacgaagtcgaaggcgtttctctctgtgtgctcctttcccatcttcagagggccacggtacagtgtatttatttgctttgttttttaaaacaaaaagtctgaaaacgaatttccatttgtccgattttgccttaagaatgaaatcgtttgcaccgtcgaattgcgagagacagaaagtgccgacgacggagaagccaaattagtggccaaaagagagcggcaaatccttggccacgttctgatcactcggcttgggttggccaga

SEQ ID NO: 85074 - DNA, 479 bp, Heterodera glycines
  Genomic contig location: Contig_ID=SeqID_20268; Location=197..675; Strand=-
  SCN-specific regions: Sequence locations=1-295,361-416,442-479
  Gene Ontology: Mol. function=neutral amino acid transporter activity; Cellular component=integral to membrane; Biological process=transport
atgggccgttggagtgccacggcttttgtgacaaatgccatcatcggctccggaattttcatcactcccaccggcattctgaacaatgtccaagcggtgggcgcttcgctggtcgtttggctgctttccggactaatttcggtggtcggtgccttctgctacgtggagttgggcacttcaattaaggtaagtgtctgtgtgtgccgtgccattcattttgctatacttcgcaattttttttacctattttgtccgagaattttattaattacataatacaaaattgttcaaaaactcttttcttttccattttaatttttcactcattttccttttcctttctcttttctgctattatttggtgcatatttgcatattttagggtccttttgctctctgattgttttggtgtgcattattaatacataaatatatatttttgtccattttattagtctttttcgaatgaaaataataaa

SEQ ID NO: 85075 - DNA, 944 bp, Heterodera glycines
  Genomic contig location: Contig_ID=SeqID_20268; Location=1229..2172; Strand=+
  SCN-specific regions: Sequence locations=1-563,619-767,812-890,912-944
atgcttcgaatatttttccgcattatttttgccacgttaattttcgcgaaaattcgtgccgaatgggaaattcccgacgaattgcgcccaccccaatttcttacagtaattaaaaatggcttccaatcggcggtttatttcacggagaatggccaaaactctgtcgatgaagcgacaacaaatcagcaatggcttttccaaaggcttttggaatttgcagatgaaaacaaaatgccaacaatggcaaaaagaaaaggaggcgcaaatttggaaggaaatggcatttaccgagagcatacagtctcgagcaattggcatacgctaattgacaaaatcaacggaaaaagcggcgacgttttggatggatgcgaaggcattagcgaattaattattcacatttaaatttaatcattattagggatcggatttaattgctttaaatcgcaaaacaggtacttaaaaaaagtaccaaaaaagttcaaaataagcgcttttttaatttttttgcatttttcatgagaaaaaatagagtaaaaagtaaaaatccgattcataatgattagaattttaaatatattttaagacattaatacttttacatttaataaatattttttagttcttttacaatcatccgaaagaattgagtttgaaattggggtaggaaatgtgacgatcggatgcatcaacaaaaatttcgatttatcaatttctccattaaatgtttatttctgcaaaaatggcacagaatgccaacgatcaaagtgaaaattaaattaacaatttaattaatgaaatgatatttaaatttcaggaaaaaattgacaaattgcgcaattattgtgcaaccagcagaaggaaattggacgaattatgaccagcagcaggagaaaaggcattttgaattttttggaatatcaccaaccgaaaataatgaaatttaa

SEQ ID NO: 85076 - DNA, 1071 bp, Heterodera glycines
  Genomic contig location: Contig_ID=SeqID_20274; Location=1..1071; Strand=+
  SCN-specific regions: Sequence locations=1-83,116-247,269-734,777 -795,817-835,873-1071
  Gene Ontology: Mol. function=N-acetyltransferase activity; Cellular component=nucleus
ggtctcttttaattaatttttgcttttcacaggtattacgtcaacagagactcgctcttctcatttcacaaggcggcagaggtattattcattttttggaatttaagaacattttgggcattttcaacaacaaaaagccgaaaccgattcttattattagaaaagttgtaaggaaatatcatgaaaaaattttttaattcatcacaaaatttcaacgaaaaagaaatcggttttataaatttgaccgaaaatttaaaacaaaaaattcaggaaggaaacaaccgaaacgggggggggtgaagagctctgttcccataaaagtgccaaaatctgttaaaattagccatttccaacaagggaatgaaaatgtcaacctcccaccacctcttgatgaaaagtgccattaaaatgaaactctttttttccatttccaggtgttcttggccaatctgatgtccatttacgcggtacgttttggcatttactccaaaaattttatgttatttttgccattaattttcctctttcatatttttggccgcccattacaaaaacagtccggacgacctgcaaatgttggccgacgcgccggcacatcacctttttgtgctgatggcacccgtgccggctgaccaaagctccgtgccacaggcaaatatttgtggataaattggcatttaattcgtccacactccatcaccgaaaatgaaatccaagaattatcgaacatattcaaaatttaaaaaaaaaatttaaatttttgaataaaattaaatgagtgatgatgaagcgttaaattttatgaaaaattctctaccttttcagaattttctacatttttttattaattgtaatttagaaaatttatttttcccggttcgggaaatgacaaaaaatgattaaaaaatcaaatttatctacttccattcatccattttcagattttggcggttgtccaacagtgcctggagggctccatctctaaacaaagtgtgacaaatgtacgggacaaaggcaaaaagcgggcggccggtgacctcatcccgtggacactttgccaacactttttgg

SEQ ID NO: 85077 - DNA, 1183 bp, Heterodera glycines
  Genomic contig location: Contig_ID=SeqID_20275; Location=154..1336; Strand=-
  SCN-specific regions: Sequence locations=1-128,153-717,739-921,990 -1048,1070-1183
atgccattctcagacttcgatggccgtgccatgcaaattgatttcctccgttcaaatggtccgtcttttttgtctgattatgccgacctttggcttcttggacttgacatgctgccaatggcacaccaaacagaagagcaaagagaacagctgaagatgaatctgttcatcagccgcagctccaaatgctccatggaagcatgggtcgaaaaacaatccgaccagaagggacccgtattttagggatttgtctaacaattaattttatttttttctgggctttatggaaatctaatatttcgtaactattttcccattttagttatttgatcaaattcaattcctttaagtttatccaaccttcgcattcccttgtgccacccgatccgaaaatgccattcgacggttcggtgtgcaaaccgaatccgacggaagaagaatatgaacggtagtaaaacttcaaaatgtgatttgacatttttgtgacgaccgcaatttaagtacatgaaaattttaaaaaaatatttcatcttttcaaattggatccaggcttttcccgaaaaaagttgacaaatatgtgttcacgacaggcgttcatgtgcaggattgggcaatcaaatggtactttttatgaacaagtcgggatttccgataacagatttcaaaaaaacaattaaggaatgaatgattttatgactggtccaaaaatttaaaatccagcccccagggcaaagaaatttgattttgagctttaatgaatttggttgcatttttagttccgttttgccgcattgtacggaattggaaaaccttatggacggaagccgatttacaaggacagtcacaaatgcacaacacacgatcatggaatagaagaaggcgagcagaaggagcagcttttcccgatcttcgccagccaagaaaaatattttgtaatttaattaattaattttaatcatttatttatttttttttaataatttaaaattcattcagaatccgaaagggaaggaagcaaaatgaaactttttatgtggagaatgtattcattgaatgtttatcatatgtgaacctacaaaagttggcattgtgttttttgattaatttcaattaattttgtttaagtttttctatttcgagaatcaagcagaaatatttggaattggatgtgattattaataaa

SEQ ID NO: 85078 - DNA, 1155 bp, Heterodera glycines
  Genomic contig location: Contig_ID=SeqID_3536; Location=257..1411; Strand=-
  SCN-specific regions: Sequence locations=1-290,313-314,336-339,361 -481,503-551,584-702,725-789,812-822,845-893,926-936,959-1123,1146 -1155
atgagaaagaacaaaaagagtaagagatataacgatgaaaaagtaacacaaaaagtgtgcggtgcatacattaaaaaaaagtgtggggcgggagagaatcgaccaaatttttgcgaagggtccgccgggggggggggggtcaatggccaaatttacgaagcgccaaaagtgcccttttaattccttttttattttgtttttaatttgcttctcccattaattatttttggccatttttacgtaagaatttattctgagaaaattatgagattgaagccgaaaatggacatttatttcatttattttcccatgcgtttaattacattatttaattttcgattcttttgtctgccattttcactgattattggacatttaattaaaacggcaaaggcattaattaccgaaatggcacaattgctaaggaaattattattaattgtaagtcactttgagaaccaaaaacgatggcacttaggtgattttataatttgtaaatagcattttattaaccgtagatgataaatgatcactggtacaaaaaaagaaacttttttttaaattttaatatgtaaaattttttggacaaaataattggaaaataatccgacaaaaaaaatcattttcagacagaaacgttttgttgaagtgaaaatcgcaattttaatgagcagaaattacaaaggcacaacgcaaaatggcgaatgattaacaaaataatggaaaaagtcattggaccctaacgaaaatatttttgccttttccttttcatccgtaaatttttccatgtttaaaaagggaagtaaaattgaagacgagacgaaagtgatcagctttttctgtccgttggtttatctttcggctacaaaaaacagatggacattttaagccagacgaacggacggacgaacgaaaggacgaatgatgagacagcggaagaaagggggaaaggagggggattatgccaaagtgggaaagtgcaacggggagaggaatgccattggcactttgggagagtgcgcaatgggaggggggggggggtaataatgagaacaaaagtgcggcattccattcgctgtgccttcggccgatgcctacaaaagaacggaatgcacttgaaaaaggaggaaaatgagaaagaaaggcttaaataaa

SEQ ID NO: 85079 - DNA, 1143 bp, Heterodera glycines
  Genomic contig location: Contig_ID=SeqID_20278; Location=165..1307; Strand=+
  SCN-specific regions: Sequence locations=1-131,154-249,272-642,664 -851,890-1143
atgtcaacttttaaccgacaaattgagcaggaacaggacaaaagtggcaaactgataatggaagtcgaacggaggtaatgccgacaatggacagactcattttctgaacgcatttcgacactaaatccggattcttttttaaattttgttttagagtaatcactaaagcctctcccgaccgactgctccaacaacttttggtgggcgatgaaaatgccgtgggttcggaagaagtgccgtccgactcgcattttgtggaggactttttgctgatgcacagagtgtttttccgcgactctgcccaaattgtgcgccaattgctccgttggttccgcgcggagcccaaccgccgagaccgagtggcgcggataatgctcatttggttgaacaaccatttcgaggactttgaagggggacagagcggcagacaaatggccgaactgttggacgaatttgacgaagtaacagtggtggtgctaataaactgatcaattaagagagaattttttaattaaaggcaattaggcgtatatttttaatctctttcagctgttggccagcgcaaagatgttcaatcaccaaagccttctcagcataaccgtcagtgtgaaatcgcaggcccgaatggtctgacgaattaacgaaaatatttgtggcaacaagtttgcttgtttagataattttgacgaggtcggacagagctgaaaaactcgacttccaactgattggcaggaataatggcattttcgtgatgaatgtcgacgcaaattcggctgcggaaaaggccggcatcaaacgatgggacgaggtgataggtgtaaaaccatggatatgctgctgaattcagcgaattttttggaatgaattattattcaaaaaataataatagggacaacgactctctgtccggtctaatgaacgctaatattcaacgatttgttcagcttttggagatcaatggccaactttgccgctgcatgagcctttcgaaagcattggatttgctgagagaaagcacccatttgagcatcagcgtcaaaaccaattggattgggttcaaggtgggcaaaggcgcaagggcaattaatcgttaatcatttcgatcattaccttcaaaataactcgagaaaatcacaaaggaca

SEQ ID NO: 85080 - DNA, 515 bp, Heterodera glycines
  Genomic contig location: Contig_ID=SeqID_20279; Location=799..1313; Strand=-
  SCN-specific regions: Sequence locations=1-109,133-323,416-420
atgactttgcttaaaatgcttaatgccctcattcatttatcggttgcttttatgatcaatgggcagtgcgtgatcagtgttttctgatcaccgcttcctcccattgtttttggcttttcctcccccttttgctcacttgcgcctctttaacaattcgcaggtccaacatttgcgacttggcactcggtgaacagaatgccaattcggctgacaaaacactgccctttcggcccgaatttgccaaaagtccgttgggcaaaaaatgatcagacgacgccgaaacagaagcagaagtggaagcaactacagaagaagcgaaggggaaatgaaaaatgaattaaaaaataaacaaaattagcaaaattaataaaaatgcaaaaacaaaattaaaaatatattttaaaattaagaataatttggttaatatttaaaaataaactattaattatttcagataatagttaaatagtaattttaattggattaattaaatttattgttttaattaaaataaa

SEQ ID NO: 85081 - DNA, 2261 bp, Heterodera glycines
  Genomic contig location: Contig_ID=SeqID_20279; Location=288..2548; Strand=+
  SCN-specific regions: Sequence locations=1-215,237-504,607-611,704 -894,918-1643,1665-1805,1828-1884,1907-1980,2017-2046,2068-2261
ccgcagccgttgccgttggccaaaaatggcaaaaatggtggagattttttggtcaaaggagcggcagaaaatggcaaaataacgacgaacaaaggcatcatgaacagttgtggcgaatccgtcgatgaacagcacacggcggcattcgattttcgccatttttccgccatggaaaaagggcacagagtgggcaattaacggactaattgattgtcagcgcaaattaattaattaatcgctgtctaatggacatcgattatccattaattaattgatgtttcgctgtactcttaagcgccaaaaatattgaatgtttcattttcgtaattagaaaatggaaattattctaaattattcccaaaggtctgtaaattgttcgtgctgaaaaagttcgacgtttcctttcgccacctttggctcaatttgcacactcatcagcttgtactcaccaaattggcaagcagttcagcctcaaatgatgagcccggtccgacaatttaatggattttattttattttaattaaaacaataaatttaattaatccaattaaaattactatttaactattatctgaaataattaatagtttatttttaaatattaaccaaattattcttaattttaaaatatatttttaattttgtttttgcatttttattaattttgctaattttgtttattttttaattcatttttcatttccccttcgcttcttctgtagttgcttccacttctgcttctgtttcggcgtcgtctgatcattttttgcccaacggacttttggcaaattcgggccgaaagggcagtgttttgtcagccgaattggcattctgttcaccgagtgccaagtcgcaaatgttggacctgcgaattgttaaagaggcgcaagtgagcaaaagggggaggaaaagccaaaaacaatgggaggaagcggtgatcagaaaacactgatcacgcactgcccattgatcataaaagcaaccgataaatgaatgagggcattaagcattttaagcaaagtcattggggatataagatgaagagaatttggcagagattggcttgaacattctaatcatttgatcatggcattcctaatcagttgatgccattcaaattcaattggctggctctcttatgcttttggctatcctttcgaaagctggtttttgaggtgctgagcaaagccattggcacgatgcaaatcgcggagaaatggcgccgggacacttcgctgcagactttcgacccggaactgattctgatcatccaatggggcaccgcttttgtgctcaactcgtggcttattctgtgtaagccgacctgagaaaagtgcgccatttgatcatcgggcgtctgtctgatcagaataccgaccttttgaccagtgtgcccaatgatttcttacatctttttccatatcatttggctaaaatgccaattgcttccgttttgcgttcagtcaacacaaaagaggcctgccagctgtggtgccgtgggctgcagcagctgtgtgccgtcggcgatccttcttctgatcagtcgcatgcactcgtcgtggagcggtggctgcgcaaaagggtatcatttcttgatcaatctcgatcagtttcaaatttaaaaatgaatttcaatttggaattttgcttttcagttccttgccctgcttccccatccgacaagtgccgcgtcggtgaacatcaaacacatgaagccgtttgtgcagcaacggctgcagtgcaaagtgagcagcaaacaattgcaggagatcgccgaggtgggcaattaaaaatggataaatgattaattaaaagtgaatcagtgggtaatttaatagggaaaatgaccaaaagcaaaatgaaataatttaattcaaactaagaattaaaaattaggaaaataaattagctcacagttttaagagggtgaaatattaattaaatgatagcacgtcaattaaattgctccaattaacggattataaatgtttaaaattaaacaactttaaataatcaaatattatctgatcatctgatcactgatcacaatttttcttttccttcaatgctttttctcctttgtgcccagggcgaaatgggcttcgaggcctttgtgctggcacataatcggctgctgaacttccacgcgttgttcgactgtatgttcagcgagtacgcggacactgaacacgcgcaattggtgccctttcaacgctttgtcgactttttacgagacattcagcacgacgggctgggacag

SEQ ID NO: 85082 - DNA, 513 bp, Heterodera glycines
  Genomic contig location: Contig_ID=SeqID_20284; Location=883..1395; Strand=-
  SCN-specific regions: Sequence locations=1-513
atgctacgaggcaaaaccgtggcgcaaattgcagaagaatgtggacggattcgtgggatttgtgccaaattcaaacatgttcattttgtttggttgccaccaccgtacgtccgagagcagcacaccctgtacaatgaactgctgccgatcctggaaacagtcgctggcgaatggttcatcgcgctaacaacgagcggaagaagtctggtggagatgtggcgattcggcgagactttcgatatgacacggattcgttcggatgggaaaattttgtctgagggattgaaatgttttcgcgcttggattgtcacccaaatcccaaatttccccgatgataatgctcttggttttcgtcgttcatctcgctcagttccatctgtatctgatcacatctctgaattgtctctcagtcattctcgcacttctcgatctcacccctatgctgttcgtcaccattatagctcgcaggctcacagaggcggaaacgagatgatcagccgtcgtcgtcattaa

SEQ ID NO: 85083 - DNA, 805 bp, Heterodera glycines
  Genomic contig location: Contig_ID=SeqID_20285; Location=312..1116; Strand=-
  SCN-specific regions: Sequence locations=1-80,102-177,200-345,390-805
atgagctcaagcacaccgaacacatcactcataacttgggacatcaattcagaccaaagtaacggcaaaatgacatcacaattaaagaatataaaacttgggaattagtttctcgacttgggcctggatttttcctggaccaggcccagggtcaaggccattttgtgggaatctgagtttttggtttttatgggtttttcgtcaggtctaggtcaatctggaaatccaggcctaggtccagttccaacagaacctaggttcaggttttttcaaaatgtcgagctcagtttaaaatcgttaaaacgcttaactccgtgccattcacttagaaagacaaaaaacgcgatttaataattaaaaaaaataatttacaaaataataaaataaaacacaaaaatcttctctctcactttttagacaatctttgcccttcttttgcactgtccgatgatggaaatgaattggaaagattggaggcccagcgaaaagcaattaatgcaaaaatagcagtggaatttgcgcgtcaacaaatgataatggagggcaacgaagcgactccaaagtcaaaaggcaatttggaagcattgacaaacaataagaaaaattttattcctaaatattttaatagcctaatttaggggcgtagaatcctaatatagctaacctataataattttgatgatttgatgtgggtcaataatgcttttttgagatgctgatttacttattttaagaaatttattgattttgctgttttttgaaaaaaatcccccaaaatggccaattttcagttaaatctattaaa

SEQ ID NO: 85084 - DNA, 94 bp, Heterodera glycines
  Genomic contig location: Contig_ID=SeqID_20286; Location=1141..1234; Strand=+
  SCN-specific regions: Sequence locations=1-94
atgaacaagcaacgtttaccatctgagctgatttgcgaaatcatcgccacaatcccgcttatgtacctatttggaggaatttctaagaaaccag

SEQ ID NO: 85085 - DNA, 211 bp, Heterodera glycines
  Genomic contig location: Contig_ID=SeqID_20287; Location=760..970; Strand=-
  SCN-specific regions: Sequence locations=1-167,190-211
atgattcgctgcccaattattctgcttctcctttttgtcagcattttgccatttaattgtgccgtcgacggaatggcgggcgacgctttggccactgttgtcactctgagcattggccaatcggatggaactagcggaacggcacaagcgaagaagcaattggacaaggaggaagaagcagtggaggaggcaaaaagcggagaaacaatca

SEQ ID NO: 85086 - DNA, 1129 bp, Heterodera glycines
  Genomic contig location: Contig_ID=SeqID_20287; Location=1581..2709; Strand=+
  SCN-specific regions: Sequence locations=1-188,211-216,248-435,470 -608,630-730,752-824,848-886,943-1014,1036-1061,1102-1129
atgaaattggcgtttgttcgtttgaatgttcttacggtactttgtctgttctgttcaatgagtcattcctacggtaatccatccgacgaatccgatgacgaaatttgcgaggaagaagaaaatgaagcacaatcagaagcagaagaagcggacgaattttttcataattttaacggcacaattcaaagtgaaagagaggagaaaagaacggtgaaattttaattgaaaaggattttattaattttaaatgattgcctaattaatgaccatttatttgcaagcgcaggttgtcgaaatattttgccgaaatacaaatgacaaatttcaattttccaccgacgacgaggggaatttcaaaattcaaatggaagcgaaaatcaaatggaaatttcacaaatgcaccaccggactgagaatggcattttacaagaaaaaagtgatggaaaacaaagtaagacaaactgaaaacagacaaattgacaagcgaaaagaccaaatgaccacaaatagagcaaaatatgcctataacattcataatttgcttcaaaaatttgttgtttttcaggtgccaaaatgtttgcccattattttgcggagtccaaaacggaaattaaaaaatgcaaaaagattggatatttgtgttgtcccaattcgcatcaaatggcttaaatttggcccaaaaataaatgcagaagaagccgaaaccgaagaaaatgacgaaattttgagaaatgaatttgcattggattttgatgtggaaaagaacgcgcaaatgaacggacaaattagaaattgcagtgatttacattctgctgaacacaattttgaaatgattttcaacaaatatttcgatgatggaaaaagtaattacctaattataattagcaatttattataattattaaacataaaattaattaataattgtttatgtaattaaaaggtgttgacgaagagggacaatcatcgaaaagtaaggaaaatgggcacaaagtgacagaaaagtaattaaaagggcaattaaaaagagggaaaagcaacggaattgacaaagcgaaagcatttaataaaatttgaataataatttatatttttatttttcagcttaaaatgaggccgaaccgtcgca

SEQ ID NO: 85087 - DNA, 648 bp, Heterodera glycines
  Genomic contig location: Contig_ID=SeqID_20288; Location=273..920; Strand=+
  SCN-specific regions: Sequence locations=1-138,161-164,354-574,640-648
atggcacgtgcctttggcattaatttattacaaaaaaaaatttcttatgcattaatttacatgcgatgggtaaggggccaaatttgcctttttgggatcttaaagatgtgccaataattgatttggcaacaaaagctattcctagtaatgctaataaaaatgcgaaattaattaaaatatttcatttaaaaattaattttatttttttatgcttaaaaaaattttattttaaaaatgtaaattaattttataattaaaacagtaacatatataaaatattttaaatataaaaataattaaaattgacaaaaaatattgaattatgataatataaaaaatttttgaataaattagcctaattttactaataacaaaactaaaccactcatgtgccatttgattagaatttttagatgttttttggtcattccgtcatccttttttgcttcatagcaaatttgtattccttttattcatcggcggatgaagttgttaagtgtccaatttgtcaggaagaatttggaggaaacgcgcaagagaagcttctttatgattgcaatgtgagctaataggtttaataattaattaattaattaggtcaattaaatcataattaatttttaaattccttaaaattaaaatattaaa

SEQ ID NO: 85088 - DNA, 4371 bp, Heterodera glycines
  Genomic contig location: Contig_ID=SeqID_3540; Location=961..5331; Strand=-
  SCN-specific regions: Sequence locations=1-39,76-125,169-370,399 -414,441-452,476-480,502-567,590-831,853-896,918-1172,1216-1300,1325 -1506,1534-1554,1586-1613,1636-1675,1697-2303,2325-2437,2464 -2496,2518-2813,2835-2956,...
  SCN-specific regions: Sequence locations=...2997-3030,3052-3336,3371 -3623,3645-3839,3872-3887,3909-4066,4088-4184,4211-4246,4272 -4290,4362-4371
atgtccggaactattagaacccgaattcctattttggttaaaagtttgaaaaataaaattgaaaaatattatgaacaaatagaacaagggaaatatgaatttgattccaatgatttacctggttgtttaaaattatatgaatttattaaaaaagaaatatttaattttgaaaaaacgtttgatagtttaatagaattggataaaaaatggaaaaagatacgaaacaaattaaatactgaagataaaaatgctgagataaaaatatataaaatttacacagaaaaacatgactatttaaaaattttagaagaagcggatagtgttatcgatgaattaaagtcgcttaacttagaggtaaagaaagctattcaaaatttaaaaagaaataagaaaaataattcaggggatcaacacgaagatgaaaatgatgatgatgacgaaccaaatgatgaacaaaacacagaagaagaattaactgataaagaagaaaaagaaactggtactgatcaaacaaatgattccgaaattaaatctgatttaaattcatatgaatattcaaatttttcttcaaataatcatagaataaaaataaaattaccagcacaatccttaacccattttaatggcaaatattcaaattggacatctttttgggatgattataaatcatcaattcataatgataaagaattagaaaatattcaaaaatttaaatatttgagaggattgctccatgatgagccatatagaatgataagtccatatcccataacaaatcaaaactatccaattgtaattgaattattaaaatccagatatggaaatgaaaatctcttaagagaaaatttgcataatgaattacgtaatttacgaaagccatcagaatcaatatctgatttaagaaaattcattttatccataaaccgaataattttacaacttcaaacatacaaagaagatataaatcatcctcaaattaagcaatcaattgaaacaaaattgccaaataatataaggatcaaagtccgtgaacaacttggcaccttcaatacaaaaaaattaatgaatttcttagaccaatatacgcaggcaagagaagaagttcaaaatattgaggaaattgataaaatgaatcacaatgcttatagcaataaaccacaatttcgcaatggaaattttaataaaaataattattcaaaacaatataaaaattttcgaattaatggaaattttcaaaacaatccattaaataataatcactcatttccaacatcagcattaacaactcaatctaaaccagttttaaatataaattataataaaacaacagaccaaaaatcaaatgaaataaaattgttttgtaatttttgcgaaaaaacaaatcacaaatcaaaagattgtaaaatttatccagacatagaaacacgaaatagcagaaggcgcgaattaaaattatgttttaattgtttaaaaaagggacatcacgtgaaagaatgtaaatcaccatatacatgcttttattgtaaaaataaacataatagtctcctttgtctaaagaaaaaacaaaataataatgagaaacaaattagaccaaatcaaacccgtactaatctaattaatgaagaaaaattatatgaaacccaaactttttcaattacaaagcaatttgaaaaggaagaaattgaagaaatattaatgacaattgaagcaccaattataaatattaatgataatactgaattaaattcaataattttattcgacaatggttcgcaaaaaagttatataacaatggaacttgctaaaaaattaaatcttccaataatatctaaaaaaacattagcactttctacattcaacgaaacaaaacccaaaattattgaaagccaaattgttcagattggcattaaaactctagatgggtcttatgaaaccgttaccctacaaacaattgacaaaataactgatttaataaacgtaaatctacaaaaaacaattgatttcggcagaagtaaaatgccaattggattaagaattccacatattctaataggaattgatcattattggcaatttatgttatctgattcaaaaatcagatcgttaccatcaggatttttccgaatttctactaaaattggtgatatttgttccggaaaaggaacagtagaaataacaaaaactaattatgcttccgtaaaacaacaagaaaaagaagaattaaataaaactatacaaaaattctggaatttagaaagtataggaatatccgactcaccttctttaaacgatgatgatttatcagttatacattttaataaaacagtaaaatttgaaaataataggtacatcgtccgatggccatttaaacaagaacaaccggaaattccaacaaattttggtttatgttttggtcgattaaaaggagtacttaaacaattaataaaaaataaaaaattattagagtatgacgagatattacaaaaccaattagaaatggaagttaatgaaattgtaccatttgaatccagttatttaactcattatttggcacatcatccagtcattaaagaaagttcgaatacgacaaaaattagaccagtatttgatgcttcagctaaattacgaggcaatcattctctcaatgatgaaatatttcaaggtccaaagaaaatgccagatttatgtggaatgataatgagatttagacttaaaaaatatgtattaattggagatatagaaaaagcctttctacaaatcggattagatattctcgatagagatactaccagatttttatggattaagaatgaattattaaatgaattaaataaatccaaccgagaaattgaaatgaaagacgttgaaattagaagatttacaagaataccatttggcgtaaatgcgtcaccatttttactggcagcagtaattgaattacatctatcaaaaatagatgaaatgtatgaaaattttaaaaacataaatacaaatgacatcgaattagacttagaggataaaaaagaaaaatttggaaaattatgtaaagaattaacagaaaatgcatatgtagacaattttgtaatgatgtgtgaagatcaaaatgaaataaaatttaagcattattggagtaaagaaattttcaaatttgcgtcaatgaacttacgagagtttatttcaaatcatgaagaatctaataatgaaattcagaaaattgaaggctctgaaatgccaaaaataagcaagcttcttggaataaaatggaacgtagaaaatgatgaactaacaataccaataaaaattccaactatttcaattggaacaactaaaagaaatgtaattcatttaattgcaaaaaattttgatccaatgggatggatttcacccgtaattttgccacataaaagattctttcaaaacttatggaaatctaaaaaagattgggatgaccaacttagtaatgaagaaataaaaaactggaatgaaataacttatgaagaggaaattcatttaagacgttttccatttaacaattctttaattcaaccagttgaactgcacattttttctgacgcttcaggttcagcctatgcatccacagcctacttgaaattaattgaatcaaatgaaatatatttaatttttgctaaaacaagattagcaccagtaaaagaattaactattccaaaattagaactattagccttattaattggtacaagaattgctaaatttattataaatgaaaccaaaattaaaatacaaaatacttatttatggtcagattctaaatgtgttctaagttggcttaaatataaaaaagaattgcctacatttgtaaaaaatagagttaatgaaataaaaaatgcaacaatagtttttaatttaaaatttcactatataaaatcaaaagaaaatccagcagatattgcatcccgagggatgactgtatctgagataaaaaattctgatttatggtggtatggcccaaattggctaaaattaccaattgataaatggccatataaacaattagaagattttactcctgaagaaataaatgaagagtttaatgaagaattagaaattcaattaacaaaatcaaatttgactacaaatccaattaaaccatttatcaaatgggaagattacagttcatggacgaaattaataaattattgctgaaaatattaatatttaaaaataaattgttgctgaaaatattattataagataataaacatggtttatttttagatttacagcaaaatgatataagagatgaagaagtaaataaataaatattttaacatataatttttaaaacaaaattataaaaaattattaattttatattatatggaaaataaa

SEQ ID NO: 85089 - DNA, 4810 bp, Heterodera glycines
  Genomic contig location: Contig_ID=SeqID_3540; Location=1329..6138; Strand=-
  SCN-specific regions: Sequence locations=1-277,309-484,518-700,722 -846,883-932,976-1061,1083-1177,1206-1221,1248-1259,1283-1287,1309 -1374,1397-1638,1660-1703,1725-1979,2023-2107,2132-2139,2163 -2178,2200-2313,2341-2361,...
  SCN-specific regions: Sequence locations=...2393-2420,2443-2482,2504 -3110,3132-3244,3271-3303,3325-3620,3642-3763,3804-3837,3859 -4143,4178-4430,4452-4646,4679-4694,4716-4810
ggacaaccatactcatcacccaagttagttgattggacaacagaaatcagctgtattcctccgaaagacatataaaatcccgctagaagacgaaccgtccactagtgcgaacaatttggagaaaaaagattgattttttttgacattatttgaaggcgatcagataccaagatttttgatcactattgttgatactgtgatcgtattgttaataaaaaaaaaaatttccaaataaacgtcaaactgtgtcggccaaagaaactaatttctgaactggaaaaggaagaagaaaattttgaaaattttgatcaattggaagaaattattgaagaagttgaagaatttgtacctattgtagaaattccggttttaacacccgaagaaattgttaccgagcttgaaagaagggcaaactttccctttccaatagtgcatatttacccaggaatttccaaattaacgaaccaaattttaaaaactgaacccttcacataccaaaacaaaaccgtatataaattcactttgacaataactatttttccatactgcattttagataacctagataaagccgattctttggaaagaatatcacaggaagtaattttagaagcttacttaaaagtaagagaaacactcaactctaaccctgaaaaacgactgaaatttgtcaaattcattctaaaagttttatcaagagaaagaaaaagtttattaaaaaagtggagaagatctgaaagaagtatagtattacaccctattaattcattagtccacaaagagtatataatttaaaaacttacgaaaatgtccggaactattagaacccgaattcctattttggttaaaagtttgaaaaataaaattgaaaaatattatgaacaaatagaacaagggaaatatgaatttgattccaatgatttacctggttgtttaaaattatatgaatttattaaaaaagaaatatttaattttgaaaaaacgtttgatagtttaatagaattggataaaaaatggaaaaagatacgaaacaaattaaatactgaagataaaaatgctgagataaaaatatataaaatttacacagaaaaacatgactatttaaaaattttagaagaagcggatagtgttatcgatgaattaaagtcgcttaacttagaggtaaagaaagctattcaaaatttaaaaagaaataagaaaaataattcaggggatcaacacgaagatgaaaatgatgatgatgacgaaccaaatgatgaacaaaacacagaagaagaattaactgataaagaagaaaaagaaactggtactgatcaaacaaatgattccgaaattaaatctgatttaaattcatatgaatattcaaatttttcttcaaataatcatagaataaaaataaaattaccagcacaatccttaacccattttaatggcaaatattcaaattggacatctttttgggatgattataaatcatcaattcataatgataaagaattagaaaatattcaaaaatttaaatatttgagaggattgctccatgatgagccatatagaatgataagtccatatcccataacaaatcaaaactatccaattgtaattgaattattaaaatccagatatggaaatgaaaatctcttaagagaaaatttgcataatgaattacgtaatttacgaaagccatcagaatcaatatctgatttaagaaaattcattttatccataaaccgaataattttacaacttcaaacatacaaagaagatataaatcatcctcaaattaagcaatcaattgaaacaaaattgccaaataatataaggatcaaagtccgtgaacaacttggcaccttcaatacaaaaaaattaatgaatttcttagaccaatatacgcaggcaagagaagaagttcaaaatattgaggaaattgataaaatgaatcacaatgcttatagcaataaaccacaatttcgcaatggaaattttaataaaaataattattcaaaacaatataaaaattttcgaattaatggaaattttcaaaacaatccattaaataataatcactcatttccaacatcagcattaacaactcaatctaaaccagttttaaatataaattataataaaacaacagaccaaaaatcaaatgaaataaaattgttttgtaatttttgcgaaaaaacaaatcacaaatcaaaagattgtaaaatttatccagacatagaaacacgaaatagcagaaggcgcgaattaaaattatgttttaattgtttaaaaaagggacatcacgtgaaagaatgtaaatcaccatatacatgcttttattgtaaaaataaacataatagtctcctttgtctaaagaaaaaacaaaataataatgagaaacaaattagaccaaatcaaacccgtactaatctaattaatgaagaaaaattatatgaaacccaaactttttcaattacaaagcaatttgaaaaggaagaaattgaagaaatattaatgacaattgaagcaccaattataaatattaatgataatactgaattaaattcaataattttattcgacaatggttcgcaaaaaagttatataacaatggaacttgctaaaaaattaaatcttccaataatatctaaaaaaacattagcactttctacattcaacgaaacaaaacccaaaattattgaaagccaaattgttcagattggcattaaaactctagatgggtcttatgaaaccgttaccctacaaacaattgacaaaataactgatttaataaacgtaaatctacaaaaaacaattgatttcggcagaagtaaaatgccaattggattaagaattccacatattctaataggaattgatcattattggcaatttatgttatctgattcaaaaatcagatcgttaccatcaggatttttccgaatttctactaaaattggtgatatttgttccggaaaaggaacagtagaaataacaaaaactaattatgcttccgtaaaacaacaagaaaaagaagaattaaataaaactatacaaaaattctggaatttagaaagtataggaatatccgactcaccttctttaaacgatgatgatttatcagttatacattttaataaaacagtaaaatttgaaaataataggtacatcgtccgatggccatttaaacaagaacaaccggaaattccaacaaattttggtttatgttttggtcgattaaaaggagtacttaaacaattaataaaaaataaaaaattattagagtatgacgagatattacaaaaccaattagaaatggaagttaatgaaattgtaccatttgaatccagttatttaactcattatttggcacatcatccagtcattaaagaaagttcgaatacgacaaaaattagaccagtatttgatgcttcagctaaattacgaggcaatcattctctcaatgatgaaatatttcaaggtccaaagaaaatgccagatttatgtggaatgataatgagatttagacttaaaaaatatgtattaattggagatatagaaaaagcctttctacaaatcggattagatattctcgatagagatactaccagatttttatggattaagaatgaattattaaatgaattaaataaatccaaccgagaaattgaaatgaaagacgttgaaattagaagatttacaagaataccatttggcgtaaatgcgtcaccatttttactggcagcagtaattgaattacatctatcaaaaatagatgaaatgtatgaaaattttaaaaacataaatacaaatgacatcgaattagacttagaggataaaaaagaaaaatttggaaaattatgtaaagaattaacagaaaatgcatatgtagacaattttgtaatgatgtgtgaagatcaaaatgaaataaaatttaagcattattggagtaaagaaattttcaaatttgcgtcaatgaacttacgagagtttatttcaaatcatgaagaatctaataatgaaattcagaaaattgaaggctctgaaatgccaaaaataagcaagcttcttggaataaaatggaacgtagaaaatgatgaactaacaataccaataaaaattccaactatttcaattggaacaactaaaagaaatgtaattcatttaattgcaaaaaattttgatccaatgggatggatttcacccgtaattttgccacataaaagattctttcaaaacttatggaaatctaaaaaagattgggatgaccaacttagtaatgaagaaataaaaaactggaatgaaataacttatgaagaggaaattcatttaagacgttttccatttaacaattctttaattcaaccagttgaactgcacattttttctgacgcttcaggttcagcctatgcatccacagcctacttgaaattaattgaatcaaatgaaatatatttaatttttgctaaaacaagattagcaccagtaaaagaattaactattccaaaattagaactattagccttattaattggtacaagaattgctaaatttattataaatgaaaccaaaattaaaatacaaaatacttatttatggtcagattctaaatgtgttctaagttggcttaaatataaaaaagaattgcctacatttgtaaaaaatagagttaatgaaataaaaaatgcaacaatagtttttaatttaaaatttcactatataaaatcaaaagaaaatccagcagatattgcatcccgagggatgactgtatctgagataaaaaattctgatttatggtggtatggcccaaattggctaaaat

SEQ ID NO: 85090 - DNA, 2103 bp, Heterodera glycines
  Genomic contig location: Contig_ID=SeqID_3541; Location=746..2848; Strand=-
  SCN-specific regions: Sequence locations=1-52,74-166,188-533,556 -596,618-781,803-1065,1097-1284,1306-1634,1671-1720,1764-1792,1814 -1849,1871-1965,1994-2007,2045-2056,2080-2103
tgaaaagaaaatcaactgaagagccaaaacccgacacggacacgaaacagtccaaacctgagcaaaaaccagcacaacagaaggaaggaaaatcagaagaaggtcaaaaaccgaaaactggtaaaaaaccagaatttttgttgaaaaaagcaaaacatcccagtagcatttctgtatctgaaagaaaagaggccagagtttactttaccaaaatttttgagcattctgaattgttcaaacgttcagacacttctgattctgaataaattttaattttgtagacacatcatccttgtcaaaggagactcaatttgtcttacaaaaactcagacaacaagaagcaatcgtacaggcaaaagaattgtcaaaagtaataagagaagttcaagcaacaatcaatttcaacaggaacactgaccttattagttattcacgagctttacagaaagcaagtcaaattcctgagcaggacgaagccactgacaatttgaacttccattcgaatttctctccagaaattaacaacaaatttttggaagaactcaactctcttgaatcaacacacgacgatatctacaatcgtgccgtggccgattgtgagagagcagaacaaaagcgtataaactctgttaccaaacaaacgcaaaatatttttgaagccgtgggaaaggctatcaaagctgaaaatttcaacaagggactactcaccgagttggcaaaagccatcaacagtccttcatacaacagtcgcgctggaaaggacaaagcattaatcattgtgaataaactgcaggacaaccttacacatcaccaccgttttttgattggacaacaaaaaacagctgaattcctcagaaagacatttaaaatcccgctagaagacgaaccgtccactagtgcgaacaatttggagaaaaaagattgatttttttttttgacattatttgaaggcgatcagataccaagatttttgatcactattgttgatactgtgatcgtattgttaataaaaattccaaataaacgtcaaactgtgtcggccaaagaaactaatttctgaactggaaaaggaagaagaaaattttgaaaattttgatcaattggaagagattattgaagaagttgaagaatttgtacctattgtagaaattccggttttaacacccgaagaaattgttaccgagcttgaaagaagggcaaactttccctttccaatagtgcatatttacccaggaatttccaaagtaacgaaccaaattttaaaattcgaacccttcccctaccaaaacaaaacagtatataaattcactttgactgtaactatttttccatactgcattttaaataatctagacaaagccgattctttggaaaggatttgccaggaagtaattttagaagcttacttaaaagtaagagaaacactcaactctaaccctgaaaaatgactgaaatttgtcaaattcattctcaaagttttatcaagtgaacggaagaatttattaaggaagtggaaaaatactgacagaagtatagtattacaccctattaattctttagttcacaaagagtatataatttaaaaccttacgaaaatgtccggaaatattagaacccgaattcctatgttggtcaaaagtttgaaaaataaaattgaaaaatattatgaacaaatcgaacacgggaaatatgaatttgattccaatgatttacctggttgtttaaaattatatgaatttattaaaaaagaaatatttaattttgaaaaaacgtttgatagtttaacagaattggataaaaaatggaaaaagatacgaaacaaattaaatactgaagataaaaatgctgagataaaaatatataaaatttacacagaaaaacatgactatttaaaaattttagaagaagcggatagtgttatcgatgaattaaaatcgcttaacttagaggtaaagaaagctattcaaaatttaaaaagaaataagaaaaataattcaggggatcaacatgaaaatgatgatgagaatgatgatgatgaagacgaaccaaatgatgaacaaaacacagaagaagaattaactgataaagaagaaaaagaaactg

SEQ ID NO: 85091 - DNA, 284 bp, Heterodera glycines
  Genomic contig location: Contig_ID=SeqID_20289; Location=630..913; Strand=-
  SCN-specific regions: Sequence locations=1-154,184-284
atggaaatagtaaaaaataaaatgaaaatatgtaataggaggataaaaagagatgagaccaatggtacggcagcgattatttatgatttcgtgtagataatacagtaataagtggaaatggtaggacggagaaatacggtaatagaggtaacgaacaaagaaagaagaaaaagagaaacatggaggacgactggacgaaaaaagaagtgactgatgagcagaaaaagtgctggacggacaatcatcaaacggaagagattcgcgagtcggagaaggcaatgtga

SEQ ID NO: 85092 - DNA, 448 bp, Heterodera glycines
  Genomic contig location: Contig_ID=SeqID_20289; Location=1224..1671; Strand=-
  SCN-specific regions: Sequence locations=1-27,49-448
atgaaatatcaatcgtaagcatcataggattgttttttcaagaatttttgcggtttccattgaggactatgatgagcagtgggtcaaatgggttggaggtgccctgcatcggactgaatctccaaggacgcacctcgtccgaggaatatatatacacgccttagggaagctaacatacgtatttcaagacatacagaaaaaggatgtatgtataagaacgcactcaaatgcacgactcatggtagacttcgatacagcagttacaagcgcgcgtatacaactcatccatacccaactcatccatacccaactcatccatacccaactcatccatagacccaacttatccatgcataaaaatgccacgaccaagaccgcataatcaaaaataccacgacgatgactcgcagtgttatggatgagttgggggtgactccacaaaaataaa

SEQ ID NO: 85093 - DNA, 2087 bp, Heterodera glycines
  Genomic contig location: Contig_ID=SeqID_20290; Location=18..2104; Strand=-
  SCN-specific regions: Sequence locations=1-199,221-249,283-364,393 -549,600-604,641-720,767-781,804-821,877-886,922-1030,1056-1251,1274 -1290,1380-1403,1431-1438,1464-1581,1606-1649,1671-1710,1754 -1855,1911-2087
  Gene Ontology: Mol. function=transcription factor activity; Biological process=embryogenesis and morphogenesis
atgggcggttgttggcgccgccgctaccggccggcccactctcgtctattctcgaccctgccggtagtcactcttcgggcctcggcgggcggggggggggggaaccgatttccgagcaaatcttctttcactccatcattatatatcctctgaagggggggggggggattgatctcccggtcgaccgaaaggggtgtcgtttaaataaatattaaaaatgcggcgccgctggtgccattttctatcggcaaaaacaaaggggaaaataaaatattttttgtggggacaccgacagtaatagacaattaattggttgaggggcttatgatggactcgacctgcggtgccaacaatcgcctcctcctaaataatattgttataaataataataactgtgttgccgccttcaaattatcactgatgaattatggttgtggcccaaattttttggttgccaaaatttctggcaccgtaaatgccattaaaattagaatggaatactgatggggtttggaatgcaaaatctcgggctattggacaaaaaacacctcttcaaatttttatatatttttctttgaaaatgcaagaaaaacgtttattattgtttttcattagcgttttattaaatgtattttaaaaagatcaaattgttttctaattttgcatttaaaatttagtttttttgataaaactcatattaatttttccaacttttttggcattttaaattaaataattattttactaaaacaaaactttaatatttgctcttttggcattcaattaaattttaattaattttacaaatggataaatgaattttctttctttactaccattttaattttatttgggaaaataaagtattttcttgtactatttctgctaaatttaaatttacattattttataataattattccttatttggcattaaatttcccatgatattttttttacataaatttcatattccaaacattttttggacgaaattaatttttgttaatttgcgtctttttagttaatcaaaaatacaattttatataaatgaaaattttgtcatcgacatcgaatttttcaattgaaaatctgctgtttaagccgtgcacattgccaaccccaacaccaaatgcttttggcactgctccacccattgtgccaataccaatgtaccccccattctttgcaacaatgctaacacaagccacagcgtcaacaacaacgattttcacaccgccatcattaatttttaaatctggtgaaattttaagtgaattaaatacgcacaattaaataataaaattaacaaaataaattaatttatggaattttttgtaaattaataagattttttaatataaattatcatttttatagacaaacattctgcttcccttcattgcaagaacaacaacaataattcatcacaacaaattggcacatcaacaacaacgaaatcatccacaaattatgccattcaaaaggcacaatttttttaattgtgatttttcttttcatgggctaaaaaattttaagattaagatttttaagcagataatcattaataataactaaaattctcatttttcaaatttttctttagcaaatttctcgggcatccagaaagaaattgcttggattgaaaactcttttaattccaatgaaattataatattttgatttaacaaataacttcattggtgtttcattaatttttgactcaaaaaagcaagaaatgacaaaattattgccaaaatcttatgaaattagcttaatctgctttataatataattaatgcctaagtggtttcatttacaaaattcgactgtattaacttttccaattttcatgataattttaattttcaaatgaaattaattaattttccattttttaaattaattttccattttttcagctcagtgctctaagcagtgaaaagcggaagcgtcgccatcgtacaatgttcacggagtaccaactgaacacgatggaggaggcgttcaccgcctgtcaatatccggacgtacaaatgcgggagcacttggcggacaaattaaaattgcgggaggaacgcgtggaa

SEQ ID NO: 85094 - DNA, 1455 bp, Heterodera glycines
  Genomic contig location: Contig_ID=SeqID_20291; Location=284..1738; Strand=+
  SCN-specific regions: Sequence locations=1-91,114-319,341-923,956 -1214,1241-1427,1453-1455
atgaacagacggtaatgaattcttttgaaaaattaaattttcgtttacccaattttttcccatgtttcagttggatttgtgcggatgtttggttggacattctgccatcttttgaccatgcccaactcggactcaaaatggcattgctttccgaccgttttgatgttttggtggacacgcattttgatggaaaaagcgaattgacaatttggagagaaataataattgacaaggacgaaggaccaaaaccgaaagtgtctgtacggatcgatggcagttaccattttgtggattttccgttgtctgttcgtcaactgccaaacaaaatcagctttaagaacattcagattgagtcattcttaaacttttgtgcacgttaaagcatttttctcttgctttaggtacatcgaccattccgtgatcaaatttctccgctccaagaagcgattctttgacaaaagtggcaccaaattggaagtgtttgtgcattcaattgatacggatgtccaaccgatttgggatatttttaccagtgaaatttgggcactttttacgacaaacattcgccatttgggcttcgaagatggcaatcatttggacaatttgcgtcgtcgcacatcgccaacaattctcactgatcttgatcaattgaattccatcgattccggtcgtctgttccccgatagaattgctgatgatgggccaaatgcaactgctggccaagcgttgtccaaatggttgcatacgtccacaactgatggtcaaccaaagcgattgtattgcaataattattttggtccactgaatctcgaatgggtcaacaacttcaaagaggtgtgtctagccatattttcgtcaatttgtttttgttttaccaatttttgtgtttagacatttcgccgtgccaccacttctgtcagttacacaattcaactttatttttgggtggaacaaatgccaattgaatcatttgaattggtgaacgaacggacgaaggaaaagctgacactgaaacagaatatcgatgaattcgacgtaaatgtgtgtaattggttgttgcaacggtgcccaattggggagatggcgacggcgccagcaattaaatggggagacagcttaaatccgagtgccaatttgaaccatatcagatttgttctgtggagtttcgataaatgcattgggtgagcagcagcaatagcatttgaattttatcgaaaaataaaatatttaattaattttaggccattgtcgccaccagcggaagaagaaaaagcggatcaaagcaatgaaaatgtcgtctgattaagtgtacgggaattaattaattacctaattgtatttgagaaatgatctatctcaatttggtgtgctcatttactctcagaaatgcttttgttaattctttcgttctacatataatattacacatttatatatattttaaataattatgaa

SEQ ID NO: 85095 - DNA, 596 bp, Heterodera glycines
  Genomic contig location: Contig_ID=SeqID_20292; Location=853..1448; Strand=+
  SCN-specific regions: Sequence locations=1-219,241-288,312-596
atggccgcggtaacaaaggtcggaaaaggacccggtccatttttgccagatatgtgctgggcgacgtggtgggaacggttcgagtttttcatccagctgaaaggcgtgactgatgtcgcaacaaagcgtctgctcctgttcaccgaaatgggtcaggtgtacgaagagcttcggcgaatggcacagcctgaggatgtccgaaccatggaccttgccgaaattgaacaactgatggtggaacgatttggcgaagcaaaatcaattgctgcgtgcaggcatgaattgttttcagccaagcagcagacagggcaatcgataagagactattcagtccaattgcgaagtttgatcgcgaaggctgaatggagccgcgacagcattgacatgtgtcagcgcattgtttatcaatggcatctccaatgattcaattcgggttgaattgatcaaaaaaggcgacaaggacctaaaattcaaggatgccgtcgaatcagccgttttgttggaacagtctaatttggatgcccaagcaattggttcaaatgcaataccggaggtcgcaaaagttggcacttagcaaagaggaccaagaacgccga

SEQ ID NO: 85096 - DNA, 93 bp, Heterodera glycines
  Genomic contig location: Contig_ID=SeqID_20292; Location=182..274; Strand=+
  SCN-specific regions: Sequence locations=1-47,70-93
gcacttcccttcgcttgaccatttatttattatatttgtgctccaaataaatatttgtcttttcttcatatctgttgttctcggacacaacag

SEQ ID NO: 85097 - DNA, 1603 bp, Heterodera glycines
  Genomic contig location: Contig_ID=SeqID_20296; Location=595..2197; Strand=-
  SCN-specific regions: Sequence locations=1-89,111-195,217-236,264 -315,337-425,448-503,525-533,643-941,963-983,1006-1065,1087-1306,1341- 1582
aatttgaacaattcttcaactcgcagttatgacgatggaaatgatgattcggatgatgatgccaaaaatgagaaagtcgctggtggactttttgcccaatttactgccgcttttcgacgccgttccgttagcatggacgagcgcgtgttccgcccacggcacggcacaatttcgtcatcctactcggtgggcggcacaaaaatatttaaattttaaccgcatttaaatcgagaccgttgataaataaaaattttcttaaaaagaagcaaattcggtctaaaataaggatttggtcacaaaaaaaacgacgaaagcttatttaaaaatggaaaatttattaaaattaaggccttataatttatcaccaatatttttaaggttaattttgaaggaaaatttagcacaaaataaggggatttaatacgaataaaattataaaaataatttgcattaaaatgttacgaaaaaattatgccaatttaatataataaagatcaaaaaagggaaattcagaaaatagggaatgattgtcgatataattttattgaatatttattattattattatatttgatttttttttaatttgtacatttttaaagatttttaatttaaaattaattaatttataaaattaaatttcaacttacatttatgaatttaaagattagcggaagtccaacaggcgaggtatacggaggcgtcgccaagggcacgcggcaaccgcgcgcaaaggaatcgaacactttccgcaagatgcgcgagcggctaaacaagtggaagctgtccaccggataaagccgatgtccgtaagccgaaattaagcggatcctgaagcggaggcggacatgacacgagacgagcaaaaaaatttttttttgttttttcctgtccaaattatgctatttgtgcgagactctcggcacttggcactcgactcgagaattttagaatttttcaggtcttttcgtgacctttgtgagttacaaaattttcaaatttcggtcggtatttcgtctgcttggaagtgttgtttttgattttttttttgatttttttccccgattgaatttcgggccaaaaaagttagcattttttcgcaattagaattccagcctgaagaatgtgctaggaaaaatttggcaaattcaatttgttcattaatttctcaacaattctcgagttttggcaaaaaattctgctctcgcactcctatttatccacccaatatttactcatcatcaagccattcgagcacccttttgcccctctgctgatctcgtccgatttatgtactattttttcgtagcagtggtcagacagacagacacacagagtaattactgtaaattttggtgtaacgcaactgtagtcagtctgtgatcacacatcgaatagatacgatatatacactatcgtgaatatacaaattttcgaactggaaaaacccatctcctctatcaacttttagttaaagctgataccgtattcgtttgtcagtattcagaagatattgtatttattttgataattttttttatcccaaatactttgtagaaaattctataaactattttttaacaatttatgtgattttaataaa

SEQ ID NO: 85098 - DNA, 137 bp, Heterodera glycines
  Genomic contig location: Contig_ID=SeqID_20296; Location=282..418; Strand=-
  SCN-specific regions: Sequence locations=1-137
aatgaataaaaataaatcaatcaaatgttaaaaattcacaggtgataaaaatatagtgtaaatatggcaacatggaaaatcctactcagaactcattgcttttagtaaatccctgaattcctttgccttattaattt

SEQ ID NO: 85099 - DNA, 227 bp, Heterodera glycines
  Genomic contig location: Contig_ID=SeqID_20297; Location=490..716; Strand=-
  SCN-specific regions: Sequence locations=1-104,126-227
atggacgaatcatccgatggaaatgccgtcgatgttggcgaaggacgttccaaatatgtgcaatggattttggagatgagcgcaatggttggaaaacaaaatgaggaaattcggatggtaatttaaatttcaaaaaaaaaatcgggagaaatataaaatttcagacggcaaaatccgtgcagaataaaagaaggggtcttttgaaattttttcgtttttttgcataa

SEQ ID NO: 85100 - DNA, 726 bp, Heterodera glycines
  Genomic contig location: Contig_ID=SeqID_20297; Location=1662..2387; Strand=+
  SCN-specific regions: Sequence locations=1-726
atgccaaatgtgaaaaaacaacacgaagacttacccccgaatagcaaaacgttcaagggaagagggactgtaagaagaaaatggaaaagaatttcaaaatatatcgggcagaaatgagaacaccgactttaattgtttgagttttttatattcatgaaaaacttactaaaaataaggaatttttttttcaaaaaagccttaaatttttgagtttttctgtgttcaaagcgtggcttatgcacctccaatttttgccgattttcggtcggctcagccaacaattgggtcaatcgttcgtccgttgcgccaattcgctgctgacgcgccgcaatttggtcggccaacagaacattcgcatgacgaagctgaacatgaagcagaaataattgacagcctcttcagtttttttcgtgtttgcctggacctggacctggcttttttcacattagactggacctggatttcctggacaaaaatccaggaaattccaggtccaggaaaaatccaggttgccaaaaaatggcatggacctggacccaggaaaaatccaggcctggatccaggtccaggtcgatctctagtgcaaacagacgccacgcagtaaaaaaaattgaaattttaaccattttttaaaacagattttcaccaaaaaatgcgaattttgtggattttcagaaaaaaattcacgaatttttttttgagagaccatggggggtataccaacaa

SEQ ID NO: 85101 - DNA, 709 bp, Heterodera glycines
  SCN-specific regions: Sequence locations=1-709
gtggccatcttggtggcccaaaatgacacggactttggcatggcacgaaagaacgccgcgttgcccaattcgggcggcgcaattccaatggcattggaacagttgtgggcggacgaaatcctaccaaaaagcgtcaatttttcgtcagtttactaacactttaaaacggcaattttaaatttgtcgccacagaattcattggacttattctcaatgtaatgaagcaaacgattttggccaaacttacaattatattagcaaattgggagcagacgcaatcattgcgacttcgtgcattgacggtaatgcgaataaattagtataattgtatgtataattaattagaataattaatttgttgcaaattctttgaagtgccgccaatgctgggtcatttggctgccaattctaacattccgatgcttgtctggggacaaagcatgtcttcaaagtgagttcgttcaattaatttgactaattaatcttcgaattctcatcagtcttgcctcctcaaacaatgccacctatccaactctgttgaacattgtgccaaattgcaaatagtacactcattttgatttgtatattatttaattgcctgactttaccgttagcatggcttccgggcttataagtcttcttcagtattttaattggacacaaatcggcattataatccaaagtgatatcatatcagcaagtggaggta

SEQ ID NO: 85102 - DNA, 252 bp, Heterodera glycines
  SCN-specific regions: Sequence locations=1-228,250-252
gaattcgtctgggaaagtgccgacggcaaatgttcagtccaattttttgtcgaacacgacaatgcctcacaaactgcagacaacttcaaccagaaaagactcaaattgttccgtcacttctctgcttcccaatgctgaaaaagaattcgacaaatcttttgctggcgttgctttgtcgtgcggtggtggcaaaaaagcacaccaattgaatgacattaaggcagttggggaagaagcagcagcagagaatgt

SEQ ID NO: 85103 - DNA, 485 bp, Heterodera glycines
  SCN-specific regions: Sequence locations=1-177,199-454,483-485
aatttttttgtgtcttggatttataggtgctaggaaattggtaaaaatttacaaaaagttgtaatcaaaaaagctcgaaaaatttagaccgaacaattttgaccctaacttttttgaaattcaataaaatttttcgaactttaacaaaataatagagaaatctttgggctatctaattatataaatacaattaaaattggttctttcagaaaaaagttatgaaggaattaatagtattatatttttatggtcatccaaaaaatgtaaggtcgtttaaatgcatgaaaattgttcaaaccttcaattatcacattacatttgatatgaaaagatagcccaaagatttctttatgatgcagttaaatttcgaaaaaacttattgaatttcaaaaaagttagggtcaaaattgttgagtctaaatttttcgagtttttttttgcttacaactttttgtaaatttttactaattttttaaaaattacat

SEQ ID NO: 85104 - DNA, 478 bp, Heterodera glycines
  SCN-specific regions: Sequence locations=1-365,388-478
aaattgcaatgccttcatttaaatttgtatgtttccaatttttgctaatttttgtgctcacggaattggcacattcagagaaagggtgcccaaaaacagaagatttaattgaaatgaccaaacatttgctgacaactgggaagaatgtaatttctggtgaagcagcttcatcatccaccgaaggaaagtgcagtgatacggtaatggaaagtgttgtaacaaaagttattgaatttgggtgttatgacgaaatggaaaagaatgacggcgaaagagcgaaaagcaaaacgaaaaacgcatttattgaaagcattgaaacacaacgaaaaggtttttgccaactttggcaaaacggcaaaagcattggggagaaggagcaaaaagatggcattttgaaaatagtgaaaggattgggaggaattgagctgaagaaaattgaacgaattcttgaaaatgttcaaaacattggattatcgcc

SEQ ID NO: 85105 - DNA, 591 bp, Heterodera glycines
  SCN-specific regions: Sequence locations=1-140,168-547,569-591
gagtttcattgaaaactcaaaaaatgacaacagtcaaattgctatgcctaattgccctatttgcggtagtgcaacttcgttttgcatttgctatgatgaatcaaaacaaccaacaagtgagccaaaacaacagctctgacgaaggagaagatgatgatgatgctggtaacggcgggcaatatgacacggttgctccattgcgtagcgacagcactagtttcgttagcagcggcaccttaccgccgcagggcagcaccggtttcagcggggtcggcatgatgccgccgcatgcccaaaacatgggagcaatgggcatggggatgggcaataccagtttcggcaatttgcaacaacccactatgcaaatgcaatatcaaaaccagcaaatgatgcaaaccccgcaaatgatgcaaaaccagcaaatgccgtttaaccagagtggcagtttcagtggggttggcatgatgcctatgcagcaccaaaacatgggagcaatgggcatgatgaatgttggcagtaccagttttggcaatttgcaacaatccaatatgcaaatgcaacatcaaaaccagcaaatgatgcaaaacccgc

SEQ ID NO: 85106 - DNA, 612 bp, Heterodera glycines
  SCN-specific regions: Sequence locations=1-612
gaaggcgtgtccaagttgatcaacggtattccagtggctgagaccgtggtttacccagccatcggcgagaccaagactcatatcacggtgttcaccgataccacctgcccgtactgccacaagctgcacgccgaagtgcctgcgctgaacaaaatggggatcgaagtgcgctacgtcgcgttcccgcgccagggcctgggctcgccgggtgacgaacagctgcaagccgtatggtgctcggccgacaagaaagcggccatggacaaaatggtcgatggcaaggaaatcaaatcggccaaatgcgccaacccggtttccaagcagttcgccctgggccagtcgattggtgtgaacggtacaccggccatcgttttggctgatggccaggtcattccgggctaccagcctgcgccacaagttgccaaactggcactgggtgcgaagtaagcagtcatcgtcgagcctttgacgatcatgccccgtcgaacagtcgacggggcattaattgagagccgcagttgtgcggctgtttaccacggccgaccttgagtcggccgtttcatggggagttcttcagtgaaaccggtcaaagtaggcatctgtgggttaggg

SEQ ID NO: 85107 - DNA, 584 bp, Heterodera glycines
  misc_feature (145)..(145): n is a, c, g, or t
  misc_feature (221)..(221): n is a, c, g, or t
  misc_feature (487)..(487): n is a, c, g, or t
  misc_feature (569)..(569): n is a, c, g, or t
  SCN-specific regions: Sequence locations=1-355,377-434,475-584
tgtcgacagatttcaaacttgatacttgttgttgttgaacatatttctatacctcacagttcgtccacattttgactttcggacaaaaacaaaagacaaaaaacggtggcaatgatctccaggagggcaattattatttgggccnttgctttgttggcattagcagcgatttcgcccaacttttccaccgctgacaaaggagttgacgctgtcgatgcggnggacgaaatcattgacgacccaaaagtggaggtgccgaagaacggcgttggcaaaggcaccgatgaccaaacagtgcagtgggaggaggaggccatcaaactggagggactatcagtggccgagttcaagcagctcagggagagtgcggagaagcatcaattccaagccgaggtcaaccggatggtgaagctgatcatcaattcattgtaccggaacaaggagattttcctccgtgagctcatctccaacgcgtcggatgccctgnacaaaattcggctcatttcgctgacaaattcgacagcacttgcggccaccgaagaattgtccatcaaaattaaggccgacanagaaaatcacatttt

SEQ ID NO: 85108 - DNA, 320 bp, Heterodera glycines
  SCN-specific regions: Sequence locations=1-40,62-265,311-320
acaaaaattaattggccgtgacgaaaacaatatcatcaaccacagaaaagtgaactgctccagcgctgcaatgttgatgctgttgatgaccattttcactgtgctgtccaatgtcaacgaggtagcagccgaggagcacgagctggtcagccgcattaagcgcaacggctacggatacagcagcggttatggtggtggctgttcagcctgccaaagcagctgcaccacctgtggttacacatcctaccataccgtgcctgcggctcccgctcccccgccaccaccgccgcctccgcctccgcctgcgcccgtctacagct

SEQ ID NO: 85109 - DNA, 601 bp, Heterodera glycines
  misc_feature (227)..(227): n is a, c, g, or t
  misc_feature (458)..(458): n is a, c, g, or t
  misc_feature (590)..(590): n is a, c, g, or t
  misc_feature (599)..(599): n is a, c, g, or t
  SCN-specific regions: Sequence locations=22-136,204-285,308-354,376 -417,440-516,539-601
aagaataacatgaaaataataactctaattccaatcttattttcattaataaattcggtagttggacaaacaacatgcgcaacaccgacaacacccccagtttgttactgtacatgtgaatcaacacctggagtgtcatcaacagcaccaacaacgacagttggaccaacaggaacaacaacaactggcacaccattaacaactggacagggcacatctggaccatntacaccagcaccaacaggcactcccggacaatctacaacagcaccaacaggcacgcctggaccatcaacaccagcaccaactggcacgcctggaccatctacaccagcaccaacaggcacacccggaccatcaacaccaacaccaacaggcacgcctggaccatctacaccagcaccaacaggaacacccggaccatcaacaccagcaccaacaggcacgcctggaccatnaacaccagcaccaacaggcacgcctggaccatctacaccagcaccaacaggcacacccggaccatcaacaccagcaccaacaggcacgcctggaccatctacaccagcaccaacaggcacacccggaccatnaacaccagnac

SEQ ID NO: 85110 - DNA, 691 bp, Heterodera glycines
  SCN-specific regions: Sequence locations=1-55,77-691
gcagacacaattaaatgagagaaatagtgtgggcgagagagagagagggaaatggataaaaataaattaataaaatgtcttgacacaaatctctttgcgtatctttccgttggctgtggaagaggcggcatcaggagatcaatcgtggtgcgcggttttcggccaaggagcatttcggcaggggtttttgcgtccggcaacgaatcgttcggagtcgtgcggtaagttaccaggaaagtgttgatgatttccttgtttggcactccctccccttttatctttcgaaacgctctcttaaaaatgtccacgaaccgttccgcttgtccattggactttgggttgtacggagcggaaaagagatgagcaattccatttgcttctgtgaattttgcaaattcacttgcggcgaactgcgttccgttatcggttaccagtgtttcaggtataccgtgtcgtatgaacagatatcgcattcgttcgatggttgcggctgctgattttgtgttcatttcgaatacctccgggtatttcgagtatgagtccacaacaatcagaaattcttttccgaagaaagggcccgcataatcggcatgaattcgttgccatggccgcgttgattttggccatgagtgcaaatccgtttttgtcgcagcctttgcggccaattgactcggtgcacaattcttgacaa

SEQ ID NO: 85111 - DNA, 3824 bp, Heterodera glycines
  SCN-specific regions: Sequence locations=1-69,91-100,122-1125,1147 -1263,1285-1418,1440-1717,1740-1821,1845-2329,2352-3303,3325 -3562,3615-3625,3654-3739,3775-3779,3801-3824
catttgttccagtgcaaaactcagcagcagacaatgcccggcaactccgtccaacaattcaccactccatcagcgccggtggccaacaatcagacggtgatcaaagtggccatgttggtggcccaaaatgacacggactttggcctgccgagaaagaactcaatgctgcgcaatgcgggaggtgcaattccaatggcactggagcagttgtgggcagacgaagtgctgccaaaaagcgtcaatttctcgtttgagtgggtttatgaaaagtgtaatgaggcaactgcgatgggattaacctatcagtttatccacgattttggtgctgacgcaatcattccgacgacgtgcatggaggtggcaccacaagtgggtcatttggccgctaattttaatattccgatgatcgtttggggacagaatatggtctcaaatcttgcctcctcaaacaatgccacttatccaactttgctgaacattgtgccgaactacaaatacatggcatccggactgatcagtcttttacagtatttcaattggactcaatttgccgttgtgatccaaagtgatcttggcaatgtgagcggaggctgtgattatctcgccaaatccattgataattcgttagcaacttcgaatatcactgtcaattataaaacgcgcattttcaatgttcagtcttcggacatggacagaattgccaattcactgctgcaacgggcgcgaattattttgctttgctttgatgacaaaaaacagttgcgcacatttgcgcttaatttgtttgatggcggactgaacacaaagaactttgtgtacataatacctgacaatgacatgactttgtcgttcaatttgtcgttggacccattttgggtgcaaacgagtgtcaattcgaatggacttgacggaagagacgcggacgctgaagtgattggacgattggcattttggtggcattatgacatcactctttccgcgttatccaatcgcaactattacggcttttacgggagagtggtcaaccgaacgtacggttggcccttttactgtcccgaatcggaatgtaacacagttgctaatggctccctcaattccgtccttttgtacgatgccatttataattatgggatggcactgaatgagagctttaagcaatttggcatccgaagagagacataccgtaacgggtcattgttagcggccaataacagaaggccatttatgggtttgaccggctacgcaaccgtggaaactgaccgtaacacgcgggtctttgtgttgtccaaccgaaaaagcgacagcaaacaaagtccgctgcgcattttgatgcaattggcatggacaaacggcgaattgaatgtgacaatgagaaatgccagctcattgatgtggttttctcatggtggtgtcgttcctccggctgttcccacgtgcggcttcgatggcaacggatgtaccgtatccgtgttcgatttgtacaaaggatactttttgggcggcatcgctttgtttgtgctgctcattggcgccagcattttctgcgtcgcttatttgatacacgcaaaaattgttgacaagcgaaaaggcaatttgcagtggaaaatcccttttgcgttgttgcagcgacagaaccaaagacgatctgaacggaccgccgaacggagtcaccactctctccgctccaaccaaacaaatatttccgcgttgacacatgcgaccaccagcagcagcttggcacagtcaaaaaacttcacactgtacgcttacaatggacaaatgtgcattgtacacgcgtacggcccaacactgttggccatgccattgtctgccgaggggatggccgagtgccgaacgttgcgactgtttgaccacgtgaatttaaatcgctttttgggactgagtttggacgggcccaatttgctggcggtgtggaatttctgtgcccgcgggtcgctcaaagatgtgataatgtccggtaatgcgatggtcagagacgtcgtgttcatccaatcatccatcagggaactttgtgaggggttacactttctgcacaattcgcccctccaattccacggccgactgaaatcgtccgcctgtctgatcaatgatcggtggcaagtgaaaatctcatactttggacttcgttggctgaaaaacactcaaaaaattcaaacaaaagaccttttgtggttggcccccgagcaattacggaaaatgggcgagaacaaaaatttaattgacggaactaaacaatcggacatttattcgctggcattaattttcactgaaatggtgaatatgacaccgtgttgggagacaaataatgaagacgatgaagctgacagtgacaaaagtgccgcagatgaccaagcagtgcagcaagagaatgccatgtcgcgaagacgaacaacgacgacaacggcggcacaacaacgggtgaaacgacgcgccccggggggacagcaacaaaggacaggacaaaggcgacaaaatgcggaagaaattgtctacctggttaagcgaggcggactgattccgttgaggccgacgattcggcccgcattggacaatttgaacccggaattgattcacctgatccgcgattgttgggtggaatcgcccgcggaacggccaaccattgagaaagtgcggcaaaagttgaggcaaatgaatgccggacagagcatcaacttgatggaccatgtgttcggcatgttagagcagtacgccaacaagttggaggaggacgtgcacgagcgaacgcgcgagttggaggaggagaagcgcaagtcggacatccttctctaccggatgatgccgcgccaagttgcgaacagtctgaagcttggccagtccgttgagcccgagcagttcgagtgcgtcacggtgttcttctcggacattgtccaattcgctgcactgtccaaccaaatgcgaccactgcacgtggtcaatctgatgaacgaactgtacaccacttttgatgcaattgttgatgagcacgacgtgtacaaagtggagtcgatcggtgatggttatctctgtgtgtctgggcttccaaatcgaaatggaaatttgcatgccaaacaatgcgctgacatggctttgaaatttctgaattcgttgcaatccttccgaatttctgagcactccgatcagcgaattcggcttagaattgggctgcacagtgggccatgtgtggcgggagttgtcgggttggccatgccccgctattgcctcttcggtgacacggtgaacaccgcgtctcggatggaaagttcttcaagcgccaacaaaattcacatctccaaagaaacgtgcattttgttgcacgaaaactctgaaggaggcgcttacttaacggaaagcagaggcgaagtgatcattaagggcaaaggcgtaatggaaaccttttggctgttgggaaatgcaaaaattagcggtggcacaattggcacaaatcattcgcaagcagcggaaagacaaatggcaatggaaagtgacaaatcggagaaagaaatgtacaaaagttacaaacaatcgacgacaaattaatggcaaatataaaaataattaattaattcaagtttaattattatttttatttttttcatgcaaatgtaaaaaacctttttaatatttcctttattaatgctcctctttttatgttgtgtcataaatattgtcctacttcgattacgttgaatgactttagatttatcacacttttcttgacataattaatgttattaaactattttaaaatattatcgctatttttgacataaatctttgttataacaaaaaaaaaaaaaaaaaaa

SEQ ID NO: 85112 - DNA, 3499 bp, Heterodera glycines
  SCN-specific regions: Sequence locations=1-36,59-497,519-835,858 -1065,1087-1694,1716-2342,2364-2640,2662-3381,3426-3475
atttcgttccgatgttttttgggacatcggttgctgttgttctttgttggcttttttgcactttcccaacgacattcggccaacagcaaaatgggactgcgccgctgatcaaagtcgggctaatgatgccgcacaatcagtcgtccgatttgtcttttgcccgatccgccggtgccatctcagtggcgctgaagcacattttcaacgacaatttgttgcctcccggcaccaatttcagtttcattgtccgtttcgaagagtgcctaatgtccgtcgccgccgggtacgccttcgatttgttggatggccagcaagtggaccttttcattgcgccgccgtgcaccgacagtgcgcaagttgcacttttcgtgtccacattttacaacatcccttccatcacatggggccagaattcggactcctctttcaattcgcagagcaattaccccactttgctgagtgcgcttcccaattacgccgactttggccaaattatcatttcgctgtgcatcttcttcaagtggtccgtcatggcactgatttatcagctcagcgagacgggtcaatgcgcgtcgttccagcaagacttgcagatcgcgatcaattccaacgacaaatgcgatatcagctacagagaggaagttaagatcagttctgcgggcaccagcgacgcccaatacaccataagtcaaattcagagcagggcgagaatcgtcattctttgcttcgacgagtttgttcagctgcgcaactttgccgccaaacttcaggagggtggcttggactccgctgactacgtttatctcatccccggactcaccatggatgatagtattgaaagtgttaattgtgtcttttataaaattcaaatttgcgtttgctttttctctgtttttaatttactttttgttttgggtggctccaaggccaccgcgtggtgggtcgacccgaacccgaccatccaatcagcggcctacagaattgctcagcgcagtctttatctgatgttggacatcttcaacaaagtcgcaacttcaggtcaagtgggcaacggcacttcgtttgatcaggaagtgatcagacaggtcacccaatggcccttcttctgtaccgattgcgatcagtcgttgcaggcttcttcttacgcccctttgctccacgacagtttctatttgtatgccatggccctttccaaagcggcaaaaattgccggcgcattgtcaccttccgtttaccgaaatggccaattgattcgctcccaaaccgccaatttgtcttttgaaggaatgacggggtcaaacaaatttggatctgatggacttcgtaatttcatttaccttgtctccatgtattcgagcttgaacggtgacttgacttcgtatgtgtggctccaaatgaacgatgccggagtgaattcttcatggattaatgccacggccgagaagctgatttggtcgagccgaaacggcgttaagccattggccgtgccgttgtgcggatttgacggcaacggctgtcacatggacttcttcacggagtaccgtgggtatgtgatagctgccggctgtctgttgctgctcattttgggctcgttcgccttcggcatttactggctgttccaatccaaggcgcgcgagatggaacggcaaaatcgcctctggcaaatcgcctacagtactctgacgccggcgggcaccaaaaagaaaatgatggaaagtgtgcgctctctccagtcgagcacttcttctcagttcacgcgcgactcctcccattcccacgtttccatcaaacacaacttcaatggcatcgtgtacattatgaacggcgagcgggtgatcggcattcagcattcggttggcattcgactcagtccacaggacatggccgagctgagaactatgcgccttttggatggagacaatgtgaaccgattcatcggcctttccatcgatggcgccgcgcttctctccctgtggcgctactgctcgcgtggccccctttcggacgtgatctcgggctcttcctctctgaccatggacggcttcttcatttattcgttggtccgcgacgttgccgaaggattgcgcttccttcacgcgtcctcaattggatggtatggcaatttgcgttccaccaactgtttgatcgacgaccgttggcaaataaaactgtccgagtttggtctccgcttctttcgtgcacacgaaaaacgggaggcaaaagatttggtttggacagcgccagaattgttgcgcgataatgacatcgttggcaacaaatttggcgatgtttacagcttttccatcgtttcttccgaaattgtgaatatgaagccaatttgggagcaggacgaagcgaagggaaatgttgaaagggtccgaaccggggggaagagggcatttcgtcccaaattggagccgagcagccaggacttgtccccggcactgctgcatctgatcaaagactgctgggacgaaagccctgcagaacggccaaaaatggagacggtgaccgcacttttgcagtcaatgaacacgggaaggagcaccaatttgatggaccacgtgttcaatatgctggaagtgtacgccggctcattggaggaggaagttgaggaacggaccaaagagttggtggaggagaagaagaagacggacatccttctctaccgaatgctgcccaaacaagtcgccgacaaactcaaattgggccaatctgtggagcccgaaaccttcgactgcgttaccgtattcttctcggacgtcgtctcattcacaacaatcgcttcaaaatgctcacctttgcaggtggtcaatttgctgaacaatctgtacactctgttggactcaatcatcgccgaatttgacgtgtacaaagttgagacaattggcgatggttatttgtgcgtgtcgggccttccccaccgcaatgggcatgaacacgcgcaacacatcgccaaaatgtcgttggcattcatgcgcaacttgggcagcttcaccattccccacttgcccattgaacggcttcgtctccgcattggcattcacaccggctccaccgtggcgggcgttgtcggtctttccatgccccgttattgtctgttcggcgacacaattaacacagcggcacggctggaaagcagctcaaagccgatgcgaattcacatttccacgacgacgaatcactttttggtcaatgttctcggaggttttgtcacccaagcgcgtggagaaattttagtgaagggaaagggcgttctcgaaaccttttggctgcttggcctcgaaggcgacccggcggtgatgcgaatgttgcacagttcggacggtaataatgcgactacggaatgaacaaaaacaaattgaggaagaaattgaacacaaaggaaacagaaaaaccaaaagaatgaatgaatgaatgatttgtcatttgtaaaaattaaaatgtcggacaacaaaaaaaatcgaaaggaacgaaaaaaaaaaaaaaaaaaaaaaaa

SEQ ID NO: 85113 - DNA, 364 bp, Heterodera glycines
  SCN-specific regions: Sequence locations=1-30,52-123,146-296,318 -331,355-364
gagtgtggctgaagtggctaaagccgcaggtctttttctggtcaacaaattttacacatctgaaatttgttaaggtgtcgagtggggacgcatgtcagcagcggacaagacactttgggaacagaaggcggcagacgacaagaagcgctacgagcagggtaaaaaaaatggcatggcattgcgacatttgaagactgatttttttagaaatgactcagtacagagctcgccagaagtagacgattgggcagtgaatgacgttttatctttgacttccttttccgctgttctctcctatatttaaaagtcaacaaaaatcgaccttccatttgtcgtccttttcgacattctggtttatttctct

SEQ ID NO: 85114 - DNA, 3008 bp, Heterodera glycines
  SCN-specific regions: Sequence locations=1-53,75-948,970-1403,1425 -2400,2422-2981
cgaaaatcacaattaattataaaacacgcattttcaacattcaatcatccgacacaagcacaattgtcaatgcaattcgagaacgggcgaggatcgttttgctttgctttgacgatttgaagcagatgcgaactttcgcacttcaattgttcgatggaggactaaacacaaaagattatgtttacataatggtggataatgacatgtatttatctttcaatttgacgagattacctttttgggtacaatcgagtaacaattcaaatacgctcgacggaagaaacgcggacgccgaagtgattggccgattggccttatggtggcactacgacatcactttgtccgcgttgtccaatcaaaattactacggctttttcaaaagagtgatcgacagaacgggcgattggcccttttattgcgatgaatccaattgcagcaaagtgatcaatgcatccatctattcgcttctgttgtacgacgcaatttacaattacggaatggcactgaacgaatctttccgccaatttggcattcggcccgaagtgtaccgaaacggcactctgttggcacggaacaacagaaagccattcatgggtttgaccggctatgtgacggtggaaactgatcagaacacgcgggtgttcgttttgtccaatcggaagtcgagcgagaaaggaaatgcgctacgcattttaatgcaattcgcatgggtcgaggggaaattgcaaatatcgttgcgaaatggcagcttgtccatgtggtcctcccgcggtggaagcattcctccggcggtgccaatctgcggcttcgacggcaaagggtgtgccgcgtcggtgttcgaaatgtataaaggctatttattgcttggaattgctctttttgtagtgacaataagcggtagcacttttactgtcggctttttgatacacgctaaatttgtggaaggtcggagaagcaacatgagttggaaaataccatttgctttgctgacgaaatcgaaaccaaaacgtgccgaccgcacagccgccaaccgaagtcggcactccgtccgctccaaccaaacgaacatttcctcgctgacccattcgaccattggcagtttggcacggtcccgaatcttctccctgtactcatacaatggggaaaagtgcattgtgcgcagctttggctccacaacaatggcaaaggcatttacagtgacacaaatggccgagtgccgaacgatgcgtctgttcgaccatgagaatgtgaaccggtttttggggctgagtttggacggggccaatgtgttggccgtgtggaacttttgcatgcgcgggtccatcagagacgtgattttgtctgaaaatgccatggtcaaagatgtgatattcatccagtcggccatcaaagagatttgtgaaggcattcatttcctgcacaattcgcccctccaattccatggccgactgaaatcctccgcttgtttgatcaatgaccggtggcaagtcaaaatttcatattttgggcttcgatggctaaagtcttcacaaaaaaatcgggcgaaagatcttttatggctatcgcctgaacaattacggaaaatgggagacagcgaaattgtggaggggtcaaaacattctgacatttacacgatggcattaatcttcaccgaaatggttaatatgtctccgtgttgggacagcagcgaagcggacggagcagaggctgaccgggccgaggatggagaagagcaaaacggaacggaaatgtcgcgaagaaagcaaacggcggaaacggagggagaaacggcacagcggcgcccggggcgacgcgcgaggggacgcaacgcggaggaaatcgcttatttggtgaagcggggcggaatcgttccgctgcggccgatcattcggccggcatttgaccatctgaacacggaagtgattcatctgatccgcgactgttgggtcgaaacgccgagcgaacggccgaccattgaaaaagtgcgacagaaattgcggcaaatgggtgcccaacggagggtcaatttgatggaccatgtgttcgacatgttggagcagtacgccaacaaattggaggaggaagtgcaggagcggaccaaagagttggagggggagaagcgaaagtcggacattcttctctatcggatgatgccacgccaagtggcggaccgactaaagctcggccaatccgtggagcccgagcagttcgactgtgtgacggtgttcttctcggacattgtccaattcgcggcactgtccaaccaaatgcggccgctgcaggtggtcaatctgatgaacgaactgtacaccatcttcgacgcaatcattgacgagcacgacgtgtacaagggcgatggttatttgtgcgtgtctggccttcccaatcggaatggcactttgcatgccaaacactgtgctgatatggcgatcaaatttatgcaagcgctgctcaatttccgaattcccgaccttccaaatgagcgcgtccgtctccgaattgggctgcacagcggcccatgcgtcgcgggagtcgtcgggttggccatgccccgttactgtttgtttggggatacggtaaacaccgcctcgcgcatggaaagttcttcaagcccaaacaaaattcacatgtccagtgaaacgctcgaattgctgcacaaaaatttcaacggctcttatcacacggagagcagaggcgaagtgatcataaagggcaaaggcgtcatggagaccttttggctgttgggccaagtcgaaaatggaacaacaattaacgccgattatgcgcatagaatgcatctgccggtgatcaaatttggggaggagggaaatgaaaccggaaaaaatgcgtaaagaaatggtgatgaagccaccacatttagactgaaatgcataatgaaagagcaaagatcaagactttcaaaatgcctgaaattaatgtaactttacccaaaatttagcaaaaaatttcaatttattacgaaaaaaaaaaaaaaaaaaaaaaaaaaa

SEQ ID NO: 85115 - DNA, 907 bp, Heterodera glycines
  SCN-specific regions: Sequence locations=1-434,456-856,878-907
gcaataaagagtaaattatggataggagattcactgtcttccttgtgatcgcattggttacttctatttatgaagtgcttagtaatggaaatttgaacgatggcgacgactcatttaaacaattcgatgaactcgaagaaaacccagcgcataaatattcaaaagaggcccagaaggggttcgaaatggaggaggaggaagtcacaatccgagaaccttcggggacgaaggaatcgttcaaattgcccatcaatatgccgccagtgaaattttctttttgtgtctcatgtggttatcgccaagcatatgaacagtttgcgcagattttacgcgaaaaatatcccggaattgacatccacggcgaaaactatcctcccggcattcttcgcacggtgggagcgcaggtcatcggaatggtcaaaattgcactgattgtgtgcgttgtgtccggaaggagtcctttccccaccttgggacttgaaaccccaactttcttccaatggatgctcagcaatcgtttgtctgccgcacttatgctttttttattttccaatgccatcgaagggatgctccaatccacaggagccttcgaaatttacattgaaagcgaacgaatttggtccaaattggaaagtggtcgcgttccgtcacctccggaattgttccaggccattgacagtcatttggcaattcgcaggggcggcgccggaaggtttggttcgtcttcctctttcggcatcgatgggtcatgagaagaaaatgtccattggaagtgcgggtcgttcacgttaaattcacacaaagcgaaaaaagcccctcctcttctctcattttgtctgtccatttattcatttccttgctttttgttattgggcataaatggtggagagaaaaaaaaaaaaaaaaa

SEQ ID NO: 85116 - DNA, 607 bp, Heterodera glycines
  SCN-specific regions: Sequence locations=1-20,42-175,197-514,544-584
aatattaaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatctgaccaatcgctcaatggctccaccacctcctcctgcgcaatttgaaaagggggcggcaactcgagttgaaaaaatgagggcacagctacgcgaacttgctgagaaaatgacggacaaagatcctaagcgtctgtcaccgagtggacccgacccacatcatcattagggccatggatggatctaacggaggaagaaagaatggatgcttagttttcagcttttattctatcctcttttatttattagtttttcaaaacaaatttcttcttatttgttgttttgaatctttttagataaatctaaacccctaaaaaaaaaaaaaaaaaaaaaaa

SEQ ID NO: 85117 - DNA, 1418 bp, Heterodera glycines
  misc_feature (7)..(7): n is a, c, g, or t
  misc_feature (11)..(11): n is a, c, g, or t
  misc_feature (19)..(19): n is a, c, g, or t
  misc_feature (22)..(22): n is a, c, g, or t
  misc_feature (24)..(24): n is a, c, g, or t
  misc_feature (42)..(42): n is a, c, g, or t
  SCN-specific regions: Sequence locations=1-42,65-173,195-344,366 -721,746-1150,1172-1391
tttaacngccncctcaacnacntnttgcatataacctaaaanaaatgcatttccaaactgccttccttctcctggtgccgttcattgttgccaacattgtgttggctgacatgcccaaagatgatgcgccacgcccggcggtgcaaatccgcacccgtcgttccgtgtatgtggcaatgatggacggcatcggcgtcaccaaggaggccatgagatatgcatgccggggatggcaaacgagcttctgcacaaagtttggcactacgctggccgttgagcgtacacgacgtgacacaaatgccgagatgatgggtaccaagatgactgccaatgccgagcgggaggcaaagaaggaaatgaatggcgagatgggtgccaagaaagaaatgaatgccgagatgatgaacaccaagaaagacacgaatgccgaagtgatgggcaccaagacgaatgctaaccccgagcgggacaccaagatggacgccgtggtgatgaacaccaagacgaatgccaaccccgagcgggacaccaagacggaaacgaatgctgtcatggtgaacaccaagacggattctgccaaccccgagcgggacaccaagaccgacgccgtcatggtgaacaccaagacaaatgttaacccagagcgggacaccaagatggacaccaccaatgccgaggtgatggacaccaagaaggaagccaacgcggcagctgcagcgccggtggcggcgtcggacaacacggcaccagccccaatgacatggatgatggacggcattgtgccacgcgatgtcaatgtgatggtggaccgtaccacgaaggagttgcgcaaaaccacggagacggacggcttctacgacatgagccagcgggcacaggaacgtgtgatgttggagacagccggcaaacagggcgaaattgtcaagacaaagctgaaggaagcaattgaggaggcccgaaaaatgatcgaacgtgctcttggcacagtgatttcctactcggaagcgccaatggagtccaaaatgcaattggaacaggtgttcatgacgctgacggacgagaccaagacgcccaaagagaagatggagcggatcaaggacatccagcagaaatggacaccggaaatccgcgcggcgttgaagccatccactgacgacaaggaaattgccgaggcaatccgcttcttcaccgacttgccggctcagattgagcttggcaaaaagtgatcggagctgtggcgcaattgtgccgatctgatcaatggccggacatcgcacaatgtcccaaaaaattcatagaaaaacaaaaacagtaacgatcattcggattttcttttaaatgatcaatgtcaaacaaggattgttttttttgtggttaaataaattttcattaaaaaaaaaaaaaaaaaaaaaaaaaaa

SEQ ID NO: 85118 - DNA, 120 bp, Heterodera glycines
  SCN-specific regions: Sequence locations=1-120
aatgtgggtcagccgatcctaaggacccggctaagcgtaacacactacggatgacgacttttctgtgcttgcgcagttggtccatccggttgccgaaaggaagtgggttaacattcccac

SEQ ID NO: 85119 - DNA, 7127 bp, Heterodera glycines
  SCN-specific regions: Sequence locations=1-121,143-410,435-559,639 -764,787-1002,1024-2020,2065-2351,2373-3447,3469-3664,3686-4203,4226 -5687,5709-5930,5953-5988,6010-6274,6297-7013,7035-7037,7067-7127
gaatggcgaacagtcatttgccgatatttatatgccaatctccacctctaagccgaccgaactcatccgccggttcttggctcactttgccctttcatttggctatatttcatttccatagctttaaatttattcagacgtcaattgttgaattcgtttcgccattagcttttgtttatgacttttccacatctgttcaaataatttgaacaccaaaaacttggcttttttgattgcttaaccattcattttgttaaatttgccgttcattttgtttgatcacctaaaaaatttggcgtagtttttgtgatcacattaggagttgggaccaagttagccaatttttaggggtgtatttttcgtttttttaaatcccgagctaggtggtggattttccaaaatttttagccgttttcattttttacttatttaatgggaaaatgtaaaacggaaaaaattaaacgcatggaactgaaaaaaggaaatgaaagatatttcaaacggaagaggaaaagaaaactatcaaaaattaaagaaaattcttaagaaaaagcaccgattatttatatatatatttttattttttgctgaatatattttttcatttttacttgtattattataattttttgtttattgataaggattttaaaaatttcgatatttcttagaattaaaatttgtcactctgtcaggactttgaactttaaaaaatttgaactttggcggtaaaattatttaacgatgccctcccaaacaaagctgaagaggaagtggatggaatcacttcaaaagaacgaattcattttggaattttgaaatgccctttaagggattatgcgactgccgcaaaacgaccgtaccgaatcagcttgaaacattttgtaaggtttctccgctgggatttgaatcccgacaaatcgcctttttaatgaattcatttcattttaaaatttccttgcccaaaatctctcaaaatggaaatgccgtcctgtttcttcctccttttctttcttatgctttttgtcagcccttctcggcaccaattagtcactgttagcaactcatcgtcttcgcccattggcaccaccgtcgcttttggcactccttcgccgatcatcccaatctctactgcaccctccacgaatggcactgccacttttggcgtccctccgccgatcagtccgccgattaattcttcgtcctctctcccatcaactggtcctttggaagcatcggttcagttaaaaatcggcttcctctttgctaacggcacccaacggttgcgaatgcttttcggctttggccaatccgcgcccgccgtcactttggcactcgaacgggcgaggcaggagcacctcatcgacagcatcaacttcacgtgggcaattggaatgaatttagaaactcacaattttcaaatcactttttgcaaatttaaaaatctccaagcgagcggaaataattggccgtaaatgccaatttcagttacacgtggcgaatgtgcggctgctttcagccttgggctgtcggctacgccactcaactggttctgacggaaaatgtggacgctttgatcggtccgccttgtgtgaccagtaatgcctttttgtttgacactttgccaaaaattgcgtaaatgaaaaaggtgccatcgccgcgggatacgtggcctccttctacaacattccactgtatttgtggggtgctactgtggcctcggaattttacaacactaccgtataccctacactgaacaacgtgaacgttaactcggacatgtcagtggagaaaatattcttcgccttccatcccctaaaattattatttctactaataaaataaactaaaatggatttgctttacgagccgtcaccaaatcaaatgaccaatgatttcttattaatttcaacaattattgcaggttggcgttggccttacaaagtgtgttggtgcaattcaattggacagaagtgtccttcgtgtacactccggacaatgagcgaatgtaagaattattttgaataattaattaattaattagctattaatataatttaattagggtctgtaactcggtgaaacagagtctcacaaatgtgctcaacgtgaccaatgtgaccattgttttccagcatcagatggagtccaatgtggacagtatgaaggcgacgctgagaaatctgcgcaaccgatcgcgaagtgatgggataattaatttgatagcatcgctaattaccatcaattagttgtgctttcctgtttcgatgtcgaagttgaacgtcgcaactttctgttgtccattttcgacactggtcttgctgcggacaacgaatttgtgttcatcatgggatccctgcgcaaccagggcatgctccagcagggtaattaggcaaatggccaaattaggggagggataattaaaggggcaattgattagacctaacagtgcttcagttgcgtcgcgtgaggacggcagtgtcaaatatgtgaacaattggatggacaaaaacagcccaggcgatggccgcgactcggacgcactcgccgcgacaaaacacgtcataatggtcaatccacggcgaagccaagcaaatttaagtgccttagtgtcgttcagattgacctggaaaaccaatcgagtgatcagcttaacgaattcaaccgaaatttgagtgcgaaattcggcacttatccctttttctgcaacggaagttgcatgggcggcgcaacagaacaatcggttgcaatttgcacgaaaaatggaaattataaaaaaagataatgctttttagccgtcgcaatacgccagggctttgttcgacacaacatacgcatattttagagcattgaatcgcacaatggaaaagcgcaaatcgaatgggagggattgttgcgcaacggcacggaattgaacgcagaaactgccgggacgacctttcagggtgaggtggagaggaagaaaaggaggggggggggtagaagcgaatttgggagaggaaccaatggataaagcctggcaaaatgatggagcattaaggcgagaccggacgcatcacttttgacgcccacggcaaccgccagccgaccttttttgtgacgatgctaaacgcactgaatgtgcccactgttatggtgaaagtgaacattaccaacggagtattggtgcgaatggattaagcggcggcggattcttatttttgaaattcaacagaaaatggaacggctgtacggcagtgaggcgtcgctgtgggtcaattggggcggctttcggccgatgaccacgccgttgtgcggctacaacggcacaatgtgtggccaaaatgtgacggtgtacattctgatcggcgttacgcttatgttgctgttgctggtcgccgctttgcttggcatcggatacgcaattcggtaaacagaggaaaagcatcggactgtgccgatcaaaaattgatttaaaagcaaagccaatggtcgataattggaccaaaaggaatgttaacgccaaaatcactcattaattataaattttaagcttttaatgcattaattggaccgaatttctccgaattggcacaacttaagcccattaatccgccgattttgccatttgcagggagaaaatgcgcgagaagcagcgcctgacacgcgagtgtttgatcccatttgcagagctgcgcaacctgaaagagctgcgcagttcggaggaactgaagtcggagacggagaagagcatgcggagcatgcgtagcagtcagtcgggtgagcgtacggtagcgaccattcgctcaaatatggcatatggtaacgcaggaagcacacggcttacggtcggcagccacaaagcgcagcgggagacggccaattgcgcgttctttgtgttcaaccgggaaattgtgctggccgtgaaataccacgtcagggtgcgaattatgtccgaagatttggccttcattaggaaggtaaatgggacaacggcaggagaccatgttggaaaatgtgactaattacctaaagatgggtcaatcgttaccatataatatatacttccgtcgttacggtacagctgcggcagttggaccacgacaacatgaacaagttgtacggcgtgtgcaccgatgggccccttttgttcgcaatttggcgcaattgtcagcgagggacattaaaagtgcaatttgacagaaaataacatttgttcagtaaaataacatgtcatgtcattaaggaactgatcgccaaggagcaatacgttggggacaattgtgtgatgtttgctctgatgcgggacattgcaaatgtaaacactcacatgggaagtgctttggcattggcacttcccatcagctgtttctttcctaaatcggggccattttcggggatctccgacctcgacattcttctgtcataattggcggcttgccgtttccaatttcttctgcataaattcgaatttcggtcactccatccccagggtctgctcgccatccatcaatcgttcatcggagcccacgggctgctctcctctgaaaattgtctgatcaatgaccggtggcaagtgaaaatcagcgactttggcctgaatatgatcagagaaagtcaaacgctgtcgaagaaaggttggcattgggtttacgaagtaattcgcgtaatttgcgccatttaaagcacttttgtggacggcgcctgaacttttgcgagaaaacaatcggaagggaacaaaagagggcgatgtgttcagttttgcgatcatttgtgtggaaatggtgaacagagagacggtgtggaacggagtggaaagggaccaagacatcgatggtgggagggcggaggaggggatttggaggggaaatttcggcactcggcttttccttttccatcggtgccattgtccgacctttctttagaaatcctttatcggctcagacgcaccaacaccacaatccctcaccgtccgcagcttcatccccgcgcagagattaaccaaagtttggtatgcgcacgcatttctcatggcattttgctgctgctattctgtcttataccatatccccacttaccgtaagcttcatctgatcagagactgttggtccgaagtgccgtccgaacgtccgcgcatggacattgtgcgaacgatgctcaaacagatggtccaggacgggtcagtaagtcaacagcggagcaatcaatggacacgcttgtgatgctcgaaagtctcgagagagcagtctcggggttttttaatgcccttgaccgggtcaaagcttgagtatcggcgatcttaagtagaacaagcgcttttccgatccgcttttgcccccccccccaatttttgcccatttcctttctcttcagcagtcaaaatctgatggattacgtgttcggcatgttggagcagtacgcgagttcgctggagcaggaggtggaggaacggaccaaagagttggtggaggagaagcgcaagagcgacattcttctctaccggatgttgccgcggcaggtggcggacaaactgaagataggcgagtctgtggagccagaatccttccaaatggccaccattttcttctccgacgtcgtctccttcaccactttggccggcaaatgctcgccattgcaagtgccgtaaaaaaagaaaatttaccgctacacttttggaaaaataaattgtcgcatatttttcagaccccaattaatcaattaatttaaatcaaacaagattgatcaaaatgggaaatactgatcaattacattgatcaaaatggggaggaatcgactgatcaatcccatccgtccccacccctctcttctcgtttaggttgtgaatctgctcaacggtctgtacacagcctttgacgggatcattgacactcatgactgctacaaagttggtaagtgaccagcgaatacctcactaatcgtcttcaactctctctcctcctattttattgctttgtattagttctaatttgccattttaattgccccccgccacttctcccctcagaaaccattggcgatggctatttggtctgttcgggcattccgaagcgcaacggcgaccaacacgcgaaagaaatagccgaactttcgttcgccttccttcgcactgtgtccagcttccgtgtcgatcacctcccctccgaacgggtcaaccttcgcattggcttccattccggttcgttttcgctattaccgaatcaaaaagactcccaacggcaccccggggcattccctggcttcttcccaatttggcatttctttacgaatgccatggttaattaattaattaggaccagcggtcgctggcgtcgtcggactgacaatgccgcgctattgtctctttggggactcagtgaacacggccagccgaatggagtcaaacggaaagggtaaataaacgggagaaaaagcgaaacaaaacaaatcaaattaatttggcaaccattttcagcaggccgagtgcacatttcatcaagtgccaaccactttttgaccagtgtaatcggcggatatgtgacagagccaagaggcgaagtgattataaaggtcattaattaaggatgggggcaatggctccaattagtcggttaatcccattattagggcaaaggagtgatggagaccttttggctgttagggcgaattggagaggcacatttgtcggagggcacagcggaaagaaatgcgagtgccgcaacgagaaaatgaagaaacatcacacggcattccctctgatcactcattttaatgactcgaaatcattgaccaattttaatgaattttaatctcttttattattatgatagcgcaatttttgcgcacatttaagcgataacaatttttatattaaagttccccttaacaaatttactattgtaaatactgtctcgaatacaaaaaatgtataatttactatttttctcacgatattcatggcaaaaaggtcatccctaattattaaacgttactctttcatgtgttcattaacacacaataattttttgtctcagatttactaattacatatacaataagaacaaaaatattttttggaaaaagtttacaatataaagataatattaaaggagcaattagtgaaaatgcatataattagaaatgatcgagtc

SEQ ID NO: 85120 - DNA, 1500 bp, Heterodera glycines
  SCN-specific regions: Sequence locations=1-135,157-1353,1375-1500
attttgtccgtcctttgtcccactcaaaaatgctcagtcgaatgttgtcctcggctgttgccgtccctcggatgtgtgaatcaaacaaaaaattgttgaggaaaggcgcgactttcgttggtcttctctgtgggcgaatggccaactcaactttcactgccacagttacccctcctcatcggctcttacgtccgttgcatatcaacgaaaaaaaattgttcggacctggtcccagtaacatgccaccactcgtccaggagggactcgttcaaccgttgcttggacatatgcatcccgagttcttcgaaattatggatgatgtgaaagccggcatcaaatacattttccaaactgagaatgcgctgaccttcgctgtttcgggcactggccatgccgggatggaatgtgccattttgaatctgctggagcctggccagaccattttggtggtgcaaaacggagtgtggggcttgcgggcagcgaatttggcggagagacttggcattaaagtgcatcgattggtcgtaccggagggagaagtgattaatttggacgattttgccgaggctgtggataactaccgtccccaagtggcattcgtttgtcatggtgaaagttcgaccggagtcgtccatcccttggagcgttttggcgatatttgcaatgcatatgacgttcttttcctcgtggacaccgtcgcctccatttgtggtgcccctttccatgccgatgcgctgaaagttgattgtgtgtatgccgcaactcaaaaagtgttaaactgcccgcccgggttggctcccatttcattcagcgaaaaagcactggagaaaataacgaagcggaaaacgcgagtgccctcattttatttcgacgcgttagagttgggcaattattggggctgtttcgacgagccgagaagataccatcacacggcgcccatttcgttggtttatgcgctacgcgaaggtctttcagcagttgcccaggaaggaattgggcacatggtaaaccgacacaaaatcaatgcaaaacttttgtatgacgcgtttgaccaattgggactggaattgtttgtccaaaaagagaataatcgtttgccatgtctcaccaccgtacgcgttcccgaaggtgtcgactggaaggcggtgcaagacaaactgatggcccaaggatttgaaattgccggcggattgggaccaacggcgggtaaaatatggcgcatcggaacattcggaatcaattcgaacccggaggacattgagtcacttaaacaagcattgaaaggagcactttacgaacaagaggaaaagggacagtcggaccatttcaaggcggccatctgatgacagagggaaaaatggcaaaataaattaagacggttaattaacaatgggtagatcattaacataatatatcttttggttattttggcacatttcactatgaacatgtcaatttttaaaaaggacggacaataaagttaaacggcaacaaaaaaaa

SEQ ID NO: 85121 - DNA, 1040 bp, Heterodera glycines
  SCN-specific regions: Sequence locations=1-474,496-834,856-970,992 -1040
gttgtgctgtaatttgtaatttttgaattttcttctaaaaatgaccgccgccgaaattgagctcaaaacttgtgagcaaaaaaaaacgaacggactgacaataaacaatgcgcacgaagagacaaaaatggagccgattgaagaagcgaatttgaaaataattgacacggacatcggatattgtcgctacggaaagggcccagtcaattttctgttcatttgcggtggcgtcggctgttacaaaaaagattatccggagtgtgtactgcgtgcctttgaccccaactttgccaccataatttgcatcgacccgccaggatacggcaccagtcgtccgcccgatcggaagcaggaggtgaaccgttgcaaaatggacgccaaatactgcttgaaactgatggagaccctcaaattgacgccgtttgttgtgttgggatggagcgaagggggcagaacatcgatacacgtggcaggccaagggaagggcctggtcagccacatggtactgctttcgtccggctcccaagtggacatgcggggagacttggcattcaaaggcatgcgaaacacggaccaatggatgcccgcggcaaaggcaccctatttggagcattattccaacgaatttctcaaggaacaatgggccggactttgcgatgttgtagcaaaagtgtacaaggacctcggaggaagttttccatgcgaccgcgttctaaacacactgaagatccccgttttgatcgtcaacggtaacatggaccggttcgtccttgacccgagcttgatgagcaagaaattggaaaatgccaggattgaaatacatgcccagggagggcacgaccttcacatcaaatacccacgttggtttgctttaaaagtgactagttttgtgaaggaatcggcgaaaagtgatgtgaaggcgaataggaaatgaaagtaaaatcagtttcactgcttatattcaacccaatttcactttgtatttttcactgtgatcgtttcgttacaaatgctgccaaataaagcgcgacaaacaaaaa

SEQ ID NO: 85122 - DNA, 1243 bp, Heterodera glycines
  SCN-specific regions: Sequence locations=1-348,374-387,425-548,679 -725,768-811,839-851,886-902,1010-1010,1042-1048,1077-1243
cgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccactacgaacctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactct

SEQ ID NO: 85123 - DNA, 3762 bp, Heterodera glycines
  SCN-specific regions: Sequence locations=1-102,124-1038,1060 -1828,1850-3742
gggatttgaatcccgacaaatcgcctttttaatgaattcatttcattttaaaatttccttgcccaaaatctctcaaaatggaaatgccgtcctgtttcttcctccttttctttcttatgctttttgtcagcccttctcggcaccaattagtcactgttagcaactcatcgtcttcgcccattggcaccaccgtcgcttttggcactccttcgccgatcatcccaatctctactgcaccctccacgaatggcactgccacttttggcgtccctccgccgatcagtccgccgattaattcttcgtcctctctcccatcaactggtcctttggaagcatcggttcagttaaaaatcggcttcctctttgctaacggcacccaacggttgcgaatgcttttcggctttggccaatccgcgcccgccgtcactttggcactcgaacgggcgaggcaggagcacctcatcgacagcatcaacttcacttacacgtggcgaatgtgcggctgctttcagccttgggctgtcggctacgccactcaactggttctgacggaaaatgtggacgctttgatcggtccgccttgtgccatcgccgcgggatacgtggcctccttctacaacattccactgtatttgtggggtgctactgtggcctcggaattttacaacactaccgtataccctacactgaacaacgtgaacgttaactcggacatgttggcgttggccttacaaagtgtgttggtgcaattcaattggacagaagtgtccttcgtgtacactccggacaatgagcgaatggtctgtaactcggtgaaacagagtctcacaaatgtgctcaacgtgaccaatgtgaccattgttttccagcatcagatggagtccaatgtggacagtatgaaggcgacgctgagaaatctgcgcagccgatcgcgaattgtgctttcctgtttcgatgtcgaggttgaccgtcgcaactttctgttgtccattttcgacactggtcttgctgcggacaacgaatttgtgttcatcatgggatccctgcgcaaccagggcatgctccagcaggttgcgtcgcgtgaggacggcagtgtcaaatatgtgaacaattggatggacaaaaacagcccaggcgatggccgcgactcggacgcactcgccgcgacaaaacacgtcataatgattgacctggaaaaccaatcgagtgatcatcttaacgaattcaaccgagatttgagtgcgaaattcggcacttatccctttttctgcaacggaagttgcatgggcggcgcagcagaacaatcgccgtcgcaatacgccagggctttgttcgacacaacatacgcatattttagagcattgaatcgcacaatggaaaagcgcaaatcgaatgggagggatttgttgcgcaacggcacggaattgaacgcagaaactgccgggacgacctttcagggcgagaccggacgcatcacttttgacgcccacggcaaccgccagccgaccttttttgtgacgatgctaaacgcactgaatgtgcccactgttatggtgaaagtgaacattaccaacggagtattgaaaatggaacggctgtacggcagtgaggcgtcgctgtgggtcaattggggcggctttcggccgatgaccacgccgttgtgcggctacaacggcacaatgtgtggccaaaatgtgacggtgtacattctgatcggcgttacgcttatgttgctgttgctggtcgccgctttgcttggcatcggatacgcaattcgggagaaaatgcgcgagaagcagcgcctgacacgcgagtgtttgatcccatttgcagagctgcgcaacctgaaagagctgcgcagttcggaggaactgaagtcggagacggagaagagcatgcggagcatgcgtagcagtcagtcgggaagcacacggcttacggtcggcagccacaaagcgcagcgggagacggccaattgcgcgttctttgtgttcaaccgggaaattgtgctggccgtgaaataccacgtcagggtgcgaattatgtccgaagatttggccttcattaggaagctgcggcagttggaccacgacaacatgaacaagttgtacggcgtgtgcaccgatgggccccttttgttcgcaatttggcgcaattgtcagcgagggacattaaaagaactgatcgccaaggagcaatacgttggggacaattgtgtgatgtttgctctgatgcgggacattgcaaatggtctgctcgccatccatcaatcgttcatcggagcccacgggctgctctcctctgaaaattgtctgatcaatgaccggtggcaagtgaaaatcagcgactttggcctgaatatgatcagagaaagtcaaacgctgtcgaagaaagcacttttgtggacggcgcctgaacttttgcgagaaaacaatcggaagggagcaaaagagggcgatgtgttcagttttgcgatcatttgtgtggaaatgatgaacagagagacggtgtggaacggagtggaaagggaccaagacatcgatgaaatcctttatcggctcagacgcaccaacaccacaatccctcaccgtccgcagcttcatccccgcgcagagattaaccaaagtttgcttcatctgatcagagactgttggtccgaagtgccgtccgaacgtccgcgcatggacattgtgcgaacgatgctcaaacagatggtccaggacggcagtcaaaatctgatggattacgtgttcggcatgttggagcagtacgcgagttcgctggagcaggaggtggaggaacggaccaaagagttggtggaggagaagcgcaagagcgacattcttctctaccggatgttgccgcggcaggtggcggacaaactgaagataggcgagtctgtggagccagaatccttccaaatggccaccattttcttctccgacgtcgtctccttcaccactttggccggcaaatgctcgccattgcaagttgtgaatctgctcaacggtctgttcacagcctttgacgggatcattgacactcatgactgctacaaagttgaaaccattggcgatggctatttggtctgttcgggcattccgaagcgcaacggcgaccaacacgcgaaagaaatagccgaactttcgttcgccttccttcgcactgtgtccagcttccgtgtcgatcacctcccctccgaacgggtcaaccttcgcattggcttccattccggaccagcggtcgctggcgtcgtcggactgacaatgccgcgctattgtctctttggggactcagtgaacacggccagccgaatggagtcaaacggaaaggcaggccgagtgcacatttcatcaagtgccaaccactttttgaccagtgtaatcggcggatatgtgacagagccaagaggcgaagtgattataaagggcaaaggagtgatggagaccttttggctgttagggcgaattggagaggcacatttgtcggagggcacagcggaaagaaatgcgagtgccgcaacgagaaaatgaagaaacatcacacggcattccctctgatcactcattttaatgactcgaaatcattgaccaattttaatgaattttaatctcttttattattatgatagcgcaatttttgcgcacatttaagcgataacaatttttatattaaagttccccttaacaaatttactattgtaaatactgtctcgaatacaaaaaatgtataatttactattaaaaaaaaaaaaaaaaaaaa

SEQ ID NO: 85124 - DNA, 7127 bp, Heterodera glycines; identical to SEQ ID NO: 85119
  SCN-specific regions: Sequence locations=1-121,143-410,435-559,639 -764,787-1002,1024-2020,2065-2351,2373-3447,3469-3664,3686-4203,4226 -5687,5709-5930,5953-5988,6010-6274,6297-7013,7035-7037,7067-7127

SEQ ID NO: 85125 - DNA, 3499 bp, Heterodera glycines; identical to SEQ ID NO: 85112
  SCN-specific regions: Sequence locations=1-36,59-497,519-835,858 -1065,1087-1694,1716-2342,2364-2640,2662-3381,3426-3475

SEQ ID NO: 85126 - DNA, 3008 bp, Heterodera glycines; identical to SEQ ID NO: 85114
  SCN-specific regions: Sequence locations=1-53,75-948,970-1403,1425 -2400,2422-2981

SEQ ID NO: 85127 - DNA, 356 bp, Heterodera glycines
  SCN-specific regions: Sequence locations=1-11,33-41,71-126,213 -219,242-246,277-356
ggaatcgaaggtgttgtaatcttttttcctttcttcacttgtaaatttatttaaattttcaatttttttagctttttttcgaaaatttttttgtctttttttcggcaggcactgcctctgacgatgttttttatttatttagaaaaataaattgattttttttcttgttgatttattttaattatatttcatccttaaatttttttaataaacattttcaaactttcaccttattaatttaaggcgaattttgccttttttaataaattctcttgtgaaaaggcaaaaaataggctcttttaaatatgcctatttaaattactttcattgctttcctttcgcatacgaccatacca

SEQ ID NO: 85128 - DNA, 136 bp, Heterodera glycines
  SCN-specific regions: Sequence locations=1-136
tcgagactgggaaaacccaggacgcacccaacttaaccgccttgcagcacatccccctttccccagctggcataacaccgaagaggcccgaagcgatcgcccttaccaccatccgcacagcctgaatggcgaatgg

SEQ ID NO: 85129 - DNA, 163 bp, Heterodera glycines
  SCN-specific regions: Sequence locations=1-163
ttcactggccgaaattttacaacgtggcgactgttaaaaccctggcgtaacccaaataaatcgccttgaatcatatccccctctcgccagctggtgcaatattgaacaggtccgcaactatcgaccatcccaacacctacgcaccctgaatggggaatggcac

SEQ ID NO: 85130 - DNA, 480 bp, Heterodera glycines
  misc_feature (224)..(227): n is a, c, g, or t
  misc_feature (229)..(230): n is a, c, g, or t
  misc_feature (267)..(272): n is a, c, g, or t
  misc_feature (282)..(284): n is a, c, g, or t
  misc_feature (310)..(312): n is a, c, g, or t
  misc_feature (339)..(339): n is a, c, g, or t
  SCN-specific regions: Sequence locations=1-219,275-480
gttcgaagcggtgaagcagatgtacgacggagtgaaacacctgatcgaattggagaagaaagcataatgggaggaccgatctatgatgatgactttatattgcgtaatgtggagatttgctagttgttctgaatctcttaggctttaactatttaattattgtcccaaaatcgtgcttcatccgtatgattatttccgtgcataaatttgttcgtgttcaaaannnnannaaaaaaaaaaaaaaaaaaaaaaaaaaaaaaaaaaaannnnnnaattcccccnnnattacaactgcttaaaaaaaaaaaannnaaccactctaaatgacccacgtttacntacccctgcatgcaacatcatacctctcctataatggcccctaaatttcattccctggccgccgttttacaaggtcccgcctgggaaaaccctggggtccccactttaagggcttgcagccaatccccgtttggcagttgg

SEQ ID NO: 85131 - DNA, 484 bp, Heterodera glycines
  SCN-specific regions: Sequence locations=1-188,219-302,338-341,367 -402,424-434,476-484
gttccgttttcgcgtgacgaccgtcttggctggctgactttctgtcctaccaacttgggaacgactgttcgcgcgagtgtgcatatccgacttccgaagatcagcgcaaaacccgacttcaagtccagtgttgactcagaacaactaagctgatcgcacggtcttgtaccggcgacgtgtctttcaagtgtctgccttatcaactttcgatggtagtgtatctgactaccatggtgatgacgggtagcggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaatccagctctcaaatgca

SEQ ID NO: 85132 - DNA, 378 bp, Heterodera glycines
  SCN-specific regions: Sequence locations=1-42,64-64,101-378
gtttatatggttccacatttattgttgattttgatgtttgttgataataaatgttttaatttgtaaaaaaaaaaaaaaaaaaaaaaaaaaaaaaaaaaaactcaaaagaagttaccactgcttaaaaaagcaaaaggaggccgcatcaagaggaaccaagattacacaactcttgtgttgtcgacgtcattgctcttcaataacgtcccctaaaatcacttcactccacgtcgttttacaacgcctatgactgggaaaaccctgaagatccccaccttaatcgacttgcagttcctcccccttttcccccgctggcgtaatagcgaagaggtccacaacgatcgcccctcccaacagttgctcatcctgaatggccaa

SEQ ID NO: 85133 - DNA, 145 bp, Heterodera glycines
  SCN-specific regions: Sequence locations=1-145
atttttacaactacatgactgggaatgccctggggttacccaacttaagcccgttaaaacacatccccctttcgccaaaaggcgtaagaacgaaaacgcccttacctatcgtccttcacaacagttgaggaccctgaatgtcgaa

SEQ ID NO: 85134 - DNA, 157 bp, Heterodera glycines
  SCN-specific regions: Sequence locations=1-157
ttcactggccgtccttttacaacctcctgactgagaaaaccctgccgttacccaacttaatcaccttgcatcacatccccctttcttcagctggcgtaataactaaaaggcacgccccgatcgcccttccctccagttgcgcaccctgactggcgaa

SEQ ID NO: 85135 - DNA, 1059 bp, Heterodera glycines
  SCN-specific regions: Sequence locations=1-951,982-1059
atgttggttcaactcgtcctccttgccatcattggcatttcctttgtcggtgctgccgcgccgccgtacggccaattgtccgtctccggcaccaaattggttggctcaaacggcaaaccggtgcagctgatcggcaattcgttgttctggcaccagtggtacccacaattttggaatactgaaacagtgaaggcactcaaatgcaattggaattccaatgtcgtgcgcaccgcaatgggcgtggaacagggcggctatctgagtgacgcgaacaccgcctaccgactgacggcagctgtgattgaggcggccattgcacagggcatttacgtgatcgtcgattggcacgcgcatgaggcgaacgcggacaaagcgattgaattcttcaccaaagttgcgaaagcgtacggctccaaccctcacttgctttacgaaacgtttaacgagccgttggacgtgtcttggaacgatgtgcttgtcccgtaccataaaaaggttatttctgcaattcgtgccatcgacaaaaagaatgtgatcattctcggcactcccaaatggtctcaagatgttgacgtggcggcccaaaatccgatcaaaggattcggtaatttgatgtacactctccacttctatgcgtccagtcactttgttgatggacttggaaataagcttaagaccgccgtaaacaagggtcttccggtgttcgtcactgagtacggtacatgcgaagcgtctggcaatggtaatctgaataccaattcaatgtcaagctggtggagcctgctggaccaactgcaaatttcgtacgtcaattggtcaatcactgacaaaagcgaagcttgtgcagcgctcactggcggaacatcggctgccaatgttggcacttcctcccgctggacgcagtctggcaatatggtagcttcgcaacacaagaaaaaatccaccggtgtgaactgcagcggtggtggtggcgctgctgctaagccagctgctaagcccgccgctaagccagctgctaaatcgaagggaaagtcttccaaagccaagaagtccggatga

SEQ ID NO: 85136 - DNA, 950 bp, Heterodera glycines
  SCN-specific regions: Sequence locations=1-595,618-658,681-950
ccaagtgattcctattcaccacctacctgctgtcctgttgggctagcgttggcaccaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacatgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagggcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcaagcgcaccaatgctttgcatgctgtggcggactgcctggattactggcattcctgctttgatt

SEQ ID NO: 85137 - DNA, 368 bp, Heterodera glycines
  SCN-specific regions: Sequence locations=1-21,44-368
aaaatttgaatgctgaaattgcagagctgttgaagaaggaagctttgaatgttcagcagacatcagtccgcattgatgaggacaagcaacacaaattgcagtctgcattgggactttccaccaagtatgcagatatacatgaatagaagagacttgtggggattgcttgtagttgcatgaagaaccaacttccctctgacacaatgcatgctattttgctactatgttccaatcttacaaagaatcattctgtcgctcttaccttttttgacgctggtggtttaagtttacttctttctctgccaaccagtagcctctttcctgggtttgacaatgttgctgctggtattgtccgtcatgttatcgaa

SEQ ID NO: 85138 - DNA, 173 bp, Heterodera glycines
  SCN-specific regions: Sequence locations=1-8,136-173
ttcttggtcttctttttcttttcgtccccttcctcttttttcttctcggcttcgtcatctgacacgtcatcttctggcttctcctcctactcctttgcttcatcttccttcttctcctcctctgcctcatcatccgaaatttccttgtcacgctccttttccactagcaattt

SEQ ID NO: 85139 - DNA, 344 bp, Heterodera glycines
  SCN-specific regions: Sequence locations=1-3,119-119,209-344
ttcgttgaaaggagattcaggagatgaaatcggtggctcaggagcatggtgaaattgtcttgctttgtgtgcagaagaaggagcttgagcaggggaatgtactataactggtagtggtcttggtgttttgtatggaggtgcagaaactggttctccacctttggtccaattgaagcttctagaaggtgttgatacaggagagacaacaggtgcttgagcatggaaatgcactatagctgatggtggctttggtgttttgtacacaggtgcagaaactagttctccaccaggtgctggtgattttggtggaggtgctgctggtatgactgggtggaccaatggag

SEQ ID NO: 85140 - DNA, 334 bp, Heterodera glycines
  SCN-specific regions: Sequence locations=1-59,81-334
gatttccaccatcgcttcgttttccaatgtttggccgtatcgctttggcacaaattgagcagctgaagaatgggtgcaggcgttgtcgtgctgtctttcggtgcatcgcatcgccgaattgagcagactctcttttggggcgaagcacgccttcacctggcggaagttgccaccgagcgaagtgatatgagattggcacgtgtccaagcatggctccatcgtcttctgatagcggtctttgcacggcttaatctccgcacatttgcactgccttttcatccccgcgggcggttgccgttgcgctgccaccgcttgtcgcgcggccggtcgcgca

SEQ ID NO: 85141 - DNA, 389 bp, Heterodera glycines
  SCN-specific regions: Sequence locations=1-389
atggtaaccaacagaaccatgctaccggacaaacgccgcctggcagtccgaaaggtgggcacggcaacaacaaatcgccaacgacgccgcacggtgccggttcgccacacggcacgcagcatggtaaccaacagaaaaatgctaccggacaaacgccgcctggcagtccgaaaggtgggcacggcaacaacaaatcgccaacgacgccgcacagtgccggttcgccacacggcacgcagcatggacaaacgccgcctggcagtccgaaaggtgggcacggcaacaacaaatcgccaacgacgccgcacagtgccggttcgccacacggcacgcagcatggacaaacgccgcctggcagtccgaaaggtgggcacggcaacaacaaatcg

SEQ ID NO: 85142 - DNA, 450 bp, Heterodera glycines
  SCN-specific regions: Sequence locations=1-100,122-420,444-450
atgcgcacttttctgttcatagccgtagtcgggttgatgttggccgtcatcttggagaatgtaaatgcgacgccgacaaagggacaatcgctgccagacagtacaaaacgggaaacagaacctaaagaagagtatggtaaccaacagaaccatgctacagtttcaaatgaggtgcagaacgttgactacagacaacaagctcctggaaaacagtcgctagacagtccaaaccatgaaaaagaccataaaaatgagcatgaaaagtatgaagcagcttactttcaaatttcaaatgtggtgcagaacgttgacaacaaacctcggccatctgctgctgcttcacaccttgtgccagtaacaccagggaaagtaggaggagcaagccttaaaatggtgaagaaactgtgtggaacgatgatgccaaccatgaacaaacccaaagctgttgta

SEQ ID NO: 85143 - DNA, 581 bp, Heterodera glycines
  SCN-specific regions: Sequence locations=1-581
atgggccaaatcaatgtatgcgacgacgtttggttggacacattggcatggatcaatcgtgtagaagtcggcatgaagttcgcgctggtcaatgttcggttaaacgctttggcggacaaacatttcaagcagaggaagtggtgcttcggcgagtttcatacctgtgagcggatgacggaagaatcgggcgcagaaatcatgacatcgatcgacggctccgacttcagcacgttgccactgcccaccactccgttgccggacagtgtcgtcggcttccgatcaatttccatttggtacatcaatgaagaggtcgtcaattttctgcgcacaattcgccgtctccttaccaaagacattgcgctggaattctccactttcttcacggaatatcgcagttggaaagtgatggcacaacacatttggccactgttgaaagatgggatcagcaccttgtgcctgaagaagtgtgacttgggccatgctccgtcaaacacgtgtcgcccaccgtgctgtttcgactgtgccggcctggaccgaattcacaacgcaaaatgcttgccccgagtgttcgtcttggttga

SEQ ID NO: 85144 - DNA, 866 bp, Heterodera glycines
  misc_feature (19)..(19): n is a, c, g, or t
  misc_feature (25)..(25): n is a, c, g, or t
  misc_feature (38)..(38): n is a, c, g, or t
  misc_feature (63)..(63): n is a, c, g, or t
  misc_feature (77)..(77): n is a, c, g, or t
  SCN-specific regions: Sequence locations=1-82,108-560,584-812,834-866
tccttaagaatgccatctntttggnattttgccccttnattttccccaccaattccctttctnatttccgtcctttngcttcttttctgtctccaattctttcctctcaatgcccttcatcattcggtttttgttcgacgtgacttgagccgacccgcgccggatgatggcgtcgcgtccgcctccatcaacacggaggaggatttgggaggactgaacaccgaatggctaactgacgatcagctgagcgaattggcctctgccgggagtaacgaagaacgaatgataaaaatgaggaccttttatgacaatttggaaggcgaagcgaagaaaggcgcaacgaagaaaatagtggaggaatgctacggatgggtggacgaagtggcgacggaggacgagcgaaacgcactgaagcaaatgcaccaccaaagccatgacgaatgcaaggccaaagtcagggaactgatgggacggctaagtgaggagagaagcgaacaagtggagaatcggatgggtttctgcgaacacgtctattacgggaagatggacggggaaggcgacggaggagcaggaacagctggagacgaacaccaccaccaccatcatcaccacaccaaaagacgggctcacaggcaacgcagagaccaccaccaccaccaccatggcgaacatggacttgaggattatttcaaaacgcatttggcatggttaacggatgagcaaaaagcggaaataagcgggatgaaggagtcagggaaaagccgacaggaaataaagcagaaagtgatcgaattgtacgacgcaaccactggagaagcgcgagaaaaggcaacccgacttgctgaagggcgggtgcccgagagctg

SEQ ID NO: 85145 - DNA, 1002 bp, Heterodera glycines
  misc_feature (649)..(649): n is a, c, g, or t
  misc_feature (721)..(721): n is a, c, g, or t
  misc_feature (769)..(769): n is a, c, g, or t
  misc_feature (781)..(781): n is a, c, g, or t
  misc_feature (826)..(826): n is a, c, g, or t
  misc_feature (844)..(844): n is a, c, g, or t
  misc_feature (853)..(853): n is a, c, g, or t
  misc_feature (868)..(868): n is a, c, g, or t
  misc_feature (964)..(964): n is a, c, g, or t
  SCN-specific regions: Sequence locations=1-1002
atgaaaggatttgtttccaaagacattgtttgtatagcaaacatttgtgtacaaaaacaggaattcactgaagcgaccagtgagcctggcctcaccttcgtggctgcgaaatttgatggcattcttggcatgggattttcggaaatttctgtccaaaaattgccgaccgtgttcgacaacatggtcacgcaacagaaagtgccggagccggtgttcgcattttggcttaaccgtgacccgacctctgaatttggtggtgagatcaccattgggggcactgatcagcgacgatttgtggccccaatcacttacacaccggtcacacacaaagcctactggcaattcaagatggattcgatcagtggaggtaatggcaaacttgcgtgccaaaatgggtgccaagccattgcggacaccggcacttccctgcttgctgggcccaaaaatgacattgaaaagattcagaaacacattggagcaattccactcttccatggcgagtatatgatatcatgtgaacgtattcccacactgcccgatgtgacgatcaacatcggtggcaaggcgtacaccgttgaagggcgaggactatgtgctgaaaatgaccagcatgggcaaaagcatatgcctttccggttttatgggcatngatttgccggaacgtgtcggagaactttggattcttggcgatgtgtttattggtcgttactacacggtgttngatgtgggccaaagtcgtgttggttttgcgcaggccaaagacggaaangaaattccaatngagcctcaagtgcgcgattgcgtaaggggaggcgcactttgcttngatcattccaacggagtngacgattcngatcagcagatggtngagggcgattttgtaatgacggactgaagaaaattgattttatttatgcaattttcagttttatacaatttttaatccatgacgaagcctatgagnaaactatttttcctagtctgataattgtaatcaccatg

SEQ ID NO: 85146 - DNA, 840 bp, Heterodera glycines
  misc_feature (406)..(406): n is a, c, g, or t
  SCN-specific regions: Sequence locations=1-76,98-111,169-840
atgttcgacaaaatggagaaggacggggacggaaaaatctcttcggatgtgctgaagcgatttgccaccgccggaagtgccgcgggggcggcgggcgaacgcggagacgaattgctgaaggacatttttaaaaagaaaagtgatggagagacaacagaaactggtgacgcgaaacaacagcaaattgaggaatcactcgattttgccgcatttttggacaaatttgaaatggtcaaagagtttgttgatgaaatcgccagcgcagcggaaaagcaagatgcagaaatccccgctggcaccgaagagggcgacaaaacggacgaccaaagcggcgaagagggacaaaaggaaaccgaaaaatatgagcagaaaacgcgcgaacttatcgaacgggcggaccaggctngcaaagagtacgacgaggtcgccgacaaagtgtccgacttggagaggctaattagagaatcctcctcctatttggacgtagaatttgggccggacagcgcgtgggcaccgctgaagggccaatgcgcggaattgaccaccacccaatacgtgtcaaactgtgcatgttcgaccgaacggtgcaaaaggaccgaaacggacactcggagatcagcctgggccattggggcaagtgggccgggccggaaaacggcaacaaattcgaggctcaacgctatgaacatggccaaacgtgttggaatggaccggagaggtccactttggtgcagttcgagtgcggtgaacagttcgaacttgtggaaaccagcgaaccgtccaagtgcgaatatcactttttggcaaaatctccgaccgcttgtgctaacccggaggagc

SEQ ID NO: 85147 - DNA, 681 bp, Heterodera glycines
  SCN-specific regions: Sequence locations=1-140,162-681
atgctgaaggaagtggaagaatggtacgcacatcacaaaaatgatgaacataaaaaagctccagtttttgtgttcaagtgtaaagacaatgtcagtctggtgataaatgttcatcttgatgcagtccggctttccaaggagttgtcaaatatgcttgaagatactgccgacgaaggatatccgaagccaatcccgagtccagttcagaatttcaaaagtgacatcatgctaaaactgattaaattgtgtgaagaatacaagtacaaattcgatggcctaaagaaaacaactgatgtgccaactggagaagtcgcggaggcatcggcttcaaatgtccaagagggtgacgttggggaggcatcggcttcaaaggtcaaggctggaacaattgcggaggaaatccaaaaattcgttcctccgccacacattatgcaatgggacgtgaaaacggaccttgagatggttcgggccgccgacttttataacatcaatcgtttgatcaacgatgattacattgacaatgtgtacgaaatcgtaaaagtcaaatggatcaatggcaaaaccgccgcaggaaatttcgcaagggattcggcgtcgaagagcccgtacccgcccgggacatccgaaatgggcacgagtttgcgaaggagcacgagttgggacgaatcggtccaaggaact

SEQ ID NO: 85148 - DNA, 360 bp, Heterodera glycines
  misc_feature (177)..(177): n is a, c, g, or t
  misc_feature (287)..(287): n is a, c, g, or t
  misc_feature (318)..(318): n is a, c, g, or t
  misc_feature (334)..(334): n is a, c, g, or t
  misc_feature (355)..(355): n is a, c, g, or t
  SCN-specific regions: Sequence locations=1-177,218-360
atggagtccgacatggcttcttcgagcctggagacgtcgatgaccaactcggccaacatcgcccgacaagccctggaggagttgcccgtgaaacaggtccgacaaatggaacaaattgcggaggagggaaagagcaaaacggtggaggagcaggagagggcactgcgcgagtacgcngagaagaacagcgaaagtgtgaagaaggctgttgaccaagtgttcgtcgccaaggaccgggcggacatcgctttggagacgtacttgaggagccacgctgtcaccttctnccaggaggcgcgaaaggccaacgaccagatnctgttccttgatgaangacaagaaagctttaactttngagga

SEQ ID NO: 85149 - DNA, 760 bp, Heterodera glycines
  misc_feature (460)..(460): n is a, c, g, or t
  misc_feature (541)..(541): n is a, c, g, or t
  SCN-specific regions: Sequence locations=1-204,226-344,366-628,650-760
atggtagcggggggcacccaaaaaaggagaaagccccgaaccgaaaaaggaaaaaaagggccaaaggaggaagcccgaaaagggaagaaaccaagaaaggaggggggcaaaccggaacaagctcaagaaacatccaagccccaaaaggggggcccggaaaagggaagaggccaaaaaggaagaaagcaaagcccagcgccccggccgtctttaactgaaagctgccgacaatgcgaacaaaacgggtcaatgactcaagggttaaacaggcaaaagcatcgaaaaaacgcggcccaagcaacggcaaagaaaaccccggaaagagcaggaaaaagcatcgaaagaagtggcagaaaaaggaggaaacgaacagctgaagacggctgtcaccaaaattttggaggcaaaagcgaaaaacgacgcggaattggaaagcgaagtgaaaacgaaaacggcaacnctttccgaggacagcaaaaaggccagcgcagagtcgactttgataatcgaagacaaaaagacgcctttggacgaaaaggtnaagcggacggaggagctgacagccaaaatgtcggacaacacgaacaaggagctgaatctgaacaacagtgccgacgtcgtcgccttcgtcaagtcgtactccgccgtcgccgtgccggcggtggccacggagggcaaagcatgatcaatcagtctgatcggaggattcggcattgttgtgtgatgaaatgtagccaacaacgaaattcattgatcaaat

SEQ ID NO: 85150 - DNA, 702 bp, Heterodera glycines
  misc_feature (611)..(611): n is a, c, g, or t
  SCN-specific regions: Sequence locations=1-702
atgaacattctgctgaagtctgttctattcatctctcttctgtcactgtttggtgattgcatgaaaaactcagatcaaattggagtcaaaagaaaatcagcaggaataagaattgaggaaccaaatgatgtaaaaggcaaaggaaaagtcgtcgaaacaagcagaaaaggcaaagaaaaagtcggcgaaaaaataagcgttatgaacacagctgaacgcattgaaaaaatggaccttgcccaagacaaagctaaaatggaaatagacaatatagacaccaatgccaaacccaaacaaaatgaggataaaggcgttatgaacacagctgaacgcattgaaaaaatggaccttgcccaagacaaagctaaaatggatatagacaccaatggcaaacccaaacaaaatgaggaaaatgctcctccaaaatatgttttcatttggagcggtaacaatgagaagaagaaccttgaggttgacctcagagtgatccgtcactccaaaaaactcagcgaattattccatgccaaaagtgatcaatccgtcaatgcaaaacacggaaagcaggaagcattacccggttccgaaacaggaagccgaaaaaatgctcgaanggaagtggaagaatggtacgcacatcacaaaaatgatgaacataaaaaagctccagtttttgtgttcaagtgtaaagacaatgtcagtctc

SEQ ID NO: 85151 - DNA, 553 bp, Heterodera glycines
  misc_feature (177)..(177): n is a, c, g, or t
  SCN-specific regions: Sequence locations=1-225,248-385,408-553
atgaatcccaacggttttttctttgttttagcggtgctctttcttgtcaaagtcgactttttacagtgcaaatacaatgaaccaatggcacgacaggtgctgcaaaagcatgcttcacaatttcagcagcattgtaaaaatgcccgcagaggaagtgccgtggccaaatgttgcagngccatcagaagcataatgggccgattcacaagccaaaaaaaggcaatgaaccaaatgctggccaagtgtaaagcgggcacaacgccaagcgaagcacagcaaatgcgaagaaaattggaaggatcgaataaactgaaggattgtggccagtttaaaagccaaattcagcacaagttcagcgagttgaagcagtactgcaacaatggggcagaaaatgaggaggaaaacgacgaacgatcagagagggagagagaagaggagagagttttagagagagaggaacagcaaaattctaatcaccagcgatcactgataattgccgatcgattgaccggtttggctgatcaagtttttttatggcataaagagttgcgtc

SEQ ID NO: 85152 - DNA, 270 bp, Heterodera glycines
  SCN-specific regions: Sequence locations=1-270
atgttcgctcaaactcttcaacagcagcgcgggtttggcaccagcttcaaatttcctggagagggcaaaaaatcgtcaagtggcagaggcgggaatgaggccggaaatgatgacgatgacctctacagccaaagtgtgaacattgattattcggaagtgatatcatcagatgatgagcaaaatatgtcattgtttaattgtattggctgcatttttgcgccttgtcggttattatgtgtattgtttttcatttatggaaaggtggaataa

SEQ ID NO: 85153 - DNA, 936 bp, Heterodera glycines
  SCN-specific regions: Sequence locations=1-177,199-791,815-884
atgcttttcattctactggtcataactttcgtccaaattggtcaactgaatgctggcatatgcacatttccaaatccgtcaaaaagtgttacggtccaatcgatgatgactgtttcatcgagtacggactataagaacactttgtttgtcggcggttccggcattttgaacggcgcgtgtgatgtgaacaatgacaaactgaaatatttgatgacattgaagaatggcgtgaccatcaaaaatgccattcttgacacgcccggtttgggcatttactgcgagggcaattgtgtgctggaaaatatttactacaagcgattgtgttaccatgctactgggttcgggtataagagcaccagcacttcatacacttaccaagtgattggcggtgctggccaaggttcacctgacaaatatttcacccaatcgggcaaaggcactaccatcatcaagaatttttgcgctgaaggcaaatacggcaaattgtggtgttcatgcgggaattgtccgttccaaacggctcgtaccgtacaaatttccaacaccgtccttaaggggcccggactttcggttgtctcgcttaattccaactacggtgacaaaatgtcactttcgggactgactttgcatggccaaaaatcagcgagcacaaaaacgtcatacatttgccaagagtacaaaggcctcacttatatggcagccatgagtcctcaagcgaattatgagccaaccaaatcgggcagtggcacatgcgcgtacagtgcctcggcagttaaaattgcgagctaatttggagaaataaatgaagaaataatggagggttgagtgatgaaagtaaatttagaaattaaatgatgttaatacaacctgttaattgtcggacgaatataaataaagattaaaaataatttgcttctaaaaaaaaaaaaaaaaaaa

SEQ ID NO: 85154 - DNA, 2062 bp, Heterodera glycines
  SCN-specific regions: Sequence locations=272-272,380-380,432-567,589 -687,717-736,758-821,847-1625,1649-2062
cggacacaaaaacccacccgaaaatgttccatttggccgccatcgttgcgctagcggcgctcgcactgcccctggcatcttcagacaagttcagaccatgcctcgagggctacgcacaatacggcaaatactgctacaaggcattcacaaacccggacaaaagcctgccatggtcagacgctaacaaaatgtgcaagactgaaggtgccgaactcgcgtcagtgcacagcgaaacggagcgcgaatttgtgaacatgctcgtccttagggaagcgaacaaaatggaattcaactgcaaacagccgggccgcgccttcttttggtttggcctgaagctgaaatggagcgaaaagaagctggaggatgcaagttggacggatggaaagccggtggactacttgagcccgaccgagtggggcgcgtacaaacggccgttgacgatggacaacgcaggcggggccggctacaacaaagagaacgaaaactgcgttttccttggccaatggccgcgcaaagtgaaggaatatctgtcgctggagacggcgctggacaaaagcggcgtggatgtgctgtggatggacgtggtgtgcgagaagccggaggagtactgggcaccgcacggcgccgtgtgcaaaatgcgcgccaaggaggaggagaagggatacggtaaagacaagtacggtgcaaaggaggaagaggaggaggaggacgaagagcttcgcaagatcaacaagtacgtcaccatcggctcgggcaacttcatctacgccaacaagaacacgtacatgattctcctcctgaaagacttgtacggcaagcagttgaaggaggagagcaggaagaaggtgtgcgaattgtacaatggcgaatatgtgaaggtcaaggacgagccgaaggaggcacaagaatacctggacaaagtgctggccaaggaaaaggagctgtactctgacgccagcgaccacatgttctgccgcttcaccggcatcatcggcgcgtgcggcgagtcgtgctacaaagtgccgttgccaatctgtgccgagggatacgcgtacttcagcgggtactgctacaaggcgttcaccaacgcggacaaagaagtcaaatattcggaagcgcagaagatttgcaagtcggacggggccgaactcgtgtcgatgcactcggagttggagcgcgagtttgtgaatgttgtggcactgactgcggcgaagaaatacgaatacaacgccaaagtgccgggattggccttctactggaccagcatgcagttggagtgggacgagaagaagctaaagaacgccagctgggccgacatgacgccgatggactacttgagcccgatggagtggggcacgaagaagcgtccggtgtacgtggacaactcgaacggcggcgagtacaacaaagaaaacgaaaactgcgtgttcattggccaatggccacgcgagggcaagcagtacctgaagttggactcggcagtagacaagtacggtctggacgtgctgtggagagacgaggtgtgcgagaagccgggcgaggactgtccgcgcggcgccgtgtgtaagaagagggctacggtgggcgaatgctacggcacaggggcgtatctcctggacgcggccgaggaggaggagatgaagaagctgctcaaattcatcactgtcggatccggcacttttgtctatgctgaaaagaacacatacatggtcctcctgctgaaggacttgtacggcaaacagatgaaggaggaggacaggaagaaggtgtgcgcttactacaaggcggagtacgtcactgtaaaggccgagccgaacaaagtgcaagaatatgtggacaaagtgttgtccaagcagaagcagatgtacgcggatgcgagcgaccacatgctgtgtaagttcagcgggacactcggcggatgcggcgactattgcaaaacgggatattgagaagggacggacggaagggaaggaacactttctcattagcatttagtcgtcctttgttttagttaaaatggtgcgctttttctctctgatttattgcataaataaaaaatttt

SEQ ID NO: 85155 - DNA, 819 bp, Heterodera glycines
  SCN-specific regions: Sequence locations=1-142,164-438,460-462,484-819
atgaattcgtccgtcgtttcattttcgctgttactttttgggttattcacaattcgcactgcaaaatcgcaatgcgagaaacattgcactaaaagcaaaccgatgggccaatgcaatgaggcggaagaagtgattctgcgcaactccgactgtgccttcatgaagaaaacggaaacggcattcgaatttgtggtcggaatgaatggccaaacggaggacaaaacggcgcccggggccaatgccaatggggcatttttgtgctgtaaggcaacccaaggaaccgcaacacttttcatcgtcggcgtggccaacaaacggctgatgttggccaaggacgtggtcaattacaagtttcatcaaaacatctcaatcgatgattttgaacgggaaaagcaagtgttggaaagtgtttcggcgcagggacaaaaagccggcattggggacaattatggagaaaaattcttccaggaccaaatggacgccaacaaaatgattcagaaaggctctgtgaagctgtggaccgccaacaaatcgttgcctcctcaaaatgtgccggatttacagaaagatacccggcccaaagtgacggcggcgacagaagaaatgattttggcactgaaggtgtttcaacagtttcgaaagaacaaaaattgttgggcatctgtggaaaaggaactcttaaagtcgcaaagctttttgagtttggccgaacccaacggaaaggacgcaatgcgaaaagcggcggtgcgattgtgcgcaaaaatggaagcgaaaattgaggcacaaattgacgaaacggcaaagaaattgttggcctga

SEQ ID NO: 85156 - DNA, 792 bp, Heterodera glycines
  SCN-specific regions: Sequence locations=1-656,678-792
atgattcttttcattctattggtcataacttttgtccaaattggtcaactgagtgctggcatatgcaaatttccaaatccgtcaaaaagtgttacggtccaatcgatgatgactgtttcatcgaataccgactataagaacactttgtttgtcggcggttccggcattttgaacggcgcgtgtgatgtgaacaatggcaaactgaaatatttgatgacattgaagaatggcgtgaccatcaaaaatgccattctcgacacgcccggtttgggcatttactgcgagggcaattgtgtgctggaaaatatttactacaagcgattgtgttaccatgctactgggttcgggtataagagcaccagcacttcatacacttaccaagtgattggcggtgctggccaaggttcaccggacaaatatttcacccaatcgggcaaaggcacaaccatcatcaagaatttctgcgcagaaggcaaatacggcaaattgtggtgttcatgcgggaattgtgctttccaaacggcgcgtaccgtacaaatttcaaacaccgtccttaaggggcccggactttcggttgtctcgcttaattccaactacggtgacaaaatgtcactttcgggactgactttgcatggccaaaaatcatcgagcacaaaaactaattacatttgccaagagtacaaaggcctcactcacatggccgccatgagtcctcaagcgaattatgagccaaccaaatcgggcagtggcacatgcgcgtacagtgcctcggcagttaaaattgcgagctaa

SEQ ID NO: 85157 - DNA, 1009 bp, Heterodera glycines
  misc_feature (694)..(694): n is a, c, g, or t
  SCN-specific regions: Sequence locations=1-23,54-120,165-294,325 -337,359-408,444-447,473-508,530-540,587-600,634-892,925-930,1005-1009
acctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctntccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgcccat

SEQ ID NO: 85158 - DNA, 659 bp, Heterodera glycines
  SCN-specific regions: Sequence locations=1-7,29-659
gtttgaggtttctttttatttctaaacattatgaagaagtttgactatctcgtcattggcggcggttccggtggcatcgcatcggcacgccgtgccgcggaattcaaagtgaaagtcggactcatcgagtcggagcgccttggtggcacatgcgtcaaccttggatgtgttcccaagaaagtgatgtacaacaccgccatacatgccgagtttctgcgggaccatgctgactacggcttcgactcaatgaacgtaaaattcaattggagcaaaatcaaaaattcccgtgacgaatacatccgccgtctgaattccatgtatcagaccaacttggaaaattccaaggtggaaatagtccgtggacgggccaaattcaacaaagacggctctgtcgaagtctccagaagtgatggctcaaaagagacatgtcagggtacgcacacactgatcgcagtcggcggtgcgccgcggattccgaaggacgtgccgggcgccaggtatggcacgagcagtgatggattttttggctttgagcaaatgcccaataaaaccgtcgtggttggtgccggacacattgcagtcgaattggcatcaattttggctgaccttggctctgaaacccatctgctgatccgttatgatcgtgttctgcgcagtcg

SEQ ID NO: 85159 - DNA, 1052 bp, Heterodera glycines
  SCN-specific regions: Sequence locations=1-7,29-487,523-1052
agtttgagaatggaaaaaggaatcagttcggctgtgttttgtggacctttctattcgtcctggccgacttggccgcttccttcggctccatctgtttccacggttcctcgccgtcggttggacatttttccgatcagttccgcgccccctatctgtttaaccgttccgttttcgactttttcgtgatctcagtgctcagatcgtttttcatttcgcttggatgtgccatttgcatcttcaaaaatgcccaagccccccgaactctcgctcaactctctcaggcctcatttggcctttgcattttgctctgttccttctcgcctaccaaatttcttgcgcttagcgacaactcaggccctgaccatcccggcactctttttcccggcgacattcccctcattctcgccaatttcatcttttccatcaccgcccatcgcctttggctgtttttcttgcacacggcacaaaaaaatgaatatgaaaggatggaggaggaagaggaggaggaagaagaagaggagggcaatgaacggattgagacgcgaaatggggcggtgaaaggcaacgtgcgcacttttgtgatcatccttcggctgcttcagtactgccgtaatgaatggttttggcatctcagcgggttcacttggctgttcatctactcactgactcgtattttcatcccctacttcaccggccaagtgatcgccagcgtcgtctcttcctccggcgaggaatacgcttctctgatctcttccgtcaaactgatgcttttcatctctgtcatttcggcaatggccggaggtcttcggggcggttcctttgaatatgcttactctcgcatcaatcgggcaattcgctataatttgtttgcttctttggttcgccaagaagtcgcctttttcgacaaccataaaactggcgaaattacttcgcgactgaccgcggatacgaccacaatgtcggatacaatcgctcttaacgtgaacatctttctgcgtaacactgtccaaatgggcggttcgatgctttttatgatgactctctgctggcgc

SEQ ID NO: 85160 - DNA, 975 bp, Heterodera glycines
  SCN-specific regions: Sequence locations=1-1,445-580,602-700,730 -749,771-834,860-975
agcccccaatcgccggacacaaaaacccacccgaaaatgttccatttggccgccatcgttgcgctagcggcgctcgcactgcccctggcatcttcagacaagttcagaccatgcctcgagggctacgcacaatacggcaaatactgctacaaggcattcacaaacccggacaaaagcctgccatggtcagacgctaacaaaatgtgcaagactgaaggtgccgaactcgcgtcagtgcacagcgaaacggagcgcgaatttgtgaacatgctcgtccttagggaggcgaacaaaatggaattcaactgcaaacagccgggccgcgccttcttttggtttggcctgaagctgaaatggagcgaaaagaagctggaggatgcaagttggacggacggaaagccggtggactacttgagcccgaccgagtggggcgcgtacaaacggccgttgacgatggacaacgcaggcggggccggctacaacaaagagaacgaaaactgcgttttccttggccaatggccgcgcaaagtgaaggaatatctgtcgctggagacggcgctggacaaaagcggcgtggatgtgctgtggatggacgtggtgtgcgagaagccggaggagtactgggcaccgcacggcgccgtgtgcaaaatgcgcgccaaggaggaggagaagggatacggtaaagacaagtacggtgcaaaggaggaagaggaggaggaggacgaagagcttcgcaagatcaacaagtacgtcaccatcggctcgggcaacttcatctacgccaacaagaacacgtacatgattctcctcctgaaagacttgtacggcaagcagttgaaggaggagagcaggaagaaggtgtgcgaattgtacaatggcgaatatgtgaaggtcaaggacgagccgaaggaggcacaagaataccaggacaaagtgctggccaaggaaaaggagctgtattctgactccagcgat

SEQ ID NO: 85161 - DNA, 650 bp, Heterodera glycines
  misc_feature (546)..(546): n is a, c, g, or t
  SCN-specific regions: Sequence locations=1-650
agtaatttcaagtccaaatggacgccgttaaagcgccaactttggcttcgattcaccacaaaaatcgtctccaatctccgctcaatgcccacggccatcctttgatcattgaaaatggcactgtcgcagaaacattagtggacaaagaagaagaggaattgacggaacaagtcggcacttttttgttcacttccgaatctgtgggcgaaggacacccggacaaaatgtgtgaccagatttctgatgccattttggatgcgcatttggcattggaccccgcagcaaaagtcgcctgcgaggttgtcacaaagacaggaatggttttggtctgtggggaaactacttcgagcgcaaccgtcgattaccaatcggtcgtccgcgaaacgatcaaaaagattggttacgatgactccagcaaaggatttaactataaaacgtgcaatgttttggttgcgttggaaaagcaatcgcccgagatcgccgcaggtgttcacgaagacaaggaaccggaagatgtgggggcccgggatcaagggattatgttcngctacccttccgacgaaagccccgaggcaatgccactgactttggtcctttcgcataaattaaatgccaaataccaccaacttcgaaggtccgccgttttgccc

SEQ ID NO: 85162 - DNA, 255 bp, Heterodera glycines
  misc_feature (9)..(9): n is a, c, g, or t
  misc_feature (37)..(37): n is a, c, g, or t
  misc_feature (42)..(42): n is a, c, g, or t
  misc_feature (46)..(46): n is a, c, g, or t
  misc_feature (124)..(124): n is a, c, g, or t
  misc_feature (186)..(186): n is a, c, g, or t
  misc_feature (225)..(225): n is a, c, g, or t
  SCN-specific regions: Sequence locations=1-255
atgcagagnagtcccatgctcactttgcttttccatngcagnattntggggatcatttcccttctcagtgccattgactcttacttcatttctcacgctttcttcacaactttgatgcgggggnccggcgctcaaattgtgtttggatttgagtacgccgttcttctcacaacggttgcgcatacnaccatcaattacattttgcatttgcacgatttgcgttcnccgcacccctgggaaaacaaagctgcgtac

SEQ ID NO: 85163 - DNA, 185 bp, Heterodera glycines
  misc_feature (155)..(155): n is a, c, g, or t
  misc_feature (158)..(158): n is a, c, g, or t
  misc_feature (181)..(181): n is a, c, g, or t
  SCN-specific regions: Sequence locations=1-37,68-104,126-185
acaacgatgagaatccgaatccggaaatggatgatgaaatgatggaagaagaggcagcgcatcatgaggacgatcagctggtgttaggcagtgatgaggacgaacaggaggaccccaaggactacagaaaaggtggctaccaccctgtgcagatnggngatgtgttgaaaaatgggcgatnccac

SEQ ID NO: 85164 - DNA, 142 bp, Heterodera glycines
  SCN-specific regions: Sequence locations=1-142
cgacagaactcttttaaagactttcaagtttataaaagagttctgtcgcacatcatttatattgatcgatttctgatcactcgcaatgcatattaatgttcttcacggctcagcgtccaaatcagccatcaaagcccattcc

SEQ ID NO: 85165 - DNA, 1615 bp, Heterodera glycines
  SCN-specific regions: Sequence locations=1-553,575-1033,1163 -1438,1460-1615
aattcgctttcatcgttcaaatgtgccgactccaagcaactcatctgctcgctcgactctttctgcttcttgcgctttgcactgctctcgttagctctctcactgctgttgccccgccattcggccaattgtccgtttccggcaccaatttggtcggcgccaacggacaacccgtacagctgatcggcaactcactgttctggcaccaatggtacccgcagttttggaacgctgacacagtgaaggcactcaaatgcaattggaatgccaatgtcatccggggggccatgggcgtggacgagggcggctatctgagtgacgcgaacacggcttacaatctgatggtggcagtgatcgaagcggccatttccaatggcatttacgtgatcgtcgattggcatgcccacaattcacatccggacgaagcggtcaaattcttcacccgaattgctcaagcgtacggctcctaccctcacattttgtacgaggatttcaacgagccgctgagcgtttcgtggaccgatgtgctggtgccataccacaaaaaggtcattgctgccatccgagctattgacaagaaaaatgtgatcattctcggcactccaacatggtcccaagacgtggatgtggcatcacagaacccaatcaaagactaccaaaatctgatgtacactctccacttttacgcgtccagtcacttcacgaatgatcttggtgccaagctcaaaacagccgtgaacaacggtttgcctgtgttcgtcactgagtacggcacatgcgaagcgtcgggcaacggcaacttgaacactgactcgatgtccagctggtggactctgctggacagcttgaagatttcatacgccaactgggcaatctccgacaaaagtgaggcctgctcagcactgagccccggtacaactgctgccaatgtcggtgtttcgtcccgttggacatcctccggaaatatggttgcttcgtactacaagaaaaaatccaccggcgtaagctgtagcggctcaagttccggcagctcttcgggctcgagttctggctcttccggttcaagttccggcagctcttccggctcaagttccggcagctcttccggctcaagttcgggctcctctggttcgagctcagggtccagctcgggttcgggatccgccagcatctctgtagtcccatccaacacgtggaatggcggtggtcaggtcaacttcgaaatcaaaaacatcgggtccgtgccattgtgtggcgttgtgttcagcgtctctcttccctcagggaccacgcttggtggatcgtggaacatggaatccgcaggctccggccaatacagcttgccaagttgggtcagaattgaggccggaaaatcgagcaaagacgcggggctgacattcaacggaaaagataagccaacggcgaaaattgtgacgacgaagaaatgttagggaaaagacaaagcgcaaaatgggaggaaaagaatgggaaaatgaaagagtggagaaaaagaacaaagggaaagaaagacaaagaattaatgattatgataagagataataactgataaagtttagcataaaatgttgaccaaagtaaaaaaaaaaaaaaaaaa

SEQ ID NO: 85166 - DNA, 1191 bp, Heterodera glycines
  SCN-specific regions: Sequence locations=1-33,55-1057,1082-1085,1109 -1191
tcttaataaaaaaatactcttcaaataaataatcattcctagctgcttttggtttgatcacaaatgttcgtccaactcgtcctccttgccatcgttggcattacttttgtcgatgctgccgcaccgccgttcggccaattgtccgtcaaaggcaccaatttggtcggctcaaacggcaaaccggtgcagctgatcggcaattcgttgttctggcaccagtggtacccacaattttggaatgcccaaacagtgaaggcactcaaatgcaattggaattccaatgtcgtgcgcaccgcaatgggcgtggaacagggcggctatctgagtgacgcgaacaccgcctaccgactgacggcagctgtgattgaggcggccattgcacagggcatttacgtgatcgtcgattggcacgcgcatgagccgaacgcggacaaggcgattgaattcttcaccaaaattgcgaaagcgtacggctccaaccctcacttgctttacgaaacgtttaacgagccattggatgtgtcttggaacgatgtgcttgtcccttaccataaaaaggttatttctgcaattcgtgccatcgacaaaaagaatgtgatcattctcggcactcccaaatggtctcaagatgttgacgtggcggcccaaaatccgatcaaaggattcagtaatttgatgtacactctccacttctatgcgtccagtcactttgttgatggacttggcaataagcttaagaccgccgtaaataagggtcttccggtgttcgtcactgagtacggtacatgcgaagcgtctagcaacggtaatctgaactccggctcaatgtcaagctggtggagcctgttggaccaactgaaaatttcgtacgtcaattggtcaatcactgacaaaagcgaagcttgtgcagcgctcactggcggaacatcggctgccaatgttggcacttcctcccgctggacgcagtctggcaatatggtagcttcgcaacacaagaaaaaatccaccggtgtgaaatgctaaataaagtctgaagtccggatgatcaactgaaactgaagaaaatggaaaatgtgaagattgcgaaaaataaatatatataaaatttgcatgcgaatgtttatcgaaattccgattaaattgttttttgagcgcagataaatcgcaaagcataaaaaaaaaaaaaaaaaa

SEQ ID NO: 85167 - DNA, 1053 bp, Heterodera glycines
  SCN-specific regions: Sequence locations=1-1020,1045-1053
atgaacaggttttttacattattattttttgtattatttttcaatgccgcaattaattttgtcagttcacatcgcattgtcggttattatcagggcatacgtccattgacaaatgatcaagccaagaagttgacccatcttatcctggcattttcaacccctgactctcaaggcaatttgagtccattgagctctgtgcttaaacaggcgctaaaagcgggtaaatccgctaatggtgcgctcaaagtgatgattgccattggaggaggtggctttgatccggccatatttacttcgttagcatcaaacagtggcacacgtaaaagctttattaataacattgtttcttatctgaaaaccaatgagctggacggttgcgacatcgactgggagttcccaacttctagtgacaaggcaatctttgtgacatttctgcgcgacttaaaaaaggcgatggcacccagcggcgctgtgcttagcatggcatcggcagcaagtgccttctatttggaccctggttacgatttgccaggcattgagagtgccgtcgatttcattaacgtgatgtgctatgactattatggaagctggaccaaaacatcgactgggccaaactcgccactgtttaagggtggcagtgccgacccatcggacacattgaacagcaattggacaatgaattatcacttaatgaaagtgtataatcgagcaaagttgaacatgggtgtgccattctacggaaaatcttggaccaatgttggagcaccactaaacggtgacggactttggcgtcagttgggcacttatggcaccgaattagcctggcgtaacatgggcaaaagttttgacatgaccaagacaacgtatcataaaacggccaaaactgcatacatttatgatacagctaccaaaaattttttaacctttgacaacccacaatcactgaaggacaaggcaaaatatgttgcggaaaagggcattggtgggataatgatatggtcaattgatcaagatgacgacaaattgtctttattgaattctgtttcatattga

SEQ ID NO: 85168 - DNA, 1714 bp, Heterodera glycines
  SCN-specific regions: Sequence locations=1-270,316-466,489-1147,1193 -1253,1275-1286,1310-1681,1706-1714
atgaacaggttttttacattattattttttgtattatttttcaatgccgcaattaattttgtcagttcacatcgcattgtcggttattatcagggcatacgtccattgacaaatgatcaagccaagaagttgacccatcttatcctggcattttcaacccctgactctcaaggcaatttgagtccattgagctctgtgcttaaacaagcgctaaaagcgggtaaatccgctaatggtgcgctcaaagtgatgattgccattggaggagggtaaaaaataataaattttaaaaataaattaattcaataattttaagtggctttgatccggccatatttacttcgttagcatcaaacagtggcacacgtaaaagctttattaataacattgtttcttatctgaaaaccaatgagctggacggttgcgacatcgactgggagttcccaacttctgtacttgcttaaactttaaatgtctatatttagatcacaatagtgctctacattattcaatagtgatatcatttagttaatgaattatttttgctccgcttttttggcatttttacaaaaatttattcttttttcaacaatcatcataaaagcatgagatatttagcttttgccctaccttattagggtaaattattttgcgttttacctgattaaaaatggcatccttgtcagttagaatgaaaatttgaaattttacattaatttctacaaaaatgaggagtactatgtataatatcaatactgtatttgaacagagtgacaaggcaatctttgtgacatttctgcgcgacttaaaaaaggcgatggcacccagcggcgctgtgcttagcatggcatcggcagcaagtgccttctatttggaccctggttacgatttgccaggcattgagagtgccgtcgatttcattaacgtgatgtgctatgactattatggaagctggaccaaaacatcgactgggccaaactcgccactgtttaagggtggcagtgccgacccatcggacacattgaacagcaattggacaatgaattatcacttaatgaaagtgtataatcgagcaaaggtaatataataatgaaacatcaatgaatgtaaaagatagaaaaagaggaaaaaattcataaagtttccgaatttttttaagtttattatttaaaaaagaagaaaatttataaaagaatgaaaaaaaagcagctaataatctgtaaaaaatacattttcgtaaggttattttctaggaaaaaggtttttatgaaaatcttttaagctacatataaattattttaaaaattaagcatttggtatgaaaatttcctatttttcaaagctaactttgcttgttttaacataacgaattaagttgaacatgggtgtgccattctacggaaaatcttggaccaatgttggagcaccactaagcggtgacggactttggcgtcagttgggcacttatggcaccgaattagcctggcgtaacatgggcaaaagttttgacatgaccaagacaacgtatcataaaacggccaaaactgcatacatttatgatacagctaccaaaaattttttaacctttgacaacccacaatcactgaaggacaaggcaaaatatgttgcggaaaagggcattggtgggataatgatatggtcaattgatcaagatgacgacaaattgtctttattgaattctgtttcatattga

SEQ ID NO: 85169 - DNA, 1008 bp, Heterodera glycines
  SCN-specific regions: Sequence locations=1-560,582-609,633-688,710 -1008
atgtccgcttggatttgtcctgggtttttgctgttttttgtgctcattctgatcactgatcactgtccgatgacccaagctgtcactcaaccgccctatggtcaattggctgtcagtggaaaaaatctagtacaaaaaagtacgaaaaaagccgtggcattgcacggcctgtcaatgtactggagccaatgggtgccgaagttttgggtgaaacagaccgtcaacaaattaaaatgttcatgcaatgccaacgttgtacgcgcagcaatggcatccagctttggcggttacatttcaaacccaactgctgaatataaaaaaatgactgcaatcattgatggggcaattgaccaaggcctttacgtggttgtcgattggcacacgggcgacgatttggccaccaccgaaataaaatatgcgactgaattctttacaaaaattgctaaagcctataataaatacccgcacattttgtacgaaatttggaatgagcccaacaaatttgtggcatgggaagcggtggtcaaaccatacgcaaagacgatgattgacgtgattcgtaaatatgacaaaaacaatgtgatcattgttggcacgccaaactgggaccaagatgttgacattgttgcaaaaagtccgttgaaagacgcaaatattatttacactatgcacttttacgccggccaacacaaagatgacatccgaaacaaagtcaaaacggcttataaattgggccttccaatgtttgtgactgagtacggttgctactcggctgacggcaatgaaaaaacaaatttggaagagttgaaaaagtggatggaacttttggacggctatggcatttcctacgccgcgtggcacgtggcggacattggcgaacagtcgtccatactgacaaagacttccgaagtgaacaacatctgtgacccggcccatttgaccaactacggaaaagccatcattaacaaattgaaatcgcaaaacaatggtgtgaaatgcagtggttag

SEQ ID NO: 85170 - DNA, 1803 bp, Heterodera glycines
  SCN-specific regions: Sequence locations=1-1268,1290-1303,1325-1803
atgtccgatgccaatttggtcggcactgccgaccatcctctgtcgtctttacaccatcgcccatccgcctatgcatggcctccaccttcccactcgttgatggaacgtttccgtcaggctgccgtcacctcagataacggcatttgttccgaaattggccgtgacgtgatgatgcagaaaaatggcaatgccgtggacgccgcggttgccgccatgttgtgcattggtgtgaccaacgcacagagcagtggacttggtggcggaatggtgctgaccttttatgatgccaaaacgcgctcatgcaaagtgattgatgcgcgtgaaacggcgccggcacgcgcgactgccaaagcgtattctgaacgtgtgaccgcaaaccgaacgacagcgcgtgctacgggttaccatgaaattgcaacgcccggagagcttgctggattgtggcttgcatacaaaaagtttggcagtggccgagtgccctggtccaaactggtaatgcccgctgcaaaattggcactctatggttttccaatcactgaacacatgagaagagcattagttggcacggagaaggaactcattaacagtccaacaatgaagcaatggataataaatccccggacgaatcagctttacgaatttggtgatcttgttaaacgtcctaaattggccaacacattggagcgcttggccgcagctgaggacccaaagaaactgttttatgaaggcgaaattggggatgaaattgttgaagagatgcaaagaaatggcgcatttttgtcccgatccgatctgaaaaattacgagccccgtctgtatgagatgccattgtacacagatgatcctcatggcaacttgcgcatgtgcggaccaccgccgccgtcttcgtacgcgatcacacagtcaatcattgcgacgatgcgcatggaaccaatgtgcggtggtgacggatcagcagatgatcaatctcaagccaattcactacaaaatgatcccaaattctaccatcggctgattgaggcacaaaaatttgcatacgctcaacgcgccaatttgggcgatcaagcatttgtgccagaagcgaaaaaattggccaagcacatgacaagcaatacatttttgcataatgtgcacaaaaaaatgttggacaaagcaatgccggacgagcattacacgctgatgatcggcccatcaagagctgataaagatcatactggaacatctcacacatccatattagacgctgatggaaatgccgtttcagtgacaagctcaatcaatcaatggtttggggctgtgattcaatccgaaaatttgggcattatatggaatgatgaaatggaagatttctcatttcccgatgtgaaaaattggttcggatatgccatttcaccaaccaattttgttgcacccggaaaacgtccaatgagctcatttagtcctatggtcatctacaacaagcacacggggaaagtgaaatttgtcattggcggctccggcggtgccaaaattccgtcgtctgttgccaaaacagtgttgcatgtgttgtgcctgaaccaaacagtgaaagaggccattgatgcgccagtgttgcacaaccaattcactccgaaccatgttatttacgagaatgggacaccgccgaaattgatcaaagatctaaacgaaaacttcgggcacattatgaagtcgtacgacaacaacaacgtggttgtgcaagctattcatgtggccgatgacggcttcatctatgcaaatggggacttccgtcgtcgaacttacatgcacccggccggcttctaa

SEQ ID NO: 85171 - DNA, 558 bp, Heterodera glycines
  SCN-specific regions: Sequence locations=1-12,34-476,499-558
atgtcttcttccccgtccgtctctgtgctcgccatcgtcgcaattgtctgtttgatgtgccaatgttgcttttcggcaccgcatccgtgctgtcccggcagtcaaaaagtggtttcacttatgtccaattacgttggcacttttgccaattccatttccaagtcatcgctttgttcggatgcccaaaatgttgcggaagcgttgaaaggccaactgatcggctgctcgaatggcggcgatcgaactcttttggccgacatcgaagcatcccttgccactcattctgctgatgagtgtgccctcagcctcggcttcgtccgtgccatgttcgccattgccgcctccgcttcttcccatgccagcaacaacagcgaatggcagacattgagtgggcagtttggtcagaaagtcactgagattgactcgaaatgtgcagagtttggtattagcattggcaaagtgcccataaacggtcccaaggatgtccatgttcaaaatgtgcccaactcggaaagtgtgatttctatgcctggattggccggctcacacacccaatga

SEQ ID NO: 85172 - DNA, 399 bp, Heterodera glycines
  SCN-specific regions: Sequence locations=1-399
atgaattggatgcattattgtttaatcgcttgctttgctttttattatttcaatactgttgagtcatccactattaattcggtaaccgtacaagtgaacaagattgaaaacaatgaaaatggaagacaattcaatttggaatttacaaaccaagtttatgagcgagtgtgccacgttgactttcgaattgatctgccagacacagtaaaattgaacaaatattcaaaaatggtgccaattcctgacacctgcggccagtacgcattgcccaagagtttggacttgcttcccggcgagtcatttgatgcacaattaacactgcttggccatgatgggaagccgaatgtgactgtgctgaacacgaacaatattccaaccagcaaacaatgcaaaaaatga

SEQ ID NO: 85173 - DNA, 1026 bp, Heterodera glycines
  SCN-specific regions: Sequence locations=1-497,520-1026
atgctccaaaacggccttaccattctgcttctgatcagtgttgtgatcggccattccttggccaaccttggcccaaccatcaaacataatcctcattttaaagccgtacaaactgcgcatcatttgcatgatgccattgcgaagaagcacgaggccgaagttacgcaagtcatttgctctattagcaacgaacagcgtcaagcattggctttggagttcaaaaaacaattcggcactgatctgattgccatgctgaaaaaggagttcaaaagcgactttgaagaactgatcatttctttgatgcaaacgcccgccgtttacgatgccaaccaaatgcgtgccgcattgtccggctccaatgaggcggtgctaatcgaaattttggcgacgcgcacaaaccgacaaattacggcgccgaagcaggcgtatgagcagttggacagaaggcatcagcacaatcagctggaggaggacatcaaagcgaagacgaagaggacccttccaaaatctgttggtgtctttgctcagctgctctcgcgaagaaaaagtgcgcccgcaagcattgtattggcacacgacgaggccatgaaactgttcagagagggcgagggccgacggggcgttaacgccgtggtgttcaaccaggtgttggccactcgcagcttcgcccagcttcgggaaactttcgagttttaccgacaagccgcgcaccacgagattgaggagggaattaagcaagaattcagcggtcacaacgaagcgggtttcttggcactaatcaaatatgtccgcaacgcttctgtgttttttgcggatttgttgttcaattcgatgaaagggctcggcacacgcgactcggatttgattcgtctggtcatttctcggtctgagattgacctggctgacatcaaacacgcttttcacacgttgcacaagaagagcctggaggaggcgatcaaaggggacaccagcggagcttaccgagacgcacttttggcattggtcaagggcaacacggagcagtga

SEQ ID NO: 85174 - DNA, 501 bp, Heterodera glycines
  SCN-specific regions: Sequence locations=1-162,184-501
atggcaaaattcgttgccattgctcttctctcgctgaccattgtttcgatggcacttgcaaaaactggcaaaagtcaaacggcagacgaagttgagggatttcgcaatatgaacatcggcgacaacaataaggttgacgccggaaaggagcccgcggctgataaagcaaccaaaaagggaaaagctcagaaagccggaacgaaatcggcggcggccactaatgagcccgcggctgctaaaggaactaaaaatggaaaagccccgaaaaccaaagcgaagcaagaggtggccactaatgagcccgcggctgctaatgaatggaacgaccaattgatgggcatgagcgttgagaaatttaacgaggagcttgctgtgttgttgccaaaagccaacacttttatggaaaatgctttgagcttcatcaatgaacaagtggaaaaaaatggtattgcaactggcgctgccggggactcgtgctcgaccgggatcccggccaactag

SEQ ID NO: 85175 - DNA, 1470 bp, Heterodera glycines
  SCN-specific regions: Sequence locations=1-15,37-249,271-293,315 -338,360-827,856-1297,1319-1470
atgaaaaattctttcctcttcctgcttcaaatttttattctaaccaacattttaactgaaatactttgtggagataagtcaaggccgtcgacggaaatcaatgccaatttgggaacaaggaaaaagcctgaaacaattacggcaacaaaaaatgccaatttgggaacaggaaaaatgcatgaaaccgatgggaccagcaaaatgccaaaacatggcaaacctgtgtcaaatcgaatggcagccaaaagcacgacgattaaaaataataatgaagcagcagggccaagccaacaatcaaaacaacctgcggcaaacattacgccacagcaaaaggggccaatgcaaaattcaaaaaagcagccaccaaacgaattgtttggcaagaagcaaaggtcaacccctgaagagatcaaagctggcaaacaaccagcaatggagctaatgccatgctatcgaggaatcggcaaaaagacgatgccaacaattgcacagcgaaatgccaccatgctaaaaaggggggacagtttgacacggagtgccgactttgaggacccaattttggccaatgtaaaacaaagccaaatgttgatccgacaaaaatccaagggcaccatggacttggaaatggacgaattcttaaaactgcacaagcaaattcaaggacctcggcaaaaattggtacgaatggaaagggaaaaaatgatcaaagaagcgaccgaaaaggcaaaagtggaccgaagaaatcgtatgttggaacgagaaaaaatgtggagcatgaagaaggctggtgttgctgcacatcaaccagcatcaccggcaattcgtggacgaacacagcagcaacaacagcagaagctgcaacctgacaaaaagccggaaaaaatgctgaaacagcaaaacaaaacacaaaatttttcggcaccttccaccagcaaacaaattgtcaatcgaaggttgttgattggcccaaacaaaccgagaactggcaacaaaattggcactaccaagcacggcatacattcggcggaaataatgacatcatcgtcggaaagcaatgtgccaaaaagtgaaaatttgggcagcagtgaaatggagacggcggaggaagcggcacaaacctatttgaacaatttacgggttgatttaaataaaattccttcgatgaaaattccattccttgaaccaataattgaaaaatatgttgatgaatacaaaaaaagtcgtcaattattcgctgaatgcatgcaaaaaattttgcgaaaatcgaaaaatcctaatcaaacggtgaagatcatcgaatttaaaaagacaattgaaaaagaaatgaatgatttgttgaaacatacggatttgccaccagatcaattaattgatctgttgaacactcgtgaatggctattgtcgatgaaaaaagacattgagtacatggaacgcattctgaccggacgcgagaataatgacaacatttga

SEQ ID NO: 85176 - DNA, 642 bp, Heterodera glycines
  SCN-specific regions: Sequence locations=1-121,143-183,205-347,371-642
atgtcttctctgctgctctccatcttcccaattgtgtttttggtctgttgcaatgcaatgccaaatttcccgtgctgcccgggcagtcagcaagtggttgctgtgatgtccaaatacattgacactttctcttctgctgctgacgagtctacagtatgctcaaccgctaaaagtactgtggatggaataaaaaatgaactgtcctatcgcgtgggatgcccaagcggaggagaagcacaaattgtgaatgaaattgatcgacagctgaagaacattgcgaaaatggaaatcaattatgaggacgagtgcccgtacaatttgggctttgcccgtgccatgttcgacttggccgctgctgctgctggccatgcggggaacggcacagaatggcaatacatgaaagtacaatttgagcaggaaagccaagcaatcaaagcaattggacaagaaaagaactttgaagttacggatgtgcattttggagtcccaagcaaaggggtttctgcacatcaaaatgtgccgagtccgagccatgtgattgccaaccctggccaacacagtttcggttggccaacggaaagaaagaagaaccgttgtcatcggacctcgatttttgaggaccaaccaatcaggaggaaatag

SEQ ID NO: 85177 - DNA, 1138 bp, Heterodera glycines
  SCN-specific regions: Sequence locations=1-569,593-1138
attatgcttaaactttgcttgacaattattttggttaccatcggatacaaatcattttcgttgtctgagcatatttcagaattttccgaatgcggcatttccgactttgaacccgaatttcccattgcaccaaaagtggaaattggcacaaatcatatattcaaaggaaaaacaattgtggatgacaaatcattgccgtggatggcaagaattttaagtggagtctcttgcactgcgacaatcatcgggccccgacatgtgttgacagcggcgcattgtgttgaaggccaagcacttgaaaacttcgttgtgtcatatggaagcgccgatgcttcaaatcaacaacataaatccggcgttgaagcaattaaatatcatccaaaaacacaacattatgaaattaaggataaatttcgaaagaatacaagagcatacttatttttgaatgacattgtcgtaattaaaattaaaaactcaatcaagttttcacaaaatgcccgaccaatttgtttgcatggcttccatctaacaaattcaacaaaatctgatggaaaaagcattaaatatgatgaatattcaaaatttattaacaacactcaatgtgttgttgctggttggggtataaccaaaccgacgtgctctaatgatgatgataaaccactaagtggccaattaatttatggccaaatgcgaatgatttcgaagcaaaaatgccgtgaattgtcaattgaatatgaaaaagtattcacaccatctgatggtaacccagaagttgaatcgatgattgaagcttttgatgcgtatagtattaaaagcaatatttgtgtggtgcccgagcaaagcattggcgaaccgggtgacagtggtggcccattaatgagcaaagttggaaaaaacaattggggtcaattgggagtgttgacaaaaggcgactgcagacctaaaaacccaacaagcacagaaggactctttgcccaatacgcgccgatcgattgtgaatgggttgccgaagcaacagatggtgaagtgaagtgccaaacatggtaaaatgcctggcctttctatatgatcaacgacatatttaattaatctttcattagcatttgttggcacataatcataaataaacgtttaaaca

SEQ ID NO: 85178 - DNA, 985 bp, Heterodera glycines
  SCN-specific regions: Sequence locations=1-461,485-634,656-985
cagatcttgtgttcaagcaatcatcagaatgagggtgctacttcttctttgtctggctctgccagtattcagcgagaacatcgatagccacgttgttggaggcagcaatgctaacattgcaaactaccctcatcaactctcactccgtgtttctggctctcactcatgcggagcttcactagtctctactaccaaggccgtcactgctgctcactgcggaggaagtgctatctctgtctactcaatccttggaggcaccacctcccgtactgatactacctgcagtacctgcgtcaccagaaacctcagccaattcaatagacacgctagtttcgtgaacaacggtaaccagggttatcctaatgatgtagctacccttcacttcagcgccgtgacaaccaacagcaaccttcgtaccatcgccatggctgcctccagcgcaggagactacgccggacaaagctgcgtcatcaccggctggggccgtacttctgctaccagctctcttccagtaactctacagcagggaaccatgaccgtccttactaacagtaactgcgccagtcgttggtcagctgctcagatcaataacggtcacatctgtgtctcttcaagctccgtcagcgcttgcagtggtgattctggtggcccacttgtctgcggtagcaccctggttggtgccacatcctggggtcaggctcagtgcaacccatcctatccatcagtctacacacgtatcagctacttcagatcttggattgatagccactaaacaactcatccaaacattaacgtgttcaactaaacacaagcgcctacctaactactacgtgacgttattatgataacagtctattgtcaagaaaggtggcgataaggatttaatatgtatttaataaagactttagtttaattaactaaattgctaatagtttgccatttaatggctcatgatatgatacaaaataaaatattatacaactaa

SEQ ID NO: 85179 - DNA, 953 bp, Heterodera glycines
  SCN-specific regions: Sequence locations=1-953
gcacaataaatagccgtttaatttcttatcaaatgcaatcactttcacatattcttttcacatttttctcaattctttttgctgctcattgtcaaagcgatgaatcaaaaagcgcgggagcgcaaatgcaaacggtggacgaaaataagattcggcacggcaaaccgttgacgagcattgtcaaatacccttttatggccactgtttggcaaaatgaccgcaaactttgcaccgcgtcaattgtcagtccaaattatattttgtcggcgggccattgctttgtgaaaatgtccgaggaaaattacataattttggtggggacagtgaacgcgaagttggagaagggcaacggacagcaatttaaagtggagaaagcgcacgtgtactcggagacggtgttcggccaagacattgccattgtgaagctgaagaattcgattgatttctccgacaatgccactcagccgatcactttgtcccggaggtccaattttacaaagactgacctggcattcattgccggatggggacgtatcaccgactggagttctccggtcactctgcaaggtgccaatgtgctgatttggccaaaggatgaggcgcgttgcgacggcattatggagtcggaagtttgcgcatttggcgaagacggagctaatgtttgctttggcgacagtggtggtccgttgttggtcaaaagttacgacggtcagcgctgggaacagatcggagtgaccagccgaggcaatttcgtatgcgaatcgaacggcttcttctcctgcgtttatatctactgcgaatggttggcaaaaataacggagggcgaagttcagtgtctaaataatgagtgattttcgaaatgcattctctgttctgtgctttttaattgtttaatcattttaaagaaatccaacaatttgttaattaaatgaaataaaatactttcctttcaa

SEQ ID NO: 85180 - DNA, 1529 bp, Heterodera glycines
  SCN-specific regions: Sequence locations=1-40,63-319,343-347,370 -499,521-1412,1449-1493
tttgagaaagggtaaaatgaatttgcacacaattttctccgtgttattgtgtgcgctggtgttgtcctgcgcagtcggaaagccaccagcaaaaaagggccagcaaagtaaaaaggctgacgtcatagctaaagccgctgctggtgaaccggccgaagtaaagaacgatggcaaagcaaaaaaatcggctaccgtcgtgcctgtcgcggctggaccggtaggcgcaagtaacgatgccaagggcactaccgccggtggcaacaaggcaaccggcgacactggcacgactaaaccaagcgccggcggctctgccacgacagatgatgatgatgatgatgacgagagtccttctccttccgccgccgccggtggtgcgacgacaaccgatggcaaggctaaaccaagcggcgatggcacggccaccactttgtcgggtggcggtgggaaggcctccagcgcggcaaaagttggcagtggtggcacaactgtgcccgccaagggagaggaaacaaccgcagtaaaggtggacgaaaactcgaaaggcactgatgagacagagaaaccggaaggctcaactgatgccaccattactggcgacacgtttacaaaggtcaacaaaatcgcggacgagatcacagagtgcgagttttacttcgttcatttggaaaacgtgaaagccaacgaaaaggaaaagctttggacacgaaccaaacaagaagcggagatcgacaccgaagagatggcagaagatagcgtcgattatcgcattgtgacgcccgccatttccaaggaccaaccggacatgggcacattgtacgagcaagacacggatgatttgccctccgatccagatgatttgcgcaaggaggaatattttgctgctgacactgagctcgttgatgcggaatttcttaaaaaaaatacttccaatttatacgacgaaaccgattgccatgggatatttggacggaacgaaatacgacacggcaaaagttggaccatttttcagaagggaaattcgctgatgaaacacagattctgcctcttttcccctgatgatcaactccaaaatacggcaaagactgcatctcaagtacatgcccggtgttgttgctacaacaaaaatgtaagcgacagcttacgcgacttcgacatctcaaaaaccgccgatgcagatgctattcgtgccaaacacattgacaatgagtacgcgttgttccaaaagaatcaaagttcgacgatggcattgcgcggcagtttggttggcgaggatgggcaagccgtctatttcagcatttggagcaagagtgcccctggctcatacggtctttgcacagctgaggatgggaagaactcccgcgggaaacgccaagcagaagatgacgaagcgttttacgataattatgacgacgaatgaggagaaaagcaaaaaggaaccaaaaagcatggataattagttaattacaataattgatggcgaattaattaaagcgtaataaaaaagtttaacaaaaaaaaaaaaaaaaaaa

SEQ ID NO: 85181 - DNA, 1194 bp, Heterodera glycines
  SCN-specific regions: Sequence locations=1-236,258-364,386-541,582 -753,775-777,799-841,865-1194
atgaattcgtccgtcgtttcattttcgctgttactttttgggttattcacaattcgcactgcaaaatcgcaatgcgagaaacattgcactaaaagtatgaattttatgttttattaagggttgatttctatgattaatccgaaaaacccttgggggcattgctaatgggaggggtcttaagcagcagtgtccatggattttcaagaatcactttttcgtgggaagaaaatgggataaagaataaagaatatggagaacaggcagccgttgttcagttcgataggaaaattaatcgactgactctcggcattattaggcaaaccgatgggccaatgcaatgaggcggaagaagtgattctgcgcaactccgactgtgccttcatgaagaaaacggaaacggcattcgaatttgtggtcggaatgaatggccaaacggaggacaaaacggcgcccggggccaatgccaatggggcatttttgtgctgtaaggcaacccaaggtgaataaaagcatcggagacatttatttatatgagtaattgaattttatattgatttaaataaacaaaaataatttaaattccttcacaaaggaaccgcaacacttttcatcgtcggcgtggccaacaaacggctgatgttggccaaggacgtggtcaattacaaatttcataacaacatctcaatcgatgattttgtacgggaaaagcaagtgttggaaagtgtttcggcgcagggacaaaaagccggcattggggacaattatggagaaaaattcttccaggaccaaatggacgccaacaaaatgattcaggtgaaagttggaaatcgtttaaacgtcattaatgaatatagttgtttaaacattttgtagaaaggctatgtgaagctgtggaccgccaacaaatcgttgcttcctcaaaatgtgccggatttacagaaagatacccggcccaaagtgacggcggcgacagaagaaatgattttggcactgaaagtgtttcaacagtttcgaatcaacaaaaattgttgggcatctgtggaaaaggaactcttaaagtcgcaaagctttttgagtttggccgaacccaacggaaaggacgcaatgcgaaaagcggcggtgcgattgtgcgcagaaatggaagcgaaaattgaggcacaaattgacgaaacggcaaagaaattgttggcctga

SEQ ID NO: 85182 - DNA, 279 bp, Heterodera glycines
  SCN-specific regions: Sequence locations=1-279
atgtcccttttccgtcctcaatcgctgcttcttctggccgctctttgcctgtcctttgcgctgctctttgtcacttcgtcggaagagggagggcgagtgaagcgcggcggatggccttgggattgggccggcaaacaactgtgcaaaacatcggcaaattgcaagtgcaaggatggcaaaaattgggccaaatgtgtaaagtcggaaggctacgcggccagcaattgttgcgacaaaaattacgtgtgggcatgttgcgggaagaagcccaaacattga

SEQ ID NO: 85183 - DNA, 417 bp, Heterodera glycines
  SCN-specific regions: Sequence locations=1-154,176-270,293-417
atgccaaacattttcaaaatccttctgattgtgcttttggccgtcgtctcattccgcctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgaccctcatcatcattag

SEQ ID NO: 85184 - DNA, 411 bp, Heterodera glycines
  SCN-specific regions: Sequence locations=1-411
atgttcagctcttccaatttgtctgctctctttttggcctcctccgttttggccgtgcttataattggcattaaaatggacggaccgacggaggcaaaaggcgccgcccctccaaacgccgcggggccaatgggacttttgcttttattgaatggcaaacaatcggcggctaatgaaaagggaaaagcgccctctggcgaaagtaagccaaatccggggcagaagccgagcggagaacggcgaaagagggacgttttggggcacgccggcggatacgtcggaggatgggaccatcccattgactcgacacttgattgggcaaagagtcagtggaatgatgccaattggctcgccgatgttgtcaacagaaacggatgggaaaacaccggcactccaaccggcggacgatga

SEQ ID NO: 85185 - DNA, 645 bp, Heterodera glycines
  SCN-specific regions: Sequence locations=1-56,78-111,133-597,619-645
atgcgtaccattctcttcatggccatggtttgcttggtgatggctgtcctaatggaaatggcaaattcaaaagtagtcaaaaaagacaataaaaaagcagcagtggcggcatctccagcaaaaggaaaagcatcgccaaaaggaggcaaaagcccagcaaaaggaaaagcggcaaaagttagtaaaaaagataacaaattgaaagcaaagaaagaaaccaaaggcattaaagttaaaaatgcaaagccaacaaaaaaaggtaaatcggcaaaaggcgcatcaaaaacagccaagaaagtccaagccgccaaaaaagcaccaggaaaggacaaaaagtcgctagttaagccaatcgtccttaaagcaccggtaccaccccataaaatgcacccgatgattgaatccgaagctgtgccaccgcccgcccatgcgcgttcgcttgcgaccgttccttacagtacaccgggggcagccgaccgtaactcattgccatcgtacacttcgactgccaccaatttggacatggccgatgataatgatgattatcagaattattactacggaacggaagacagcagcagggaatttgatgcatcggcggaggaggaggatgaactatatgagagaggagagtcggggcaatga

SEQ ID NO: 85186 - DNA, 726 bp, Heterodera glycines
  misc_feature (342)..(342): n is a, c, g, or t
  SCN-specific regions: Sequence locations=1-726
atgagcaactttatatttgtcgcctctttaactgcagcgttttttagctcaggcctcgctctaccggctccttatgatgctgaatcggtggtatcttctgaattaaatgttccactactttcagctgacgcaaatgttgaagcagcaattaccaatgaaagtgatgctgctgctgagatacaagctccatcaattccggtaccaattgaacatcaaactgctgctgacattactcatccaactgaaactggcaatgagtcttctattgcatcatcatcatccacgccgaaaagtgagcagacgccaaaaaaagtgatgaacatgaaaagcgcgctggaagancgcaggcaggccaacgtgtacgaggagaggcttccgttagacaagcagcccaagacgatcgctgaagcggcagcaaaagcaaagcagacgcccgccaaacttccggctgactacgacgtgaaccgcgtggcggaacgcgcagcagcccgtgtgtacgggtggcttccggaagacaagcagcctaaggcgatctatgacgcggcggagaaggcaaagaacacgcccaaaccgccgggcgactacgacgtggagcgcgtggcgcaaaaggcggcccggctcgtctacggtgtgctgcccatcggcatgcagcccaacttcgccggccctagcactgacaagagcaatgtcgacgactcggagaaaccttctgctgctgcggcttaa

SEQ ID NO: 85187 - DNA, 750 bp, Heterodera glycines
  SCN-specific regions: Sequence locations=1-73,95-369,391-393,415-750
caatgcgagaaacattgcactaaaagcaaaccgatgggccaatgcaatgaggcggaagaagtgattctgcgcaactccgactgtgccttcatgaagaaaacggaaacggcattcgaatttgtggtcggaatgaatggccaaacggaggacaaaacggcgcccggggccaatgccaatggggcatttttgtgctgtaaggcaacccaaggaaccgcaacacttttcatcgtcggcgtggccaacaaacggctgatgttggccaaggacgtggtcaattacaaatttcataacaacatctcaatcgatgattttgtacgggaaaagcaagtgttggaaagtgtttcggcgcagggacaaaaagccggcattggggacaattatggagaaaaattcttccaggaccaaatggacgccaacaaaatgattcagaaaggctatgtgaagctgtggaccgccaacaaatcgttgcttcctcaaaatgtgccggatttacagaaagatacccggcccaaagtgacggcggcgacagaagaaatgattttggcactgaaagtgtttcaacagtttcgaatcaacaaaaattgttgggcatctgtggaaaaggaactcttaaagtcgcaaagctttttgagtttggccgaacccaacggaaaggacgcaatgcgaaaagcggcggtgcgattgtgcgcagaaatggaagcgaaaattgaggcacaaattgacgaaacggcaaagaaattgttggcctga

SEQ ID NO: 85188 - DNA, 1614 bp, Heterodera glycines
  misc_feature (1157)..(1157): n is a, c, g, or t
  SCN-specific regions: Sequence locations=1-17,39-328,351-552,574 -1007,1029-1096,1118-1457,1479-1614
atggccctctctgcccttctgcttcttctccccctgcttctcaatgttcaaaatatcccagatgagtcagtccaatcggatatgaaggctgtttattcggctatttcatcgccggaacaatggaagaactcacaaaattcattggcttcactcgaatcacaactgacagagccccaaagagcactggcaaaaatgcattgggaattggagaccatccaaaaggaaaagccggaggcaccgccacaattcgacttgggacttttctcggaagctttggaagtgatggtcgaaatggacgaagaagcgaaagaagtgaagctgaggaaggacaaactgatccgaatgggcaggaggagaggaagcaaaaaaaaattgaaggaaaagatgacggaggaggacacagtgccggaagtgagggtgaacgagaatggtaaggttgaagtgaaggacggcgccggaggggaaggacggttggaagtcagacgaacaaaggacgagaaaggcagagagcaggtggtgatcacccttatgaagaatggcggaacggagggaccagcggaaggaaccgcggagaagccacaagagaaggccaagacggaggaggaggtacagaaaaagaatgatgacaaaagtacacgacaagaacaggaggaagcgaagaagacggagcaggaaaacgccggaggggtgccaaaaactgactcggccaacagccacattccggtaatgccaatgcacaccattttgtcatccccgtctccaccggtggaggagaagggcaaagcgagtgcagaggaggcacaaaaaaaggaggaggacaaaaacacacgacgtggaggggaggaggcaaacaacacggagcagaacaaagtcggaggagtgccaaaaatgtcagttgacagtcctaagtcggtcgtgccaatgccaatgcacaccattttgtcctcaccagccccaccggtcgaggagcaggacaaggcaagggatgcgctcacagaaggagcaaatggaaggaaaaaggcgcaaaacaacgaagaaatgttgctggttgcgacggagaacaacggaagcatgagaaatacgaataatggaggaatatttgattttgtccgaaaatttatctccaatgtgtttggacgtaagaaaagggacacggnaagcggtgcacagagaaaatatgacgggggaacgaaggaaaattcgcagcattcaaaatttgattatgagcactgtagggaagtccgactcagagccgaagagcgaagacaaacagcagcaggaagagaaaaagaaggcggagatcaagcagtacctggagaagggagtggtcaacacgggtggaatcaaaaaggccgagaaactggcatatgcttggtactcggagcttctgtactggacaaccaagtggatcgaggcattagaaaatcgggtggcgggagtcaaacccgaattggcacagcaattcttattctccaaaacgggatcagctgcttaccaggagctgaaggaagaggtggacaaatgcgaggcgaagttggccaaactaaaggaatggatcggcgactctttcaagtgaaaatggaagaaacggctcttagaggtgtatttttctga

SEQ ID NO: 85189 - DNA, 429 bp, Heterodera glycines
  SCN-specific regions: Sequence locations=1-183,354-429
atggccacttacctattcatcgctgctgctgccttcggagcaggaatttactgttggaaggcgtacctcggcccgatgctcgaccaaccgaagagcgacgacgaggagaagcccaagccggaaggaggcgaagaagcgacaaccgccggcgacaaggaggagaagaaggctggcagcaagggcgacaagcacaagaagaaggacaagaagggcgaaggcgcagcagcagcaccagcggcggacaaaaaggaggagaagcgcaaggacaaacaccgatcgaaggaggcggggaagagcgacgacaacaaagcgggcaagaaggacaagcacgggaagaaggacaagaagaaggacaccgccgatgcatccaccgtggacgaagcgctgggagaacagagcacagcggagatgagccaagcagaggaatag

SEQ ID NO: 85190 - DNA, 558 bp, Heterodera glycines
  SCN-specific regions: Sequence locations=1-83,105-558
atggcttcatctttctgctcttcactcatttccatcgtcgcaattgtctgtttgctgtgcaaatgctgcttttcagcaccccatccatgctgtcctggcagccaacatgttgtttcgatgatgaaagatcacaccggcacattctccgcttcgatgccaaagtcttcgctttgtctgagtgccgaaagagtcgccgctgcggtggaaaaccaactgaaaacaatttggtgccctggcaatggtggccaaacactcatcaacgagatcaacgcagctcaatcatcatctgatgagtgtgctcgctctctcggcttcgtccgtgccatgttcgaaattgccgcttccgccgcttcccatgtcggtgccaacgccgaattggccaatttggctgtccagttccgagaacaagttggcacaattgacaccaactgtgctgcgctgggcattcatgttgggcaaatcagcttgggcactcccaaaggagaccatccgcaagtgcatgactctgagagtgtgcttagtaaccctggcaccagcgggtctcacaagcgcatttaa

SEQ ID NO: 85191 - DNA, 303 bp, Heterodera glycines
  SCN-specific regions: Sequence locations=1-50,72-303
atgttgagcagatgctgttggctccgttcctgtcttccaggcctcggaaaatgctctgatcaaggagttggaagcgggagaaaatgccgaagtcgcccagaaattcttcagacggatagggccaaggagggaagcgttcagaaagcgagacatgacggggaacagcatccggaaaatcctcgtccacgccgatcaaatggaggcccttttcgagacggaatggggcaaaacaatttgccaaacgatggcacatttggggaaaatccaaattttcaccaaagcccagctattgtccccaggtga

SEQ ID NO: 85192 - DNA, 402 bp, Heterodera glycines
  SCN-specific regions: Sequence locations=1-248,273-402
atggcatttctcctgttgtcacttgcacccctcttcgttgcccttagcgggattgatgcaaataaagtgccactgcaattgtgctgtgctggtggccaaagcttggctggccttatctacgactattctgaccatttcagcgaagttttgcaacagtcgggaactgagatgtgcactagcctgaaaaaggacatgaccaaattgacaactgcaattgaaaaagctgaaggatgcaagtgcaatcttgttgaaaaaattgagaaggaattggatgatgttgaggatgattgcgcctacaatttgtcacttcattcgcgcactgttccacattgtggccatggcctcggaacatttgggcgaaagttggaactccgaagcggccgagttcaacgagcaaattga

SEQ ID NO: 85193 - DNA, 669 bp, Heterodera glycines
  SCN-specific regions: Sequence locations=1-4,34-82,106-450,472-669
atgcatttaaaaatatttttattaattttatttgtgacaatttgctcggtttggtcactttcacccaaaatccaccacaactaccaccaacagcagcaacagcacaacattaagaataaattgccaccaaaaaatattgggacaaaacatttgaaaacggaaattaatgggcacaacaaacacaagcacaacccggcgagcagacacgggcatgctttgcttcaaaaagtgaaagaccaattgaataatgatggatgggccagtgaagatgcaaacaaaacatcggtattgctctcttcactgttggccatcgaatgccatatgaaaaaattggacaagaaaaggaccaacgactcggccgagatcaaacatttgacggagcaaatctgtgccgccgagaacaaagaacaaattggcattcataaactgataaatgaagttgcgaaaacatttgaaaaagatggaaagaaaatggtagaacaaatgaaaagggacgagcatacggtaaaggtgcatcttgacgggcactacggtacgttggccgagattttgccaagcgccaaaaagcacgcgaaggcaacaaggcttcgaacgtatcatgcagtgctccatttgttgcatttgatcactccgaagatggaggagggaccggccaaagaagcgatgtaa

SEQ ID NO: 85194 - DNA, 336 bp, Heterodera glycines
  SCN-specific regions: Sequence locations=1-336
atgttgttcggctttttcccatttcgcgccggctgtccgggcaaaaacgatataaaagcggggtcatcatcacatgtgagcagcacaattatgataattgaggaaaaagaggacagcgaatcggacgaacaaatggacggcgccggaggggacgaggagaaacggggaggagagaacggcagcgaagcgcagggcggcaaaggcgccgcaagggacaacgaaatggaagacgaagaattgaaagtgaaagccgtggtggaagagacgacgacaaatgaacagggcaaaactgagacaaacgtcgaacagagcgaaaaggaggggccgatgaactga

SEQ ID NO: 85195 - DNA, 579 bp, Heterodera glycines
  SCN-specific regions: Sequence locations=1-41,63-204,234-344,368-579
atggcatttgccatttcaagtttaagcgctttaatttcgctcgctttattggcagcaccacaaaactcgtaccaacagaaacctaacgatgaaccgaaggtctttaatgatatccaaaacgggtgtgatttgataaattgtaccgatggtcgaacctgcggcattcgagttgggctcgcaaaattcggcaacagaaattttgagaaatttgcttttccaaaatgtataacaaatgaaacggaactaaacatgaacacggacaacgatggaaatgcgcacattgttcctaatggaccagggtgccaaatgatacaatgttctgttggctaccaatgtcaagttcgaatttcaatttccaagcttggcaatttgccatatgctcagtcaattggaaccttcccgcaatgcgtggggcctaatgtaagcttcaactcatcaagttcaactatcgagaatggcccagggtgtgaccaacttccgacgaaatgtgacgaaggcacaaaatgcgtaactgccgtcggaattgcgaaatatggcaatttgccatggtcgcaatttttctggcccttttgtacatga

SEQ ID NO: 85196 - DNA, 566 bp, Heterodera glycines
  SCN-specific regions: Sequence locations=24-127,149-534
ggtttaattacccaagtttgagtcaaattaagcatcgcttcggctgatggaaatgcgttgcgttccctcccgtcgcccctttcgtctcatcgccccgctgttcaacgcaattcctaccttttacctcattctcacccttattttctgcattctctccccctgggctgmctctgcagatgcggacgaatggtatggcgcgagacaattacgcgcaccgaaacctaaatttatccgatttggacgttccggacaaaaaatgatacctttcagcagaagtttttcaacagaaactcagtacggcgacgaagggatcaaccaattggacgcgttggttgatgcggtcgataagctgtatcaatcatcgccagaaattagggcattcaaaactgcgccaaaaagggcacaaaagttcatacgattcggctgatgagagagaatttgacgaggaaaagcggacaatctcagaaaaagttaccagcagacgatctcacaatcccttctcttttctgaacaaataaaataagttttattcgtaaaaaaaaaaaaaaaaaaaaaaaaaaaaaaaa

SEQ ID NO: 85197 - DNA, 563 bp, Heterodera glycines
  SCN-specific regions: Sequence locations=26-538
ggtttaattacccaagtttgagatacctcctcctcccattcgttcattcttctccaattcgtcctttcccttctcaaatggcccaattccccgtcgccaacattctcctcgcctcccttttgttgggtttcgtcattttgaacagcaaaacgaatgcgcagtttcaatacggcggcggaatgttagccgaagggccccaaatggaaggccttttggaggattacggtagggtgggcgactatcccttcgaaagtcttgcaaaacgcgcgccgctcgaccgttccgcaatggccagatttggtaagcgcgcaccgctcgaccgttccgcgttggcacgattcggcaagagggcgccgttggatcggtccgcaattgcgcggttcggaaagtgaggagaaacggacggatggatggaaaccggtggaaaatggcggaaggaaaggaaccaccggcggaaaacaaacattttctgttttcattccttctcaaattactttttccatacacattttatggcgaaaaagaaattattttcttgaaaaaaaaaaaaaaaaaaaaaaaaa

SEQ ID NO: 85198 - DNA, 723 bp, Heterodera glycines
  SCN-specific regions: Sequence locations=26-99,144-463,485-535,558 -584,606-692
ggtttaattacccaagtttgagagtcagccccattcgcacagtctgtccaaatcccccggaataattcattccaaaaaatatataaaaatgaaaagccgcttctcccccggtgcttcttcttttccttcttcttccccctctctgccggtgcttcatcgtgccccgcttttgctgctctgtgccatggcggcggtgcttcagttgatcccgtgctcctcctcctcctccttggccaacgccgctgtcctttttgcagaaagtggccatcccgctgaccagcagcagcaatttggccaatccgattgtgcacagttggccgcaggggacgaagaaaggatgttgttgtgccagctgtacgagagttcggcactgctcgcccaactgggcattctggtcaacgaaggcattggccgattggccgtcagccaaggaatgggcaaatttgttgtagcggaagcaggccgagagaagaggaaacacgagtatctccgttttggaaagcggaaacacgagtatctgaggttcggcagaaagtgatcaatgaaagagagtggaatgatcgtcacagaagcagaacatggatagagtgagagagagtgaagggaacgcagagggcagaagagacaatcagagaaacacgtagaaacaaaatgccaatcattcccattttgaataaaaaaaaacacgcgcsaaaaaaaaaaaaaaaaaaaaaaaaaaaaaaa

SEQ ID NO: 85199 - DNA, 568 bp, Heterodera glycines
  SCN-specific regions: Sequence locations=25-121,146-194,216-358,379 -537
ggtttaattacccaagtttgagaaatttcattttaaaatggcactccaaatttcaaacaccgccttcatgctgattgtgttggccacttcgcttctgctgttgatgccgtccagcagcagtgccaaagtgatgccccaacttggcttcgcgaatgcagaacaactgatgaatgacaacagcagtccaatgggcgccggagttgagggtgaagtcatggacaaagtggaggcccgacttttgggtgcactggaacttcttcaaagctataaagaagtcccaattgtgcccaaattcacggaaaagcggaagaacaaattcgagttcatccgattcgggaagagaagacgatgatcaacaagagagagagagagagagagtggaaggacagacagtcagacaaaaccatttgagtgatcagagagcggtgatcaatgatacatttttaacaaatacacgtacaattttggtaatattatcgctggcaatgggacattttttgcttttttgatgggcattgaataaagagaaacactgcgaaaaaaaaaaaaaaaaaaaaaaaaaaaaaaa

SEQ ID NO: 85200 - DNA, 1239 bp, Heterodera glycines
  SCN-specific regions: Sequence locations=24-32,55-1085,1116-1209
ggtttaattacccaagtttgagcctccgtttcctttccaatgggccatttctttcccggcaccgtttccttcccaatttttctctttatgctcgggtccgctcgttgctggtggcattttggtgccaaacagcctcgggtgttcgcctcttcccatgcccaattgaccccgcccgaagggatcgaatcggccgacctccgaatgcccggagtcagtcctcaaatgaatgagtcgtatttgtgcagtgcgttccctttggactccgagagggaccattttatcgtgggtttcgagccggtgctctcttcacggcacattcaccacgtcattgtctacggatgcgaaatgcccggcagcgaagacaaagcgtgggattgcggggagatggcctcgccccggggcagctacagccattcgcccgtctgtgcctcccaaccggacattgtctacgcttgggcccacaatgcccccgagttgcttctccccgatggggtcgcttttcgcgttggcggttcttccgcggttcaattcctcgtccttcaagttcattatatgcgcgcggaggaggatgacacttccggcattcgaatcattcacacggatcggccacagccgcggcaggcggcgacgcttcttttggccactgacggacgaattgggccgaaaaggaaagaacaattggaagtcgcatgcgtcgtcgatgagtcggtggtgctccatccgttcgcctttcgcgtgcacacccatcgccacgggcgaaaagtcggcggatgggcggtgcgcgaagacccaaagagtgggacggacaaatggacacttttgggacagagggacccgcagctgccccaaatgttccaactggtagccaaccaatcggtgaccatcacccaaggcgacgtattggcggcacgatgttcgatggaaaacgaagagaagcgggaaataaaaatcggaccgacgggggaagacgaaatgtgcaacttttatttgatgtattggaccaaaaatggacagactctcgagcagaatatgtgtttctcacccggcccacccatttaccgatggacgaaaagtgccggactgaaccacaccccaaaaaggaaatgaaagaatcaatgggagcgcactgcgcagatggggaggacgaacccattaaattatgcatcatcatcggttgatatatgtacaacaaagaaattcacatgttagaaaaaaaaaaaaaaaaaaaaaaaaaaaaaa

SEQ ID NO: 85201 - DNA, 561 bp, Heterodera glycines
  SCN-specific regions: Sequence locations=1-12,34-329,352-561
atgtcttcttccccgtccgtctctgtgctcgccatcgtcgcaattgtctgtttgatgtgccaatgttgcttttcggcaccgcatccgtgctgtcccggcagtcaaaaagtggtttcacttatgtccaattacgttggcacttttgccaattccatttccaagtcatcgctttgttcggatgcccaaaatgttgcggacgcgttgaaaggccaactgatcggctgctcgaatggcggcgatcgaactcttttggccgacatcgaagcatctcttgccagtcattctgctgatgagtgtgcccacagcctcggcttcgtccgtgccatgttcgccattgccgcctctgcttcttctcatgccagcaacaacagcgaatggcaggcattgagtacacagtttgttcagaaagtcactgaaattgactcgaaatgtgcagagtttggcattagcattggaaaagtgcccatcgatggccccaagggagaccactcccaacgaaatgtgcctagtacggacagtgtgatttccatgcccggattgaccggctcacacaaacattga

SEQ ID NO: 85202 - DNA, 687 bp, Heterodera glycines
  SCN-specific regions: Sequence locations=1-121,143-183,205-347,371-687
atgtcttctctgctgctctccatcttcccaattgtgtttttggtctgttgcaatgcaatgccaaatttcccgtgctgcccgggcagtcagcaagtggttgctgtgatgtccatttacattgacactttctcttctgctgctgacgagtctacagtatgctttttcgctaaaagtactgtggatggaataaaaaatgaactgtcctctcgcggcggatgccaaaacggaggagaagcacaaattgtggatgaaatcgatcgacagctgaagaatattgcaaaaatggagatcaattatgaggacgagtgcccgtacaatttgggctttgcccgtgccatgttcgacttggccgctgctgctgctggccatgcgggcaacggcacagaatggcaatacatgaaagtacaatttgagcaggaaagccaagcaatcaaagcaattggacaagaaaagaactttgaagttacggatgtgcattttggagtcccaagcaaaggggtttctgcacatcaaaatgtgccgagtccgagccatgtgattgccaatcctggccaacacagttcggttgggccaaggaaagaaagaagaaccgttgtcatcggacttcgatttttgaggacaaacaaatcaggaggaaatagaatagaaaaccattttgttgacatgtcgaacatttatttaaagtaa

SEQ ID NO: 85203 - DNA, 279 bp, Heterodera glycines
  SCN-specific regions: Sequence locations=1-279
atgtcccttctccgtcctcaatcgctgcttcttgtgcccgctctttccctgtcctttgcgctgctctttgtcacttcgtcggaagagggagggcgagtgaagcccggcggatgcccttgggattgggccggcaaacaactgtgcaaaacatcggcaaattgcaagtgcaaggatggcaaaagttgggccaaatgtgtaaagtcggaaggctacgcggccagcaattgttgcgacaaaaattacgtgtgggcatgttgcgggaagaagcccaaacattga

SEQ ID NO: 85204 - DNA, 717 bp, Heterodera glycines
  misc_feature (408)..(408): n is a, c, g, or t
  SCN-specific regions: Sequence locations=1-9,32-328,351-717
atgagcaactttatatttgtttcctttttaactgcagcgttttttagctcaggcctcgctctaccggctccttatgatgctgaatcggtggtatcttttgttttaaatgttccactactttcagctgacgcaaatgttgaagcatctcctcccaatgaaagtgatgctgtttttgagatacaagctccatcaattccggtaccaattgaacatcaaactgctgctgacattactcatccaactgaaactggcaatgagtcttctattgcatcatcatcatccacgccgaaaagtgagcagacgccaaaaaaagtgatgaacatgaaaagcgcgctggaaggcgcggcggccaacgtgtacggggggcttccgttagacaagcagcccaagacgatcgctgaagcggcngcaaaagcaaagcagacgcccgccaaacttccggctgactacgacgtgaaccgcgtggcggaacgcgcagcagcccgtgtgtacgggtggcttccggaagacaagcagcctaaggcgatctatgacgcggcggagaatgcaaagaacacgcccaaaccgccgggcgactacgacgtggagcgcgtggcgcaaaaggcggcacggctcgtctacggtgtgctgcccatcggcatgcagcccaacttcgccggccctagcactgacaagagcaatgtcgacgactcggagaaaccttctgctgctgcgtga

SEQ ID NO: 85205 - DNA, 528 bp, Heterodera glycines
  SCN-specific regions: Sequence locations=1-199,221-528
atgagcaactttatatttgtcgcctttttaactgcagcgttttttagctcaagcctcgctctaccggctccttatgatgctgaatcggtggtatcttctgaattaaatgttccactactttcagctgacgcaaatgttcaagcagctgaaaatgttgagatacaaattccatcaattccagcaccaattgaacaacaaactgctgctcacattactcatccaactgaaactggcaatgagccttctattgcatcatcatcatccgcgccgaaaagtgagcagacgccaaaaaaagtgatgaacatgaaaagcgcgatggaaggcgcggcggccaacgtgtacggggggcttccgttagaccagcagcccaagacgatcgctgaagcggcagcaaaagcaaagcagacgcccgccaaacttccggctgactacgacgcgaaccgcgtggcggaacgcgcggcggcccgtgtgtacgggtggcttccggaagacaagcagcctaaggcgatctatgacgcggcggagtga

SEQ ID NO: 85206 - DNA, 669 bp, Heterodera glycines
  misc_feature (606)..(606): n is a, c, g, or t
  SCN-specific regions: Sequence locations=1-579,601-669
atggccatggtttgcttggtgatggctgtcctaatggaaatggcaaattcaaaagcagtcaaaaaagacaataaaaaaggagcagtggcggcatcaccagcaaaaggaaaagcatcgccaaaaggaggcaaaagcccagcaaaaggaaaagcggcaaaagttagtaaaaaagataacaaattgaaagcaaagaaagaaaccaaaggcattaaagttaaaaatgcaaagccaacaaaaaaaggtaaatcggcaaaaggcgcaccaaaaacagccaagaaagtccaagccgccaaaaaagcaccaggaaaggacaaaaagtcgctagttaagccaatcgtccttaaagcaccggtaccaccccataaaatgcacccgatgattgaatccgaagctgtgccaccgcccgcccatgcgcgttcgcttgcgaccgttccttacagtacaccgggggcagccgaccgtaactcattgccatcgtacacttcggctggcaccaatttggacatggccgatgataatgatgattatcagaattattactacggaacggaagacggcagcagggaatttgatgcatcggcggaggaggaggatgaactatatgangagggaggtcggggcaatgagtgggcagacggacgactacggtattggcagtggacaggatga

SEQ ID NO: 85207 - DNA, 837 bp, Heterodera glycines
  SCN-specific regions: Sequence locations=1-77,99-744,789-837
atgcgcaccattctcttcatagccatggtttgcttggtgatggctgtcctaatggaaatggcaaattcaaaggctgtcaaaaaagacaacaaaaaaggagcagtggcggcatcaccagcaaaaggaaaagcatcgccaaaaggaggcaaaagcccagcaaaaggaaaagcggcaaaaaaattgaaacctaaaaaggatgctaaaggcattaaagctaaaaaagcaaagccagcaaagaaaggcaaagcggcaaaagcagtaaagggagcgcctaagacagtcaaaaaactcgcaattgccaaaacagcacaagcaaaagacaaaaagtcaccagccaagccaatggttctaaaagcagtgccgccccaccaaatgcatttaatgaatgagaaagttcaaacagctgtgtctccacccgcccatgctcgttcacttgcgaccgttccttacagtacaccggtggcagccgaccgtaactcactgccatcgtacacttcggatggcaccaatttggacatggcccatgagaatgatgattatcagaattattactacggatcgggagacagcagcaaagaatttgatgcatcggctgaagaggaagatggactgtatgaggagggggacggggcaatgaattgggcaaacggacgactaccggattgggcattgaacaggaatacgggcatcaatcggggggagtggccaccaaagtcggggatgctccaactgaaaaacaccaagaattttggaaaaaacttattttccaaaattttgaaacatttggattttaatattcccgttaaaaaactaaatttttttttacccagcctctaa

SEQ ID NO: 85208 - DNA, 816 bp, Heterodera glycines
  SCN-specific regions: Sequence locations=1-51,76-723,768-816
atggtttgcttggtgatggctgtcctaatggaaatggcaaattcaaaggctgtcaaaaaatacaacaaaaaaggagcagtggcggcatcaccagcaaaaggaaaagcatcgccaaaaggaggcaaaagcccagcaaaaggaaaagcggcaaaaaaattgaaacctaaaaaggatgctaaaggcattaaagctaaaaaagcaaagccagcaaagaaaagcaaagcggcaaaagcagtaaagggagcgcctaagacagtcaaaaaactcgcatttgccaaaacagcagcgcaagtgaaagaaataaagtcaccagccaagccaatggttctaaaagcagtgccgccccaccaaatgcatttaatgaatgagaaagttcaaactgctgtgtctccacccgcccatgctcgttcgcttgcgaccgttccttacagtacaccggtggcagccgaccgtaactcactgccatcgtacacttcggatggcaccaatttggacatggcccatgagaatgatgattatcagaattattactacggatcgggagacagcagcaaagaatttgatgcatcggctgaagaggaagatggactgtatgaggagggggacggggcaatgaattgggcaaacggacgactaccggattgggcattgaacaggaatacgggcatcaatcggggggagtggccaccaaagtcggggatgctccaactgaaaaacaccaagaattttggaaaaaacttattttccaaaattttgaaacatttggattttaatattcccgttaaaaaactaaatttttttttacccagcctctaa

SEQ ID NO: 85209 - DNA, 330 bp, Heterodera glycines
  SCN-specific regions: Sequence locations=1-9,31-46,68-330
atgtacaaatttttatttttccctcatttttgtatcttaattaaggcaatttcggggctccattgttggaattcgaacatgattttgctgagtgaaatgccggaaaagggcagtgtcactgtacaccaatgtccgtccgggcatcaatgcgtgacggcaaattgttggcttggagtcggcaattacattgtccaaaaatgcgtgccggaccagccaggggccagaaactattgcaaagacttcaacaacatttgccaaatgggctttttcggcatgccaattcattgctcatcttgtaagggtgatctgtgcaacgaagcgcgtaattaa

SEQ ID NO: 85210 - DNA, 1302 bp, Heterodera glycines
  SCN-specific regions: Sequence locations=1-481,507-626,648-1122,1245 -1302
atgaacattctgctgaagtctgttctattcatctctcttctgtcactgtttggtgattgcatgaaaaactcagatcaaattggagtcaaaagaaaatcagcaggaataagaattgaggaaccaaatgatgtaaaaggcaaaggaaaagtcgtcgaaacaagcagaaaaggcaaagaaaaagtcggcgaaaaaataagcgttatgaacacagctgaacgcattgaaaaaatggaccttgcccaagacaaagctaaaatggatatagacaccaatggcaaacccaaacaaaatgaggaaaatgctcctccaaaatatgttttcatttggagcggtaacaatgagaagaagaaccttgaggttgacctcagagtgatccgtcactccaaaaaactcagcgaattattccatgccaaaagtgatcaatccgtcaatgcaaaacacggaaagcaggaagcattaccggttccgaaacaggaagctgaaaaaatgctgaaggaagtggaagaatggtacgcacatcacaaaaatgatgaacataaaaaagctccagtttttgtgttcaagtgtaaagacaatgtcagtctggtgataaatgttcatcttgatgcagtccggctttccaaggagttgtcaaatatgcttgaagatactgccgacgaaggatatccgaagccaatcccgagtccagttcagaatttcaaaagtgacatcatgctaaaactgattaaattgtgtgaagaatacaagtacaaattcgatggcctaaagaaaacaactgatgtgccaactggagaagtcgcggaggcatcggcttcaaatgtccaagagggtgacgttggggaggcatcggcttcaaaggtcaaggctggaacaattgcggaggaaatccaaaaattcgttcctccgccacacattatgcaatgggacgtgaaaacggaccttgagatggttcgggccgccgacttttataacatcaatcgtttgatcaacgatgattacattgacaatgtgtacgaaatcgtaaaagtcaaatggatcaatggcaaaacgccgcaggaaattcgcaagggattcggcgtcgaagagccgtacccgccgggacatccggaatgggcacgagttgagaaggagaacgagtgggaagaatcggacgaggaacgtgaggcacgccatgcaaaggaacgagaggaggaagaggagcgtgagagaaaggaagaacagaagcgtaaggaagaggaagcggaacgcctccatcaggaacaactgcagcaacaacagaatcaggaacagcaacctcagtag

SEQ ID NO: 85211 - DNA, 1455 bp, Heterodera glycines
  SCN-specific regions: Sequence locations=1-411,433-439,462-605,627 -1277,1299-1455
atggaagcaggagacgttgacataattcgacaacaacatatccgctattatgctgacattgatggcaggaaatatccaactgaaggacccgattatgatgttcttctttatgggacggatcttttagtcgacggaaagttatataaaaatgcagtccccactggttatatcaattatatcaatcgaattgaggaacgaattcccgttctcggctcatcaggccgaagcattcaactgaatgcggcgggagatgatcaaggaaataatgcacgtttacatacgaatgttgttggtcaccaaatttcagggagtgtctccttgccagaaattccgattgggggaaactctgattatataaacactggacataacaagcatgatggaaaacccacttttggagacaccaaacgggaagaaaaacagaagaataaacagaaacagcaaaagagaggagagctaatcggtggaaattttacacatataaacaatcaaaacaatgaaaacattggtggtactcaagacatcggacgcatacaaattggaggaatgccaccaggaggagctcttcatttaaatactggtggaaatcgcaacgttggtggtactcagatgattggaggcataaaaataggaaagatgccgacaggagggacatttggtttaaatattggaggcaatcgaaacgttggaggtactcaggagattggaagttcacaagggctttataatcgcagcaatactggagatttgactcatgcattgcgtcaacaacgcaccgaggacaatcacatttcgataaatggacaaatttactcagttgacggacctaatgttaatgttggtgttgaagggcatgatttgagtgtgaatgggagagtttatcaaaacagggccacagagcagtatctggaaattatacaagacaaaaacataagaaatgtaattgtcagtgtgccattatcgttattttctcgcgaaaacacaaccgttgggcaaacgcgacatattcacgctgaatgcgatggaaatttatatatcgaccaatcggcagatgactgtattcgcatattatgcgttgatgtaaaaaaggatgccgctgcaaagaactttgggtcaacaagtggaggctttaattttggatcgacgagtgttttttacaatttttcggtccgaggaactttacatatccataattcgtcacttgagtgtgctaacattgaatgtgatgcatctttaaatgtaactcactcaccaatagaacgtaatgcgcaaatgaaatgtggtgggagtttaagtattgatgagtcaccaatgggaaatattcggcttaactgtgatggatctttgcggatcgaaaaatcgaaaatggaaagcagtcagattgatgttggtggaagcattgggattgttgagtcaccaatgggaagtattgggattgactgtggtggatcttaa

SEQ ID NO: 85212 - DNA, 384 bp, Heterodera glycines
  SCN-specific regions: Sequence locations=1-113,136-138,309-384
atggccacttacctattcatcgccgctgctgccttcggagcaggaatttactgttggaaggcgtacctcggcccgatgctcgaccaaccgaagagcgacgacgaggagaagaaggctggcagcaagggcgacaagcacaagaagaaggacaagaagggcgaaggcgcagcagcagcaccagcggcggacaaaaaggaggagaagcgcaaggacaaacaccgatcgaaggaggcggggaagagcgacgacagcaaagcgggcaagaaggacaagcacgggaagaaggacaagaagggcaagaagaaggacaccgccgatgcatccaccgtggacgaagcgctgggagaacagagcacagcggagacgagccaagcagaggaatag

SEQ ID NO: 85213 - DNA, 435 bp, Heterodera glycines
  SCN-specific regions: Sequence locations=1-149,187-189,360-435
atggccacttacctattcctcgctgcagctgccttcggagcgggaatttactgttggaagacgtaccttggcccgatgcttgaccaaccgaagagcgacgacgaggagaagcccaagccggaaggaggcgaagaagcgacgaccgccggcgaggaggagaagaaggctggcagcaagggcgacaagcacaagaagaaggacaagaagggcgaaggcgcagcagcagcaccagcggcggacaaaaaggaggagaagcgcaaggacaaacacaaatccaaggagtcggggaagagcgacgacagcaaagcgggcaagaaggacaagcacgggaagaaggacaagaagggcaagaagaaggacaccgccgatgcatccaccgtggacgaagcgctgggagaacagagcacagcggagacgagccaagcagaggaatag

SEQ ID NO: 85214 - DNA, 549 bp, Heterodera glycines
  SCN-specific regions: Sequence locations=1-83,105-549
atggcttcatctttccgctcctcaatcatttccatcgtcgcaattgtctgtttgctgtgcaaatgctgcttttcggcaccccatccatgctgtcctggcagccaacatgtcgtttcgatgatgaaagatcacaccggcacattctccgcttcgatgccaaagtcttcgctttgtatgagtgccgaaagagtcgccgctgcggtggaaaaccaactgaaaacaatttggtgccctggcaatggtagtcaaacactcatcaacgagatcaacgcaactcaatcatcatcagatgagtgtgctcgcagtctcggcttcgtccgtgccatgttcgaaattgccgcttccgccgcttcccatgccggtgccaacgccgatttggctgtccagttccgagaacaagttggcacaattgacagcaattgtgccgcgttgggcattcatgttgggcaaatcagcttggatgcccccaagggagaccatccgcaagtgcatgactctgagagtgtgcttagtaaccctggcaccagcgggtctcacaagcgcttttaa

SEQ ID NO: 85215 - DNA, 585 bp, Heterodera glycines
  SCN-specific regions: Sequence locations=1-399,430-585
atgcttcgtccgtccgttctgcccttgggcacttctgctcgtccattggtcctctcctgcgtggccatcgtcgcctccgttggcattgtctgtgcccattcccaatcgaagggtatttccggcgccccactcaatccgagcccttcactgctttttgtgtgtgggctgagtttcgccacgcttttctccgtcattttggccatgttcggcctttcttggctccgtccgatttttcttttgcccattatttgcgcctcgggcgttgtctgcgtctttcacactctctccgtggccaattggctctccgactggtggatcagtgctgatcagtcactcgacttggattggctgatcattttcacctcggcgattaccttccaagcaatttccatgctggtcttttctttaaagcatttaatgattttcaaattgttaaggccttttaccttcaaattcgctgctatcgccttttttgacagtcaaattcaaaatattccattaattgttgcgttaataatcgcttcgactgctgctgaaagtgagctatttctaaaaggtggcggtaaatcatttttatttccatag

SEQ ID NO: 85216 - DNA, 798 bp, Heterodera glycines
  SCN-specific regions: Sequence locations=1-258,280-798
atggagaagatcgtctacttaaagctgttgcaatttgtgctcactttgaccatcatttggcaactccgttcacttcaccaattctgcggcacttttgccgacccaaaagccttcctccatgacatctcaattggccattgcaaaaattttacgctcattggaaaggactcaaaaagcggcgaattcagcgctttgttcgaccaggacaaatggcacaaccaactgattatgatgagcagcaccaatggacaactaatcgaagaacagcaacaccaattcatggacgaattggccacgaaattgccatccgctggacgcatttgtattccgataacgatttcgccttttgactggattttttatcggattgccaatgacagaattctcatcgacaatgacattttgtacttttcttccgtccaactctgcgtcgcattgtgcctgcttgtcccccttgtcctaggcacccttctaatgctactctctgtggaagaatatgaaccctgcgcctatttccttgcctcctattttgtcttctgctggtgcggctttgctgcgatctcatccgatttgctgctcaattggacggacttatggacttgctttaacttccaagcggatcacactaatatgccgttggccactttggtgcttagcattgtcatggcgtgttcgtccgtctttgagattttcttcaaaaattcgctgttcaaaaaacgcctcgtgaatgctccagccgccgccgaaaacaatcaccacaaactgcgcaaacattacgccacgtgtgccatcgagtga

SEQ ID NO: 85217 - DNA, 1086 bp, Heterodera glycines
  SCN-specific regions: Sequence locations=1-324,346-573,595-852,874 -1086
atgtcggattcggagaaagtgacaacgcgaaatgcgcagccaaaagtgttagacaccagagatgatggcaaatttacggcaaaatttatcgcgcccagaagcagggagcccgactcggtgttcctccacatatttgggagcaaaaaagatcctcatttgtatttggacgtgtccgaagtgcaatggggcaatgtgtacatttttgacttgaacaaaacggaagtgatcgctgttcggccgcgcagagttgcggatgaattgaggaagttggaagaacgggaccgaccaccggtgaagagggagcaaccaaaaccgcaaccgcagccacaaccacaacctcaacctgtgacttttcaaaaaattctgtccggtttggtttggccaaccactgaaaagtacaccctgctggtgtcatcgcgtgattttgatttggatggacgaggatcaccgatcaaacaacgtgccaccaatcccgacccgaccagagccgagacaaactacaagggcacattcgacgtcaaaatggcactgacggaaaggccggaaactttttacgtgtgggtttcaagtgccaaggggggccaaaaacggtttgtcatcccggcttatgaggttgactcgtccaaatttgcgctggatatgcgcacaggcaaagtggaaccattccaacgcctggaaaacgtattgagaaagttgaagtcggttgggatgatcaacaacgagcaaatcccgtccggaccaccgaagagggccgtggcagcagccgaaccggcaagggcagcagtggcaccaagtgccggatcggacatgctcaattccattaaggcaatggtgaacaacttaggcgctgtgttggaaaagaaaattgagcaacagcatgccaagctgaagcaggacattgagaccgagctggagcagcgtgttggccaaaaactggtcgctgttggcaaacgtcttggccttgttgatgacacgctgaaggacatgtacaaaaaattgccgcgcgaaattgaggacgtaattgcggcggagtttgatgtgctgtacaaaaagaaattaattggcaaacttgatggaaaggcataa

SEQ ID NO: 85218 - DNA, 321 bp, Heterodera glycines
  SCN-specific regions: Sequence locations=1-195,217-232,254-321
atgcgcacttttctgttcatagccgtagtcgggttgatgttggccgtcatcttggagaatgtaaatgcgacagggaaaaattcgccgacaaaggaacttatacatgagcaaggtaacctacagaaccatgctaccggacaatcgccgccagacagtccaaaccataaaaatgaccatgaaaacgagattagtaacctacagaaccgtgctaccggacaatcgccgccagacagtacaaaacgggaaacagaacataaaattgagaaaggaaaaccgtcgccagacagtccaaagtatgatgagcaagccttaaaatggtga

SEQ ID NO: 85219 - DNA, 441 bp, Heterodera glycines
  SCN-specific regions: Sequence locations=1-12,34-441
atgtcttcttccccgtccgtctctgtgctcgccgtcgtcgcaattgtctgtttgatgtgccaatgttgcttttcggcaccgcatccgtgctgtcccggcagtcaaaaagtggtttcacttatgtccaattacgttggcacttttgccaattccatttccaagtcatcgctttgttcggatgcccaaaatgttgcggacgcgttgaaaggccaactgatcggctgctccgcttcttcccatgccagcaacaacagcgaatggcagacattgagtgggcagtttggtcagaaagtcactgagattgactcgaaatgtgcagagtttggcattagcattggcaaagtgcccataaacggtcccaagggtgtccatgttcaaaatgtgcccaactcggaaagtgtgatttctatgcctggattggccggctcacacacccaatga

SEQ ID NO: 85220 - DNA, 558 bp, Heterodera glycines
  SCN-specific regions: Sequence locations=1-83,105-558
atggcttcatctttctgctcctcaatcatttccatcgtcgcaattgtctgtttgctgtgcaaatgctgcttttcggcaccccatccatgctgtcctggcagccaacatgttgtttcgatgatgaaagatcacaccggcacattctccgcttcgatgccaaagtcttcgctttgtctgagtgccgaaagagtcgccgctgcggtggaaaaccaactgaaaacaatttggtgccctggcaatggtggtcaaacactcatcaacgagatcaacgcagctcaatcatcatctgatgagtgtgctcgctctctcggcttcatccgtgccatgttcgaaattgccgcttccgccgcttcccatgccggtgccaacgccgaattggccaatttggctgtccagttccgagaacaagttggcacaattgacaccaactgtgctgcgctgggcattcatgttgggcaaatcagcttgggcactcccaaaggagaccatccgcaagtgcatgactctgagagtgtgcttagtaaccctggcaccagcgggtctcacaagcgcatttaa

SEQ ID NO: 85221 - DNA, 588 bp, Heterodera glycines
  SCN-specific regions: Sequence locations=1-32,66-69,98-274,395-588
atgcgcgccgttctcttcctggccatggtttgcttggtgatggctgttattcttgagacagccaactcaaaggcagtgaaaaaagacaataagaaaggagcaattacaacgccagcaaaaggaaaagcggcgccgaaaggagcagcgaaaggaggaattaaaaaagacgcaaaatcaaagggaaaaggaaaaaaggacgccaaaggcaaaaaggacaaaaaagctaaaccagccaaagggaaagcatcgcctaaaaatgacaaaaaacccccagctgccaaagcaaatgacaaaaagagcccaaccaaaccaatggcagcagtgaaagccgtgccaaaggcggcggagaatgctcagaagggaccgtcgagtgcggaagtggtggcggaggaaagcaacttggacactgaggcggtcgacgacttgggggttggacctgaggcggtcgacgacttgggggcggaagagtcggactttgaccaattggcagaggacgaactgctcgaggacgacgccatgggcggcgaggcggacgaatgggaaggcatgggggaggagacggagatggacagccaaatggcactttga

SEQ ID NO: 85222 - DNA, 735 bp, Heterodera glycines
  SCN-specific regions: Sequence locations=1-735
atgcgcacttttctgttcatagccgtagtcgggttgatgttggccgtcatcttggagaatgtaaatgcgactgggaaaaattcgccgacaaagggacaatcgccgccaggcagtccaaaacatgaaaaagaccgtaaaaatgagcatggtaaccaacagaaccatgctaccggaaaatcgccgccaggcagtccgagagtacaatcgccgccaggcagtccgagaggaaaatcgccgccaggcagtccgagagtacaatcgccgccaggcagtccgagaggacaatcgccgccaggcagtccaaaacatgaaaaagaccataaaaatgagcatggtaaccaacagaaccatgctaccgttccaaatgtggtgcagaaagttgaagtccacaaccaacctacgccatctgctgctgcttcacaccctgtgccaccaacaccagggaacagccctactgcgcatgacagtcaccacacaagcccaaaagttgcccatgttgctgccgccgccactttgggccatggacgccaagaatgtgccaatgtgtcgtgtggtgatgatgtaaccgaggaaatggaccgcgacgatgataagacagtggaacgcgcggtcggcgagtcaccaatcggcgtttcggaatccagcgccacggatgaggatgattctgctgccgtttcggcttacaacaaaaacaacagctcggccgccgcatcagcgtcagttgctgatgactga

SEQ ID NO: 85223 - DNA, 927 bp, Heterodera glycines
  SCN-specific regions: Sequence locations=1-51,81-205,229-359,382 -433,457-798,820-849,872-927
atgctgaggattgctctactcatctccattttggcactgtttggtgattgcatggacaagggaaaaagaaaattaggaggaatcagtattaatgagccaagtgaatatggaaccaaagaaaaagaagccatcgcaacaaaagaaaatgctctaacatcaaaggacccgccgacatcggcgggtggtcaaaatgaagcaatcccttcaccaaaaaagccaagccccaaggggaagttgaaaagcgattttggcctaaacttagccaaggcttttccacggccggttccgaaaggaaaaaaagttgaaaatacactatcatcaaaggactcggcatctgaagctcacaaagaattggccaaagagaaaaatgaagaaaatgcacagacctcaaaggtcccgacatcgatggaaaggcaaaatgaaccaatcccttcaccaaaaaagccaagccccaaggggaagtccaaaagcgatttcgccctaaacttggccaaagcttttccacgaccagttgccgaagcaaaaatgggagaagaagctcagtcttcaaaagatccgacaatgaatgccaaatttgtgcaatttgtttggatgcatcgcttatcactgaccttgaaattgagcaaatgccatcatcgctttcaccgcgaatgcgttgatgggtggtttaaaaacaatgacacatgcccttattgtcgtgctgtagttgcaagcagatatttaccaagacctacgcgtacagatcgaatttttgacgccagaatcgaaaacaaaagacgcttcatgggagaaggagaaggaaaatacacaattattcgccctaacggaagtacgcttatggttcacgataatcattttggaaacaattttacggtcgaaaaaactgaagagggctccattcaactcagtaaaaacgatcgcaaatag

SEQ ID NO: 85224 - DNA, 684 bp, Heterodera glycines
  SCN-specific regions: Sequence locations=1-684
atgcgcacttttctgttcatagctgtagtcgggttggtgttggctgtcatcatggagagtgtaaatgcgactgggaataattcgccgacaaaggggcaaactccgcctggcagtccgaaaggtgggcacggcagcaacaaatcgccaacgacgccgcacagtgccggttcgccacacggcacgcagcatggtaaccaacagaaccatgctgccggacaaacgccgcctggcagtccgaaaggtgggcacggcagcaacaaatcgccaacgacgccgcacagtgccggttcgccacacggcacgcagcatggtaaccaacagaaaaatgctaccggacaaacgccgcctggcagtccgaaaggtgggcacggcagcaacaaatcggcaacgacgccgcacagtgccggttcgccacacggcacgcagcatggtaaccaacagaaaaatgctaccggacaaacgccgcctggcagtccgaaaggtgggcacggcaacaacaaatcgccaacgacgccgcacagtgccggttcgccacacggcacgcagcatggtaaccaacagaaccatgctgccgtttcaaatgtggtgcagaacgttgacaacaaacctcggccatctgctcctgcttcacaccttgtgccaccaacaccagggaacagccctactgcgcatgacagtcgctga

SEQ ID NO: 85225 - DNA, 492 bp, Heterodera glycines
  SCN-specific regions: Sequence locations=1-492
atgaggaaacttccattcttgctcttattttctgcttgttgctacttgcaacggaaggaagtatatttcgccgaaaaaacagaaagaaaaattcatcgagcagcgaacaaaaaacacaaagaagaaaccgagggtatggccgaagtcgcactttttcaaatggcaatggcatgtatggccaatcgaatggattttcaaatggccgatttggcggctccagtgtctattcaaatagcggccggtcgaatagctttccaaatggtggatttggcggctccagtggcttttcatcgatgggacataactcgggcggacttcacggctttgggtccggcccaccttctggaggctacggatacggaagcggttttggtggaagaaaatgaaaaaaagaccgaaagtgatcggcgagagaatgatttgtgctgttgccttttatgcatgcaaaatttaaatggaaaaacgcatttcaccagcagaacacttttttaa

SEQ ID NO: 85226 - DNA, 708 bp, Heterodera glycines
  SCN-specific regions: Sequence locations=1-53,75-538,560-570,592-708
atggtttgcttggtgatggctgtcctaatggaaatggcaaattcaaaggctgtcaaaaaagacaacaaaaaaggagcagtggcggcatcaccagcaaaaggaaaatcatcgccaaaaggaggcaaaagcccagcaaaaggaaaagcggcaaaaaaattgaaacctaaaaaggatgctaaaggcattaaagctaaaaaagcaaagccagcaaagaaaagcaaagcggcaaaagcagtaaagggagcgcctaagacagtcaaaaaactcgcaattgccaaaacagcagcgcaagtgaaagaaataaagtcaccagccaagccaatggttctaaaagcagtgccgccccaccaaatgcatttaatgaatgagaaagttcaaactgctgtgtctccacccgcccatgctcgttcacttgcgaccgttccttacagtacaccgatggcagccgaccgtaactcactgccatcgtacacttcggatggcaccaatttggacatggcccatgagaatgatgattatcagaattattactacggaacggaagacagcagcagagaatttgatgcatcggcggaggaggaggatgaactgtatgaggagggggacggggcaatgagttggcagacggacgactacggtattggcattggacaggagtacggtcatcaatcggtggaagtgccaccaaagtcggtgatgctcgactga

SEQ ID NO: 85227 - DNA, 1008 bp, Heterodera glycines
  SCN-specific regions: Sequence locations=1-20,42-811,834-1008
atgaactcctcatttgtcatctgctgctgcttccacaactttgtgttgttccttcttttgagttgtgttgtgccacatgcttttgcttgttgtcctcatggaaatctcagagtgaaaggtacgcatttggccgatgaaaagggcgaaactgtgcagctgcgagggatgtctttgtactggagccaatgggagtacggctcaaagttcttcaacgagaagacggtcaactgcctgaagtgcagttggcatgccgacattgtccgtgctccgttagctgtggaccagggcggctatttgtcaaatccagaacaggagtatgcgaaggtgaagagcgtagtccaagcagcaatcgacaaatgcatatatgtgctgattgattggcattacacgagcagtgagaaatatacggacaaagcgaaggagttcttcggcagaattagcactctgtgcgctggcaaatgcaactgtttgtacgaaacatggaacgaacccatacaaaacgattggtcctcgcagttgaagccgtaccacgaggagctggttaaagtgattcggcagaatgacaagaacggagtgataatcgctggaacgccaaattatgaccaggatgtgaaggcggtagtcaatgacccaatcaaagagcacaatataatgtacacattgcatttgtacgcggcatcgcataagcaagaactgcgcaacacggcacaacaggcaatcggcgcgggagtgccgttgtttgtcacggagtatggcacaagttcgtacacaggcgatggcgggccagaccttgtcgaaacacagaattggtacgactttttcaacaaaaactccctctcgtacatcaactgggccatcgacgacaagcaggaagcgtcggtagcgctgcagaacacacagcccccagtcgggccggccgacgtgtgcagcaccgatcggctgaccaaatcgggcaaatttgtgcacgaccacctcatcggtgtaaaccagaagccggatggctgttaa

SEQ ID NO: 85228 - DNA, 5368 bp, Heterodera glycines
  SCN-specific regions: Sequence locations=1-123,145-431,476-1472,1494 -1709,1732-1857,1937-2002,2024-2036,2086-2353,2375-3170,3216 -3234,3256-3581,3603-4006,4136-4487,4509-4656,4678-4840,4865 -5030,5052-5368
gttcacatatttgacactgccgtcctcacgcgacgcaactgaagcactgttaggtctaatcaattgcccctttaattatccctcccctaatttggccatttgcctaattaccctgctggagcatgccctggttgcgcagggatcccatgatgaacacaaattcgttgtccgcagcaagaccagtgtcgaaaatggacaacagaaagttgcgacgttcaacttcgacatcgaaacaggaaagcacaactaattgatggtaattagcgatgctatcaaattaattatcccatcacttcgcgatcggttgcgcagatttctcagcgtcgccttcatactgtccacattggactccatctgatgctggaaaacaatggtcacattggtcacgttgagcacatttgtgagactctgtttcaccgagttacagaccctaattaaattatattaatagctaattaattaattaattattcaaaataattcttacattcgctcattgtccggagtgtacacgaaggacacttctgtccaattgaattgcaccaacacactttgtaaggccaacgccaacctgcaataattgttgaaattaataagaaatcattggtcatttgatttggtgacggctcgtaaagcaaatccattttagtttattttattagtagaaataataattttaggggatggaaggcgaagaatattttctccactgacatgtccgagttaacgttcacgttgttcagtgtagggtatacggtagtgttgtaaaattccgaggccacagtagcaccccacaaatacagtggaatgttgtagaaggaggccacgtatcccgcggcgatggcacctttttcatttacgcaatttttggcaaagtgtcaaacaaaaaggcattactggtcacacaaggcggaccgatcaaagcgtccacattttccgtcagaaccagttgagtggcgtagccgacagcccaaggctgaaagcagccgcacattcgccacgtgtaactgaaattggcatttacggccaattatttccgctcgcttggagatttttaaatttgcaaaaagtgatttgaaaattgtgagtttctaaattcattccaattgcccacgtgaagttgatgctgtcgatgaggtgctcctgcctcgcccgttcgagtgccaaagtgacggcgggcgcggattggccaaagccgaaaagcattcgcaaccgttgggtgccgttagcaaagaggaagccgatttttaactgaaccgatgcttccaaaggaccagttgatgggagagaggacgaagaattaatcggcggactgatcggcggagggacgccaaaagtggcagtgccattcgtggagggtgcagtagagattgggatgatcggcgaaggagtgccaaaagcgacggtggtgccaatgggcgaagacgatgagttgctaacagtgactaattggtgccgagaagggctgacaaaaagcataagaaagaaaaggaggaagaaacaggacggcatttccattttgagagattttgggcaaggaaattttaaaatgaaatgaattcattaaaaaggcgatttgtcgggattcaaatcccagcggagaaaccttacaaaatgtttcaagctgattcggtacggtcgttttgcggcagtcgcataatcccttaaagggcatttcaaaattccaaaatgaattcgttcttttgaagtgattccatccacttcctcttcagctttgtttgggagggcatcgttaaataattttaccgccaaagttcaaattttttaaagttcaaagtcctgacagagtgacaaattttaattctaagaaatatcgaaatttttaaaatccttatcaataaacaaaaaattataataatacaagtaaaaatgaaaaaatatattcagcaaaaaataaaaatatatatataaataatcggtgctttttcttaagaattttctttaatttttgatagttttcttttcctcttccgtttgaaatatctttcatttccttttttcagttccatgcgtttaattttttccgttttacattttcccattaaataagtaaaaaatgaaaacggctaaaaattttggaaaatccaccacctagctcgggatttaaaaaaacgaaaaatacacccctaaaaattggctaacttggtcccaactcctaatgtgatcacaaaaactacgccaaattttttaggtgatcaaacaaaatgaacggcaaatttaacaaaatgaatggttaagcaatcaaaaaagccaagtttttggtgttcaaattatttgaacagatgtggaaaagtcataaacaaaagctaatggcgaaacgaattcaacaattgacgtctgaataaatttaaagctatggaaatgaaatatagccaaatgaaagggcaaagtgagccaagaaccggcggatgagttcggtcggcttagaggtggagattggcatataaatatcggcaaatgactgttcgccattcaattcgctttcatcgttcaaatgtgccgactccaagcaactcatctgctcgctcgactctttctgcttcttgcgctttgcactgctctcgttagctctctcactgctgttgccccgccattcggccaattgtccgtttccggcaccaatttggtcggcgccaacggacaacccgtacagctgatcggcaactcactgttctggcaccaatggtacccgcagttttggaacgctgacacagtgaaggtaccataaaagcactcacttttcaaaatggattaagaagccaaacatatttgatcaaaatgtgcaaagtgttaatgttaaataggcactcaaatgcaattggaatgccaatgtcatccggggggccatgggcgtggacgagggcggctatctgagtgacgcgaacacggcttacaatctgatggtggcagtgatcgaagcggccatttccaatggcatttacgtgatcgtcgattggcatgcccacaattcacatccggacgaagcggtgattagtgccgagactgaggcaaatggcaaatttgagcattctcaaggtcaaattcttcacccgaattgctcaagcgtacggctcctaccctcacattttgtacgaggatttcaacgagccgctgagcgtttcgtggaccgatgtgctggtgccataccacaaaaaggcgagtcataagagaacatttttggtgaccaaaaggaacccatctgctgaaggtcattgctgccatccgagctattgacaagaaaaatgtgatcattctcggcactccaacatggtcccaagacgtggatgtggcatcacagaacccaatcaaagactaccaaaatctgatgtacgttttcgatcagttttacactgaaagtgtgccaatatggggggggcaaaatgaacgaccatcaaaacgacaaaaaacaattgtcaatccccttaacaacgacatcccttttaaggtacactctccacttttacgcgtccagtcacttcacgaatgatcttggtgccaagctcaaaacagccgtgaacaacggcaagtgctaatatttgtctgggacgtgccgggctcctcaagggaagcttcttctccatctaaactgcttccctaaaggtttgcctgtgttcgtcactgagtacggcacatgcgaagcgtcgggcaacggcaacttgaacactgactcgatgtccagctggtggactctgctggacagcttgaagatttcatacgccaactgggcaatctccgacaaaagtgaggcctgctcagcactgagccccggtacaactgctgccaatgtgagaaagaggcggaatttcgggacattaatgataaattgtcttgaaaggtcggtgtttcgtcccgttggacatcctccggaaatatggttgcttcgtactacaagaaaaaatccaccggtctgtcccaaattcgttgccatttgctggaactaaacgaattcaggcgtaagctgtagcggctcaagttccggcagctcttcgggctcgagttctggctcttccggttcaagttccggcagctcttccggctcaagttccggcagctcttccggctcaagttcgggctcctctggttcgagctcagggtccagctcgggttcgggatccgccagcatctctgtagtcccatccaacacgtggaatggcggtggtcaggtcaacttcgaaatcaaaaacatcgggtccgtgccattgtgtggcgttgtgttcagcgtctctcttccctcaggggttcgtttgaatagggcgatttgttgccattttcgagtgactcctttcttttccaatgtgtcaccgtccgttttagaccacgcttggtggatcgtggaacatggaatccgcaggctccggccaatacagcttgccaagttgggtcagaattgaggccggaaaatcgagcaaagacgcggggctgacattcaacggaaaagataagccaacggcgaaaattgtgacgacgaagaaatgttagggaaaagacaaagcgcaaaatgggaggaaaagaatgggaaaatgaaagagtggagaaaaagaacaaagggaaagaaagacaaagaattaatgattatgataagagataataactgataaagtttagcataaaatgttgaccaaagtacacattagccaaacccaattaattaattggcatttattcgttgcttaattaggggtcggacttttcagtagaaaaaatcgtcacaagtctcattttcgtttctaaattaatcaaaactagctaaatttagtcaataaaccattgcaacatcaaaaaatagtcattctatacagatacgaaaataagtgaaacctataaatttttccacaaaaattttgaatttttttttcgaaaaggggaggttaccaccggcggcggtagtattacataccaagttgaatctcgtgttttcgctgtaagccaagctttccaatcttggaaaaattgaagaataccgccaattttgattttgtaaacagaatcgttcaaagctaaaaattcaaaaaatattgttcctttcgattcctctagggtaaaattgcaagctaagcagtgttaagtgttaaatttaaaaactaattcttaaagtcgcaaagcatcacgctaatggcgagcatgcgatgacgaagcaagtagtggggtgcccgagcgagcggcgccccaattactggccgccgtagtcgagtgtgcggtgtcttggccaaaatgctaagtaacgtcaacggttttctgatggttcggagtaactgggaaacgccaatttttaatgttcagagtgactggtaaacgacaattttaattgaacgatttttcaaaaaaatttacccaatcaaaagtgcca

SEQ ID NO: 85229 - DNA, 3119 bp, Heterodera glycines
  SCN-specific regions: Sequence locations=1-121,144-409,431-492,516 -710,732-828,850-1055,1077-1164,1187-1250,1278-1296,1319-1641,1669 -2207,2272-2885,2907-3003,3028-3031,3055-3119
tttttttaatttatagaaagaagtctcagtctcaggaattttcggtctcgaacagcctaattttgatcatgattttttgctacaaataatttttaccacccattaaaattttgatagggaagaaaattattttctcaaaaacttcgtgcttcgagctttgaaaacttcgggtttttggggcttcgaacttcgtgctttgaaaaaaattgggcttcgccttcggcttcgagtgctaagccgagcttcgcccgtccctcgcatttccttcttcatacttcaaaatctgaaagagattttaagtgttttttgtcacctaaattattatttctaatcagtcatttcagtccataatttgacccaaagtgctttccgacaaaaaaataatacattattaaacttacatgtataaattttttcaatcatttcaaaagtcattaataagcatattaaaaatgaattgctcaaaaatgaaaattaatttcataggctgtgctaataaaaagaaaatagaaaaacgtattcaaaatgttggagatttacgtctctgagctgtcaaaatcactcacattaagctgaacaaacaaaatttagccaaaaaatttgaaaagtaaaatattgaacagaaaagcgcataagctttttggatgaacgggatatgatcattagtgcatgcgcaagctgaacaatcaaaatgtttggcgaattcatcaaaattttaaattgtcaaattttttccgtttcgtcgccctataaatactctttccaaaatcagttttggcaatccaataaaatttctcttaataaaaaaatactcttcaaataaataatcattcctagctgcttttggtttgatcacaaatgttcgtccaactcgtcctccttgccatcgttggcattacttttgtcgatgctgccgcaccgccgttcggccaattgtccgtcaaaggcaccaatttggtcggctcaaacggcaaaccggtgcagctgatcggcaattcgttgttctggcaccagtggtacccacaattttggaatgcccaaacagtgaaggttggaaaattaaaatttcattttgagcggtttggattgacacagattttggttaatctttgcaataatgacaaattgaaactaagttgaaattagacactcactgttcttggcaatcaatttttgtatattttgtgattcttttttcgggtttgaattgctaaaaatgggctgatcactcacgccaggcactcaaatgcaattggaaaatttaaaaagtgaaaagactgagtcgagatttggctaggcaaagcagctttttggatgaaattattaatcgagtccgatgcttaaattaaagactccgaataaaaaacaaacaaagtttttggctcaaaaagaaggcaatttttaaaccaattaagcctaattgcatttatgcttgtaggcactcaaatgcaattggaattccaatgtcgtgcgcaccgcaatgggcgtggaacagggcggctatctgagtgacgcgaacaccgcctaccgactgacggcagctgtgattgaggcggccattgcacagggcatttacgtgatcgtcgattggcacgcgcatgagccgaacgcggacaaggcggtaattacataatttgattttgcataatatattttaaaaaatcagagattataatttagcactctgaaaaagatggtttagccaaaatatcaaacatttcccctttattggcccacaattattcatttaatttttgaaatatttacctctgatttaatttttatgaaactttaatagtaggaatcttgggttctcgagtgttagaaatttcgattcttgagcacgattcattgttttgcttcttgagattgaattcttcaccaaaattgcgaaagcgtacggctccaaccctcacttgctttacgaaacgtttaacgagccattggatgtgtcttggaacgatgtgcttgtcccttaccataaaaaggtaattcgctgggaaatgaaaattgctaacattctcccccttaaggttatttctgcaattcgtgccatcgacaaaaagaatgtgatcattctcggcactcccaaatggtctcaagatgttgacgtggcggcccaaaatccgatcaaaggattcagtaatttgatgtaagtggactctccattaagtgtaattagtgcatgccgtaatgctgcacaaaactaattaataattttttgcaaaataattaataataattaattaatcagaattatattaatatattcgcgctattaaggtacactctccacttctatgcgtccagtcactttgttgatggacttggcaataagcttaagaccgccgtaaataagggtaatcatatgatactgtatcgtccaaaaccattactgtttgcaaccgtacattaaggtcttccggtgttcgtcactgagtacggtacatgcgaagcgtctggcaacggtaatctgaactccggctcaatgtcaagctggtggagcctgttggaccaactgaaaatttcgtacgtcaattggtcaatcactgacaaaagcgaagcttgtgcagcgctcactggcggaacatcggctgccaatgtgagtgattttgggggccactgataggaagtgccgtccgagaatttcacgccacaaaaaagcgaatatttctcgagtcgaacactaaatctctcgaattcagccatttctcctacaaatttgctcatttcaggttggcacttcctcccgctggacgcagtctggcaatatggtagcttcgcaacacaagaaaaaatccaccggtttgtctgaccaattaaaccgtcaagggcaggacacaatcaagaaatatattgaggatctggatttacggattaagggatttatttaatcagaaccagtcactcataaaactgaaaagtgcaataatatggacaaataataattcacaggtgtgaaatgctaaataaagtctgaagtccggatgatcaactgaaactgaagaaaatggaaaatgtgaagattgcgaaaaataaatatatataaaatttgcatgcgaatgtttatcgaaattccgattaaattgttttttgagcgcagataaatcgcaaagcat

SEQ ID NO: 85230 - DNA, 1266 bp, Heterodera glycines
  SCN-specific regions: Sequence locations=1-351,374-676,709-1003,1025 -1241
accaaaatggctgtccctcaggaagtaattgacaaaattgaggctggctacaaaaagcttcaggcggcggctgattgcaaatcgttgttgaagaagtacctcaccaaggacgtcgtcgatgcatgcaaggacaagcgtaccaagctcggagcgactttcttggacgtcatccagtcgggggttgccaacttggacagtggtgtcggcgtgtatgcgccagatgccgaggcttacacactcttcaaaccattgttcgacccgatcatcaacaactatcatggtggctttggaccgagcagcaagcaaccggcaacggaccttggtgaggggaagactcaactgccgactgacttggacccggaagggaaattcatcaattcgactcgcgttcgctgcggccgctctcttcaggggtatccattcaacccatgcttgaccaaggagaattacgtcgagatggaatcaaaggtcaaagcggtcttcgagcagctgaagggcgatgccgagttgggaggcacctactatccgctccagggcatgaccaaggacgtccaaaatcagctgattgccgaccacttcttgtttaaagagggcgaccgttttctgcaggaggccaatgcttgccgttattggcccaccggacgcggaattttccataacgccaagaaaacctttttggtgtgggtcaacgaggaagatcacctccgtatcatttcgatgcaaaatggcggcaatgttggacaagtgctggagcgtctcataaagggagtcaaggccatcgaatcgaaagttccgttttcgcgtgacgaccgtcttggctggctgactttctgtcctaccaacttgggaacgactgttcgcgcgagtgtgcatattcgacttccgaagatcagcgcaaaacccgacttcaagtccatctgcgacggcctgaagttgcaaatccgcgggattcacggcgaacattccgagagcgctggcggcgtttacgacatcagcaacaaggcccgtcttggtctcacggagttcgaagcggtgaagcagatgtacgacggagtgaaacacctgatcgaattggagaagaaagcataatgggaggaccgatctatgatgatgactttatattgcgtaatgtggagatttgctagttgttctgaatctcttaggctttaactatttaattattgtcccaaaatcgtgcttcatccgtatgattatttccgtgcataaatttgtttgtgttcaaaaaaaaaaaaaaaaaaaaaaaaa

SEQ ID NO: 85231 - DNA, 950 bp, Heterodera glycines
  SCN-specific regions: Sequence locations=1-594,617-657,680-950
ccaagtgattcctattcaccacctacctgctgtcctgttgggctagcgttggcaccaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacatgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagggcccgtgcttggcctagcacgtggcttaagactcaatgagtgtcagctcgggcaccgccagctttttcttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcgggcgcaccaatgctttgcatgctgtggcggagtgcctggattactggcattcctgctttgattt

SEQ ID NO: 85232 - DNA, 270 bp, Heterodera glycines
  SCN-specific regions: Sequence locations=1-270
atgaatttgatttttgaaatattcgcctttggaatggacaatttctcatcggaaaaaaatgtttctcttcttcgtcttttcttattctttttctcgaccgtagtattatttggaagcgcacaccctatggtaaacaaattatgcgaagacctagataaacctgaaggttggcaattattgaaaaagttaacaatcgaaaagtgccggatgagtataatgtggaattccccaaatggaaagacagctacaaaagcattaaaaagtttataa

SEQ ID NO: 85233 - DNA, 338 bp, Heterodera glycines
  SCN-specific regions: Sequence locations=1-59,86-86,113-302,324-338
tgaactcaccggacaaggcgtgccaactcgccaaacaggcgttcgatgatgcgattgctgagctggacacgctcaacgaggactcgtacaaggactccactctgatcatgcaactgttgcgtgacaacttgacgctttggacatccgacacggctggcgatgagcaggaggctggtggtgaggcgggcgaagctggtggcaactgatcgggcggacagacgttgaagaccaagaaaatgccccacgaaattttttccaccgaatcatttaatgacaattatgcttttctcaatatggcacttttgattgggtaaatttttttgaaaaaaaaaaaaaaa

SEQ ID NO: 85234 - DNA, 1871 bp, Heterodera glycines
  SCN-specific regions: Sequence locations=1-208,230-249,272-593,621 -1147,1225-1763,1794-1871
atgttggttcaactcgtcctccttgccatcattggcatttcctttgtcggtgctgccgcgccgccgtacggccaattgtccgtctccggcaccaaattggttggctcaaacggcaaaccggtgcagctgatcggcaattcgttgttctggcaccagtggtacccacaattttggaatgctgaaacagtgaaggtattagaaaataatagacaatttaaaaagtgaaaagactgagccgagatttggctaggcaaagcagctttttggatgaaattattaatcgagtccgatgcttaaattaaagactccgaataaaaaaacaaagtttttgactcaaaaagaaggcaattttttaaacccaattaagcctaattgcatttatgcttgtaggcactcaaatgcaattggaattccaatgtcgtgcgcaccgcaatgggcgtggaacagggcggctatctgagtgacgcgaacaccgcctaccgactgacggcagctgtgattgaggcggccattgcacagggcatttacgtgatcgtcgattggcacgcgcatgaggcgaacgcggacaaagcggtaattacataatatgattttgcataatatattttaaaaaatcagagattataatttagcactctgaaaaagatggtttagccaaaatatcaaacattccccctttattggcccacaattattcatttaatttttgaaatatttacctctgatttaatttttatgaaactttaatagtaggaatcttgggttctcgagtgttagaaatttcgattcttgagcacgattcattgttttgcttcttgagattgaattcttcaccaaagttgcgaaagcgtacggctccaaccctcacttgctttacgaaacgtttaacgagccgttggacgtgtcttggaacgatgtgcttgtcccgtaccataaaaaggtaattcgctgggaaatgaaaatcttacacattctcccccattaaggttatttctgcaattcgtgccatcgacaaaaagaatgtgatcattctcggcactcccaaatggtctcaagatgttgacgtggcggcccaaaatccgatcaaaggattcggtaatttgatgtaagtggatgtaattagtgtattggtaatgctgcacaaaactaattaattaataatttttttgcaaaaaaattaataataataaagaaatttattaatcagaattatattaatatattcgcgttattaaggtacactctccacttctatgcgtccagtcactttgttgatggacttggaaataagcttaagaccgccgtaaacaagggtaatcatatgatactgtatcgtccaaaaccattactgtttgcaaccgtactttaaggtcttccggtgttcgtcactgagtacggtacatgcgaagcgtctggcaatggtaatctgaataccaattcaatgtcaagctggtggagcctgttggaccaactgcaaatttcgtacgtcaattggtcaatcactgacaaaagcgaagcttgtgcagcgctcactggcggaacatcggctgccaatgtgagtgaatttgggggccactgataggaagtgccgtccgagaattgcacgccacaaaaaagcgaatatttctcgaggcgaacactaaatcgctcgaattcagccatttctcctacaaatttgctcatttcaggttggcacttcctcccgctggacgcagtctggcaatatggtagcttcgcaacacaagaaaaaatccaccggtgtgaactgcagcggtggtggtggcgctgctgctaagccagctgctaagcccgccgctaagccagctgctaaatcgaagggaaagtcttccaaagccaagaagtccggatga

SEQ ID NO: 85235 - DNA, 1008 bp, Heterodera glycines; identical to SEQ ID NO: 85169
  SCN-specific regions: Sequence locations=1-560,582-609,633-688,710 -1008

SEQ ID NO: 85236 - DNA, 1126 bp, Heterodera glycines
  SCN-specific regions: Sequence locations=1-56,108-271,294-748,774 -957,980-1089
ccaagctccactaaatttgtttttttgtgaataacagtcagcaaaaacaaagcaaaaatggacgccatcaagaagaagatgcaggcgatgaagatcgagaaggacaatgccatcgaccgggcggacgccgcggaggaaaagtgccgtcaaacgcaggaacggttggagcgtgttgaggaggaattgcgggacacgcagaagaaaatgatggcgacggagaacgaattggacaaggcgcaggaggacctgacggctgccaacaatttgttggaggagaaggagaagaaagtgcaggaggctgaagccgaagtggcgtcactgaaccgtcgcatggttctgttggaagaggagttggacaagcttgaggagcgccttaaacttgccaccgaaaaaatggaagaagcgacggccaattgcgacgaatcggaacgtgtgcgtaaagtgatggaaaaccgttctctgcaagacgaggagcgtgccaatgccatcgaagaacagctgaaggaggcccaatcgctggcggaagaagcggaccgaaaatacgacgaggtcgctcgtaaattggcaatggttgaagccgacttggaacgtgccgaggagcgcgcagaggccggggagaacaaaattgtggagttggaggaggaattgcgcgttgtgggcaacaacttgaagtcgttggagctcagcgaagaaaaggcgttgcaacgcgaggaagcgtacgaagagcaagtgcgtcagatggaagtgcgtctgaaggaggctgagactcgcgcggaattcgctgaacgttcggtacaaaagctgcagaaggaagtggacagactggaggacgaattggtccacgagaaggagcggtacaaagcaatttcggaggagttggactcgactttccaggagctttccggctactgatctgttcggtcaacggatgcgagcggaagtgtgctgccggacggacttggaaattatttttgattttcctgacaaaacgaaaaacaaacatcattctgttaatgataccgaagagccaattgcttccttagtaaatctgctcaccgttcttttttgatttcgttgggaaattacggcaaataaataaataatgttcaaaaaaaaaaaaaaaaaa

SEQ ID NO: 85237 - DNA, 1211 bp, Heterodera glycines
  SCN-specific regions: Sequence locations=1-1077,1102-1105,1129-1211
attccaactaattttctcccaatctaaaaaagtctctctaattaatactaattagtacaaactgctgttgatttgatcacagaatgttggttcaactcgtcctccttgccatcgttggcattacttttgtcgatgctgccgcgccgccgtacggccaattgtccgtcaaaggcaccaatttggtcggctcaaacggcaaaccggtgcagctgatcggcaattcgttgttctggcaccagtggtacccacaattttggaatgcccaaacagtgaaggcactcaaatgcaattggaattccaatgtcgtgcgcaccgcaatgggcgtggaacagggcggctatctgagtgacgcgaacaccgcctaccgactgacggcagctgtgattgaggcggccattgcacagggcatttacgtgatcgtcgattggcacgcgcatgagccgaacgcggacaaggcgattgaattcttcaccaaaattgcgaaagcgtacggctccaaccctcacttgctttacgaaacgtttaacgagccattggatgtgtcttggaacgatgtgcttgtcccttaccataaaaaggttatttctgcaattcgtgccatcgacaaaaagaatgtgatcattctcggcactcccaaatggtctcaagatgttgacgtggcggcccaaaatccgatcaaaggattcagtaatttgatgtacactctccacttctatgcgtccagtcactttgttgatggacttggcaataagcttaagaccgccgtaaataagggtcttccggtgttcgtcactgagtacggtacatgcgaagcgtctggcaacggtaatctgaactccggctcaatgtcaagctggtggagcctgttggaccaactgaaaatttcgtacgtcaattggtcaatcactgacaaaagcgaagcttgtgcagcgctcactggcggaacatcggctgccaatgttggcacttcctcccgctggacgcagtctggcaatatggtagcttcgcaacacaagaaaaaatccaccggtgtgaaatgctaaataaagtctgaagtccggatgatcaactgaaactgaagaaaatggaaaatgtgaagattgccaaaaataaatatatataaaatttgcatgcgaatgtttatcgaaattccgattaaattgttttttgagcgcagataaatcgcaaagcataaaaaaaaaaaaaaaaaa

SEQ ID NO: 85238 - DNA, 2995 bp, Heterodera glycines
  SCN-specific regions: Sequence locations=1-117,140-149,171-198,264 -582,604-932,954-1126,1154-1172,1195-1517,1545-2083,2148-2761,2783 -2879,2904-2907,2931-2995
gatcttttaggccaaaccaaaatttttgtttagtaatttattttgtttactttcatttttatttacaacagtgtccaattttctggtgtccatttttccattggtgtccaattttctggtgtctttctggtgtccaatttaccgggagccttttcatattccaatgcagaaaattgttagaatttagctactttttgctatttatttttaaaagaaagaaaataatttattaatttaaattaaaaaaaaattattattatatacaaacaaaaattttcaatcatcatttcaaatttaatgaagaatattcggaaatgaggtgatgaggtgttcgaaaatgaaatgctaattttataaggctgtgctaataaaaaaaatagaaaaacgaaatcaaaatgtttgaaaagtttatgtctcggagctgtcaaatccactaatagtaagctgaacaagcaaaaaattagccaaaagttgtgaaaagttaaaataataatcagaaaagcgcaccagttgtttgggtgaaatgaaaatgatcaaaggcatccgtaagctgaacaatcaaaatgtttggcgaattcatcaaaattttaaattgtcaaattttttgccatttcgtcgccctataaatacgctttccaaaatcagttttggcattccaactaattttctcccaatctaaaaaagtctctctaattaatactaattagtacaaactgctgttgatttgatcacagaatgttggttcaactcgtcctccttgccatcgttggcattacttttgtcgatgctgccgcgccgccgtacggccaattgtccgtcaaaggcaccaatttggtcggctcaaacggcaaaccggtgcagctgatcggcaattcgttgttctggcaccagtggtacccacaattttggaatgcccaaacagtgaaggttggaaaattaaaatttcattttgagcggtttggattgacacagattttggttaatctttgcaataatgacaaattgaaactaagttgaaattagacactcactgttcttggcaatcaatttttgcatattttgtgattctttttcgggtttgagttgctaaaaatgggctgatcactcacgccaggcactcaaatgcaattggaaaatttaaaaagtgaaaagactgagccgagatttggctaggcaaagcagctttttggatgaaattattaatcgagtccgatgcttaaattaaagactccgaataaaaaacaaacaaagtttttggctcaaaaagaaggcaatttttaaaccaattaagcctaattgcatttatgcttgtaggcactcaaatgcaattggaattccaatgtcgtgcgcaccgcaatgggcgtggaacagggcggctatctgagtgacgcgaacaccgcctaccgactgacggcagctgtgattgaggcggccattgcacagggcatttacgtgatcgtcgattggcacgcgcatgagccgaacgcggacaaggcggtaattacataatttgattttgcataatatattttaaaaaatcagagattataatttagcagtctgaaaaagatggtttagccaaaatatcaaacatttccccattattggcccacaattattcatttaatttttgaaatatttacctctgatttaatttttatgaaactttaatagtaggaatcttgggttctcgagtgttagaaatttcgattcttgagcacgattcattgttttgcttcttgagattgaattcttcaccaaaattgcgaaagcgtacggctccaaccctcacttgctttacgaaacgtttaacgagccattggatgtgtcttggaacgatgtgcttgtcccttaccataaaaaggtaattcgctgggaaatgaaaattgctaacattctcccccttaaggttatttctgcaattcgtgccatcgacaaaaagaatgtgatcattctcggcactcccaaatggtctcaagatgttgacgtggcggcccaaaatccgatcaaaggattcagtaatttgatgtaagtggactctccattaagtgtaattagtgcattccgtaatgctgcacaaaactaattaataattttttgcaaaataattaataataattaattaatcagaattatattaatatattcgcgctattaaggtacactctccacttctatgcgtccagtcactttgttgatggacttggcaataagcttaagaccgccgtaaataagggtaatcatatgatactgtatcgtccaaaaccattactgtttgcaaccgtacattaaggtcttccggtgttcgtcactgagtacggtacatgcgaagcgtctggcaacggtaatctgaactccggctcaatgtcaagctggtggagcctgttggaccaactgaaaatttcgtacgtcaattggtcaatcactgacaaaagcgaagcttgtgcagcgctcactggcggaacatcggctgccaatgtgagtgattttgggggccactgataggaagtgccgtccgagaatttcacgccacaaaaaagcgaatatttctcgagtcgaacactaaatctctcgaattcagccatttctcctacaaatttgctcatttcaggttggcacttcctcccgctggacgcagtctggcaatatggtagcttcgcaacacaagaaaaaatccaccggtttgtctgaccaattaaaccgtcaagggcaggacacaatcaagaaatatattgaggatctggatttacggattaagggatttatttaatcagaaccagtcactcataaaactgaaaagtgcaataatatggacaaataataattcacaggtgtgaaatgctaaataaagtctgaagtccggatgatcaactgaaactgaagaaaatggaaaatgtgaagattgccaaaaataaatatatataaaatttgcatgcgaatgtttatcgaaattccgattaaattgttttttgagcgcagataaatcgcaaagcat

SEQ ID NO: 85239 - DNA, 1455 bp, Heterodera glycines
  SCN-specific regions: Sequence locations=1-95,124-515,537-754,777 -1119,1156-1232,1261-1420
caagcatctacagccttcgactgaccatgaagatcgccgctttcgccacgctccttgtcgccgccatcgcccttgttgaggctggcaaccctgctcagcagcagcaacagcagcagcagaagcctaccccggctccttcggccaatgtgaccaaggtgccagccaccacggtccctgccaccactgtgccagccaccaaggtgccagtgccatcgaacgccaccaaggtgccaggcaccaaggtgccagcgaccactgccccaggcaccaaggtgccagccaccacggccccagcgccaacccctgctggcagcaagccaaccccagccggcaacaccaccactgccccaaagccaaccccagctgcttcggtcccaaccaagcagggcaactgcattgaagtgtccgttgaacgtgatgccacctactgcattgctggcccaatctgctcgggctcgggcgacaagccagccggcgacaactgcccaaagaagggcgatgttgccgtcaaggactgcttgaagaccttgaagagctacactgaatcgggcaagtgcgttttgccagaggatgccaagtgccagaagatccacaccggtgcttggggctgtgtgattggcggcggtaacgccaccccagctccatcgaagccagtgacccctccatcgaacaactcgaccactgctccaccaaagccaaccccagcggcctcgaccccatgcccatcgctcccaatcaagaccccagcgccaagcaacaccacggccgccccaaagccaaccccagcggcttcgaccccatgcccatcgctcccagtgaagactgagacgccatgcccttcgctcccaatcaagaccccagctccttcgaccaccaccccatgcccatcgctcccaatcaagaccccagcgccaacccctgcggccaccaccccatgcccttcgctcccagtgaagacgcctgctccttcgaccaccaccccatgcccttcgctcccagtgaagacgcctgctccttcgaccaccaccccatgcccttcgctcccagtgaagaccaagaccccagctcctaccgccactaagacccctgccccatccaacaacggcaccaaggtgccatccaagaccaccccagccccaaccaccaacaccaccaaggtgccagcgaccactgctcctgccaccaagacccctgccccaaccaacgccactgccgtgccaaccaagaagccacagcagcagcaacagcagcagcagaagctctaaatggctttgagtgatgtgtgctgaccgtgtgcagtggtgcgatattcacgatggaagtgcatttagacgctactacggcgacactattcggaagcctttgagagtttctatttgacgacgaatagttgagtcatggtaaaaattttggctatcggaaaaaaaaaaaaaaaaaaaaaaaaaaaaaaaaaaa

SEQ ID NO: 85240 - DNA, 2066 bp, Heterodera glycines
  SCN-specific regions: Sequence locations=260-260,368-368,420-555,577 -675,705-724,746-809,835-1613,1637-2034
cccacccgaaaatgttccatttggccgccatcgttgcgctagcggcgctcgcactgcccctggcatcttcagacaagttcagaccatgcctcgagggctacgcacaatacggcaaatactgctacaaggcagacaagttcagaccatgcctcgagggctacgcacaatacggcaaatactgctacaaggcaggtgccgaactcgcgtcagtgcacagcgaaacggagcgcgaatttgtgaacatgctcgtccttagggaagcgaacaaaatggaattcaactgcaaacagccgggccgcgccttcttttggtttggcctgaagctgaaatggagcgaaaagaagctggaggatgcaagttggacggatggaaagccggtggactacttgagcccgaccgagtggggcgcgtacaaacggccgttgacgatggacaacgcaggcggggccggctacaacaaagagaacgaaaactgcgttttccttggccaatggccgcgcaaagtgaaggaatatctgtcgctggagacggcgctggacaaaagcggcgtggatgtgctgtggatggacgtggtgtgcgagaagccggaggagtactgggcaccgcacggcgccgtgtgcaaaatgcgcgccaaggaggaggagaagggatacggtaaagacaagtacggtgcaaaggaggaagaggaggaggaggacgaagagcttcgcaagatcaacaagtacgtcaccatcggctcgggcaacttcatctacgccaacaagaacacgtacatgattctcctcctgaaagacttgtacggcaagcagttgaaggaggagagcaggaagaaggtgtgcgaattgtacaatggcgaatatgtgaaggtcaaggacgagccgaaggaggcacaagaatacctggacaaagtgctggccaaggaaaaggagctgtactctgacgccagcgaccacatgttctgccgcttcaccggcatcatcggcgcgtgcggcgagtcgtgctacaaagtgccgttgccaatctgtgccgagggatacgcgtacttcagcgggtactgctacaaggcgttcaccaacgcggacaaagaagtcaaatattcggaagcgcagaagatttgcaagtcggacggggccgaactcgtgtcgatgcactcggagttggagcgcgagtttgtgaatgttgtggcactgactgcggcgaagaaatacgaatacaacgccaaagtgccgggattggccttctactggaccagcatgcagttggagtgggacgagaagaagctaaagaacgccagctgggccgacatgacgccgatggactacttgagcccgatggagtggggcacgaagaagcgtccggtgtacgtggacaactcgaacggcggcgagtacaacaaagaaaacgaaaactgcgtgttcattggccaatggccacgcgagggcaagcagtacctgaagttggactcggcagtagacaagtacggtctggacgtgctgtggagagacgaggtgtgcgagaagccgggcgaggactgtccgcgcggcgccgtgtgtaagaagagggctacggtgggcgaatgctacggcacaggggcgtatctcctggacgcggccgaggaggaggagatgaagaagctgctcaaattcatcactgtcggatccggcacttttgtctatgctgaaaagaacacatacatggtcctcctgctgaaggacttgtacggcaaacagatgaaggaggaggacaggaagaaggtgtgcgcttactacaaggcggagtacgtcactgtaaaggccgagccgaacaaagtgcaagaatatgtggacaaagtgttgtccaagcagaagcagatgtacgcggatgcgagcgaccacatgctgtgtaagttcagcgggacactcggcggatgcggcgactattgcaaaacgggatattgagaagggacggacggaagggaaggaacactttctcattagcatttagtcgtcctttgttttagttaaaatggtgcgctttttctctctgatttattgcataaataaaaaattttaaaaaaaaaaaaaaaa

SEQ ID NO: 85241 - DNA, 622 bp, Heterodera glycines
  SCN-specific regions: Sequence locations=1-209,288-622
atgaattggatgcattattgtttaatcgcttgctttgctttttattatttcaatactgttgagtcatccactattaattcggtaaccgtacaagtgaacaagattgaaaacaatgaaaatggaagacaattcaatttggaatttacaaaccaagtttatgagcgagtgtgccacgttgactttcgaattgatctgccagacacagtaagtttttttttttttttggtttttttgaaaataaaaaataagtaaatttaatttttaaaattattaaattgaatttattagtctaaagaacgagttaaatttaggaatgaaaatttatgtaaatgctcttcatgaaactctaggattttctggaagaagcctaaaatggacgaaacgaatttaaattaagaattcgatgaattaaattatctatttaataatgtaattgaacaaatattcaaaaatggtgccaattcctgacacctgcggccagtacgcattgcccaagagtttggacttgcttcccggcgagtcatttgatgcacaattaacactgcttggccatgatgggaagccgaatgtgactgtgctgaacacgaacaatattccaaccagcaaacaatgcaaaaaatga

SEQ ID NO: 85242 - DNA, 2941 bp, Heterodera glycines
  SCN-specific regions: Sequence locations=1-20,42-251,274-534,560 -705,745-821,843-929,951-1009,1031-1307,1329-1329,1351-1717,1746 -2744,2767-2941
atgaactcctcatttgtcatctgctgctgcttccacaactttgtgttgttccttcttttgagttgtgttgtgccacatgcttttgcttgttgtcctcatggaaatctcagagtgaaaggtaagaaatgacaagtcaataattttttaaaatatttcccgggcagatcccaattagctctttggagattcattgtttaacttttcacaattctcgaaattaaaaagccaatcgaatttgtcaaataaaactcaataattaccaaaattatgtttttcgctttttgagctgttatttcatatataatttgtttaattacctcaaaaggtgcatagtttttgaatgatttcaatatgaaattagattgaaaattttgagaatgaattgcctttcccgcgctatttaaatccggatttctcgaattaatctgacattccttaaaatttttgccttaaaattcgccccataatctcatttgacggcttttaattctgtgctcataaaaccgaagaaatgcgcacataaattttaccaaattgaggttaatttctcaaaatttcttcaagtcctttaaatttaagctacaactctcgaaaatagctaagatatgcctatctaaagggaaaacgctaaaaatttataaattctaagaaaacaactaaaaaatagaaaatttctttttgatcttatattttgtcgtaatttccaatttttataaagatttatgattatattattattaaaatgccaaatatttttctaattgatttatgaaaatttctgtccttatgagtcaaaaggtccaatataattaaggtgctagttttaatggtattttttaaaaagagctccaatatcataaaaataatcacaaaaggacgtgaatatatacagatatacaaaatatgcatatcgaaatgggtcatagaagtttcaaaccaaggcacaaaattgttttatgtgcattttaacaagctgtttccagcccaagaaaaatgcttttgcacttaattaattacaaagccctattcatttgtaaggtacgcatttggccgatgaaaagggcgaaactgtgcagctgcgagggatgtctttgtactggagccaatgggagtacggctcaaagttcttcaacgagaagacggtcaactgcctgaagtgcagttggcatgccgacattgtgggacaaagcggggggcgggagacatttcaagaaattcaaaattatttactctttcacagtgttttatggcagggatttattcagattaagtgaggccaaaaagttggggtcaatttagcagtgaaattacaattatttatttttaaattcattgttgtttaatactcaccagaagacgccacgaggggtgttcagccaatgaggaaaattataattcatccgcctcattttaatccaatcttatgaaaagttaccaaatcggtccctagcattttctggcactccccacggcgaatataaaaaaaagtgttaaatctctgtccccaaaaggtccgtgctccgttagctgtggaccagggcggctatttgtcaaatccagaacaggttttgtccactgatcacgttgacagaaaataaagagccaattcaaggagtatgcgaaggtgaagagcgtagtccaagcagcaatcgacaaatgcatgtgagaattaaggggggcgagaaatccatttaacgagaaacgagaccgagaaatggagagagagagcaagagagagagagagaccgagaaatgaccctgaaaagtgccaaaaatcacaataacaaaaatataagcgagaccacgaaaatcccgagaaactctcggagaattaattctctcccccatccacctgtgttatgctgaagagcaatctctttaaacgaatttttacaattttgaattgggacaaacactcaagatatgtgctgattgattggcattacacgagcagtgagaaatatacggacaaagcgaaggagttcttcggcagaattagcactctgtgcgctggcaaatgcaactgtttgtacgaaacatggaacgaacccatacaaaacgattggtcctcgcagttgaagccgtaccacgaggagctggttaaagtgagattttaaatagccatttaatgggtgttggcggaaaagtgattgatcaggaccatgttttggaggttctcattcttaggtagcaccgtaataattagatctaagccattgagacagtatattttttatcattggaaatcaacttttttcccctcaggtgattcggcagaatgacgagaacggagtgataatcgctggaacgccaaattatgaccaggatgtgaaggcggtagtcaatgacccaatcaaagagcacaatataatgtaataaataccgaataaatgatagtgggggatttggggtgggggggggggaatggtgggccaatgcttatccgaatacgaggatttgatatcctacgcctcttccccgccgcacaaaaggtacacattgcatttgtacgcggcatcgcataagcaagaactgcgcaacacggcacaacaggcaatcggcgcgggagtgccgttgtttgtcacggagtatggcacaagttcgtacacaggcgatggcgggccagaccttgtcgaaacacagaattggtaattttccagggaccctatttcgaaaaggataaatgtttacaaattagagagggctttcaacgaattggaatatcgaccttttgtttcgaaggtacgactttttcaacaaaaactccctctcgtacatcaactgggccatcgacgacaagcaggaagcgtcggtagcgctgcagaacacacagcccccagtcgggccggccgacgtgtgcagcaccgatcggctgaccaaatcgggcaaatttgtgcacgaccacctcatcggtgtaaaccagaagccggatggctgttaa

SEQ ID NO: 85243 - DNA, 1366 bp, Heterodera glycines
  SCN-specific regions: Sequence locations=1-21,43-830,857-863,887 -985,1007-1366
gtttgagagtaaataagcaaaaatgtcttctgtgagcaaatttatcaccaacaaagggccctttattgctgttggaatgggtgtggttggaatgggctattttggctactacaaattttggcgttcgtcgcgtgagattgctatgtcttacaaacaagaagacgaatcggatggatacacagtgaaacgcattgaggaggcatacaaaactcttcaggaggcaaaggattgtaaatccctgttgaaaaagcactttactgctgatgtgaaagacaaattgaagtacaagaagacgaaattgggtgcctctctcttcgacgtcatcagatcgggtgtcaagaatcttgactctggagttggtgtgtatgcagctgattccgagtcatacaaagtgttctcgcctctttttgaccctgtcatcgacgaatatcacggcgggtttggacccaaacaaaagcatccgccttcaaactttggcgaggaccgattgggcgaattgaaggacttggacccagatgggaaatacattctttctaccaggattcgctgcggtcgttctttgcttggctatcctttcaatccgttgttaatgcgtgacgattatttggtcatgcaacaaaaggttcgaatggctctcgagaatttggaagatgaccctgaaatcggtggaacttattatccactcgaaggaatgacgaaagaaacccagaaacaactcatcgccgatcatttccttttcaaggaaggcgaccgttttttggaggccgcaaattcaaaccacttttggcctgcaggacgtggcattttccacaatgctaaaaagacctttttggtgtgggttaatgaagaggaccatttgcgcattatctccatgcagaaagggggcgatgttggcaacgttttgaaacgattgatccgcggtgtgaaaggtatcgagaagcaagttccatttgcgcgtgatgatcgactcggctatctgacgttttgcccctccaatctgggcacgaccatccgtgctagtgtgcacatccgtttgcctaaaataagcgcaaagcctgaattcaaaaagatctgcgaggacctcaagttgcaagttcgcggcattcacggagaacactcggaaagtgaaggcggggtttacgacgtgtcgaacaaggctcggcttggacttaccgaatttgaggcggtcaagcaaatgtatgacggtgttaagaaactcattgaacttgagaaggcgtcgaagtgaatgaattaaatatctatatccatttgacgcctcgtaattgcattgctttaatcacaatattgtatttttgtataggtctatagggtcagaaaatgtattgcaaaaaaaaaaaaaaaaaaa

SEQ ID NO: 85244 - DNA, 1890 bp, Heterodera glycines
  SCN-specific regions: Sequence locations=1-17,39-628,689-777,799 -1104,1126-1890
gttgagttcgatgcattttcacaaattgtttttgcttttgcctattttgcttctccatctccaacaatcccaagcttgcttttcacgtggcaacagtggcgaaccgtcggatggcaatcccgaggcccaggggctaaaatcggaaaacgatgttcggactgttcagttgaagaaggaaaaacaaacggatgaaacggaagaggagaaagacgaggaaagttcggcagaacaaaaattgccatctgaattggacccggaatttgtgaaaacttatctgcgagaatttggtcatctgaagcacaatgagaatggcctttcccatggcgttaagcatttccaacgctttttgggctaccggcagacgggcaatgtcgacttggcaacccttcaaaaaatgtcgtggaaacgctgtgccaactctgacgagggctacacagcacaagacccatcgcaactttgggaacgttcgacattgttctggaacctgaacgcgtcgcaccccaagcagttcactcatggcgaaacgaaggaattaattgcgcaagcattccgcgcatgggaaattgtgatcaaaatcgactttctggagacgaacaatgcggacaatgcgcagatcattttcacatttgaaagcgacggagcaaaaaaggagaaaagcaaaaatggggaggaggagaaggaaaaggagggcaaaacaggcctcgccattgccaaggcgtcgtcgccgcccgttgcgcgaattgttttgaatgccgacgagaattggtccacttttcaaacacaagaagagggaaaaatcgacatttttgtggttttactccacgaaattggccatgcgcttggccttcgccattcgggagacgaacattcagtgatgttcccaatgtttgagcgttctgttggcgaacatttgccagtcatttcaaatgatgatgtcgagcatttgagagcactttacgagggcgacctcaccgatcgaccaacacttgcggccgatctgcgcccaacgaggcccgtgcccgtccagggcggtacgcacagcacagactcatacggcggcgaaggagctacgacagcagcaggaaaagaagctgaaaaatgccctcactccatcacaacggcagcgaatgttaattccgagactttgttcctcttcaaggacggttacgcatggcatttgagcagaggaaaattggtcggaggcccctacaaaatcagcgagtttttcccggacggtcctgaaaaggtcgacgtcgcattttcatccggtcgactgacagtgctggtcaaatcgcgcatgctgttcggctatgagtttgatcagaaaacggcccaattcacgcgtgaccaccgttacccccgcgaattgcacagccgaattcttttctaccccgagggcgcttttccgattgtcaatggaagcgtaattttgttcaaagacgatgtgttcgccacttacaacgtggagagcaacacgccgcatttgttcggaagcatgtccgaatttttccccggactgccccaaaatttgcgcgccggttttgccgccacgcccgattttaccacctaccatatgctgaccaatgattacgcatttttgtacgatgttcgcgtggcacgaacagtcagctcacaaagcattggccagtttgttggctgtgaggggaacaaattaatgcctcctggtccaccgatgcctcatcttttcttcccataccagccgtctccacctcaaaatccgcgattcccacaacaaaattatggaaaataaataaactggtttttggcaattttatgccaattttattcactcgtacaattttatttgtgaccatttcaagcattttttcaaattaaattaacaaattgtccaaaaaaaaaaaaaaaaaa

SEQ ID NO: 85245 - DNA, 1268 bp, Heterodera glycines
  SCN-specific regions: Sequence locations=1-44,81-164,186-292,339 -731,753-1055,1077-1268
gaacaatttttgcaagacgagaggcaaagagtggacaaactgttcaacaacaataacaacaacagcaaaagcaataataagccattagaaaaagcatatggaggagcatttgcaacctcgagttcacatgacatgcaaatggcagcctcaacatcaacagttggggaagaagcagcagcagagaatgtgcaccacaccaatcagaaattgcagcaatcggcaacctcagcggcggaaggtggtggcaaattttccgattttgaggatggaagtgacaatgaattgttcatttccaccaccaccatcaacaacaatgatggtgatgatgatgatgatgaggaggaagaggagggaaaggaagcgattccatggcacgggggcggcaaatatgccaaatgttttgagcaaattgtcagagatggcacattggtggccaaagtccggtgcctcatctgtgccaaagaattgagcaccaaaagccgaacaagcataagagagcacagcaaattgcaccagttggttgccgaatcaggcatttttgaccattcgcaagagggcatttttgacggaatgatgccggaggcggttggcactgcgttagtggaagaacggacgccaattgttatcccatttcgacgccgggttacgaccacggaaatgatgccatcaacatcagcacaacagaaaatgcgtagtcaatcggtggaggacgacattttgaatgatgaagagctgcagcagcagcaaaacttggcacattttgattggaacaaacagaaaattgaactgcaaattttggaggccgaactcattcagaaacagttgtccaatttccagcggtgcactgagcttggcataccagctcgtgtccatcttccggttggcattgtgccaagtggctcacaatcagcgaccggatggaaccgccgctttgccaccttttcaaatgcgcacgcgcttcagcaacattcccccgcaggaaggcaacaacgacaaatgccgcatgggcacgcggacaacggctcgcgcgacaacggcggcattgccggaatgtttgctgctgctggcgatgacgacgacggcacgccttgcgatttcgtggcatttgccgacatttaattaaaaagagccccgagcttttcttaatttgtcattttgtttatagataataagtattattatgcgttcctctttttttatatacacaaattgtgcgttccttttcaatgtaaaaaaaactaatttttccaaaaaaaaaaaaaaaaaaa

SEQ ID NO: 85246 - DNA, 222 bp, Heterodera glycines
  SCN-specific regions: Sequence locations=1-222
cctgaacgtgttcggcctccgctcggtgtacgcgctggtgttgggcggcgagaatgcggccgagatgatggacgagcaggcaatgctcggcatggcacagccacagatggtcgcgccgggccaagacccgattggggcgttcaaatccgaatgggaggcgctgcagctgtacacgcacacgttcaacccgagatagaaaaacggaaagaaaaccgtcgataa

SEQ ID NO: 85247 - DNA, 471 bp, Heterodera glycines
  misc_feature (470)..(470): n is a, c, g, or t
  SCN-specific regions: Sequence locations=1-471
tgttgaaggcttgtgacaaaaatatcaacaccaaacagcagcggagtaaggattcgacgtttcagaaatggaccaaacacccgttgaagatcggtctgttgagctatgttccgatgacgacgaaacaaatttaactggctaaaccgattctgaggattactttatggtggaaaaacaattgagagaacgtcgtgttggaatacaaaatttctcttcgatggttttgtttgaccggaaagcgaagcagcgacaaaaaatggcagaaaagcggaggaaagagcgaaacaatgcgaaattgatactctatggtcgtccccgcaaaacgaaacaatgctcttcagttttttcaaaggaagactttgcgcaaattggaaagaaagatggcagttcagcatacgaacgcattaaacgaattcgataaaatacttctttttgttcgtgtttattttaataaattacttttccatgana

SEQ ID NO: 85248 - DNA, 409 bp, Heterodera glycines
  SCN-specific regions: Sequence locations=1-1,24-37,83-182,207-409
gttttttttttttttttttttttcgaattcaaaatgtttatgccaataaaattcattaaataaaacacaaatgaacaaacaaatcaattttaaatggtcggttattttgtttttggccttggaatgatcttctgggattatgtacaattgcgtatcattttttttgggacacctaatttatcattttcaatattttatttgtatctgatagcaacattcctcaattgggtattgagcttccaatttcatggcaagcaacaaatccattcgaatttttcgaaacaattcgatgatgtgaaaaaatccaaacatgtaatttgcatccatttttgaatccggcttttgaaggaaaaattcatgtgaaaagctaatcctaaacaaactgacggatggcattaaattggaatgg

SEQ ID NO: 85249 - DNA, 352 bp, Heterodera glycines
  misc_feature (8)..(9): n is a, c, g, or t
  misc_feature (17)..(18): n is a, c, g, or t
  misc_feature (26)..(27): n is a, c, g, or t
  misc_feature (45)..(46): n is a, c, g, or t
  misc_feature (55)..(57): n is a, c, g, or t
  misc_feature (66)..(67): n is a, c, g, or t
  misc_feature (83)..(83): n is a, c, g, or t
  SCN-specific regions: Sequence locations=88-163,185-352
tttttttnntttttttnntttttttnnttttttctcttttttttnnttttttttnnnttttttttnntttttttttttttttnttttcccccaaaaaattttttttggtttcaattaattaaataattccctcccgggggacaataaatacccaaaaacaaagtttaaaaaggcctttttcccctgggaaaaaaaaaaggggaaaagggaataatattttgtttgaaaaaaccaaaaaaggggggaaaatgccaaagggaaaacaaaaagtttttttttttttcgggccccctccccggggggggtttttttttccttttttccccctttcccccccctttgcctttcgctt

SEQ ID NO: 85250 - DNA, 627 bp, Heterodera glycines
  SCN-specific regions: Sequence locations=1-53,77-346,368-627
ggagcaggacgaattgggcaacagcattggcgttggcactcgcattgtttcaattgcagagcaacaacatctccaacagcttttgcccatgtctgtggtggagagcagtagtagcagcatccatggacgaagacatcaacagcaacaggacatcactgcagcacaaccggaacaccatcattatccaattccgattggtcagcgccgatcggcttcatcttcggcatcggactttgttgcgcaacattcaccgtttgacagcggcaataaatggttccatgtggtcgatcttccatcgtctgaacaacgctttgtcatcacggaatacagcgtaccatgctacgacagaggaggcggcggcagcggattagcaacaacaacggaaagtgtacgccggaaaagacgcgcaatcgaatatgcttcacaattgcctgacgaacaacaacaggaacagcaacaaaagactgctgcaaccgaacaaattgcgcttgagcctggcacgttgtacagaattcgtgttcgggcaatcaattcggtgggctgcagtgcatggtcacagccggtcagcttcaagacttgtgttcccggattcccaggctcgccgacaagcatcaaaatcacaaaatg

SEQ ID NO: 85251 - DNA, 332 bp, Heterodera glycines
  SCN-specific regions: Sequence locations=23-23,47-332
ttttttttttttttttttttttgcattttattagtaaattatcaaagacataaatagtattaagagcaatcaatcattttgtcaaagtgaatgtgaaaaatcacaaaaaaacaacctaagaaaataatttatttcaaattcttattttttgggccgcctattcgttcgtccgacagccaattcaattggcagtcagtcgagggaattcagtttgttcacggagcatcgctcaaagcggggacgccgggcagaaccttgccttcgagcagttcaagactgggaccaccaccggggctcacgtgggtgactttgtcctctgctccccatttctc

SEQ ID NO: 85252 - DNA, 561 bp, Heterodera glycines
  SCN-specific regions: Sequence locations=1-561
tgggagggagccgagcgcaggaggggacaaagggcgaatgtgtgccggatcagggagttcggatcgacggccgaggccaatggcagggctatcacgcgctgatcagttccgtccagctgtttcgttttggtggcgaagtgaatgcgggccaaagaattggcgtggcacgagatttggaatgtgccgggacgcggcccaagccgaggggcgacgaaaatttcgtgcgcatggaactcttccgagaggacaaacccatcgacccaacccatcatctgatcgactgcatgtgcaccggccaaatttgcgagacaaatcgcgcaaatgccctcgagggactcccatttaaatttgacagccgtttcaacggagtgcgcgggtgggaaatcgtttgtccgaatgttcggcccgaagagccgaattcgtcgggcgaatcgcctgaacaaagtgacaacagacaaacaatgagtcccaaaatttacagtcccatcgaaggcgaagtgatcggtcgcgtgcggctgagtgcgtcgagcaactcgcaaagctattcgggctgtgccaacg

SEQ ID NO: 85253 - DNA, 154 bp, Heterodera glycines
  SCN-specific regions: Sequence locations=1-154
agcgcggagacggcgatgtccgcccagaagcctagaagcgggcgcagggtcgcgatgtgggattcgggagcagacaggaagaggaagccggggcgtcgttctttgtggttgatccactgccggatcgagaacggctccttgttggtcatcaccc

SEQ ID NO: 85254 - DNA, 534 bp, Heterodera glycines
  SCN-specific regions: Sequence locations=224-232,257-316,533-534
caaagaagcagagaaaaaagagaatgaggagcaaaagcctgctggcaagaaggagaagcgcgccgcagagaaggaggaaaagaagtcagaaagcaaggaagcagagaaaaaggagaatgaggagcaaaagcctgctggtaagaaggagaagcgcgccgcagagaaagaggaaaagaagtcagaaagcaatgaagcagagaaaaaggagaatgaggagcaaaagcctgctggcaagaaggagaagcgcgccgcagagaaagaggaaaagaagtcagaaagcaaggaaacagagaaaaaggagaatgaggagcaaaagcctgctggtaagaaggagaagcgcgccgcagagaaggaggaaaagaagtcagaaagcaaggaagcagagaaaaaggagaatgaggagcaaaagcctgctggtaagaaggagaagcgcgccgcagagaaggaggaaaagaagtcagaaagcaaggaaacagagaaaaaggagaatgaggagcaaaagcctgctggtaagaaggagaagcgcgccgcata

SEQ ID NO: 85255 - DNA, 548 bp, Heterodera glycines
  SCN-specific regions: Sequence locations=1-32,62-93,115-150,172-548
gaaattttcaaatcgtaaaatgaatttgcggcatttattgtttattatattttttaatattgttgtaattgactccggcaaaatccaaccaaattttgatgaaatattttgcaacggatgggacaaaattgaaagtgaagaaattgtgataaaaattgaacaaaatgaaaacagtgaagttgatcaattaggtgaagaaatggcaaatggtccaattgatcaaatgagaaattataccgatcagaaccattcgaaaagtgatcagaatattatagaagaaccaaatgatcagcaaaagagagaaattgttcaaaaatttgatgcaattaaagaaaaattacgtgaaaaaataaaatacaaaaggaaagattatgacaaaattgaaagaaaaattgcaaaattattaggcgcaaatcggcaattaatacacaaatggaaaaatgaattaaaattaaataaaaagaaaatgaaaaaacaattatatgatgagaaaaagcgcaaattcattgaacgatttgatgaatttaaagaattatatggtcaacgaa

SEQ ID NO: 85256 - DNA, 566 bp, Heterodera glycines
  SCN-specific regions: Sequence locations=1-566
accaaattcactcaacatcatcaccaaccatgaacattctgctgaagtctgttctattcatctctcttctgtcactgtttggtgattgcatgaaaaactcagatcaaattggagtcaaaagaaaatcagcaggaataagaattgaggaaccaaatgatgtaaaaggcaaaggaaaagtcgtcgaaacaagcagaaaaggcaaagaaaaagtcggcgaaaaaataagcgttatgaacacagctgaacgcattgaaaaaatggaccttgcccaagacaaagctaaaatggaaatagacaatatagacaccaatgccaaacccaaacaaaatgaggataaaggcgttatgaacacagctgaacgcattgaaaaaatggaccttgcccaagacaaagctaaaatggatatagacaccaatggcaaacccaaacaaaatgaggaaaatgctcctccaaaatatgttttcatttggagcggtaacaatgagaagaagaaccttgaggttgacctcagagtgatccgtcactccaaaaaactcagcgaattattccatgccaaaagtgatcaa

SEQ ID NO: 85257 - DNA, 617 bp, Heterodera glycines
  SCN-specific regions: Sequence locations=1-617
attgattgacgtccctcttccggattcagagttccagttcgcaccatttggcaacttcgaccagttccggcagttgttcatccggcatcggttcgtctaccgctacagctgtcctcccccattgttccgtctttccccccaacgcttcgcccgaagctcccgccagcgcttcctcccgcctctcttccgctggctcttcaactcattgtcgttcttccgcttacttttccatctccgatgggttggattcgtcaattggccctggcgggactttgacagtccaaaaaaggacaaaagaaaaatgcccccgagtaaatatcaccgaaatgatggccaagggcataccggtaatatccaaccgaaggctgttaaatttataatgggattaaaaaaggaggcagagatttatgctgagtggcttcaaaggctgtgcctttccgagtatttggccctgtttcttggccagggctatgatttgccgacattggcacggtcatcgccggaggatttgacaactttgggcattacgcggcccgaggaccggaaaaggcttttccaagacatccagacttggcgaaatgtaacagcgaattgcaaaaaaatcaattgagtcgaat

SEQ ID NO: 85258 - DNA, 596 bp, Heterodera glycines
  SCN-specific regions: Sequence locations=1-347,380-596
accaaatcgccggccaaccccaaactgtacgccaaactgaacgcatgtttgaacacactgctcgactacaagacgagcaatggcaaaaagttggccggcccattcgtgcagttgccttcccggcgtgaatatcccgactattatgaccaaattgaacgcccaatggacccgcaacggattcggaagaaaattgaggaggacaaatacacaatgttggcccaaatgagcgcagacgtggatttgctgtgcgaaaatgcacagcgtttcaacatggacgggtcggaaatccacgagggctccaagctgttgaacatggtgtggcgtcgcatcgcggaggcaatcggtggccagggcggcaaggaggaggaggatgagaccactggacggggtggtggagcggcacggcacacgccgcaacaggaagaagcggctgctgcaccgtcgacatccggccacgcaaaggcaccagccgaagacgatgatgtgccagtgtctgctgctgctggtccttccacttcatcgatgatgaactcggaaaaggacaccaattgaacgacgctgtgactgaacaaattcgtcggaagggatcgatgcaa

SEQ ID NO: 85259 - DNA, 626 bp, Heterodera glycines
  SCN-specific regions: Sequence locations=1-626
tatgcgaaggcttacgggagaatgggcgttgcactttcatgtcagaatcgttacgatcacgcggttgaagcgtacaaaaaggcattggaattggatcctggaaacgaaagctacaaaaacaatttgtccatcgccgaagataagttgctcaagactcgcgaaacacttcgaaacaatccgcagccgaaccctttcgccaatatgttcggtggtccgggtggaatgggcggacttatgaacaacccagaaatgatgagcacaatcaccaatattatgcaggaccctagtatgcgaaatatgatgacgcaaatggttcagtctatggggcagccgggtcaacaaaatcaggaccaaggccaagctgggaacccttctgcaaatgctttctctgagatgcttcgtgttggagaggctcttgctagatcgatgcaagagagtaacccggatttggttgagcagctccgtcgtcagttcggtggagaggacggaaacgatggtggcgccggagctggaggcaatcagaacaacaacaaccagcagcctccgcccggcagtgtttgagaagtaaaaatatcagtgaaaaggagggaacggacagaaatttatgtgatggtccgattaattgt

SEQ ID NO: 85260 - DNA, 571 bp, Heterodera glycines
  SCN-specific regions: Sequence locations=1-571
gacactgtaattttggccgtcgaagtgacagcggacgcgcctcatggagtcaattgggacagcaaaaaggacactggatacattggattgaagaaccagggtgcgacatgctacatgaattccattctgcaaactcttttctttacgaacaaactcagaaaggctgtttatcaaatgccaacagaagaagacaatccggagagttctgttgctttggccatgcagcgcgttttttttcgagcttcaattttccgattcaccagtggggaccaaaaagctgacaaaatcatttggatgggattcgatcgactcatttctccagcatgacgtgcaggagttctgcagggtattgttggacaatttagactctaaaatgcgcaatactaaggtcaacgacacaatcccctcactcttcaaaggtcgcatgaagtcctatatcaaatgcaaaaatgtcgacttcggatcatctcgagaggaatgtttttatgatctccagttaaatgtcaagggaaagtcaaatgtccttgaatcgttccgggattacattcaacttgaaattctcgatggagag

SEQ ID NO: 85261 - DNA, 571 bp, Heterodera glycines
  SCN-specific regions: Sequence locations=1-249,274-373,411-476,498-571
gtggcgtctccggtgaaagccggaaaagctactacgaagacgacggctagcggaaagggcggcaaagcgaaggcggacggaaaagtgaagacgggcggaaaaggggcgaagaaggcgggcggaaagggtggaaaagtgaagattgctgcgagcggatcgaagaacacgcgctctgctcgtgctggcgttgcatttcccgtcggacgtatccatcgtttgctgcgcaacggtcgccatgctcagcgcattggggccggagcgcctgtctatatggcatcggtgttggaatacctggcggccgaagtgctcgagctagccggcaacgcggcgagggagaacaaaaagttgcgaatcactccgcgccatttgcaattggctgtgcgcaacgacgaggagttgaacaagcttctcgcggaggtcaccatttctcgtggcggtgtgttgcccaacattcacacggaacttttgtcgaagatgcagcagaagaagcagcagaacgacgacagtcagtgaacggtggaagaagaaacggacggatagaaaatgaatgatcccaaatatctctcctctc

SEQ ID NO: 85262 - DNA, 482 bp, Heterodera glycines
  SCN-specific regions: Sequence locations=1-482
tgggagggagccgagcgcaggaggggacaaagggcgaatgtgtgccggatcagggagttcggatcgacggccgaggccaatggcagggctatcacgcgctgatcagttccgtccagctgtttcgttttggtggcgaagtgaatgcgggccaaagaattggcgtggcacgagatttggaatgtgccgggacgcggcccaagccgaggggcgacgaaaatttcgtgcgcatggaactcttccgagaggacaaacccatcgacccaacccatcatctgatcgactgcatgtgcaccggccaaatttgcgagacaaatcgcgcaaatgccctcgagggactcccatttaaatttgacagccgtttcaacggagtgcgcgggtgggaaatcgtttgtccgaatgttcggcccgaagagccgaattcgtcgggcgaatcgcctgaacaaagtgacaacagacaaacaatgagtcccaaaatttacagt

SEQ ID NO: 85263 - DNA, 584 bp, Heterodera glycines
  SCN-specific regions: Sequence locations=1-48,70-203,225-501,524-584
gatccaaatcaacgcggcacagtaataaaatattaaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtacaatttgaaatgggggcaaatcgattagaaaaaatgagggcacacctacgcgaacttgctgagaaaatgccggtcaatgaatcgaagcgtctgtcaccgagtggacccgaccctcatcatcattagggccatggatggatctaacggaggaagaaagaatggatgcttagttttcagattttattctatcctcttttatttattagttgttcaaaacaaatttcttccacaactttttaaacta

SEQ ID NO: 85264 - DNA, 665 bp, Heterodera glycines
  SCN-specific regions: Sequence locations=1-219,241-533,555-665
gctcactatcgcaatcggaaggcgttatgggctggtcggacccaatggaatgggcaagacgacgctgctcaaacacatcgctgcccgcaaattggcaattccgccaaacattgacattttatattgtgaacaggagatcgaagctgacaaaacatcggccattgagacggtccttcgctcggacaaagtgcggacggaacttttggagcgcgaaaaggcattgataattcaattggaagcgggagacatttccgcgggggagaaactgcaagaagtgaccagcgaactgaagaacatcggcgctgaggcggcggagccgagggcacggcgaattttggccggacttggctttaacaaacaaatgcaggaaaaggcggtggaagacttttccggggggtggcgaatgcgcgtctctttggccagggccctttttctcgagcccactcttttacttcttgacgagccgatcaatcacctcgatttgaatgccgttatttggttggacacgtaataattccattcgattatggcaaaacaaaaataaaacattctttcgtaggactttttcaattgttttttccttcgtcagataccttcagggatggaaaaagactcttctcgttgtttcgcacgaccaatcttttttggacaacatttgcactgat

SEQ ID NO: 85265 - DNA, 569 bp, Heterodera glycines
  SCN-specific regions: Sequence locations=1-73,127-151,175-231,286-569
gaacggccattgcttctgctgctattgcgacgaaacgggccaaaccaagttcaaagtgccggtgcgacggttccgttcaatgctaatcagctaattgctcactaattaccccaaataacaaaactgtgcctgcttctcccaacaatggcccccaaatgccttccgctcgaacttttgttcgaaattgtgcctttcatccctgccgaaaaagccgtcccgaatgcgctctcttcctgtcggctgctgcacaaacttttgctgccacgtgtcatcaaatggaaagagcaactgctaaccgatttgatgagtctctcggcgaaagtggacaatctctcggcgaaagtggacaatctatcgggcgtcgtcaacaatctctcggcgaaagtggacaatctggagaagaaagtggacaatcactcggtgaaactggacaatctggagaagaaagtggacaatcactcggtgaaactggacaatctggagaagaaagtggacaatcactcggtgaaactggacaatctggagaagaaagtggacaatcactcggtgaaactggacaatctggagaa

SEQ ID NO: 85266 - DNA, 589 bp, Heterodera glycines
  SCN-specific regions: Sequence locations=1-54,76-589
cagtgatatttattttttggtgtgatttaaaagtttatttgagtaaaaaaaaagtgaaaaataaatgaaaatggtggagaaagagaacgacatcgctgccgctgtgccaaacaacgctgcaaacaacggtcatgttgaagctgtcgacccatcggcatcgaagagcgctaaggaggtgccgaacaacaccgagaagcatagtgccgaagatctaatggggttggcccgtctcttcctgaaggaatattacaccaagcttagcgaccttcctagcgaagctgggattttctacggcgatgactcgcattttgtccatgctgatgtggaggagacgggccgcgagaacattcaacgcgctatcggcaacatgggcttcgaggattgtaaggctcgcttctactcgctgaaaacggtgtcgctgccgatgcaaggtgacaatgccaagctgatccaagtttgcggcgagctgacgctggtcaaggcggctgtgcaaaaacagcagcctgttcttccacgacgctttgtccaaaccatcattttggcccaccaaacgcccaccgttttgtacgtgaagagcgatgtgtttcag

SEQ ID NO: 85267 - DNA, 289 bp, Heterodera glycines
  SCN-specific regions: Sequence locations=1-32,58-123,153-289
tgaccggggcggtggtggtggcggataccgaagcggcggcggtggtggcggcggcggttaccgtggcggtggagggaaccgcgactattcaagatctcgttcgcgttctcgttcgccgtaccagcgtcgcggaggaggaggaggccgttctcgctcgcgttcccgttgaaaaatgggagggatctacaatttccgaagaagttgtgacgaactgatgcgatttcaaccattggcgattttaaatttgtttcacgtttttggtataatcttgggttaaataaatcgccta

SEQ ID NO: 85268 - DNA, 593 bp, Heterodera glycines
  SCN-specific regions: Sequence locations=1-12,34-106,139-139,175 -184,206-214,238-593
aatgctaggtgaatttgttgatgattatacggttaacgtgattgatgtctttgcaatgccgcagtctgggacgggagtttctgttgaggccgtcgatccagtctttcaggctaaaatgttggatatgcttaaacaaactggaaggcctgagatggttgttggttggtaccattctcacccgggatttggttgttggctttctggggtcgatataaacactcagcagagttttgaggcgttgtctgacagagcagttgctgttgtagttgacccaattcaatctgtgaagggaaaggttgtcatcgatgcttttcgcacaattaacccacaggcaattgcactaaaccaagaacctcgtcagacaacgagcaacatcggccatttgcaaaagccttcaattcaagcccttatccacgggctaaatcgccattattattccattccaattgcttatcgtacaaacgagaatgagcaacagatgttgcttaacctcaacaaacaaagttggatggactctatgaatttggtaaattacaacgagcattgtacacgaactgagaaggctgttgagcatatgctaaagcttgcaaagc

SEQ ID NO: 85269 - DNA, 619 bp, Heterodera glycines
  SCN-specific regions: Sequence locations=1-377,399-444,477-619
aatcctactttgctggggtttatttttttgttttgtatttgctatttttattgaacgatggaagaaggacaaatggaacccggagaaaatgctgcagttaaactcgtggatcaaaagaagtcggctaaaaagaaagtttatgtgccgggaattagccgaattttgaaggcgagcgaagaattggtatacgatgaggaggcgtatttgttgtttcacacattcgaaacgaactatccgtgtttaagttttgatgttttgtccgactctttgggcgacaatcgctccgattttccaatgaccgcttggcttgctgctggctgaccgagcaaaggacaacgaattgctggtgcttagactgtcgaatttgcacgcaaatgaaaagacattggaaaatgcaaagaaaatggcccaaggaaagggcgacgagtcggagagcagcagcagcgaagacgacgaggaggaggaggagacggagggcggcacaaagagtgcgcggatgcacgcggcagtgatccctcaccacgggggcatcaatcggatgaagtgccaaacaattggggctagcaatgtgtgcgccgtgtggaatgaccagcagaaagtgcagttgtggaacttggac

SEQ ID NO: 85270 - DNA, 384 bp, Heterodera glycines
  SCN-specific regions: Sequence locations=25-29,52-66,100-174,198-384
ttttttttttttttttttttttttaggggtttaaatttttttaaaaaaattcaaaacaccaaatagtttaaaaagttggggaaaaaatttgttttgaaaacctattaaataaaagaggatagaataaaatctgaaaactaagcttccttttttttttcctccgttaaatccttccatggccctaatgatgatgggggtcgggtcccctcggggacaaacccttcaattctttgaccggctttttttcagcaagttcgcgtaggggggccctcattttttctaatcgatttgcccccttttcaaattgcccaggaggaggggggggagcccttgaccgattggtcacatgcgatggccccaatccgggggcttttcctccctgag

SEQ ID NO: 85271 - DNA, 119 bp, Heterodera glycines
  SCN-specific regions: Sequence locations=1-119
gtcattcaattcgccaaaaaaaagtttaatttttgcttaagaatccttcgggccatgtgactaataaattttgccggtgtgaaatttgccattgcaccctcgatttatcttcttccttt

SEQ ID NO: 85272 - DNA, 221 bp, Heterodera glycines
  SCN-specific regions: Sequence locations=1-221
atcgaatggccaagcgatcggctaaagaaatttcccgacttgcgcttcaaatacatcgaagacgaagatacggtggacttttttgtgccgtacatttggcgtctgatcaacgacggactttgtctgcaattcgacgctgaggccattcggttgttcaacgtgaacggggaacagtgatcagcagaggacgtcatgaaagagggacaaaacaaactgtgaaa

SEQ ID NO: 85273 - DNA, 508 bp, Heterodera glycines
  SCN-specific regions: Sequence locations=1-73,96-508
tattccaaatgaaaaataaataaatttatttgcttacaattaacagattttccctgggaggaattgagaagagcaaaaatggaaattataattgacaagataaacaacagcatggaacgcaaaagtccgacaattaacggtgcaggaaacaatgggaaaacaaaagtctttgttgtgtgccatcatggcaacgactcgcaattggctgcgtgtcatctgcacaaacagttgtcagaggccggcattggcgaccggttcatcgttcgtgatattgtgggcggaatggatggatgggcgttggaggtggacgccgacttcccgcgctattgatgcagccgatggtttagctgttgaatgtgagtggactcggattaatgccttctttaaattaagaaacagatctgccacaattggaaagaattcagaatcccatgggaaccccatttttatgttatttgataacacatttttacattttttgcttacgtgttaaatttttttttcatta

SEQ ID NO: 85274 - DNA, 605 bp, Heterodera glycines
  SCN-specific regions: Sequence locations=1-562,585-605
cgtccgggtcgaatccattgcaaaaaaaaaaagtcgcttcatctttctttccgaggcacgaaaagcactcatttctcaaatgaaagggaagcgcaaaagaaacagccaaaaacgcataaacgacgaccccaaacgacgaaagagcgggacgcactgacgaagatttgccatgctcaaaagttgacgcagcaattgcgacgtgtccaaagcgactgggaaagcgcgtcgatggttctgagaaggggcgacgcagtggtggtgaaggcactccagcaggacggtttcagtctctgtgacaacgccgtttcctccggactcgtccccgtcgctcttttgggtccatttgacgagagtttcaccgctccgttctctcccgagtctccggcctccggaaatgagcctcacgcgattgatttggctgttgaatccgccggccataaacaaaataattccgatgtgccttttgcttctgcttgactttataacagcaaatgaaacaaatagttcccagaatgattactcaccggacaaaatgacgtcaaactcgcaactagacaaaatcgagcaaaatgggagggatataaatctgattgatttggaggaca

SEQ ID NO: 85275 - DNA, 576 bp, Heterodera glycines
  misc_feature (574)..(574): n is a, c, g, or t
  SCN-specific regions: Sequence locations=1-576
gacacttcggccggaatttttgctgagagttcttccaagatcaaaatccatgatggcgatgaaattccgattactgaagaccctcctgaagcagtacagctaccaaagcaacatgatacgtttggcaatgatcaacagctgaaaaatgcgcaaattcgtgacgatgaccaattcccggatggacgaaatgccaaagagaccttagatgggaaaccgcttcagagcattcaatctggacaacaaaaagtggcaatttcggcacacattgaaccaaaagcatcatcatcatccaatgaatggattcttccgttcaacaaatccgaaaatggtgccaatgctaaggatgcatattctttggccaacaacaacgcatcatcatcatcatcatcctccgttttcccgcaaattaattttgatttaattcgaaatagaaaagtgccaacacaaattgaacaaaggcacggtgaagaacgtgcacgagtcggcaacatttatgaacagttcaggacaaaagaatccgtctacgatttgatcagacaaattcaacaagccgaagctcgccgtttgtccgtanag

SEQ ID NO: 85276 - DNA, 578 bp, Heterodera glycines
  SCN-specific regions: Sequence locations=1-578
ggtacaatgaattaatctctttttacttaaattgttcggaatctgaattcaagttctgctcggactataaataaatgtcagacgaaggtcagcagttgttggagtccaccttgcgcaatgtgttggaccagcagtcgcttcgatggattttcgttggcggaaagggcggcgtcggaaagaccacgtgcagttgctctttggccgttcagttggccaaatatcgtcgcaatgtgctgatcatttccaccgatccggcccataacatttcggacgcgttcaaccaaaaattcacacggagtcccaccaaagtgaacggcttcgacaatttgttcgcgatggaagtcgacgggtccaatttcggggaccatggtgtgcccaatttgggtgacgaggacgacaagtctgatatcttttccatcggaaagaattttttggccgattttgctgccggacttcccggcgttgacgaggccaccagtttttctcaaatgattaaactgatccgttccatggacttcgaagttgttttgttcgacaccgcacccaccggtcacactctccggttgctccaatttccg

SEQ ID NO: 85277 - DNA, 581 bp, Heterodera glycines
  SCN-specific regions: Sequence locations=1-36,59-80,102-581
gccatattcattatctttctttttttgattgcccgttttctgaaattgaccagcttcgatgaaaagccaaaaatcacgctgagaaagaacaaaaggagaaattcgtctcaaaaatgttcacatttaatggaggaaggaagtcaatgtgcgactggtccgtttgttgagttagctgaactttttgtgcaatgttcgattctgcaagaactttatactccgccgtcaatttggggccgtaatggtcatctccaaacaattgcttatggcctactcggccaccattcacttaagaggacattcgattgtcggcatttggttcgcctgtccgatggaacaactgcaacattcgacttgttcgaacctgtttcaacaccaaaatgggggtgacttcacgttggtcttctgtcccgggattgccaattgtagcgaatccaattacattcgaacttgcgtccatcatgcccaggagaagggttatcgttgtgcagttttaaatcacattggtgttccaaaaaatgttcagcttacgtcacaacggattttttcttatggtggcaatggtgaaatggaagcgatgttca

SEQ ID NO: 85278 - DNA, 478 bp, Heterodera glycines
  SCN-specific regions: Sequence locations=1-478
ggacaatcagcgttcattggtcgacgcgaagcacagtttggacgtgatcagacagaaacaccaggccaccgtcgacgaactgggcaaaattgacctgagattgggcaaactccatgacgaattggccgagaagcacaaaaattatttggactacaaaaatcgtttggacacacaatacaacgaattgttgtcggcggtgctggagaaagtcacgaaactctgcgaccactttcagcagatcgaggaccagaagaaatgcttcgcagaattggccaatgaaatgctcacgaagaacaaggaggatttgaagcaattggaggcgaagaaaaaggccgaagcggaagattaatttgctattatgactggaattatataatgtctgacttcattacctattttgtattgtgattgtagaaccatatttaggtatgtgtccttctgactttttgctgtgtataaaaataaaatgatgaaaaac

SEQ ID NO: 85279 - DNA, 661 bp, Heterodera glycines
  SCN-specific regions: Sequence locations=1-29,74-298,320-661
tggcccgacgtcgcatgctcccggccgcctggcggccgcgggaattcgattaacgcagagtacgcgggggcaattaattgtccaaataagcctttctttttgactttccattgactgtgctttttatccacctttcgtcttcaattttgttcatccaaaatggcggaggaaaccagcaaaaccagtgaaaacatcgctgaggacaacggcatcaaagtgctcgactctttgtttgcctccgtcgaccacgcctcaaaatgtttggcattcgctgccggcacgcccaacttctgcttggccacgcccgccttcctggctgtcatggtttggtgctgtttcctcatgccgccggtcgctgtgcttttccgcagctatcgccgcgacggcaacgcgttcactgtgcaggcggcgtacaacgtcattctgtgcttcttcctctggatgcccggcatgctgcacgccctttggttctgtttcggtgagacggtgcgtatgcttcgtcgtcacgtgccgccatcggacgacgcacagaaaaacgaataagggaaaagcaacgaaggatgacagagagagacacaacggcaccgattagacactaattagacgataatttatatgtttttaatgtttttcttaaattctaagtgtttttattttgagg

SEQ ID NO: 85280 - DNA, 99 bp, Heterodera glycines
  SCN-specific regions: Sequence locations=1-45,69-69
agtggttgtatcgtatttggaagttgtcgtaccgtagtcggaagttgttgtgtcgtatttggaagtcgttgtatcgtatttggatgttgtcgtatcgta

SEQ ID NO: 85281 - DNA, 466 bp, Heterodera glycines
  SCN-specific regions: Sequence locations=1-466
gcgacgaatttaaacaagtcaaaagcgtaactttggggtcgaagccatgcatcattttgcaaggtcacctttttgagtctaacggaatacttcaacggattggcaatttaatggtggatttgtttcgtggccccaaagtggagtacttaccgcttcaaggcacgcgaattgataatttcattgacagcactttccgaagagcggattaaatgcagaggtttacagagcatccctaaagaaggacatggaatctgcgaccccaaaaatacaattggttgaaatgggaccgaatattgacttcaaaatcgacaggacgaaattggcaagcgattcgctcttcaaaactgcactcacaaaaccccacgaagttcacaaaagtgccaaaaagaacgtgaaatttgatgcattcggaaacaaagtggctcaagtgcacacgggaagacaaagtacggacgcaattcaaacg

SEQ ID NO: 85282 - DNA, 636 bp, Heterodera glycines
  SCN-specific regions: Sequence locations=23-636
gaattcgatatcactagtgaatccgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagct

SEQ ID NO: 85283 - DNA, 661 bp, Heterodera glycines
  SCN-specific regions: Sequence locations=1-483,508-661
gtcaaattgggaattacgaactggcactggacaaaaacaaggagatggtccgccaactccaagccgatttggcggcaaaatgtgccaaagtcgactcgttgaatgccgaactggaggaacatcagcgcgttttccaggcggcgaacaacgaactgcagaacgcggtgggtcgccagcagtgcaacgacgaccaaaaaatacgtcccgaggtcctccgcagtaatggcaggattacccagaagggcaaacgtcgctcgagttcgccatttgtgcagtcctccgcggcgggaccgtcaaagcgttcgcgtcgcattgtaaaaattaatgaagagcagcgaaaatttgcagtcgacgaaagcaccgaatccgatggagaacaacagcgacagcgaagtcgtccgtcaaaggctgtgccgggccgtctgacgaagaaccggtcaatgtccgagtcgaatgtgtacgagccgccgacaagtgaaaatctgcaacaacaacaacagcagcataaggcagcgatgtcggccaagcaaatcagcacattgaacatgcatttcggtccgccccgtccgtgtgtcggccgcggttggaccaagggcaaaccgatcaaccaatgtgtgcacacttacgtgcccgtcagcaacctgttcagtgccgcgttctc

SEQ ID NO: 85284 - DNA, 582 bp, Heterodera glycines
  SCN-specific regions: Sequence locations=1-32,58-61,85-232,254 -328,351-582
tgacaaaatgagcgacggcacgcgcagcattttgcacgaggtgatggagcagcagacgctgtccattgccaaggcgggcatcatttgtcagctgaacgcgcgcacttccgttttggccgcggccaacccaatcgactccaaatggaacaagcggaagaacattgtgaagaacgtgaacctgccccacacgctgttgtcccgctttgacctcatatttttggtgttggacccgcaggacgaggcgtacgaccgccgattggcacggcatttggtgaacttctatttggagtccgatggcgagatggacaagcaacagcgagtggacatggcctttctcagggattacattgcgtacgcaaaacaaaatgtgcagccggagctcactgacgagacggtgcagctgctgaccgacaagtaccagttcatgcgccagcagggccaacaggcgggactcatttcggcctacccgcgccagttggagtcgctcattcgactcgcggaagcgttcgccaaaatgcgcctgtcgcccaccgtcacggagtcggacgtggagatggcctacgctttgcaccgcgaagcgct

SEQ ID NO: 85285 - DNA, 556 bp, Heterodera glycines
  SCN-specific regions: Sequence locations=1-319,341-556
tggctgatgaacatgaccttagcaccggttcggtcggaccgccgcttaggagctgtgaaattcgtcttcgagaatggactgaagctggttatttgccttcaaactcgcctcctcagggcgaagttctgattcacggggccaatgtcgcgttgggttacttcaaaaatgaggaaaagaccaaagaggacttcgtcgagttggacggaaagcgttggttcgccaccggggatattggagaattccgcgaggatggcagtctctgcattattgaccggaagaaagatctgatcaaattggcccacggcgagtacatcgctttggggaaggtggagacggcgccgctgaccaatccgaacgtggacgacatttgcgtttatggcgaatcgcacaaagactatctgattgcacttgtggttccaaatctcaaaaacctgcaagtccttgctgaaaagaatgacgtcaatgagccgagtattgagagaatttgtgccaacaaagaaatgcccaagattctgcagaaggaactccacagctttgtttcgggcaaattgcgtag

SEQ ID NO: 85286 - DNA, 605 bp, Heterodera glycines
  SCN-specific regions: Sequence locations=1-167,203-310,332-508,531-605
gacattagaagtggcaaaaacgagttgaaacgcgtgaaaggtccttacgaaaatgacaatgcgaaaagcgaatcggaccgaaaacgaacagcgaacagaatgagaaattctgcaaaattattccattccgatcgcattgtctgtttgcgttgcacgtcggacggccgtttccttctttccctctcccaaaacagaaatgtttgtgtttgggatgccgaaacgatgcgaatgctttgccatctgaaggtgcccgaatctgaaggcggcctcagcacttttcccgtacaatttgagctttgtgacgaggggcgtttaatttggctgttcattcccaattcgaacaatgttactgtggtgggaattgctgatccgaaattgttctcaaatcgtccgattgttggaaacattcacttccaaacattgcgaggtcatttccaaaatgttttgtcctgcgcctatcggaaagagtataatcagctaatcacttcttcaaccgatcgccttattttggtttgggcccccaaaatggacgagtttcgttccgactcggcaattcaacaaataaggcaacagcttcatgaagatgcgtttagtgatgacgaaga

SEQ ID NO: 85287 - DNA, 473 bp, Heterodera glycines
  SCN-specific regions: Sequence locations=1-119,141-431,454-473
gactcaatcgccgtcattctctgtccttttacgcactattcgccactttcactcagcgaaaattggcaaagaaagcgacgatgggaaaagaaagacttggggaggagcagcgaaaggaacttttggagcctttgctgaaggagggatgggaaacggtgcaggagagagatgccatcaaaaagagcttcactttcaaagacttcaatcaagcgttcggttttatgacgcgaatcgcactaaaggcggacaaaatggaccaccacccagaatggttcaacgtctataacaaagtggacatcacactgagcagtcacgacgtgcaaggcatttccgagagggacgtcaaattggcatcgttcattgagaacgtgttcaaaacagtgaagtgaagatggcgttcgttgtgaattaaacggatacaaattgtcattttgcaccctttttaaataaaatgataaaaaagtcacaaccga

SEQ ID NO: 85288 - DNA, 266 bp, Heterodera glycines
  misc_feature (131)..(131): n is a, c, g, or t
  SCN-specific regions: Sequence locations=1-110,162-266
gactttcactattactcgtcgacatttcgtcccattcacacatttccttctctccgttctgtcgtccaactgctgccactttcaattgcccttcacggcaatggctgacactcctcctcctcctccacctnctcctcctgctgctgctgctgccgctggtggtggtgatgaagccgttgatttggagcaacgtgttcgccaactcatcatgtccatcggcctgcgaaacgaacacgccgcgcgcgagatttccattctgatcgagt

SEQ ID NO: 85289 - DNA, 619 bp, Heterodera glycines
  SCN-specific regions: Sequence locations=1-75,97-584,607-619
ttggtggagtttgggggcgttgacttttgacatgctcaccgggggaccgcctttttcggcagagaatcgcaaaaggacaattgacaaaatcctcaagggacgccttacacttccgccctatttaagtttcgaagcgaaagacttgataaaacggttgctgaagcgacacgtggacactcgccttggggccgggccgggtgacgccgaagagataaagaaacacgcctttttcacccaccacgtcgagaattggacaaatgtttatcggcgagagatcgaagccccgtacaagccgaacatcaccagtgaggaggacgcctctctgttcgactccaaattcaccaaaatgactcccgtcgattctccgaccgccgaattgccaccaatgtccgtcaatcccttcgaaggattcacttatatagcgccttccgtcctcgaacaagtcagccaacccacgttggtccgtccgagacaacagcgcaaaatacatggccccgccatctttcacagtttccacccccaccaatcgacgaccgacaacggacccttggaagaaatggagtgaatgtgcccagcttttctgcttgtgctacatctcttttttcttcactctgtccct

SEQ ID NO: 85290 - DNA, 653 bp, Heterodera glycines
  SCN-specific regions: Sequence locations=1-244,266-653
cgacgacggacggccaaatccatttacatttgcaccatcgaaaaagctaatgggctggtcaattcgttgattgagaacggaagggcacacgaattgggcctggtcattgtggacgagattcacatgttgggtgagcagggcggaaggggcgctttgctggagcagtgtctgtgcaaattgctcttccgtcccaccaatgaacagcaacaggaacgagttcagctcattggaatgtccgcaacacttggcaatgcttctgaactgtgccgttttcttggtgccaatctcttccgaactcattttcgacccgttgcgctgattgaaaggataaaattgcacgacaaactgttcagggtggacgagcagggcgagtggaggatggagaaggaattggagaagggcaacaaagaactcgagaggagagacccggacggactgttcaaattgttgggcaatttgctcaagggatctgtgctcattttctgtccgaccaaacaaagctgcgaaaacgtgtgccaaatgctgtccaatttcagtccgaaacaattgcgtgaccatagagccgatgagagaaatgcactgatcggtcgacttatggacgaacacgagggcctcatctgtccggtgctcagtgcgtgcattcgcaacggcgt

SEQ ID NO: 85291 - DNA, 500 bp, Heterodera glycines
  SCN-specific regions: Sequence locations=1-500
aagagaaggcaatcccactcgtgatgtactccaagaaagcatagcgaccctggagagtgctcgccattgccgaattttcagctcaggacttgccgcaattgcagcatgtgtcccatttgcttaattccggacagcatgtcatcgcgtcgggggattgtaacggcggcacaaaaaattatttcgacaaaatttgtgtgccgcatcatggcttggagctgagtcctgtggattagacgcgattggaaaacttggagaatgaatttaagcccaacacaaaaatggctttgtgtgagacaccctcaaatccgcttctaaaaatcgtggacattgaagcggtgtgccgtatggttcgagcacgctcaaaagattgtgtcgtccttgttgataatacgttcatgacaccgtactttcaacgcccgttggaacttggcgccgatgttactgtgcaatcgctcaccaaagacatcaacggacacaccgatgtgctgatgggcaccgta

SEQ ID NO: 85292 - DNA, 241 bp, Heterodera glycines
  SCN-specific regions: Sequence locations=1-241
tggcggcggtggtggtgggctgtccgcgttgaccagtgcgatgttgggcaagaagccacgcaagcagtccgtgctggacaacgcccagtccggctggcgctcatttgtgcaggaggaacagttggagcaggagatggagtcgcacatgcgcagcacggacgcctatttggacaagcaggagtttctgctccgtgcggactacagccaatttgagcgggagcgcgacttgcgtgcgcaggaa

SEQ ID NO: 85293 - DNA, 506 bp, Heterodera glycines
  SCN-specific regions: Sequence locations=1-114,162-318,340-429,451 -469,493-506
ccatcgctgtataaaaattccaggaatcattggagcaagacgatccacggattgatttacaatgcattgaaacttttcatggaagagaatcagaagttgttcgacctgtgcgtacagaacttcaacaaacagaaggagcaggagcaacagaagcagcagaacaaccgcagacggtgggaactgctcgaaaaagcggccatggaaaacgcacgcgcaattcgacagcaacagacggacggagaggcggagccgtactcaattggcgagggagagaagaagccaaagtgaaacggtggcgaccaattgatgattctgtacaaataaacccccgggaaaaaacggaatgtaccgcttcaacatcacttacacacactgagaatttccaaatttctatgccacgccccccccctttcacctcacacttaaccctaatttacttctcacattttaacaattattattctttcacattttaaaaattattattttattgattatgagctaat

SEQ ID NO: 85294 - DNA, 504 bp, Heterodera glycines
  SCN-specific regions: Sequence locations=1-504
agctcaaaatgagtttatgcgggcggccgttgaggagggaattcggggcgtacaaagcggcgacggtggtccctttggcgcagtgattgtcaaaaacggcaaaataattgcccaggggcataacatggtattgttctccaacgacccaacggcacatgccgaagtgatggctcttcggggggcaagcaaagtgttggacagcttcgacctgagcgggtgcatactgtacacgagctgctacccatgtcccatgtgtttgggcgctgttttgtggtcacggattagcaatgttttctatgctgctgcgcctaccgatgccgcttcggtcggtttcgatgatcagaatttccacgaatttgtctctaatccgaagaaatacgaaaaactgatggcattggaacatttgccagtcgaagggcatatgaaagtgttcaaaatgtgggaacagagggacgagaagagaatgtactgacaaagggccaaccaatttattcaatttacatt

SEQ ID NO: 85295 - DNA, 492 bp, Heterodera glycines
  SCN-specific regions: Sequence locations=1-345,373-492
ggtgctgacggacaagtgccggccaagtacaagagcacactgtgcaacatttggttgatggagggcatttgcacgcgcggaaaacaatgccattacgcacatgggatcgaagagctgaactacagacaagatgacacaatgagtcgcttctacaaaacatctctgtgcactttttaccagcagcgcggcttttgtaacaacggcgaccaatgtcggtgggcccatggcgaagccgaacttcgcaagggggcagacggttcttctaatggactggcgaattattacgctgcgacaatgcaagcgatggccaccggtcagcagaacgccaacggctcgtcagccgaagcggcggcggctgccgctgctgccggttggaattgaattgattctcgatcatttgtataactaaccgattgtcaaaaattgttaagaatgcataacatttgggcaaaaatgtatctttcaatttgagcataaatcgcattttggcaa

SEQ ID NO: 85296 - DNA, 375 bp, Heterodera glycines
  SCN-specific regions: Sequence locations=1-333,355-375
gacagtggactttacgtttttccattcaaattggaaaatatggcacacataatagtggtgaataaattccaggatcggacaatgatccgtggcacgacattgggccaaaacatgtacaagattggcggagaagaagcagtcccggtcagggaagcacttgtgaataatatgcagcaaaagaatgccaaaacgtgtagagcagcagaagatgaaccaaaaaaagctgctattggaggcactggagatgaactggatttgttgagcttgctggtcaagggtgatcgaagcaaaacaatcggtgaggacgggttcgatttggagctgttcgaccaggacgacaacaacaacgacggggaagagcagggcgtgaataat

SEQ ID NO: 85297 - DNA, 296 bp, Heterodera glycines
  SCN-specific regions: Sequence locations=22-296
tttttttttttttttttttttggtacccatagtttatgcgtattggaaaaaacacacaaaaatattattgtaaaaagaaaaaagcatcatccaataattttgaatgtaaacaaatcgaaagggagggaatggaaggaaatgccaacaatgcgaaggatacaaacaaatttatcccaaaagttaatacaacccaacgaatcagcggcacctccaaactcaccaccgtttgtttatttggtcaccgggatccgatcccaaattgaagtcctttttcccaacgtcggttgtcccaatcg

SEQ ID NO: 85298 - DNA, 579 bp, Heterodera glycines
  SCN-specific regions: Sequence locations=1-297,319-579
gattaaataataatggcaaatgccccgacaaaattaatccgtttgttaatgtgtcgtccgactcattttaatgtgaaatacgaaataaacccatggatgaggccaggcgacccggtgaatgtgcaaaaggcaacagatcaatgggaaagactgaaacgcactctcgaggaatccggcgcccaagtcgaagtgatggaacccgtgggggctgacaattaccccgatttggtgttcacggccaatgccgccgtcgtccgcggcaaaaatgcccttttgagcaatttcttttaccccgaaaggaaaggggaacaacacttttacgaccgatggtttaagcagaacgggtacgaaaccttcaaagaccttcacgtgcctttcgaaggtgccggcgatgctttgtggataggaaagtcaaagttattttgcggcattggccccaggacggacgtgcgggcgctgactctcatttcggaaaagctgcgcgactacggagcgcccttcaaagtttatggctttcgactcattgacccgcgtttttaccacatcgacacctgcttctgtcccctgaatgatcagatc

SEQ ID NO: 85299 - DNA, 556 bp, Heterodera glycines
  SCN-specific regions: Sequence locations=1-325,486-520,553-556
aaacgaattgaataacgaatggaggttaatcctgccgatttgaatttccctaaagcagtgatcgctcgtataatcaaagaagcgttgccagatggagttacagtttcgaaggaagcaaaaaatgcgattgctagaagtgctgctatatttattcttcacgcaacttcactagctaatgacaatgcacaatcaaaaaagagaaaaaatctgatcgccgatgacgttttatatgcaattaatcaattggaatgcgatgagcttgagaacccggtaaaggaagcactcactctttacacgcaaaagaagaatcagcgacaacaacaccgaagagagagaagggcaaaacaaagagaggaaaaacggtttgaaaccaaaggaaaaggggagacagaagaaaaaggacagcaagaggatggacaaagcgactgcgaacagggaatggagaacggtgacgacgatggagaggaggaggaggaggagatggaagacgaagtggggcaatagtgcgcatttatttagactttaaactgcatttttgcataaattctttttacca

SEQ ID NO: 85300 - DNA, 418 bp, Heterodera glycines
  SCN-specific regions: Sequence locations=1-318,340-418
attaataaatcattttattatattccaccactgatgtcaacatggtcgaaaaaaatcccctgatcggactgatcttctgcattctgtagcccccggtcgctcattcagtatgcacggaggaataggacattatgggttagatcctcaacatagcgctgtacataatcagctatgtgtcctggcataatccacaccctgtggaacagcctcttttcaggctgaactttgaaaaaacaattagctgttccttaaacaacaaataaaagggcacactgaaacggatcggcaaaaggggctaataggaaaaatttaaccatatcttaactttaaaaaatgaccttaataacccattcaccccactaactgcgacgcattttcctcaagccgatttcttccacttttccctcccttccaaaaa

SEQ ID NO: 85301 - DNA, 650 bp, Heterodera glycines
  SCN-specific regions: Sequence locations=1-421,448-650
ggggcttgaccttttgtgagtgcacaaacaaatttcgatgacaatgcaaacagccgttgccctttgttacttttgtgagaaccatggctctcgagttgtggtcgtatgccaaccgatgcgaaattgtgagcttcctcgaccaaacagtgcgaattcaatgggaggtccaattgttaatgatcgccagcctcaacagcagcaaccttcaacttcgtcctttgtgcattgtcaagattgtgacggcgatggcaatgtggccgagtcgcctcagcttttcacggatttttttgccgacaacgaagtggtggacgacgaggcacgctgtgccgcgtgttcgtcctttgagcacggcgttgggctgatgtccaaagacggcgatgcggagatcagttacatcagcacacaggtgccaagaaacgaaagacttggtcatcttctgaggcaggcatccctccgatctttgagtgtcgaaatatcggtgcctcttccaacgacggaccgctcgcattcaaatcacatcgatgcgtcgccttcctcttcgagcagtgactttcgcccgaagtacgaccaaagaattggcaatgtgcgcggcgacttcactgaaagggatggcatcgttctgtttggggatgatgaacattggtacacat

SEQ ID NO: 85302 - DNA, 612 bp, Heterodera glycines
  SCN-specific regions: Sequence locations=1-532,555-612
aatcccaatttcgcattcatctcactcactcataaaatgctccaaaacggccttaccattctgcttctgatcagtgttgtgatcggccattccttggccaaccttggcccaaccatcaaacataatcctcattttaaagccgtacaaactgcgcatcatttgcatgatgccattgcgaagaagcacgaggccgaagttacgcaagtcatttgctctattagcaacgaacagcgtcaagcattggctttggagttcaaaaaacaattcggcactgatctgattgccatgctgaaaaaggagttcaaaagcgactttgaagaactgatcatttctttgatgcaaacgcccgccgtttacgatgccaaccaaatgcgtgccgcattgtccggctccaatgaggcggtgctaatcgaaattttggcgacgcgcacaaaccgacaaattacggcgccgaagcaggcgtatgagcagttggacagaaggcatcagcacaatcagctggaggaggacatcaaagcgaagacgaagggacccttccaaaatctgttggtgtctttgctcagctgctctcgcgaagaaagtgcgcccgcaagcattgtattggcacacgac

SEQ ID NO: 85303 - DNA, 530 bp, Heterodera glycines
  SCN-specific regions: Sequence locations=1-27,51-497,520-530
gggttaatgaagaggaccatttgcgcattatctccatgcagaaagggggcgatgttggcaacgttttgaaacgattgatccgcggtgtgaaaggtatcgagaagcaagttccatttgcgcgtgatgatcgactcggctatctgacgttttgcccccccaatctgggcacgaccatccgtgctagtgtgcacatccgtttgcctaaaataagcgcaaagcctgaattcaaaaagatctgcgaggacctcaagttgcaagttcgcggcattcacggagaacactcggaaagtgaaggcggggtttacgacgtgtcgaacaaggctcggcttggacttaccgaatttgaggcggtcaagcaaatgtatgacggtgttaagaaactcattgaacttgagaaggcgtcgaagtgaatgaattaaatatctatatccatttgacgcctcgtaattgcattgctttaatcacaatattgtatttttgtataggtctatagggtcagaaaatgtattgcattatgaaattgtatggac

SEQ ID NO: 85304 - DNA, 533 bp, Heterodera glycines
  SCN-specific regions: Sequence locations=1-430,453-533
tcaaatcgcacattgacaacaatggcccatctcaacaccggctacttgagcaccaaccgtggcgtcatcaaaattctgcagatcatctgcggcttcatcacctgctctctgttgtgcgcgaactggtacggcggcaagacatgcttcttcgagggccgtcttggatatgccagtggactcaacttcgtcatcgtgatcatcaacattgtgctgttcttcctcaattttctgtcgatggccgcctaccgaatggagcgcatttattcggtgatcggcaccattctgttcatcgtggcattcatttgcatggtctggtatctgatcgactatgacatcaatcgtggacagttgatcgctgctacggtgttcatcggcatccaaatggtgctgttcatctgggactatcagatcctgcatggccaggccttcaactgaatgaatggatggatggacttcttcggtcggaaatgaatggagatgaaaatggcaaatgatggaattttgaatttttttttgcgctctgatttttgctg

SEQ ID NO: 85305 - DNA, 378 bp, Heterodera glycines
  SCN-specific regions: Sequence locations=1-321,346-378
gacccgatcattcaatttttattaaaattaccctaaaatctccatgcaaaaaatgaattctgcgacaatgttcactctgctgttgatcattggcactgttcttgcactgacaattggcatgccagcccccggcggatctgatgaaagtgttgcatcgatgcgccaaaagcgcggctacggaatgagcaacggaggcggaatgggcaatggattcggaggcggaatgggcaacggatttggaggcggaatgggcaacggatttggaggcggaatgggcaatggttttggaggcggaatgggcaacggttttggaggtggaatgggcggcggaagcggcggtggctatgggtacggtaaacgtcgctgatgaattactgt

SEQ ID NO: 85306 - DNA, 390 bp, Heterodera glycines
  SCN-specific regions: Sequence locations=1-307,329-390
aatttgcgctgtttctgctgttactaattttggaaaattccctcgggcaattcccgacgagtagcacaactgagaagacaatcacagaatatgtgccgtggctttaccgatttggtcaaaagctaatgccgtgccaagacaatattccatcggacgaatgtcagaagcatgaaaatgattgccaagataccataaagcgccgagagatggcattgttctgttgtggcacctgccgaactttgtatccgaattttttgccaaaacaatcggggagaaaataagaggaagcatcagaagcaattacgagaaagaggcgacaaagtgaatgcaaagaaaggaaatgatcagaaaaagccattaacaaaaaaaaaaaaaccaacaataaaacca

SEQ ID NO: 85307 - DNA, 580 bp, Heterodera glycines
  SCN-specific regions: Sequence locations=1-6,47-170,192-232,254 -396,420-580
gatcacatatatttttcattcattaattaaattaaatatattttttgccatgtcttctctgctgctctccatcttcccaattgtgtttttggtctgttgcaatgcaatgccaaatttcccgtgctgcccgggcagtcagcaagtggttgctgtgatgtccaaatacattgacactttctcttctgctgctgacgagtctacagtatgctcaaccgctaaaagtactgtggatggaataaaaaatgaactgtcctatcgcgtgggatgcccaagcggaggagaagcacaaattgtgaatgaaattgatcgacagctgaagaacattgcgaaaatggaaatcaattatgaggacgagtgcccgtacaatttgggctttgcccgtgccatgttcgacttggccgctgctgctgctggccatgcggggaacggcacagaatggcaatacatgaaagtacaatttgagcaggaaagccaagcaatcaaagcaattggacaagaaaagaactttgaagttacggatgtgcattttggagtcccaagcaaaggggtttctgcacatcaaaatgtgccgagtccgagc

SEQ ID NO: 85308 - DNA, 626 bp, Heterodera glycines
  SCN-specific regions: Sequence locations=1-114,154-626
gacttcaccattactcgtcgtccatttcgtccgatttacacatttcctttccctccgttctgtcgtccaactgctgccactttcaattgcccttcacggcaatggctgatgacattcctcctcctcctgctgttgctgctgatggtggtgatgtcgtcgttgatttggagcaacatgttcgccaactcatcatgtccatcggccagggaagcgaggacgcagtgcacgagctttccattctgatcgagtcattcaaccaggagcagctcgtcgactttctggagattatggcaagaatatacgtcgagagcggagtcagcgttgacatgccgggtggccaaggaatcaacatgttgatggtcgctgcgtcctctggaagggtggactttgcgcgctacttgctcgcccacggtgcaaccgttggacacttggacgccaccggaagcgtcttcccactaatgctagctgccgaatctggtgagttggaggtgtgccgtctgctggtcggggaatgggcagctgaagtcaaccagcaagcaattgatggcacgacacctttgatgagcgcgagcagtgagggacgactggacgttgtgatttatctcatcgatcatggcgccgaaatc

SEQ ID NO: 85309 - DNA, 530 bp, Heterodera glycines
  SCN-specific regions: Sequence locations=1-2,39-212,234-530
gatcatttgtaattcattttttaaataaaaatttccttggaccgacaaaaatggcaaaattcgttgccattgctcttctctcgctgaccattgtttcgatggcacttgcaaaaactggcaaaagtcaaacggcagacgaagttgagggatttcgcaatatgaacatcggcgacaacaataaggttgacgccggaaaggagcccgcggctgataaagcaaccaaaaagggaaaagctcagaaagccggaacgaaatcggcggcggccactaatgagcccgcggctgctaaaggaactaaaaatggaaaagccccgaaaaccaaagcgaagcaagaggtggccactaatgagcccgcggctgctaatgaatggaacgaccaattgatgggcatgagcgttgagaaatttaacgaggagcttgctgtgttgttgccaaaagccaacacttttatggaaaatgctttgagcttcatcaatgaacaagtggaaaaaaatggtattgcaactggcgctgccggggactcgtgctcg

SEQ ID NO: 85310 - DNA, 532 bp, Heterodera glycines
  SCN-specific regions: Sequence locations=1-532
attcgtggtctcgtcgactcggacgatttgccgctgaatgtgtcgcgtgaaatgttgcagcagcacaaactgttgaaagtgatcaagaagaagttggtgcgcaaggtgttggacatgctgaagaagatttcgcccgaaaagttcgacgagttttggaaggagtactcgaccaacctgaagctgggcgtcatggaggacccgtccaaccgcaaccgcctggccaaactgttgcgcttccacagctccgccgactcggccaaacagacaacgctggaggcgtacgtggagcgaatgaaggagaagcagcaggccatctactacattgctggctcatcccgcgaggaggtggagaactcaccgtttgtggagcgtctgcttaagaagggctttgaagtgctgtatttgaccgagcctgttgatgagtactgtattcagtcgatgcccgaattcgaaggcaaaaagttccaaaatgttgcgaaggagggactgaagctggacgagggcagcaagtcggaggagcagcacaaactgc

SEQ ID NO: 85311 - DNA, 669 bp, Heterodera glycines
  SCN-specific regions: Sequence locations=1-571,593-669
attgcttttcttttgctcgttttggcaaagggattcgaaggctacactttcagttgtttggacgggtgcgaatgtgacactgatgacgaggccatccattgtcacaatcgtcccgatcggcactttgtccaattgcccccgtcgcgtctccgcggtttcactgtgctcgcgctcacccgcaataacatcgatgtgctgcccagcgaagaagtactgctcgagaaactgcccgacctgaaggccgttgacgtcgaagggaatgaacatttcgactgttccacgctcgaccattatcggacattgatggtgatgagcgattgcggaaagactcctgaacaattggaggccgaccgggccaaactgccgacggacacacagccaaatgaggattgcgacttcgaatgcgtggcgaaccgacgcagtcgcgagttgcgcgagtacgtcaaacacttgtgggagatggtcaaagagaaggtgagccgactggccaagaagcacggattggacaaagtggtggacgacgtgggcaatttcttcaacgacgtgggcgaacgcatctccaacatcaaactgaagaagaagaaatgagacggacggacggaaggaacaaaagagaaaaacaccaaaaaaaattggaaaggaaattgaaagattgccatttaaatcgac

SEQ ID NO: 85312 - DNA, 374 bp, Heterodera glycines
  SCN-specific regions: Sequence locations=1-345
cgccatcaccccgtcgccgccctcggcttcttcgtccgtttttcgtggagggagtgcaacccgcgcgaggggaggaggttttgtgccgcgaatgatgcgcccaaggggcaatgaaatgaacggctaatcccttcggaaaaggcaatgccaaaaatgtaaggaaaacaaaaaaaaatgaaaaaaaacactgactatttattccatacaaaaaagaaagaattaaaaaagaatcgatcgtaaaacagaaattaacgttttaatgtcctctcatttgttgcgggtccttaaatgagtggcgaattgtgcattgactgcgtgatggaaaataaattattcaacgctttcaaaaaaaaaaaaaaaaaaaaaaaaaaaaa

SEQ ID NO: 85313 - DNA, 581 bp, Heterodera glycines
  SCN-specific regions: Sequence locations=1-15,45-509,545-581
aagatcgctgacccggaggccaagaagccagaggactgggacgaggacgcgccattcgagatcgtcgacgaggaggccgagaagcctgctgactggctcgagaacgagcctctccaggtccctgaccctgaggccgagaagccggaggactgggatgacgaggaggatggcgactggatcccgccgatggtctcgaactcgaagtgcgatgaggtgtctggttgtggcccgtgggagaagcccaccatccgcaacccggcgtacaagggcaagtggaacgcgccgaagattgacaatccggcgtacaagggtgtctggaagcctcgcaagatcgccaacccggattacttcgaggacaagactccggctaactttgagcctgttggcgctatcggcttcgagctctggaccatgcagaacgacatccttttcgacaacatctacatcggccactccgaggctgacgccaaggccctccagaccgagaccttcgacgtcaaggtcgcggtcgagaaggaggaggaggagaagagcaagcccaagaaggaggacaagaagccggacatcaagagcccgatgga

SEQ ID NO: 85314 - DNA, 645 bp, Heterodera glycines
  SCN-specific regions: Sequence locations=1-645
ggcagaattgaaaagcatcgagcagaaccacaacagcaattcgaccagcgcaaccggcacaatttcatcgaccgattcaaattcggatgagcacaatgacacgagttcacgcgcgaaattcacttccaattttgaacggatcgccaacgcatacatcaaatttgtttcgaacatttttgcctccattggcattgtcatcgtttcggcagtgtttttcgtcatttgctttagggcggtgctcggattcgaaatcaatctgacaatggtcaaattgttcccgccagactcgcctctgctggaagtggacaactatcgtgaagacaaattggtgcccttctacacaatggcacaaatttttgtgaacaacccaggcgatttgtcaaacaattatgtgaaggatttcaatgtgtccgtgctccatgacttcggtctcttcttgggtctgctcgaaaatatgcaggaccccgtggtgattgcaggtgtgatcatttccattggcttcagtgtggacattccggcacacatctcagcattctatgggcatattatttaaatgtttaaaatgaatagcatattaattggttgttaccaatattgttcaatggatctctcttatttaaaatgaataatatcttattattgttg

SEQ ID NO: 85315 - DNA, 480 bp, Heterodera glycines
  SCN-specific regions: Sequence locations=1-480
gaatcccaatttcgcattcatctcactcactcataaaatgctccaaaacggccttaccattctgcttctgatcagtgttgtgatcggccattccttggccaaccttggcccaaccatcaaacataatcctcattttaaagccgtacaaactgcgcatcatttgcatgatgccattgcgaagaagcacgaggccgaagttacgcaagtcatttgctctattagcaacgaacagcgtcaagcattggctttggagttcaaaaaacaattcggcactgatctgattgccatgctgaaaaaggagttcaaaagcgactttgaagaactgatcatttctttgatgcaaacgcccgccgtttacgatgccaaccaaatgcgtgccgcattgtccggctccaatgaggcggtgctaatcgaaattttggcgacgcgcacaaaccgacaaattacggcgctgaagcaggcgtatgagcagttggacag

SEQ ID NO: 85316 - DNA, 495 bp, Heterodera glycines
  SCN-specific regions: Sequence locations=1-397,419-422,444-495
agggcgtttaaccgaattggaggaattcattacggagccaaatcacgcccaaatacaacttgttggagatcgttgtgcggaagatgggatgaacgacgcagcacgaattctgttcatcagcatcagcaacttcgcaaagttggcaaagacccttgtcgaactcggtgacttcccgggtgctgttgatgcaggacgcaaagccaattccacaaagacatggaaacagatttgcttcgcatgtgtaaatcatcaagaattccgtttggcacaaatttgtggtcttcatattgttgtgcatgccgatgagttggatgagctgataaattattatcaaaaccgtgcccatttcgacgaactaatcgctctcctggaaaatgcgcttggtcttgagcgtgcccacatgggaatgttcacagaattggccattttatacagcaaatacaaaactgagaaaatgcgtgaacatttggaattatcttggtctcgagtgaacat

SEQ ID NO: 85317 - DNA, 479 bp, Heterodera glycines
  misc_feature (139)..(139): n is a, c, g, or t
  SCN-specific regions: Sequence locations=1-313,355-479
gagtgcccgtgcaggggtccaaatatgctgcagatttgagccagcgtcgacgttttgcgggtccacgacggaattatttcttccgcggaaatcgaaaccgccgtccccggcatagcgaagaagcggcaggtggcgtcgnttcggtgggcgaaaagaaagaaggcgcagaagaaaacaatggaaaagaggctaagaaggaagaggttgcaaaggacgccaacggaggacgtggcggtgggcagcgtcgaggccggggcgttcgtttccgcgggcgccgcaacaatcgtcgaaacgtcgcgggctcaacatctggtggcacagaaaatgaaggcgaacagaaaaaagaacaaacgcagccggaggaagagacgaaagtgaacggaggcgaatgagcgaaatgcgacctcttttgtttagcgataattaaaaaagtaataagtctgcttcctacgatgtgttatgaattgtgtcgaccattt

SEQ ID NO: 85318 - DNA, 185 bp, Heterodera glycines
  SCN-specific regions: Sequence locations=35-35,61-69,107-108,132-140
ggggcggtctcctcccaaagcgtaacggaggagtacgaaggtacgctaggtacggtcggaaatcgtgctgatagtgcaatggcataagcgtgcttaactgcgagaccgacaagtcgagcaggtgcgaaagcttgttttattgatccggtggttctgtatggaagggccatcgctcaacggataaa

SEQ ID NO: 85319 - DNA, 137 bp, Heterodera glycines
  SCN-specific regions: Sequence locations=1-72,94-137
gcatctcagcgcactccgcctgcaaatgccccattcgccactgaacagaaggacagcaaaccccagtctggaggctagcagtccaacgtacagcaacaaacgggtgaatgcagaccagatacgccaactcttttttt

SEQ ID NO: 85320 - DNA, 592 bp, Heterodera glycines
  SCN-specific regions: Sequence locations=1-264,286-291,352-592
gataacgtaaataacttgaacatccttaatcctaatcatttgaaaaatcaaaaaaccagattttcaggaatttaattcaaatattatcgaaatattatttaaatttgatttgatagacacagagacaaagtcctggaaaaagaatatgtgataaatatagataaagcgtacctcatgccagagaaaaaaaacggagaagatgatgtaacagatgattgagtgaaaaataatttataaatttgaaactcattacatccattcttaaatacaaaactcatcaattttaatcagttaatataaaataagaattaacaattaaaaaaaattttttttattaattttcttaattatgattcgattagataatataaaaaaatgttctactaaaaaataagcagcggatttttgaatttttggaagataggtcaccaatatgttatatttttttgtaattttgccactgttatgtactgtactatactgtacttgttgtttagttccaactaccgtacatgaagaggcgtgtgcatgtcggcacctgtttcagcccacttttcctggcagaacagtggcaattggttgtgttagccat

SEQ ID NO: 85321 - DNA, 503 bp, Heterodera glycines
  SCN-specific regions: Sequence locations=1-313,355-503
gagtgcccgtgcaggggtccaaatatgctgcagatttgagccagcgtcgacgttttgcgggtccacgacggaattatttcttccgcggaaatcgaaaccgccgtccccggcatagcgaagaagcggcaggtggcgaagtgccggtgggcgaaaagaaagaaggcgcagaagaaaacaatggaaaagaggctaagaaggaagaggttgcaaaggacgccaacggaggacgtggcggtgggcagcgtcgaggccggggcgttcgtttccgcgggcgccgcaacaatcgtcgaaacgtcgcgggctcaacatctggtggcacagaaaatgaaggcgaacagaaaaaagaacaaacgcagccggaggaagagacgaaagtgaacggaggcgaatgagcgaaatgcgacctcttttgtttagcgataattaaaaaagtaataagtctgcttcctacgatgtgttatgaattgtgtcgacaatttaaaggatttgctgacacaaagata

SEQ ID NO: 85322 - DNA, 699 bp, Heterodera glycines
  misc_feature (655)..(656): n is a, c, g, or t
  SCN-specific regions: Sequence locations=1-1,23-699
ggaagcttcctcctcccatcggacagatgagtcccctccagccattaacctaaacgagtccaactcgctttcgcaccgccatttggctgaagaggccaatgcttcggttgcaggcgattcagcgacagagtccacaacaacagcagcggcggcacttttggtcaaaaagggacggaggagagagttggacggactgctgaagatggactttggcaaacactcgcccttccagacttcggacccggacaaatacgcgcaggaagtgctcatcgaggcgcgtcagcagcagcgcactttggcattggcgcaagaggagcaacggaatgcgcgtcggagcgtggagagttcctgcggcggttcagcgacagggaaaagcagcaagcgcgacaaatacgcaaaaaagcctttttcgccgcccgtctcgccactgcccgagtcacgtgccgcttcagtacggtccacgacgccaacactgcaattgcgagcgaagaatcatggggaaaaggcgtcttcgtcatcaaaattggcgacggcaagcggaattggaaagccaacaaaagagggcaccacaacatcagtggagaacaagctgaaaacatcgcccaaggattccttctcgttggagcaacgccgttctggtggtagcaacgtgtcnngagagggcgaggagcgctgtctgtactgtcgccgctcgtttaa

SEQ ID NO: 85323 - DNA, 302 bp, Heterodera glycines
  SCN-specific regions: Sequence locations=1-302
gcactttgaaaatgggcgacgaccaatcgaaggcaatggaggacactgcgcttttttacacgggctaccaacgctttggccaattggccaatgatgtgcggacaaccaagcgacgctgactcttcggcctggcactgtgctggggagtcgacaatttccgagtgatgcacggactaaaagcattggaaggtgaacgagtgcatgtgcgggcgtttatttgaatagagacgtgtttttggcaaacgcaaggccaaaactgtcgccagaattctaccgaaatgtgtgaagaattgggcggggtg

SEQ ID NO: 85324 - DNA, 587 bp, Heterodera glycines
  SCN-specific regions: Sequence locations=1-587
gtggaaaagggcggcaaaatgtgtggaaattgtgcaaaacgggcaaatttatgtaggcggcaaagagtgccaagtcgaaattgaagcggaaagtcgggcggaaatgtacagaaagtggaccaaccttggcaaggcgttgcaattcagaattggcgcactgtacaaagagaatgacggaatgttcgatgagcagaagctgatgcttctgctggagcaggcctacggcgcgttgctgaacggttcggcactgccgccgctgccgcccaatgtcagcggaacggtcgagcaaaaactgtacggcgaaatgttggaaaagtcggcacaaatgagcgagcggacgctgagccgagcgttgtcctccttcacacgtcaaaagtcgattctgtcggagaatccgatcggtgacatgaagcggacactgagcgaaaaggcgcgcgaaatgctgcacaaattttggacgggcgaaagcgtttttctggtgaagacgaaggcggtgaacgcggacacaatttggcgcctcttcgaccaaatcgaccgaacgcacgacgaaaaggcggtgaaaggcgtggagaagcaattcccggacg

SEQ ID NO: 85325 - DNA, 361 bp, Heterodera glycines
  SCN-specific regions: Sequence locations=22-36,70-71,111-361
tttttttttttttttttttttggtcccgattgtttatgcgttttggaaaaaacacacaaaaatatttttgtcaaaagaagaaagcttttttcaattattttgaatgttaacaaatcgaaagggagggaatggtaggctccgttaaccatgcgaaggattcaaacaaatttatcgcaaaagttaattccacccaacgaatcagcggcacctccaaactcaccaccgtttgtttatttggtcacagggatccgatccaaaattgaagtcctttttcccagcgtcggttgtcccaatcgcccggaattgccttcaactgccaccatttttatgccccgcgttgtgctgatcaccggacgacttc

SEQ ID NO: 85326 - DNA, 545 bp, Heterodera glycines
  SCN-specific regions: Sequence locations=1-81,133-154,178-182,241 -241,298-545
gtctgctgctgctactgttactggcgaggacgaaacgggccaaaccaagttcaaagtgccaatgtgacgacggcggtttttgttcaatgctaatcagctaattgctcactaattaccccaaataacaaaactatgcttctcccaacaatggcccccaaatgccttccgctcgaacttttgttcgaaattgtgcctctcatccctgccgaaaatgccacaccgaatgcgctctcgtcctgttggctgctgcacaaacttttgctgccacgtgtcatcaaatggaaagagataaaaatgcacgctgaaaatatcgtttggctcgaaaaatacccgcgttactttcgcatcaactggaacggaatggaggaccgaagaattgaccgttatgaggcatttgttaagcaactgtccggggtggacgattgggcacgaattggaagtcttcctgttcgcagctccatggagtcttacagtttgacgtttcaagtcggagcgccttccaacgaagaatacaaatttaaaattatcgcgattgatgcgcgcgg

SEQ ID NO: 85327 - DNA, 670 bp, Heterodera glycines
  misc_feature (663)..(663): n is a, c, g, or t
  SCN-specific regions: Sequence locations=1-138,160-670
atacacaaacacaaggaggaattgaacttgagagcatctttttggtgactaactcacagaccactaagacgaaaaatccaacttaattgtacttggagcccaaaattgaatcgccgtgtttaggtttttatctttataaatggctggtgaagagaagcgtattacttgggttccgcttgagtcaaaccctgaagcatttaataagtacatcgaaaaaatgggcgtgaaaggagctgagtgccacgaacttttcggttttgagcctgacttggtcagcttcgtgccgggacctcacttggcgctaattttctgctacccttaccaagacaaagcaaatgactatcagaagggaatttacggacaattgacggcttcagacaaaggaggcgtgccggaatgggccttcttcatgaagcagaaaatacacaacgcttgcggcacttttgctctttttcatgctctgacgaataacaccgaccgaattgacattggaaacggcgtcttctatgattggtttaaggcggcaaaacaactcaatgttgaacaacgctcggaccttttggcaaacgattcggagttggctcatttgcatgaacactgtgctttgagggaatcggagacagatgtcccaaggaatgttgctcaccacttcatctcatactntacacat

SEQ ID NO: 85328 - DNA, 586 bp, Heterodera glycines
  SCN-specific regions: Sequence locations=1-109,131-454,476-586
atccacggcacacgatccgctgtcactttcatttgcgaacagcccgacatcaaagcaatttcttttgttggcagtgaccaggccggcaaatacatttacgagcacgggtctaagtttgggaaaagagttcagtcgaatatgggcgctaagaatcacggagtcatccttcctgacgcgaaccgagaacacacgttgaatcaggtcgctgccgcggcattcggtgctgcggggcaacgatgtatggcactctctacggccatttttgtgggtgatgcgcgcggatgggtttctgatttggtggaacgagcccggaaattgcgcgtcggcccgggatgggaggcggggacggacattgggccggtgatttcacaaaaagcgaaggagcgcatttgcgagttggtcgaatcggcgctggaagaaggagccgatgtgccattggatggcaccaatgtgacagtgaaaggcttcgagaagggaaactttgtcggaccgacggtgatcactggagtaaagcccgaaatgctctgttataaggaagaaatctttgggcccgttttgtgtgtgctcgaaacggaaacacttgacg

SEQ ID NO: 85329 - DNA, 521 bp, Heterodera glycines
  SCN-specific regions: Sequence locations=1-2,39-212,234-521
gatcatttgtaattcattttttaaataaaaatttccttggaccgacaaaaatggcaaaattcgttgccattgctcttctctcgctgaccattgtttcgatggcacttgcaaaaactggcaaaagtcaaacggcagacgaagttgagggatttcgcaatatgaacatcggcgacaacaataaggttgacgccggaaaggagcccgcggctgataaagcaaccaaaaagggaaaagctcagaaagccggaacgaaatcggcggcggccactaatgagcccgcggctgctaaaggaactaaaaatggaaaagccccgaaaaccaaagcgaggcaagaggtggccactaatgagcccgcggctgctaatgaatggaacgaccaattgatgggcatgagcgttgagaaatttaacgaggagcttgctgtgttgttgccaaaagccaacacttttatggaaaatgctttgagcttcaccaatgaacaaatggaaaaaaatggtattgcaactggcgctgccggggac

SEQ ID NO: 85330 - DNA, 593 bp, Heterodera glycines
  SCN-specific regions: Sequence locations=1-309,331-593
atcaatcgaccggaaatcactcagaaattttattttatcaatgcggcaaccgaacggaagttttaccattcacaagggaggcgaaagtgatgttagggccgtgtatcgtgcactttccgttgcgtccatttgtgaattgccaggccaagaacagctttttggggacaccgctgcttggcttactcgttgtcaggtggctaattctcatttaaatgactgaactcgtcgatttttcatttctaaataattttggcagaaattccgctaatgcgccggaataagataccgatttttaaatttgagatcggcaatgttccaaaataatatatgccaaaaattatctaaccccaaagttaattgtaagacatacgaaggcggttttgggggcgagcctaactgtgaagcgcacagcggctacactttttgcgccttagcgagcctctctttgttgcggaaggtccatttggtgaatagagattcagcaatcagatggcttgtcaaccgccaaatgtcctccgaaggcggatttcaaggtcgtgccaataaacttgtagacggttgctattcttattggaacactgcatgtttctctg

SEQ ID NO: 85331 - DNA, 560 bp, Heterodera glycines
  SCN-specific regions: Sequence locations=1-221,243-335,357-560
gaagtgccaccgattgcgccttccgttggccaaatgtccgtggacattttgtcgcgtcattttggcctcacatgggaacagctgatggcacagtttgtgctgaagttgcaaattcgagagcgcgtcgacgacacggaagcagtgtttatggacattgaagaagcggaatgggacaccaaattggttgaacaccgaaccatttacaaagcgatgctttacccgaaattggaggaggaaaagaacagcgacggaaaatgtgacgtcaaagtgcccaagctccctgccgatgccgaacccttggccaaacgcgggggccaaattgtgttccgaatgaccaacttcaagtcattttccaagggctgtgggccaaagattgtgttcagcgaaccgtcggtgcccatcaacggaatgccgtggcgcattcgcgtcaaacactgcgacgagtgcgtccgagtcgatttgttctgtgccgccgaccaaaacgacatggcttggtcgtgccgtgccgcgttcactgtcggtgttctttcgtgcgccaacagcgatgtgtacgtgaagaa

SEQ ID NO: 85332 - DNA, 561 bp, Heterodera glycines
  misc_feature (518)..(518): n is a, c, g, or t
  SCN-specific regions: Sequence locations=1-1,60-64,86-298,320-342,364- 387,409-561
gaaaatttgattttatacaataaaaatattataatatttttgaataaaaatgaaaaattctttcctcttcctgcttcaaatttttattctaaccaacattttaactgaaatactttgtggagataagtcaaggccgtcgacggaaatcaatgccaatttgggaacaaggaaaaagcctgaaacaattacggcaacaaaaaatgccaatttgggaacaggaaaaatgcatgaaaccgatgggaccagcaaaatgccaaaacatggcaaacctgtgtcaaatcgaatggcagccaaaagcacgacgattaaaaataataatgaagcagcagggccaagccaacaatcaaaacaacctgcggcaaacattacgccacagcaaaaggggccaatgcaaaattcaaaaaagcagccaccaaacgaattgtttggcaagaagcaaaggtcaacccctgaagagatcaaagctggcaaacaaccagcaatggagctaatgccatgctatcgaggaatcggcaaanagacgatgccaacaattgcacagcgaaatgccaccatgctaaa

SEQ ID NO: 85333 - DNA, 555 bp, Heterodera glycines
  SCN-specific regions: Sequence locations=1-142,164-555
gggtcacaaaagacggcaccaccacggccagcagtcctccgttggtgccgcttgctcttccacccaatcctccgccccttcttcaagtcaatcggaacaggctgattcaacactccatccggaagagcggaaacgcattttgcatttgcatgcggaaaagaatcgccgttttgcgctgaaggaaggcttcgagtcgcttgtgaatgccattccggtagttgagcagacgggcgttaaatgcaccaatgcggtggtgctgaacagggcggcacagcacatcaaacaattgaagagcgaacaggatcagcagcagatgaagttgagggtgttgcgggagaagattaccaacatgaacgaacgaatcgccctaatccaatccaatttgccttcctcatcaaccggtggttcacggccttgtgaagctcagactcccagcatgcgcattcaagtggaacaattcttcgaacattacaaaaaggaacgttcccgtgaagattaccgcttttggctgatgggtgaggtgctcaagcctattgtgcattcgtttgccgaaca

SEQ ID NO: 85334 - DNA, 599 bp, Heterodera glycines
  SCN-specific regions: Sequence locations=1-1,60-64,86-298,320-342,364- 387,409-599
gaaaatttgattttatacaataaaaatattataatatttttgaataaaaatgaaaaattctttcctcttcctgcttcaaatttttattctaaccaacattttaactgaaatactttgtggagataagtcaaggccgtcgacggaaatcaatgccaatttgggaacaaggaaaaagcctgaaacaattacggcaacaaaaaatgccaatttgggaacaggaaaaatgcatgaaaccgatgggaccagcaaaatgccaaaacatggcaaacctgtgtcaaatcgaatggcagccaaaagcacgacgattaaaaataataatgaagcagcagggccaagccaacaatcaaaacaacctgcggcaaacattacgccacagcaaaaggggccaatgcaaaattcaaaaaagcagccaccaaacgaattgtttggcaagaagcaaaggtcaacccctgaagagatcaaagctggcaaacaaccagcaatggagctaatgccatgctatcgaggaatcggcaaaaagacgatgccaacaattgcacagcgaaatgccaccatgctaaaaaggggggacagtttgacacggagtgccgactttgagg

SEQ ID NO: 85335 - DNA, 686 bp, Heterodera glycines
  SCN-specific regions: Sequence locations=1-686
ggaattatttaataaacaaaaaaacaattaattaccgccaattgcccattagaagaaatgttcagctcttccaatttgtctgctctctttttggcctcctccgttttggccgtgcttataattggcattaaaatggacggaccgacggaggcaaaaggcgccgcccctccaaacgccgcggggccaatgggacttttgcttttattgaatggcaaacaatcggcggctaatgaaaagggaaaagcgccctctggcgaaagtaagccaaatccggggcagaagccgagcggagaacggcgaaagagggacgttttggggcacgccggcggatacgtcggaggatgggaccatcccattgactcgacacttgattgggcaaagagtcagtggaatgatgccaattggctcgccgatgttgtcaacagaaacggatgggaaaacaccggcactccaaccggcggacgatgaatcagtgaattgtgccgaccaaggaatgaaagacggcatttttgtttgggaatttaattgacttttcggaatcaaacacactttcctttttagttgcctatttattctaaattagcgttttttctgttcattttctacgcaaaacaaattttttacatattttttggttggggattatcccaatggtcccatttttcgcataaatatgaattgataaa

SEQ ID NO: 85336 - DNA, 634 bp, Heterodera glycines
  SCN-specific regions: Sequence locations=1-122,144-323,346-454,508-607
ggaggaaaatggtgaagaagaaacggcggcgacggagaaggcttcatcctttccacgccaaatgacggtggaccaattcaagcagtacatcaacaccacggataacaacacgggagaccaaggggatgccatggaggaggaggagttgacggaaacggcacgaaagcggtgcaaaatgatgccgatacgggaggatgaggaggagggcacagtgcctgaaatggaaactcaaactattgttcggcaacaaagcaaacgccaacaaagcctttggcagtccaattacgtacgcgtcgacgcgcatttgccgtccactgacacactgctgtttgtgccacccaatttgaacgtgtttgtcggcgcggaactgtactacgaccgtgaccaggacacctttgtgcatcgcatgggcattaaggagcgaaaatggggggaagacggacaaaactggacggatgaggacgatgatgatgatgaccataaccacgaccatgaccatgattacgaaacttcgtccgtctcctcctcgtcgtcaattggcgccacgagttcttcttcagcagtccgttcactacggggcagagacaatgcgtcacttccgcctgctttttgttgctgttggtgccaatgacaa

SEQ ID NO: 85337 - DNA, 564 bp, Heterodera glycines
  SCN-specific regions: Sequence locations=1-564
aagctgggcctgttttgtgccaccccggcggttccgttgtcgcgaaatgtgccaccaaaaattgcgcttgacatgctgctgactggacgtttcttggaagctaacattgcgcacaaatttggtctcgtgtcacgcctcgtcggcaccgcggagctccggcgcgagacgctcggcgccgcgcaacacatttgtgacaacagtcgtgcagtggtcggcatgggcaaggcgttcttctacgcacagctggagcagaacgagcgcgacgcgtacaggcaggcgacggcaacaatgtgtgacaatttgaagtggcgcgacgcgcaggagggcatttcggcattcatcacacgaccaaaacggcagccccagtggacgcacactgatcagagagtgatcaaggactgatcagagagaaagtgagagagagagagctatactgatttggaaattctcatcattgattgatcaaccggggtgattttgttgtgtttgagtgatcggaatggacgaaaaaccttattatactacggcttctttatattattataccaataaattgaagacaac

SEQ ID NO: 85338 - DNA, 571 bp, Heterodera glycines
  SCN-specific regions: Sequence locations=1-110,133-147,169-571
cgacattcctcggacgaaagagagtgcgaacgttgtgtggtcacttatttttgtggaaacttttcttttcacgggcgattcgcgtggccaattgagtatttacgacgcattgaatggaacacttttgaaattttttaaaacgcaccaagcggcagttctcaccattgccacgaacggtaaagaggtttttgctgcgggggcagattatcggatacaaatcgtaaaaagaatatcgcatgacaatgtccgtttcgagtggcaacaaagtggccagcgccttttccatgccaacgacgtgagggctatttgtgtgttggacaaacgattgcttgtttctggagggtccgactctgagcttttcatttctgataaattcactcatgcgaacccccagataaaatcagaatgcgctttcttcgtctcaaagtccaattgctatgtgattgtgagccaccatttgtctcatcttgacttatggtataaaacaatcggaggatctcttatggaccaaagaaagcgtttgaaactatttcttcgaattaccagtggcaaattagggtttatcaaacaa

SEQ ID NO: 85339 - DNA, 181 bp, Heterodera glycines
  SCN-specific regions: Sequence locations=1-148,170-181
attcgcatttaaacgaatcgatgcatttcttttcatttttcccgtgccaattgtctgtttcgatgtcaaattatgctccgctatttcgatacagttgcgattctgtccgctggagtgagtgaaagaaatgctaacgagaggagcggactggcttgaacagacgccttccgctttgtgcccc

SEQ ID NO: 85340 - DNA, 152 bp, Heterodera glycines
  SCN-specific regions: Sequence locations=1-152
cggcagtcggcctcgcggtaagcgaactgctcgcacttcgagtggcaaacgaacggagtcggtctcgagtacaatcatttgtttggctttggtgtgctctactccgtataaatggttctgatggcaaaggtgtataaaacggtaccgtcgcg

SEQ ID NO: 85341 - DNA, 548 bp, Heterodera glycines
  SCN-specific regions: Sequence locations=1-548
gttaaaatccgccggaactttgcccatcgaattggcccgcctttatgtggcggaaacggtgttggccatcgaatatttgcactcgtgtggcattgtgcacagggatttaaagccggacaatttgctaatcacttccatgggacacataaaactgacggatttcggcctctccaaaattgggcttatgaatcggactactttggtgtcggaaggttatctgctacaggacgacacgcagcagttcaaggacaaccaactttgcggaacgcccgaatacatcgcaccggaagtgattttacgacagggatacggaaaaccggtggattggtgggcacttggcgtcattctctacgagtttttggttggaattgtgccttttatgggagatacgccggaggcgttatttgccaacataattaatgaagacgtggaatacccggagggggacgaggcattggattcggatgctgagtcgttgattcatcttttgctggagaacaatccgctggaccgactcggcaccgtcggcggtgctccccaagtgtccg

SEQ ID NO: 85342 - DNA, 247 bp, Heterodera glycines
  SCN-specific regions: Sequence locations=1-71,94-113,146-221
aagaataatgccgaaaatggggaggaggacaaagggacgacaaaaaacaatgccgaaaatggggaggaggacaaagagacgacaaagaataatgccgaaaatggggaggaggacaaagagacgacaaagaataatgtctaaaatggagaagacatgcaagatgagtgatgccgaaaacgataaattgctactgaatttcccgttaaacactgtcattccgtaaaaaaaaaaaaaaaaaaaaaaaaaa

SEQ ID NO: 85343 - DNA, 561 bp, Heterodera glycines
  SCN-specific regions: Sequence locations=1-40,65-99,121-320,342-561
actcaaattttcgggctttcattgcatttacaggaacttaagcattttgatggacaaaatggcaaattaattggcaatgacagcgacgagtcattggaatcattggtttcatttatttctaaaaatggctttggtctcataaacgacgaacggagaacaaaaattgatcaggcaattcaagaaatagaacaaattgttaagaaatggaatcgcaaagcgaaaattattgtcatgggttcctaccaattgggcgcactcaccaaacaatcagacatcgatgccatttgtgttgtgcccgaattacgcacttggagagcggcaaaattttttgggaaggcaaagtgccaaattcaatggaacgggttcagaaggtgcgcggatgattcactgttttgccacttttgtttggcggcccaagtaacggggctcaatcggatccaagacgcgtgggtgccgctgattaaattcaaattcgaaatcgacccgaaaacttccgtcgattttgacattggactagaaacatttgcaatccatgacgacatttttaaatccgaagagcca

SEQ ID NO: 85344 - DNA, 557 bp, Heterodera glycines
  SCN-specific regions: Sequence locations=1-557
aaagcgcagaatttggccatggaagcggccaatttaacagacgccactgaacaaacgatggctggggccacagaaacgaaaagtgcgctggacactctcagcagcgaattggactccgttttgaccacaacaaaggattttgagaaccaagcaatttccgacgcggaacgttccaacgaagtcgcgaaaaaagcgactctctccgaagcgactgcaaattcactgcaggaaaagctgagtgactcggacacaaaacttacggaagcattggcccaactcagtcaattgatttgcgtttgttttgtcgaaattttatttttattttaggttccttagacaatgtggacgatgcgcaattggacaccgtggagaaactgctgaaagaagcggaaaatcgtttcgattcgagcggcgacgaagtgaaaatgcgagaacggatcatacaagcggagaccaaagcggtgaagcagaagagggaaatcgatacattggcaaaagagttggagaatttgcgtcaaatcagagattcattgccgactcgctgctacaattatgta

SEQ ID NO: 85345 - DNA, 567 bp, Heterodera glycines
  SCN-specific regions: Sequence locations=1-23,113-113,170-201,225 -338,412-446,481-522
agccaaatgcctcgtcggctaactaccgacgcgcacgaatggatcaacgagattcccactgtccctatctactatctagcgaaaccacagccaagggaacgggcttggcaaatttagcggggaaagaagaccctgttgagcttgactctagtctgactttgtgaagaatcatgagaggtgtagcataagtgggagccgcaaggcgccagtgaaataccactactttcatcgattccttacttaatcggtaaaacgggagtgcgcccgaaagggtgtccattttggtgttaagtcgggccacccggtggcccggcgacccgcgccgatgacagtgtcaggcggggagtttgactggggcggtacatctgtcaaagcgtaacgcaggtgtcctaaggcgagctcagagaggacggaaacctctcgtagagcaaaaaggcaaatgcttacttgatcctgattttcagtacgaatacggaccgcgaaagcgtggcttatcgatccttttgaatgtgtaaagtttccagcaagaggtgtcagaaaagttaccacagggataactggcttgtg

SEQ ID NO: 85346 - DNA, 393 bp, Heterodera glycines
  SCN-specific regions: Sequence locations=1-393
gagttcaacctgctctaccacctggacactgtctatgtgattgacctcgcccaagccatggacatttctcatccgtcctcgctgcgcttcctccaccgggacatcacgaatgttttgaacttttttggtcgcattggctgtgagccgttgcccacgccgcacgcattcttccacggaagtgaccgacattgagttcgacccgaacaaaaatttgtatgttcaggtggagtctttcgagcgcgagaatcggaacatggacttgaagggggcgaaggcgtcgccagcaaattatgaactccatttacaccagcaggagagcacaggccgagcggactcgccttcacggccttacaattgaacacgaaacgatgaacataaatgaaaactgtgaga

SEQ ID NO: 85347 - DNA, 649 bp, Heterodera glycines
  SCN-specific regions: Sequence locations=1-649
gatcgcaagttgacccgttcgggtgttctacaacctctacgttcaagcccatcatcccgtacgcgggacagcgaagattcccgagtttattttcccatgtaacgaagtgtgtgctaccaacgaggagttggatgcatttatcaacggactttgtcactcatgacaaattgtgaaggcggcgacgtcactgccggtccccgtttaccaggcccacgaacttgcgaagcgtggaaggtccaattacatggagctgaggagaatggcgcccgaacgaattccacggagtgctgacggacaagtgatgtgcgaacaattatccgagttgctctcttacaacgacagtcctctcagagaatcgcgaacaacggcttaatccaaaaatcagataatgaaactgatggactaatattataaaagcagtaacaattttaaataacaacaacatcgaaaaagaaaaagtaaacggagggacaaatcatttattattggagaattggcagaatttggaaattgaaatacactcatttataagctaaataatttattttgtggtcatctcacgcctcattaccattcccagttcctttcaccattccctttcctttgaccgattctgtcttattgtacctgatccctttgtctttattta

SEQ ID NO: 85348 - DNA, 610 bp, Heterodera glycines
  SCN-specific regions: Sequence locations=1-610
agatcagaatgttcaacaagcgtggcgaggagcacggcacggtgacatgtcggataaacgaccgcgagaacttcgaggtgacaaccctccgcgtggacgtggtgtgcgacggacggagggcgaaggtcaacttcaccaccgactgggagttggacgccttccgcagggacttgaccatcaactcgctcttccttggcctcgacgggctcatctacgattacaccggtggcatcgaagacgtcaaacagcggcgcatcatttttgtcggtgaccccatccaaaggcttcaggaggattatttgcgtattttgcgatactttcgcttcttcggccgtttctccaaattggacgcgccccatgaacagaaaaatttggaagcgatcgtccgttgccgagatgggctcaaaggtgtcagtggtgagcgaatttggatggaattgcatcaaatccttgtggggcggttggctgcccccgtgctgcgctgtatgttggtcgattgtggcctcggtcccctcctcgcacttcgccccgatcgagtggatgaattcgagagggtttcgcgtctgaatgcccccaacggcgacgacgggaaattgagtattgagccgag

SEQ ID NO: 85349 - DNA, 569 bp, Heterodera glycines
  SCN-specific regions: Sequence locations=1-40,65-99,121-320,342-569
actcaaattttcgggctttcattgcatttacaggaacttaagcattttgatggacaaaatggcaaattaattggcaatgacagcgacgagtcattggaatcattggtttcatttatttctaaaaatggctttggtctcataaacgacgaacggagaacaaaaattgatcaggcaattcaagaaatagaacaaattgttaagaaatggaatcgcaaagcgaaaattattgtcatgggttcctaccaattgggcgcactcaccaaacaatcagacatcgatgccatttgtgttgtgcccgaattacgcacttggagagcggcaaaattttttgggaaggcaaagtgccaaattcaatggaacgggttcagaaggtgcgcggatgattcactgttttgccacttttgtttggcggcccaagtaacggggctcaatcggatccaagacgcgtgggtgccgctgattaaattcaaattcgaaatcgacccgaaaacttccgtcgattttgacattggactagaaacatttgcaatccatgacgacatttttaaatccgaagagccaataaaata

SEQ ID NO: 85350 - DNA, 528 bp, Heterodera glycines
  SCN-specific regions: Sequence locations=1-528
atttggcgccacggcaacgcaaaatgaggctgaatgtggacccgaaacaacttctgcccaatttgcccaaccccaaagacttacagccttttcctactactttggcattttatctccggggccactcgggccaagtgcgtacactggcagtcgaacctgaaattggcgaacttttagtgtctggcggagcggactctacggtccgcgtttggctgttgcccagtggcaagtgccttcggctcttcgaaatgccagcctcggtcacttgcgttgcgttctgtcccaactccaaccgaacactcactttggtctcttgtgagtccgacttggtcactgtgcttaacattcaaagtggcgatcggttggccgtgtccaacacgcgccaattcatcgccggaattccttttggcactgagaacaccgctggcgttctatggacacacattcacagcaaaacgatgaatggaatccgaataaaaatgaacgacaaaatccgaagtctttgttggcacaaaagtggcgattatt

SEQ ID NO: 85351 - DNA, 594 bp, Heterodera glycines
  SCN-specific regions: Sequence locations=1-564,586-594
gacacgtagttgtccaataagaaaatatttgaaaagatgggaatacatcctttctggaacattggtgtactgcgaaagaccgatgataaatcattaatgaatggacagttggcgttaaaggggtgtgaaatctttgtactttatttcggcgctcacatgtgtcagcgatgtcgtgaatttataccggtgctcaaacaattctacgatcagttgaaaaaatctcccgaaacaatgccttttgaaattgtttttgtgccctttgaccgttccgaggatgaattccgcaactctttgcgcgatttgcacgacgattggctgtacattccctatgggagtgttcacattaactcattggccgcgaggtttaacatcattaattggggagtcattccgacattggttgtgcttaaggaggacggcactttgataaccatggctggacaagcaaatgttcagcatttgtcggcatcagaagcaatggtccgctggcgctctattcctaatcccgaatccggattcaaagatttttcgaaattttaaatttccatatcttttttgttaatgttgctaaagcattggtttgatgtgtacaac

SEQ ID NO: 85352 - DNA, 588 bp, Heterodera glycines
  SCN-specific regions: Sequence locations=1-249,271-588
gggtcaacgcggacgaactgaagaaattcccgtcacttacggatgcgtttaagaagaagaggggcaacatactcaatttcgaggaagaggaatttgacgagatcatcagcaatggcaccagcaagcgcgacaacagtccgtacaccgaccacgactacgcaggcacgcgccaattggcgacggcgaagggagcgaccggcaaacaccaacggcagaagggcggcggagggacggcgaaagagccgaaaaagaaaacggcacttgtcaatgggaccgattcggtggtccgttcatcggcacggccgcaccgtccgaccaaacgttttgtagaggaaacaaacgaatcattcattcgtgggacttcgaaagtgcgccgaacatcgccacgcaaacatggcaagaaatcgactgcggagggaggaagcgaaggggaagaatcggaggatgacgggaaggagtacagcgtggaaaaagtgttcaagaagcgtgtgaagggtggaaaaatggaatactttgtcaaatgggctgggtatgacgacggttggaacacttgggaaccgcgtaagagcttgaaacatttggaagtgt

SEQ ID NO: 85353 - DNA, 504 bp, Heterodera glycines
  SCN-specific regions: Sequence locations=1-313,336-467,502-504
acggagcaaaactcttcgagaaagtgctaaacgaattcgatttcgcccgtcgcgctgagtgggaattggtccaaactctctttggcattgcctccgacaggacaatactttttcccgacgatcagattcgcctttttatcggctgtcctcagaatagcgatgcgtacaaatttctttgttcgattttcgtcgatggaagctccgaaggaataaattacggaacaacgtccacttcagtgcttctggtagacattgaagggacggccgtttttcatgaaagacgtttggtcaacccacaaagtccgatggacgacccccaaaaatggaaattctcccgggaacggttcaccatttgctattaaagaaggtcggcgtcctccgtcggtcgtttatatgtcatttatttcaggccaatgttgcacttttcgcttattcattttgtttcggttatttgtcaattgtttttgtaaatattttttttattaaaaataaattttaaatgcg

SEQ ID NO: 85354 - DNA, 657 bp, Heterodera glycines
  SCN-specific regions: Sequence locations=1-585,607-624,655-657
gtggacattttgtcgttcggcgcctccaaaaacggctgttggtgtgccgaggccattctcgtgttcaacgacttgcagcaggctcacaaagactttcccttcctgcgcaaaagggccgcccatttgttctccaaaacgcggttcatcgccgcccaattcgaggcgtatttccacgactcactttggctgcgcaatgctcggcatgccaacaagatggcttcccatttgacttcggcaattcgttcgttggatccgtcggtgattcgtttggcatggaccccccaggccaacgaagttttcgttgtgatgcgtcgttcagttgccgaaacattgcgcaaaagtggcgaaatttcgcatttttatgagtggaatgttccggacggagagcgacgcgagttgaagctgtacacggaggagggactgttccgtttggtcaccacatttgccaccaaagaagctgaagtggacgagttcgcttctcttctgaaggcgcattatttgggaaaatcggagcaaatgcgaagcatcgcttaacagcagaagagagtgaaaaagacagcaaacgcaacacaattgggacacaacaaacaataaaattgtacatttatttcccgcatcgttatcaaaattaataacattaaaataaaaataaatggc

SEQ ID NO: 85355 - DNA, 506 bp, Heterodera glycines
  SCN-specific regions: Sequence locations=1-165,189-262,284-321,343-506
tacaagaccggactgcgtgacgccgtgccgattgccgccttctggaagaagttctccgctttcgtcatgatgccactttgcggatggaaggaccatcagaatgtgcaccattctccacgccctgagtacgtcgcatacgaatatttggccacgcgtcgaaagcctttcccctggggcgacggcaaccattctttattgcacaacccggccactaattgggtgcctggcgttggctacgaagccccgtggcccggcgatgcgcacaaaaaggagggggacagcggcggcgaggggaagaagcactgagcggcgcccactgaccgatggatgatgaaatgaatggcacggcacgcacacgatttttttcatttgtcggctaatttaggcgcttccccccccacgacgatgtagaaaattatggtggagcgacacagttagggttctcatgaaaatgtgtcttctttgttagagaatgtggataaacaacatacaacagcaaaaaaaaa

SEQ ID NO: 85356 - DNA, 115 bp, Heterodera glycines
  SCN-specific regions: Sequence locations=57-115
ttttttttttttttttttttttttttaaaaattttaaaatttttttgaattttttactttgcaacaattggttttttatttttaaaaaaaggttggttttttttttttttttggt

SEQ ID NO: 85357 - DNA, 549 bp, Heterodera glycines
  SCN-specific regions: Sequence locations=1-64,86-164,194-549
actgaaacggcgatgagaaagcaacaggagacaaattatacaggtgctccttccgctcatccgtcttccccttgctcttcctctttgcttcccccgcccgtctcgtctctctccgtcccattgcatcaccgatccagcatttctggtggcgggtcccgcccaattgtcattcggaaagggccccaaggcttcggattttccatacgatccgtccgcgtttatttgagcgaaatgtccgagtattactccattgaacatattgtggccgctgtgcgcgagggttcgcccgcttgggaagccggtctccggacaaacgatttaatcacgcgcgtgcacgcccaatcggtccacaacatgactcaccccgaaatgatgcgccgtctcctctcctgcggcaatgaactcactgtccatgtcgttccattgtccagcacctccataaaagagggcgaaccgcgtcgaaacattggcaaacccttgcgcaagaagccgcgacggccgccaaccgcacaacagaaaaacaaacaacagagtcgcaaaggttctgca

SEQ ID NO: 85358 - DNA, 601 bp, Heterodera glycines
  SCN-specific regions: Sequence locations=1-440,463-601
ctgtgactggattttacacacagatacgtgctcctccaaatcccaatgttcagaaggataaaaagggaggtgagtcgttcatcctcatggaccaaataatcggtgtttcttgggcaaccaaaccttacatgttgctccaaaggccgttgacaatcgtcctgaaatttcgtcattttcgtgatgaaagaatatgtcaattgccttattggaagaaatccgatggaatttcccaggaaatttacaaccattggttgaatgatatgcgacaatgggatgaggaatatccttctttggaattcatcgagaaaaagtccaaagagttggtcaccgttttgtccgaacctcccagaggaccgccagtcgatgtcatcagattggctacaatcgaagcagagagagaaaattcgactaaactgctgaaaaaactaaaagaatggcaagaagaacaaaaagttggaaatgcaatgcatcagccttttccgtcacctcgtcaacccttttaccctccctctcgtcctattcgattcccgcattggccatttcatcatgatccttcacggccaagaccgcacttgatgtatgggaggtcagtgggttacca

SEQ ID NO: 85359 - DNA, 640 bp, Heterodera glycines
  SCN-specific regions: Sequence locations=1-314,336-640
caatttaccgatggatcaccgtcaagaatttgaatgtgatgaactttgacaacgatttggacaacgataccccaatgggactattgagaggcatcaaatacggtaccgaaagttaccacgtgttgttcaaacggctgtgcagttacgccggcctccactgtgtggtgattaaggggttcagcaaatccgccggatatcagcccggacttggcttcgacgacagccgcttcagaaacacatggaacgcggtttttttggacggttcttgacgatttgtgcaatgcaattggggcgcaagacatttggtgaacgccaaagaaaatgccagaggcaaaagatcaatgacggtacaaaacggacacgaaaaagacggcaacggagcagtgggcagtaatttgcgatatgaatacgacgaccattacttcatgaccgacccggaagagatgatctacgaattcttcccggatgagtcccaatggcaactccttccgcggcccgtctctctgaagcaattcgaacagtttcccttcgtccgttcgctgttcttccgctacggcctccgcttcagtgacccgcggttgtcagcggttgtccgcgcggacaaaacgggcgcagtgtcaattgccatcgctttgggtgc

SEQ ID NO: 85360 - DNA, 655 bp, Heterodera glycines
  SCN-specific regions: Sequence locations=1-655
agcaccgaaattggtcgaaaatgacaaagtgacactttttgtgaagggaaagaaatgttcagtgatgctcaacaaaatacttggcgaactttaccaactgaagaagccattggccaatcgactgcaacgaaataatgacagccatccctttgaggatgattcgttattgtgcagattttctcacaaatttgacgcttctttatttgtcttcgggtccagcacaaagaaacggccgaattcattgctttttggcagaatgtacgaccatcaaatgttggatatggtcgaattgcaagtggagaattttgtctctagcgacgaatttaaacaagtcaaaagcgtaactttggggtcgaagccatgcatcattttgcaaggtcacctttttgagtctaacggaatacttcaacggattggcaatttaatggtggatttgtttcgtggccccaaagtggagtacttacggcttcaaggcaccgaattgataatttcattgacagcagtttccgaagagcggattaaattcagagtttacagagcatccctaaagaaggacatggaatctgcgaccccaaaaatagaattggttgaaatgggaccgaatattgacttcaaaatcgacaggacgaaattggcaagcgattcgctcttcaaa

SEQ ID NO: 85361 - DNA, 515 bp, Heterodera glycines
  SCN-specific regions: Sequence locations=1-69,91-515
gacttctaaattaactctaattaccactcattagtgctaatgatgctgatcaaatttgctttgccgctcctctttgtgcttctccatcccttcgtttgttcggctgccgaggaaaatgccggcgctgccgatttccctcaacaattttatggcgccttcaaattggaccacagcgacaattgggacgattatttgattgccaaagggtacagtgaccctgagatgcgcaagaaagtggagctgcccaggttcacacgcattttgtaccgtttcccgaacggcacttatcggatgatggtcggcacggggctcgagggcagcaaatgggtgaaggggtccaagaagaacgccgattggcagttcaagcctaacgagccgttcattggcaattattgggacggctccaaacacgaaatcactttcacgtacgacccgaaagagagtcggctgacggaacggcacgtcaaagtggacggcaccggcacgccggaggagttcaactacaaaattgacca

SEQ ID NO: 85362 - DNA, 616 bp, Heterodera glycines
  SCN-specific regions: Sequence locations=1-445,468-616
atctttcgattgcggacagagaagcagcggagaaagaggtttccgacaataagacgctttctttgttgatgagtttatttgagaagaagcgggtgatgaataactctttgcccgaaaatacatcgaacagttcggcggacgatgtttatggcggcgtctccgccattgaatatctttcgagaagagtgggcaactgtcacattgggaaacggagtgaggagcaaataaaatccaacgcattcaatgcaagcctttggctttccgaaacttttcctcttaaattgcatgaacaaatttttccggttatcgatttgttggccgttcggaatacaaaattttcaagactgaagagctttattcaattgcaattgccttccggctttcctattagggtcaaaattccgattttccacctaatcaatgcacaaattacatttcggaatgtcaatgatccgaaagaagaagctattgaacggattgccgaacactctgaggacgatgggccacaaatgttgcaacttcgccagtcacttttccaaatccccgatggatttgaacgttgtgaattatcaggctcttttctgtttaatcgagctggcgaattcgagaggacaca

SEQ ID NO: 85363 - DNA, 533 bp, Heterodera glycines
  SCN-specific regions: Sequence locations=1-187,209-533
atgtgcagtttgagaatcgtcagaagcgagctcggccgacctctgagggcctttttttcacaacactttgccatcggtggcttcgttgttggaatcggacgacgatttgctaagagtggacataaaggaagagaagttttacgtgtcggaggaggtcactcagacgcacctcttctgtctgagcaagaatttgtgctccaatttgttccgtcttttgcgtcgctgcagctccaacaatgccatccgcgtccagcatttgcttgaaatctcttcccaattggtgcccatcggcgcccccatgcccaactccaacgctttggtcgacctgtgcaatcgcttcccgaccattttcaaattgcgttgttcgcctcaagacaattatcgctttgacaattcggtgattatgctcaacgaacagttgctggacagcgagaatttggcgtggcgcgtcgttttggacactgacgaattttaaagggtgaattggcgaagaagcggactctgaccaaatttgccataaaatctttttgttg

SEQ ID NO: 85364 - DNA, 578 bp, Heterodera glycines
  SCN-specific regions: Sequence locations=1-48,70-115,137-203,225 -319,342-501,524-539,568-578
gatccaaaccaacgcggcacagtaataaaatattaaaagatccgaaaaaatgccaaacattttcaaaatccttctgattgtgcttttggccgtcgtctcattccgtctctcggcttctactggtgacaaattttctgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaacttttt

SEQ ID NO: 85365 - DNA, 624 bp, Heterodera glycines
  SCN-specific regions: Sequence locations=1-31,53-164,308-404,437-624
gataatacttaatctcttttaatattcctgcattaaacaaattctgtcaaattgagcattttatttgaaaaaatcgtaatattttaaaagaatggatttgaaattatgcctattattcaatttaattatatttttgatcatccaaactgatcaaattgcctcagaaaataaaaattggaacaaaaatcatttggagaaatatttggagaaaaatgggaagaaaaaagaaacgaagaacagaaaaaaaagagaaataagtggaaaattctataaaataaaagaaaaaataaaacaaaaaggaaaaaaatattcgaatagagaatggagtaaaattgaaggaaaaatagcgaaaaaattaggcataaatcgcaataatatttatgaatggatcaaaaaaattggattaaatcaaagaataaataaatgttataaaatacgaagaaaacttttaacattgtctaaataatttttttatgaaatgaaaaaaagtcttcaccgggaaaatttgaaaaaaaaatagttgaacgcagaaaattggcggaattctttatttgttttttgtctaaagctaagagttttcggagtcgcgaaaagcgcaatttccgcacagcccaagcaataatg

SEQ ID NO: 85366 - DNA, 549 bp, Heterodera glycines
  SCN-specific regions: Sequence locations=1-319,342-549
acgcacagaacacaaagccatggtccttcccttatgagcagccattcgtcgcgccggagaagcttttctgcgtgttggacatggacgagggccaattggccttcgccaccgactccaaatatttgggcgtcgccttccgcggcctcaaaggcaaaaaactgtacccggccgtcagtgcggtgtggggacactgcgaaatcactctcagatatttgggcggactcaatccggacagtcaattgatggacacttgtcggaggtcaattcgggttcgcgtaggcaaggagcgagtcgatcgtattggagaactgaaccttccgcctaatctcatcaaataccttcattacaaataaccatgaacgacgacactttccttaccaccaatgtttcctgttccttttttcctatttccttattcattttcacttaatttttctgttgctttagcctccattttctcctcttcctgaaccatttgatctcgttattccactgctttcttgtcaaatgctacttgtgataagtcagaaaataaaacattcattccaa

SEQ ID NO: 85367 - DNA, 295 bp, Heterodera glycines
  SCN-specific regions: Sequence locations=1-218
agcgtgccaagtgccgaaatcccgcaaattcgtcctccattttccaatatgtgcaccaccccaatccgccgccgccgcgtaaatgatcattaacaaacctttggcatttcattttgtcgcgtatttctctcttatatctctatttacctgttggttcatctctcgtttttttcggactgacgtgtttttatggtgtaagaataaaatgcaattttcttaaaaaaaaaaaaaaaaaaaaaaaaaaaaaaaaaaaaaaaaaaaaaaaaaaaaaaaaaaaaaaaaaaaaaaaaaaaac

SEQ ID NO: 85368 - DNA, 429 bp, Heterodera glycines
  SCN-specific regions: Sequence locations=51-76,99-242,357-429
tattcttgagacagccaattcaaaggcagtgaaaaaagacaataagaaaggaacagttgcaacgccagcaaaaggaaaagcggcgccgaaaggagcagcgaaaggaggaattaaaaaagacgcaaaatcaaagggaaaaggaaaaaaggacgccaaaggcaaaaaggacaaaaaagctaagccagtcaaagggaaaggagtgcctaaaaatgacaaaaaatccccagcggcaaaagccaatcacaaaaagagcccaaccaaaccaatggcagcagtgaaagccgtgccaaaggcggcggagaatgctcagaagggaccgtcgagtgcggaagtggtggcggaggaaaacaacttgggcactgaggcggtcgacaacttgggggcggaagagtcggactttgaccaattggcagagggcgaactgctcga

SEQ ID NO: 85369 - DNA, 390 bp, Heterodera glycines
  SCN-specific regions: Sequence locations=1-281,303-390
gaaccgcgtggcggaacgcgcggcggcccgtgtgtacgggtggcttccggaagacaagcagcctaaggcgatctatgacgcggcggagaaggcaaagaacacgcccaaaccgccgggcgactacgacgtggagcgcgtggcgcaaaaggcggcacggctcgtctacggtgtgctgcccatcggctttcagcccaacttcgccggccctagcacgaactagggtagatacgaaaaattgttgtgaattttttcacgacaattttgcaaaaagataggcctgtaaaatatttgggaattgattttatgatatgttttcaaagggtatgtgataaactttgtgtcatgctttgtaattaaacttactttattaaacccatcaaatttttaaac

SEQ ID NO: 85370 - DNA, 582 bp, Heterodera glycines
  SCN-specific regions: Sequence locations=1-582
gacattttttctctctctctcggtacctccacatcctaaagtcgatcccatcaaaactgtcccctcaccgaaacccggaaaagtatccctaattcctataaaaacaaatggctaatatgaaatacttgccgcctgaacttttggacgaaatggctttttacgtatatcctaaccaacgtttttctaaaattctgacttcttcctggctactcttggaatttttgatgccccgtatcaaaagatggaaagaaatattgaaattaagccgttccgaggtcattaaaaagcacaaattggccaaagacgatctcccttggaccaattttgtcacggtggcaaaaaaaagacagtgtctgcactgattttcttaacacgttcaccgaactgtttaaagaggaagatttttataactcgatcgacggaagtatgttgaatttgttgctttcaaatctccgcgagctttacccccgtgttaaacaaacatgtgcgtggttggatcttttaatccaagccaaactctttccggcgactatgcttctgattgaagaactttgcaagttcatcgaatcgccgggtctttat

SEQ ID NO: 85371 - DNA, 428 bp, Heterodera glycines
  SCN-specific regions: Sequence locations=1-428
atgatccggcggaaacgttttacggtccacccggcggtgaacagaccattgacggagttgcggtgccttggtcttctccgggggacttcgataagctgacaaaagtgcacaatttgcggcacaacaaatccactcgcgttctcggaagcgtgcacgggctatgaagtttttgagcacaaagttttgctgggcgattggtcccggggccgagcttatgcccgcgacattctcaacgatttgcgcacttgggtggtcggatggactgactggaatatgtgtttggatttggagggcgggcccaatttggcacggaattttgttgactctccgatcattgtgaatgccagtgctggcgagttctacaagcagccaatgttttatgcgatggcacattttagtcgctttgtcccgcgcgattcatcagtcat

SEQ ID NO: 85372 - DNA, 581 bp, Heterodera glycines
  SCN-specific regions: Sequence locations=1-14,36-89,111-144,166-581
atatcacattttcatttaaattatcctcccaaaatgcgtaccattctcttcatggccatggtttgcttggtgatggctgtcctaatggaaatggcaaattcaaaagtagtcaaaaaagacaataaaaaagcagcagtggcggcatctccagcaaaaggaaaagcatcgccaaaaggaggcaaaagcccagcaaaaggaaaagcggcaaaagttagtaaaaaagataacaaattgaaagcaaagaaagaaaccaaaggcattaaagttaaaaatgcaaagccaacaaaaaaaggtaaatcggcaaaaggcgcatcaaaaacagccaagaaagtccaagccgccaaaaaagcaccaggaaaggacaaaaagtcgctagttaagccaatcgtccttaaagcaccggtaccaccccataaaatgcacccgatgattgaatccgaagctgtgccaccgcccgcccatgcgcgttcgcttgcgaccgttccttacagtacaccgggggcagccgaccgtaactcattgccatcgtacacttcgactgccaccaatttggacatggccgatgataatgatgattatca

SEQ ID NO: 85373 - DNA, 529 bp, Heterodera glycines
  SCN-specific regions: Sequence locations=1-483,505-529
gagagcgaccattgccattgccacgcataaagcggaaatgcattcggcacttcagcaaaaggaccaggaaatcgagggatggatagaaaagtgccattccatggagaaacgggataccgattcaaatacactctggcaggaaaaggtggacacacttcaaaaagccatcgtggcattggaacatgagaaggcggacatggtggagaaactgtcgcaagccaaacaggagggagtcaaattggtaaaagaaagcgaggagaaacggcatggcgaaattctaactgaacaattgaagaaaaaggatgaagaatggagtcgtcgcgttaaagaattggaggaacaaatgcaattggcggtggaagaaagtgaccttcaaagaaagacgagtgttactggccacgaaagggaactttcgaatttgagaggacgagttgcagaattggaaaaggaaaatacacaaattttacaacaattttgtggacaaaaggaagaattagagcaaatgaagcgaaaagaattgacggaaacg

SEQ ID NO: 85374 - DNA, 450 bp, Heterodera glycines
  misc_feature (422)..(422): n is a, c, g, or t
  misc_feature (425)..(426): n is a, c, g, or t
  SCN-specific regions: Sequence locations=1-34,56-423
ggtcacatttttgctagaagagctgatcgagaataaccaatgttgttgtcagcaaatttccggcatcttcatttattgagaattttcaatcgaattgtccgattgtctcctcgctgtgtctgtcagacgacggaattattctccgaacggtttctttcaacgtctttccttttattacaaaaacgttctacgcctaagcctactggacctgtccgtcgagttcccgctgttagcatcggaagtgatgtgcgacaaaagcattcggaaagaaccgcaggaaaaggtgatggaacaaatggattctggcaaccatggaatgcttcggatgattacagtgaaattaaaaaacgtcttttgcgtcctccgaatgatttctccgagctcagggaaattatacgcaaagacattgaaagaatggcccngannaaaaaaaaaaaaaacaaaaaaaaa

SEQ ID NO: 85375 - DNA, 439 bp, Heterodera glycines
  misc_feature (406)..(406): n is a, c, g, or t
  SCN-specific regions: Sequence locations=1-439
gggattgtcaatttgttgaacggtgatcagaacaaagatgaatttttgtccaaacttccgttcgccaaagtcccagtgtttgtccatgacaatttagtgctgtccgaaagtatggcaatcattgaatatttggacgaaaaattccccgaacccaaccctttgttcccaaaaagtgccgaagatcgtgcacacgtgcgggcacttgcgcttcaaattgtcgcaaatacgcaaccgctacaaaatttgggtgttctcaagcacctttctgaagagccggccaaacgaaatgcctgtgctcgtcattggatcgagcagtcattcaatgtttttgagaaagcattggccaaaacggcaggcaaatatgcctacggggatcagatcagtttggccgacatttgcattccgncacaagtgtataacgcaaagcgctttggcgtcg

SEQ ID NO: 85376 - DNA, 405 bp, Heterodera glycines
  SCN-specific regions: Sequence locations=1-405
gggcgcaacggttggagccaaaaaacaatcaaccgcacaacaccaaggcgaacagcaacaaaaacaggctcaacaagtacaacaacaaccgttgaaaaatgccaaattgcaaattgtcaacaatcggcggatggcacggctggcccacgctgacgacgaatcggccgaccaattggctgcccgggaggactgggcccattttgaaatggttgagcgtcagctggacgaactgcttgaacatcatgcggacaagttggacgaggagggtgatgtgctcggcgttgacatggtggcggaaccgctcaacgagcccgacatctccgagatggagaccggcgatgagacggcttctcgaccgatcaaccgattccgcccaattttgtacacggagggcgagctggacaa

SEQ ID NO: 85377 - DNA, 341 bp, Heterodera glycines
  SCN-specific regions: Sequence locations=26-341
tttttttttttttttttttttttttaaaaactatttatttattcattgttaattaagaccaataagtgaaaattataccgaaacactaaaccatactaaacatacagatacaataattagtaattatcccaattcaattttcataatatttcatccttcattgagagcaaagtcccgtggctttgtcacatttgtcatttgctttgcatttgctgcacggctccccggccaaatagacaggcgcaccaaagtaattaccacccgtgtaataccagcagaccacatatgttttccaattggtatttgggcagttttgtgccatggcacagccaattcggtcg

SEQ ID NO: 85378 - DNA, 127 bp, Heterodera glycines
  SCN-specific regions: Sequence locations=1-51,78-79,117-127
tttattctttgagcgatggtcctttcatacataacctccggatcactatgacctgctttcgcacctgctcgacttgtcggtctcgcagttaagcacgcttatgccattgcactatcagcacgatttc

SEQ ID NO: 85379 - DNA, 379 bp, Heterodera glycines
  SCN-specific regions: Sequence locations=28-379
tttttttttttttttttttttttttttgatgaacacattttaacatgataaatattattattaaatagaacacgggaatggcatcagatttaacgaaatcattcattgaggggcggagcattggcatttccgtttttattcggaaatgacgggacgaagggaccattctgttgttgtggaatgtgaggcgatcgcagtgggggcggaatgttgtgagatttcatgaaggagcacacctgatcaggcagttcggacagcacttccttggccagggcggacttgaggtactcttgacaaagagcagaagacgcattttgggtccaatcggttcccaaaaagaattcgcggaaagggacaaattggacaatgtctctgacgg

SEQ ID NO: 85380 - DNA, 321 bp, Heterodera glycines
  SCN-specific regions: Sequence locations=27-32,143-232,257-321
ttttttttttttttttttttttttttggtgcttcctcttttctcatcatcttccgttttctttttctcgttttcttttcttctccccgcttcctgctctctggtgctttcctttttttcttttccactctcttcccttttctcactgtcttccccgatctgatcaatcggcttctctggctttgggtgcttcttattgggcacatcctccgccgctatttcatttctttgcgcttcttcttcttccttttttgagatgccaccggcttcaccggtttcaccggcttcaccaccactgatcacacttcccaagcccatcacg

SEQ ID NO: 85381 - DNA, 451 bp, Heterodera glycines
  misc_feature (450)..(450): n is a, c, g, or t
  SCN-specific regions: Sequence locations=1-32,54-451
gggacttacagttggatccgtcaattttcaaggagagccaaccacaaatcatcatgcctgaaggttatgagtctggtcggggaaaatttgagttcgctctcggttacatcggttgttcggttatcggaggattcggagttggaagtgttcgtggaatgttcggcgagttaggaaatccacagaacagaactttggcttggaatccgtggtacactcggatgctgaatgccgccactaagcatggcagcggatacgcacaaactgctgggactgccatgtttctctattcggtcactgagttggggctgaagctgtcacgagccgatgacttgcttaattcttttatcgccggaccaatcgctggcggacttttccgcggattgcctcatgggctgcgtgctggcggtgttggtgcattggccggactgggtttggtcaccgtctggaatnt

SEQ ID NO: 85382 - DNA, 327 bp, Heterodera glycines
  SCN-specific regions: Sequence locations=26-327
tttttttttttttttttttttttttcatggaaaagtaatttattaaaataaacacgaacaaaaagaagtattttatcgaattcgtttaatgcgttcgtttgctgaactgccatctttctttccaatttgcgcaaagtcttcctttgaaaaaactgaagagcattgtttcgttttgcggggacgaccataaaggatcaatttcgcattgtttcgctctttcctccgcttttctgccattttttgtcgctgcttcgctttccggtcaaacaaaaccatcgaagagaaattttgtattccaacacgacgttctctcaattgtttttccac

SEQ ID NO: 85383 - DNA, 422 bp, Heterodera glycines
  SCN-specific regions: Sequence locations=1-114,136-170,353-422
gggatttcatgcccaatgaaaatgggttggccaatgccattccggcggctttgaacggaggcgacgcgttgctgttgagaaagaagcgcgaagacgaagatggagcaggtgatggtgaagaggggggtggagatgatgccgagggtgcccaagaagacgccgaaggtgttgaggatgaagaaaaagccgacgaggatggagccgaagatgaagcaaaagagaacgaagacggagatgataaggaggacaaagatgaagacggcaaagacggcgaggaaggcggtgacaaaggaggaaaagacaaaggaaaaggaggaaaaggaaagggaggagaaccaggagaaggaggaggtaaaaaaggaaatggaggtggcagtggtgtgccgcaaccgacaggcggaggaggaggtggcactctccca

SEQ ID NO: 85384 - DNA, 134 bp, Heterodera glycines
  misc_feature (8)..(8): n is a, c, g, or t
  misc_feature (133)..(133): n is a, c, g, or t
  SCN-specific regions: Sequence locations=1-134
ggggtcgncgttgcattaataaaattggatttcgtatactcgggcacagagtacaaaatgaggacggattgcatataagcagagaaagaatttggggacgcgaaaggacggaagagaacattgaagaagcatnc

SEQ ID NO: 85385 - DNA, 155 bp, Heterodera glycines
  SCN-specific regions: Sequence locations=75-155
tttttttttttttttttttttttttactttttttttttttttttttttttttttttttttttttttttttttttacaaaagaattttttgctcacaaagattggggggaaacaatttttttccccgaaaaaaaaccaacgaatttaaaaaccaaa

SEQ ID NO: 85386 - DNA, 345 bp, Heterodera glycines
  SCN-specific regions: Sequence locations=36-78,100-207,229-345
tttttttttttttttttttttttttttatttttttcgggttttttcatatttatagacatgaaacaacgaaaagacacacatttttcatataaatagaattaagttttgcaacaacatcacaaaatcaaatcactcctttttccattcaagttcgagcacccgctgcaaaaaacagtacaaatcgacaagttcggcgatctgaacaaaaagcagcacagagagtatcatttgcctgtttccccaagagttttgcgttaccgttttggtggttggcttgccggctccgtgccccgcctttgtctcaatgcgcgccagcaccggcctccgttgccattcgcttgcct

SEQ ID NO: 85387 - DNA, 436 bp, Heterodera glycines
  SCN-specific regions: Sequence locations=1-368,390-436
ggggggcatcttcatttattgagaattttcaatcgaattgtccgattgtctcctcactgtgtctatcagacgacggaattattctccgaacggtttctttcaacgtctttccttttattacaaaaacgttctacgcctaagcctactggacctgtccgtcgagttcccgctgttagcatcggaagtgatgtgcgacaaaagcattcggaaagaaccgcaggaaaaggtgatggaacaaatggattctggcaaccatggaatgcttcggatgattacagtgaaattaaaaaacgtcttttgcgtcctccgaatgatttctccgagctcagggaaattatacgcaaagacattgaaagaatggcacagataaaggaggaaaacctaaaaaagaggaagggaacgaccaaagggaagaagcaaatgacggatgagcaga

SEQ ID NO: 85388 - DNA, 468 bp, Heterodera glycines
  SCN-specific regions: Sequence locations=1-51,73-206,228-322,345-468
ggggatccaaatcaacgcggcacagtaataaaatattaaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgggtggacccgaccctcatcatcatta

SEQ ID NO: 85389 - DNA, 285 bp, Heterodera glycines
  SCN-specific regions: Sequence locations=1-198,225-248,270-285
ggggacatcactaagaaggaattgttggccgagcgcgacgaagcactcgcagcatgcaagtaatggaaagggagagacaaacgtagaggaaatgacagaacgacagaaataaacattcagtgccgacctcaatttggtgggagtcggtaaggcgaattcacatttatgacttttaataaattataataggcgagcaattaaattaaatagcaaaataaagtgaccttaaaacttggaatgtttgtccattttttcactttttgcaaataaattttgcttacgaca

SEQ ID NO: 85390 - DNA, 376 bp, Heterodera glycines
  SCN-specific regions: Sequence locations=38-137,160-319,342-376
ttttttttttttttttttttttttttttgatttttttaggggtttaaatttatctaaaaagattcaaaacaacaaatagtttaaaaagttgtggaaaaaatttgttttgaaaaactaataaataaaagaggattgaataaaatctgaaaactaagcatccattctttcttcctccgttagatccatccatggccctaatgatgatgagggtcgggtccactcggtgacagacgcttcgattcattgaccggcattttctcaacaagttcgcgtaggtgtgccctcattttttctaatcgatttgcccccatttcaaattgcacaggaggaggtggtggagccattgagcgattggtcacatgcgatggcaccaatc

SEQ ID NO: 85391 - DNA, 249 bp, Heterodera glycines
  SCN-specific regions: Sequence locations=1-249
ggaattctcgacttcatcaagtcggcgactgatcttctctttttccacgttgaccatggtgctgatttgccttatcaccaatttctcatcgatctcattaatgcctacaagcgaacgcaattccatccctttcgttccggtgtttttgtgctgcgcggtgacagaagtgaagaggagcagcatacgcaggatttgagctcgctgatcgaaatcctttgtctcttccactcgaaaacctatgtgccgcct

SEQ ID NO: 85392 - DNA, 290 bp, Heterodera glycines
  SCN-specific regions: Sequence locations=27-95,117-290
ttttttttttttttttttttttttttgacagtcgaaatgtgtaataagtgaaatgattgacgtggaagggaaatacaatgatgattgatcgccgtaattattaataatgaatgaaacctaagcaaatttctgcttattttggaagaaaaagctgccgatcggcgaaaaggacaaaaaagatcaaaccaggggaagtatatgccaaaatgagaagcccacggaagggcagagaaaatgaggaaaatattgtaagacacacacaaaacaaaacaaaaaggtgaaagagagga

SEQ ID NO: 85393 - DNA, 310 bp, Heterodera glycines
  SCN-specific regions: Sequence locations=38-147,170-310
tttttttttttttttttttttttttttttttttttttatccattttataaaccagaggagatcaagcaaagaaacaataaaaataataaatcgaaaaattggtgggttttttttggattggttttggttcattaataatatgggggcggctggtgctccatggcactgggttcaaagggcaactgttcctgcatggcgatcagctttttttttagcacttggataccactgaacacaatgttttccgcacgcaatgcgccgggcgactcgacgcccaaccaaaacttgcacgggttggcgtcccccttgt

SEQ ID NO: 85394 - DNA, 98 bp, Heterodera glycines
ttttttttttttttttttttttttttcttttttttttttttttttttttttttttttttttttttttttttttttttttttttttttttttttttttg

SEQ ID NO: 85395 - DNA, 406 bp, Heterodera glycines
  SCN-specific regions: Sequence locations=1-209,232-340,369-406
ggggcttattgagattttggtgacccgcagcaatgcccaactgcgtgccatcaaggcggcctaccagaagttgtacggtcatgggttggagaaggacctggcggccgagacaagcggcagctttaagactctgctgctcgacttggtcgaagcgaaccgggatgagtcgtaccgtactgatctggccaaggcgaagacggatgccgagaaactttacaaagccggggaaggcaaatggggcactgacgaagatgcgttcatcaaagtgttggccaaccaaaacttgagtcagcttcagctgatgttcaacgagtatgaaaagcttggcaagaagcacaccattgaacaggcaatcaaagctgaattcagtggagacgagttcagtgctctgttggcaattgtcagc

SEQ ID NO: 85396 - DNA, 291 bp, Heterodera glycines
  SCN-specific regions: Sequence locations=1-291
gggatgttgcagcccgcctggtagagcaggcccgagacggcgtggacaatgcccttggcgtcctggcaggacagggtcagaacgaattcttgcgaggtcttcatgatggacccgattgtagggtcgtcatctgacagccgcgcgaaaccgccagtggcggccggtctcagtgaccgtggccgatgtgctcgccttccttgaccttgtagaccgtgccgcagtaggggcacatgccttcgccggtcttggccacgtcgatgaagacacgggggtggttgctccacagcggca

SEQ ID NO: 85397 - DNA, 449 bp, Heterodera glycines
  SCN-specific regions: Sequence locations=1-51,73-206,228-322,345-449
ggggatccaaatcaacgcggcacagtaataaaatattaaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtggccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggac

SEQ ID NO: 85398 - DNA, 446 bp, Heterodera glycines
  misc_feature (359)..(359): n is a, c, g, or t
  SCN-specific regions: Sequence locations=1-226,248-446
ggctgttacactgtttataatttgttgctttatttcgatccgaatgttcagagaatttacattgaacggcatggacagcgcagtctgatcccagtccttatcaatgacgttgtgttcgcttcccatgctttgttggcatgcatcataacgggcgttcagtgctttttctatgagcgtggaaaccagcgcatttcgtacattggccgtgcctgggcttcccttctgctctgtttctcttcggtgtctttggcgttggcgcttttccgtgttttgaattggctcgatttcatcaattacctttcttactcaaaaatggccgtcactctgagcaaatatttcccgcaggctattctcaactntaaacgaaaaagcaccgtcggttggagcattggcaatgttttgttggacttttccggtgggttcatgggcatttgtcagatgtgtct

SEQ ID NO: 85399 - DNA, 357 bp, Heterodera glycines
  SCN-specific regions: Sequence locations=1-65,87-357
ggggaaccaaccaataccattaatttcataaatccgaagaaatccctccaaaaatgtcttcttccccgtccgtctctgtgctcgccatcgtcgcaattgtctgtttgatgtgccaatgttgcttttcggcaccgcatccgtgctgtcccggcagtcaaaaagtggtttcacttatgtccaattacgttggcacttttgccaattccatttccaagtcatcgctttgttcggatgcccaaaatgttgcggaagcgttgaaaggccaactgatcggctgctcgaatggcggcgatcgaactcttttggccgacatcgaagcattccttgccactcattctgctgatgagtgtgccctaa

SEQ ID NO: 85400 - DNA, 180 bp, Heterodera glycines
  SCN-specific regions: Sequence locations=74-180
tttttttttttttttttttttttttttttttttttttttttttttttttttttttttttttttttttttttttaaaaaaatacttttttacccccccaatttttgtttttccaaattttaaacaaaacaaaatttggtttggaaagggaaaaacaaaaaatggggggaaataaatgaaat

SEQ ID NO: 85401 - DNA, 363 bp, Heterodera glycines
  SCN-specific regions: Sequence locations=1-363
ggggattttgagaatattcaacatgtgataaattttgaaatgcccgaagacatagaaaattatgtgcatcgaattggacgtacgggtcggtcaatgagacgcggaattgccacgacattcatcaaccgaaaagcggatttgcctgtactgttggatcttaagcatttgctgatcgaagccggacaacaattgcccgcgtttctcaaacaattggccggggaagatgaggatttgggagcgattcaagaaactgaaccggtcaacgacatggacaagggttgttcatactgttccgggcttggccatcgcatcaccaactgcccgaaattggagagcgtgcgcacaaagaatgcttccaacctc

SEQ ID NO: 85402 - DNA, 315 bp, Heterodera glycines
  SCN-specific regions: Sequence locations=30-137,159-171,194-315
tttttttttttttttttttttttttttttgagtaaacaatgtttttatccaattaacatagggtcatataagcacattaagtaaattggtatcacacatttcaattagagaattaacaatttgaataattgggggcgtaaagaaacttaattatgggatacaatccttttcaaaatctaagggaacaaaaattgtcggaggggataaaatttatcgactgggcatcaataccattttaataattgatatcatttgtcttgaggagcaattaagtcaattcagttctcttcataaagctgcctgatttcctcctcg

SEQ ID NO: 85403 - DNA, 365 bp, Heterodera glycines
  SCN-specific regions: Sequence locations=1-365
cgtctgtatcttgcaccaatccatacgcattaacgttctcgtcgggcacgaacttttccgggatgacattgtccaaataccatttgaaacttttacagcccaaacgctccctcaacgctttgcgggcgcttaaatcgccgacttcaacatccttcaatcccattctgtgcacataaaacaaccgtttgtagtcgtccacccaaacttcggccagacgcttggagttggtgccgtgcacgtccttgttgccgccagggcccgtcatgttgtacgggtggccggcacggaaaatgtgcccgacgtgggagcaggggacgacttcgatggacccaccgcacatccacaccctaaacgaaatctgcaaa

SEQ ID NO: 85404 - DNA, 353 bp, Heterodera glycines
  SCN-specific regions: Sequence locations=1-353
gggagaaggagtccacgctccacttggtcctccgtctccggggcggaaatgggaagagaaacacgggtaagaacaagaaaagcaacaaaaagcttgatcagaattgatcagcagcgaacgcaccatcacatactattgattggcacagtgattttccaccaccaaattcacaacacttttcccttttccgggttatctttgatttccattttcggttattgttttctgtttttctcctctatcttttgtaaaattctgttactttgatctttagttttatcatttatcatcgcatatatagaagttatcatagtccatatttctgtccctttttatttatttttttgactata

SEQ ID NO: 85405 - DNA, 178 bp, Heterodera glycines
  SCN-specific regions: Sequence locations=32-178
ttttttttttttttttttttttttttttcttaaaaaatgaagatttatttaaccacaaaaaaaaaacaatccttggttgacattgatcatttaaaaaaaaatccgaatgatcgttactgtttttgtttttttatgaatttttggggacattgtgcgatggccggccattgatcagatc

SEQ ID NO: 85406 - DNA, 347 bp, Heterodera glycines
  SCN-specific regions: Sequence locations=30-65,119-347
tttttttttttttttttttttttttttttagggaaattggggtacctttttcgcattttcaaatttcctcctcccattcgtccccctcttcttcttcctcctcttttcccttctcctcgtcgtccatttgctcctcaatttcgttgttcgtttcatcacggccaccggcggacggagagcgtcccaagtccgggactccgccgaccgggccactttcaatgccgcactcgtcggagccgcgcaaaatgcggaagaatccgtcctcgccccagtccgtgttccatgagttggcaaccagccaatacggaatgccattgtccgcgccccatccgagcagtttcaccgcg

SEQ ID NO: 85407 - DNA, 391 bp, Heterodera glycines
  SCN-specific regions: Sequence locations=1-391
gggcaacgaaatttggcgacacgcactgtcggctttgatgatccgaattgtctcgcgatggcaattcgggatgaagaaaacatccgagtgaacgacaaaagtgcacaatttggattcaaatcattcaaagaattgctcgagtcgccaatgatggacaaatttgttaaagtagaagtgggcataaaggaagggcggctcagaacgacgtacacagcgaaaatggacgcgacgacgcgaaaagtgatggaacagcagaaatggtttcaccaaacggcggaggggcgcttgaaggagcagcggaggcaaaattaccaatcgcagaacaatgccgccgccgcaaaaagacgctgttcaatggcgccactgtcagtgaatcatccgtcccttttcc

SEQ ID NO: 85408 - DNA, 381 bp, Heterodera glycines
  SCN-specific regions: Sequence locations=1-381
gggcagaatttggccggaagagaagcggcgccgaaatttacggtgccgacagtgcaggattcttatttcctcgcgctgaaggcagggacaagggcaacgaacttggtcgacaaatgggttcgcgagtatgaggagtcccctgaccaggcaattgtccaacttctgcagctaattgttgcttcctgtgggtgttctgggaaattggatgccaacatgattcacaacatgcagtggaaggacatagtcgaacggctcagcgagtattttgacgaagactccggcgactatcccctgaccacacaacaatatcgtaaattccgcaacaattttgcggaatttctccaggccttcgttttgcgaagcaaaaacaacattctattc

SEQ ID NO: 85409 - DNA, 341 bp, Heterodera glycines
  SCN-specific regions: Sequence locations=27-77,129-228,250-341
ttttttttttttttttttttttttttcatttatcttctttaattcattttcatccgttgcaatttttcgtttcagtgaaatttttaaattaaattatgtgaaatgataaaaaaatgataaaaataaaacgagtaaaaaggcgttgagaatcaagctcccataaatgtaatttgagaataatttcaaaatgctttcgtttcggctgtccctttcttttcccccattttctctgattttccttcgccattccgtaaaattaaactccaaaatccgccgcggtcactttcagctgaaatgccgatttgtggggcggctgctgctccgtaagattgagaaaggga

SEQ ID NO: 85410 - DNA, 352 bp, Heterodera glycines
  SCN-specific regions: Sequence locations=26-179,202-352
tttttttttttttttttttttttttggatttaacgaaatttatcgaacgagatatgttttgacgtataataaaaatgcaaaggcaaaataaaaaatcgtcataaaaacatatcacagtgtaaaggaggataatgcggaaagcatctgggtaatgattaagatctggaaaaaataaacggaaaataaattttaattgtaaaacttacaatgaggacccagactcgaaattactcaaaactataaatttagcagtaaaaaatgaaatatatgtaagaatttcctttattgcgctttttgagtctgggcctcacattaatatttaccaagtaatgaaaaatgccttaagataact

SEQ ID NO: 85411 - DNA, 370 bp, Heterodera glycines
  SCN-specific regions: Sequence locations=23-26,58-128,150-370
ttttttttttttttttttttttggtgaattttatttaataaaaaattaataatttttggacaacctttttttaaattaataaatctttgtccaaataatcaatcagtatagctttttatcgctgattgtaccctcctcctcctcccattagaatggcagcacactggacaaattgaacacgaatgaaggtccaaagttggcacggatggcgtccttgttgtcaaccaaagtgacggcggcaaaaaggcggaccggatcagcagcaagaatccccatgtccaatttctcgccattaagcgtaaagaagacatgacggttgaatgcgttcagtccacatccaattacatcgcccgtcgtgaactgcggaaaa

SEQ ID NO: 85412 - DNA, 361 bp, Heterodera glycines
  SCN-specific regions: Sequence locations=22-132,154-230,252-336,359 -361
tttttttttttttttttttttctgagtacaaacagtactaaattgcttcgcttttgtgcgattctgaaaaacaccgaacaaaagctgactgaacacaaaatgactgggatgaggaaaaagttaaaggcacaatccaaaagggacacattttggttacacaattatttacttggatacaataaaatcgaatgccaaaaattacgaaaagaatgtgagaagaaatgaacgaatgaacaaaaaacaaatttttgttggtttgactgacacgcataacatcgaaaatgggaggaagagagggtataatttaatgtagcaaatggatggactcgaattacttctgctcctcttctcactgttaatg

SEQ ID NO: 85413 - DNA, 343 bp, Heterodera glycines
  SCN-specific regions: Sequence locations=1-57,80-239,262-277,306 -308,330-343
gggcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaaggatggatgcttagttttcagattttattctatcctcttttatttattagtttttcaaaacaaatttcttccacaactttttaaactattcgttgttttgaatcttttt

SEQ ID NO: 85414 - DNA, 440 bp, Heterodera glycines
  SCN-specific regions: Sequence locations=1-440
gggacgtcggaggaggacaccgaagcggacatggaggagggcgatggactcgcagcggatgaacgcaaaatggaaatgttggacaaatacattcactgcgcacgccaagcccaaatggaacctcaagtggccttccgtgccaccgagcacatttgcggttggctgttgtgcggtggtctgcgcattggaagtgcggaaagtgtgaaggcgttggcccatcttttgctggtgatgttcaacacggagagccgtgacagagcgccggaggcgcacgtgtgcctttcccgctttttgccctgtttcgtggcggtcaatcgccgacaccagcagttgctgttccgggccttcatgtccgcattttcactgcttcagacaatgagtttggcactgcaagaagaggcacgtcaaatcgacactgtgaaaatggcgatcagtgtgca

SEQ ID NO: 85415 - DNA, 213 bp, Heterodera glycines
  SCN-specific regions: Sequence locations=58-213
tttttttttttttttttttttttttttttctttttttttttttttttttttttttttaacggatcaaatttaaaccaaatcacaaaacaaaaaaaaacagtcaaaatttcttcatgctcaagtaacttctgttctgctcgcacattttgggcaactcctgcttcccctgaatgggcaatccttcgttttccatcgcggggagcaattcggacc

SEQ ID NO: 85416 - DNA, 332 bp, Heterodera glycines
  SCN-specific regions: Sequence locations=28-332
tttttttttttttttttttttttttttggggagctaataacaaaaatccaaaaaagcgaatttagaaatgaataagatttttgaaaaaatgtcagcgtttttgtgtctgtcctccaccgccttcgttttgaaatttgtcattcaaagcatcgattctatcaaagtgtcgcgcaaatcggtggaaattgcgctcggcgccgcgtctcccaatttgaagatggactccaacacggacagttcggcggaagtcgtgtcgaggcctatgaatgcgatccaatcgttgacgcaacagctgccattggcgtcatcatgggccgtgtgttcgtcgtcgc

SEQ ID NO: 85417 - DNA, 402 bp, Heterodera glycines
  SCN-specific regions: Sequence locations=1-229,251-288
ttttttttcaacacaaacaatattgtgacagaatatagcaagaaaaaatgattgggtgtgtctatcccaagatgacgattttccatggtaaaaaatgtaacaccaattaattcataatcagtcagtcataaaattgactgtttaaagcgtgacgatgaaaatgcatgtttacaagacgaaattagcagattcagattaaagaacaaagaagatgaaggattataattagagagagaggacagacacacaatgaacgaaagttccgacaaaaaaattaactaattaattaaaaaacagacaaaaaattaaaattaaaatacacaaaagttgaggaaaggagagggaaaaaggaaagaaatgggagacacaaagaggaaaaaaaaggaggacaaaaaggaagac

SEQ ID NO: 85418 - DNA, 320 bp, Heterodera glycines
  SCN-specific regions: Sequence locations=51-295
ttttttttttttttttttttttttctttttttttttttttttttttttttaaacccaaaatggatttaacaacaaaaaaaaggggcaaaccttttttttacactaaataaaaaagattttaaacaaatattgaaaccccattttggaaacaaaaaaatggttaattggggatgatgaaaaaaaaaattttttgatttggacaaaagtgctaaaatgatcaaacatatggcttttttttggcttgtatttatgggaaggacctggaaaaatgttcaacaattctttgacaaaaaaattttgggaattgaaaatttaaagaa

SEQ ID NO: 85419 - DNA, 201 bp, Heterodera glycines
  SCN-specific regions: Sequence locations=28-201
tttttttttttttttttttttttttttaaatttttttattgagccaaccaattaaaatacacatccctcaggtttttcatcaaagatacaatgcagaaaacgaatctttttattaagggcaatttgaattaagacacaggtattattatcggggagggatttgattaaaagtgggaaagtccaaacggaaagagagagcag

SEQ ID NO: 85420 - DNA, 420 bp, Heterodera glycines
  SCN-specific regions: Sequence locations=27-28,50-362,385-399
ttttttttttttttttttttttttttgcataaaatattatattaataatcacatgtgaaaatgtacaaatgaggtaaaatatagtaaaaaatcgaatgattaaaaaaagacaaattgcacgaaactaaaaaatgatgtccataatatcgtaaaaaaggggtgtctcgttcatttcaacaacaaactctttgccatttcgttgtccactttttgccaaaaacgtccataacgtccgccatggtaaacagtgcgtgcgctcggttccagcgtcaattccaaatgctgctcggtgttctgtgcactgattggacgccaaaagtcgggtgaaacgagcgtggaattggcgcaatgctcattgtgccatggctgctggtggtggtgttggcattggtcattatcaccatcattttcatgcaattg

SEQ ID NO: 85421 - DNA, 322 bp, Heterodera glycines
  SCN-specific regions: Sequence locations=1-88,110-154,207-270
tgctccacgcgttgggagctctccctatggtcgacctgcaggcggccgcgaattcactagtgattagaaacaaaaaaagccacttgcatttgcgttgttttattttgttgctacagtaatcacatagttcacctttgtagatgctttactgtactcttttcatttttctctctttctgtccctctctttcttttctttccgcttctggcttataaattcctttttctctattacacaaacattgaattcgattgaatatttgccgatttgaaaaaaaaaaaaaaaaaaaaaaaaagaaaaaaaaaaaaaaaaaaaaaaaaaa

SEQ ID NO: 85422 - DNA, 181 bp, Heterodera glycines
  SCN-specific regions: Sequence locations=1-8
gggatccgtctctatctctctcctctttctctctctctcttccgtttctctctcctctcttctctctcactctctttcttctctctcactctctctctatctccctctgttctcattctctctctctcctctctctctctctcccctctctcttctatctctctctctctactctctttct

SEQ ID NO: 85423 - DNA, 372 bp, Heterodera glycines
  SCN-specific regions: Sequence locations=27-174,196-372
ttttttttttttttttttttttttttgcacaaatttattcgattttcaaagaaaaattcaatgaaatttattatgttttcacacacattttttgggtgtttgtgccaaagagatcgaaaggaaattcaaaattttgtcgggaattggtcatcatttatttttcaccgttgcgctgtgttgttttgaacatgaaaaatataacaacaattcatccgaagcgaaacatcgttcctcccaaatcgccaagatgacgcgcatacatttttggagcagtcacctcttcaatgtttcgtccagcccgcaacaaattttgttcctcctccctttgttcggtccgcgcatttaacgcttcgccatcaattgcctcctcat

SEQ ID NO: 85424 - DNA, 407 bp, Heterodera glycines
  SCN-specific regions: Sequence locations=1-407
ttcgtcatcgagtgttgtggccaagaagaagaagtcttggatgaaagcgaacagaagcagggaagcagttacaaacaagttcaaagagatgtacgcggaaagaatcaagcagaaacggagaagccggacagcgtaaaagccgacagcgccgagaagacacatggaaaagacgaaggaaaggccagtggcgacggacaacgactcgaaaatcatcgactgcaaaacgtagccgaaattgagcagcaaatggccaaccgccacggccaaaacacaggcggccacggagtaaagccatttggtctcccgctttcgcgtctcagtccattgttggtccgcctgggccatttccgagtccattttgaatttgacacggagtgaaagtgccgtgccgaatgcacgcggtgcca

SEQ ID NO: 85425 - DNA, 342 bp, Heterodera glycines
  SCN-specific regions: Sequence locations=28-342
tttttttttttttttttttttttttttgataatgatttatttatcacatcgattgataattacatggggattacaattatcagactaggaaaaatagtttactcataggcttcgtcatggattaaaaattgtataaaactgaaaattgcataaataaaatcaattttcttcagtccgtcattacaaaatcgccctcaaccatctgctgatcaaaatcgtcaactccgttggaatgatcaaagcaaagtgcgcctccccttacgcaatcgcgcacttgaggctcaattggaatttcatttccgtctttggcctgcgcaaaaccaacacgactttggcccacat

SEQ ID NO: 85426 - DNA, 467 bp, Heterodera glycines
  SCN-specific regions: Sequence locations=28-78,100-171,193-434,456-467
tttttttttttttttttttttttttttcgtaacaaagaggaatttatcaattcatgcaaaattattaaacggagataatcaagttaaacatggcaatttcaatcctcatcttcaaaactatcgcccgtaaaagcgaaaggtttaaatccctctttaagtgctattgtcagcttctcttcttcctttttgcctagcgaacagttcctccaatccaccttttcttcacagtccaaaagggccttgttggcaaaaacctctctcccaaattggaggggaaactgtgccattgaacggctcaacattttgctgccgtcgggaaattcggcataaaaatagggagaaccctctccgacgaggtcccaaagattgtcttcatcctttaaaaatgaaaattcaatgttcttgagacgtgccaaattgagaaacgtactgcgcaatgctttgctttttgtttttggaattggaac

SEQ ID NO: 85427 - DNA, 387 bp, Heterodera glycines
  SCN-specific regions: Sequence locations=27-387
ttttttttttttttttttttttttttacatctatcctaatctcttgcaaaatcccttctgccgctgctccatcactgctccgtgttgcccttgaccaatgccaaaagtgcgtctcggtaagctccgctggtgtcccctttgatcgcctcctccaggctcttcttgtgcaacgtgtgaaaagcgtgtttgatgtcagccaggtcaatctcagaccgagaaatgaccagacgaatcaaatccgagtcgcgtgtgccgagccctttcatcgaattgaacaacaaatccgcaaaaaacacagaagcgttgcggacatatttgattagtgccaaaaaacccgcttcgttctgaccgctgaattcttgctcaatgcccttctcaatctcgtgg

SEQ ID NO: 85428 - DNA, 296 bp, Heterodera glycines
  SCN-specific regions: Sequence locations=26-77,101-296
tttttttttttttttttttttttttgcaaaaatttagatgcaaatatcttacagaaaatggtcatagaaaaataggcaaaagaaacaagaaaatgcattaaaacccgcatatagacacacaatcatatgaaaacaccaccattactcctccatggatttttgcctcgtcaaattcgacgcgtttgaggcggtcgaactgcgtcgcttgtcctgttttttcggttcgcccatgtacaaattgacccgtaacactgctcccgggttccttttgtaatctatcaaaaactggcgccctt

SEQ ID NO: 85429 - DNA, 436 bp, Heterodera glycines
  SCN-specific regions: Sequence locations=1-356,378-436
ggggattattcatcgttttctttcagctgtcatcgttttcccttttccatcctttcaattcaattcgatgtcaatcgatgaaattgagcggacaattcctttgccttcgtcccatctcttctctcattcgcaattcgtccgggctgagattcactctttcgaagaagcttttgtccacaacaaacgcttcaaagagttcgaaggattgctcagaacgaatcacaaaacttacgaaagtgtcgaagcgaaattcgacctgcaaaaaatcgaaaaaatgagcactttgacgaatcgactgaacaaattggcggatcatttgggggaaattggccatttgcattttgaaaagggtgagcttaatgcaatggatttggaggagaagccaatgttcgaaattgttcggcttgcggaacaaaaacagcacgaaattgaagaa

SEQ ID NO: 85430 - DNA, 405 bp, Heterodera glycines
  SCN-specific regions: Sequence locations=1-405
gggatccacggcacacgatccgctgtcactttcatttgcgaacagcccgactcaaacaatttcttttgttggcagtgaccaggccggcaaatacatttacgagcacgggtctaagcttgggaaaagagttcagtcgaatatgggcgctaagaatcacggagtcatccttcctgacgcgaaccgagaacacacgttgaatcaggtcgctgccgcggcattcggtgctgcggggcaacgatgtatggcactctctacggccatttttgtgggtgatgcgcgcggatgggtttctgatttggtggaacgagcccggaaattgcgcgtcggcccgggatgggaggcggggacggacattgggccggtgatttcacaaaaagcgaaggagcgcatttgcgagttggtcga

SEQ ID NO: 85431 - DNA, 304 bp, Heterodera glycines
  SCN-specific regions: Sequence locations=27-304
ttttttttttttttttttttttttttggataataacaattcttcaacaaatatgatgtggcaaaacaatgaatgcgatcgattgtctcaaatcccatcgtccgcttgttgtcatttacttgcctcctttctttttcttgggaccaacagtttcccttttgcccacagtttccgtttttgacttcggctgctccttctctgcagtttttaccgcggcaggttgtgtcttgggctgttccttatcaacggtccgtgcagcgacaggttgtggcttcggttgctctttctcggctggctttgtcact

SEQ ID NO: 85432 - DNA, 328 bp, Heterodera glycines
  SCN-specific regions: Sequence locations=28-43,72-87,110-328
tttttttttttttttttttttttttttgggttaaaaagttggggaagaaatttgttttgaaaaactaataaataaaagagggtagaataaaatctgaaaactaagcatccattctttcttcctccgttagatccatccatggccctaatgatgatgaggggcgggtccactcggggacagacgcttcgattcattgaccggcattttctcaacaagttcgcgtaggggtgccctcattttttctaatcgatttgcccccatttcaaattgcacaggaggaggtgggggagccattgagcgattggtcacatgccatggcaccaatccg

SEQ ID NO: 85433 - DNA, 350 bp, Heterodera glycines
  SCN-specific regions: Sequence locations=1-350
gggagcaggaacggcccgaagaccacgaatcgtattggaattcggtgcttcgccagatgctctgcgccgatttctcctcagtgctcactttgctccaatttcattcagccttcaaaaatgacgaggccctcttaaaaatggcgaaaattttgcagactgtgaatgtgtctctgttcaaatatgaccgtacaaattgcgatgaactttgggcactaagaaagaaagtttgtgatttgactgctcacaagcaaatgttccgttcgcatgacaatttgggagtgatttgttctcttctgatcggcgatcgcggcaccttcaaaaagtacttcgacctcttccgtcccaattgg

SEQ ID NO: 85434 - DNA, 398 bp, Heterodera glycines
  SCN-specific regions: Sequence locations=24-247,290-398
tttttttttttttttttttttttgttatcatcatttgattggggaagagaaaaaaaacaaacaattaacaacggggaaaggtgtgtgtgttccaagcgattgtatcggcagaggaaaagtcaaatttaaaaatggtatgaaaaaaagaataaatcattttaaaagatgatgggtggtttaattgaggtgaaatgaaaggaatgtgtaatacataataattgaggtgattgattggatttggattgggtaataaataataataataatgacacatataataaatatttaaggcatttgtcgcagcagttgtggcgccaaacaaagaatcggaatcagaaagcagagtcgggtggtcgacctttcacggcatgttgtccccccattttcagtccaattgc

SEQ ID NO: 85435 - DNA, 221 bp, Heterodera glycines
  SCN-specific regions: Sequence locations=69-90,124-221
ttttttttttttttttttttttttttttttttttttttttttttttttttatttttttttttttttttggaaaaaaaagaattttttttagccaaaaccctttttaaaaaaagggaaaggttggaaattttttttggggggtccccgtttttttaaaaaaggggacttggggggttttttgttccccctttaaaccccccccaaattgggcaaaaattggg

SEQ ID NO: 85436 - DNA, 472 bp, Heterodera glycines
  misc_feature (420)..(420): n is a, c, g, or t
  misc_feature (436)..(436): n is a, c, g, or t
  SCN-specific regions: Sequence locations=1-472
ggggaatctcctcgagagtctcgaacctccgcctcgaccaaaaatcagttggtccaattacctcagggcttccgacgaacaaagccatttggggagaccgattcagaccaaagtcaccactaaggacgtgagtggaatgcttgccatgagcaccgattttccgatcagcctcaatttggcacttgacattctcagcgtcatggagccggtgaatccgacggtggccaaattacgcgaattttgcaccgctaaactgcctgaggggttcccggtacgcgtggaaatgccaatttttgcgacgattcaggctcgggtcatttttcaacaatttcgctggtgcggtgaaggcgcctctccagcatttccggatgcaatgttcagaacaccggacgattatcgcgaggacccgaagagattcanacggatgtagacagantaataaatactcattagtcttactaagtcattatcg

SEQ ID NO: 85437 - DNA, 121 bp, Heterodera glycines
  SCN-specific regions: Sequence locations=28-121
tttttttttttttttttttttttttttgggtcaggggtatttatggaatcttcaagaacaacaacctttttctatcgatgaataaaacataaataataatttaatcaaatttctccgcgag

SEQ ID NO: 85438 - DNA, 421 bp, Heterodera glycines
  SCN-specific regions: Sequence locations=1-421
gggaacaagcgcagcacttcccgtggtctccgcatcagcctttctctatgcctttcgggggtttgcctccgccccctccgtttctgcctttcccacaacctccgctgtttgccggtctcagtgatgctgaaattgccgcaatggaagggacggaaagacgggcggtcgaggcgcgcattcagtccctgcggaacatttcgacccttttggacgctgcactgctgcagttccagcaatatttgagcgtctctcccgggatagctcctcaacaaacgcaaagggacgaaaactttgcgcaaaacccttcgacatcggccgacagcgcaacggatgcggaaacaaacggcagggaaagtcagcggaatgagacggagacgtacgcaaagaagcggaagagagatagagagagagactcacacca

SEQ ID NO: 85439 - DNA, 475 bp, Heterodera glycines
  SCN-specific regions: Sequence locations=1-475
gggggatccgccaccttacgaagcactggctgccgctttagaacatttgtacgctctcggtgctttaaaccacaaagggatgttgactaaacttggacgacggatggccgaatttccttgtgatccggcaatgtccaaaatgataatttcctcagaaaaatacgaatgttctgaagagattatcactatttccgcgatgctttccgtaaatgcggcggtgttttaccgcccgaaagcgatggtaatccatgcggacacagcgcggaaaggattttggtcgtccagcggcgaccatctgactcttctgaatgtgtacaacaaatggagagaaaccaacttttcgatgcagtggtgtatcgaaaattttgtccaacatcgtacaatgaaacgggcaagggatattcgggatcagttggaaggactgctcgaacgagtggagattgagccgaaatcttcttccgacacaatggccatt

SEQ ID NO: 85440 - DNA, 308 bp, Heterodera glycines
  SCN-specific regions: Sequence locations=29-308
ttttttttttttttttttttttttttttcgaatgtgaaatttttttaaatttcggggtgcaaaacaagaaaaaaacaacaaataacaaaaagtgaggatccaccattaacgcattttgacgtcctccgcccccctttactcctcctccattttttccttcttgaccttttttttggcggctcggtactcggccaccaccaccgcgtggtcacgttcgtacggctcgagtgttacctgctcaatgggtttgaactgctcctcgcgcaatttgttcacttcgccggcaaacaccgcctccggttccgccg

SEQ ID NO: 85441 - DNA, 369 bp, Heterodera glycines
  SCN-specific regions: Sequence locations=29-345,367-369
ttttttttttttttttttttttttttttgaatccgataatttgctcgatgtaagccgaaatcgaaattcttatggtcaagctgccactcaatccctgaaattcctggtcaatgtcggccaaatcgatgggtgcgcgagtgagcaaaattcgcgtcacgtttttcaacgcgtccgctgaggcccacttttcgtttcctcgcaatttgtcaagcttttctttcaataattgggcaaaaaaatatgggcgaccatattgaatatccgttaagattgcgttcaatgtttgccaaaaatgttgctcgacatgaaggtccagtttaagtagattctttattcggttttttgataaatgtttgaattctttgatgt

SEQ ID NO: 85442 - DNA, 292 bp, Heterodera glycines
  SCN-specific regions: Sequence locations=30-292
tttttttttttttttttttttttttttttggggtgataaaatttatacttacgctttcaaaaaaaacaaccgaaaatattagcatgatcaattcaaattataacgtctcactaaagggcttatacagtaatcaatttatccggctcggttcatttcgtccgttgccaagttcaatgccatgtccaagtcattgatcagggccgtcttggcctcgcacccgaccgacagtctgatcaaggtgtcgctgatgccgatcaaattgcgcatttgctctggcaccgacgcgtgcgtc

SEQ ID NO: 85443 - DNA, 471 bp, Heterodera glycines
  SCN-specific regions: Sequence locations=1-220,242-273,296-446
ggggggggtgtcgtcgatggaatgcgctcggccagtgtcatccatccgccagctgccggcgtgatcggtgcgccctcttcgacggtttcgaccgggaacaatgtcagcagcaacaatcccccgtcttcgcaaccgatcggtgctggccgcaatttgcagaatatgtcaccttcacagcagcgcaacggatggccatcttttggatagacatatttcctctttttctctcttccaaatctccctgctgaaatcgtcattattattgttcttgtctttatttaaatatacatacatattcagtcacatttgtactgctgattgcacaaccaaccgtatatgctaatgacaaacaatcgcaaattttcgttggattttgtttacagatttggatttgttgctttccccctcccccctcccttcggattgttcgttggcccatgagaacaatgattattattatgatgatgatga

SEQ ID NO: 85444 - DNA, 437 bp, Heterodera glycines
  SCN-specific regions: Sequence locations=1-437
gggctgtctgttctgctttatggcctcactgattgttttcgcgctggtccttggtttggccatcactttgacagttatcacagtgaacaattggaaggaaatcggcgtgcttcttagcaaacaatcggcgttgaagagccgctcggacattgaagcgttttatgaaattgattgcccaatttacagtgacaactccaaacttccggacaaatgggaccaatttgatttggcattctgcaatcgctattgtgatcgcaaccaaatgttcgagttcatgtaccgtcaactcgaccccaaccggaaatcttcagccaagagcaaagacaatcaagagcttatgtgtcccatatacattgaattcaaacaatgtcagatggaggaagggggtcactgtgaggagaagttattcagcgaggaattcaccgaattcgttcaac

SEQ ID NO: 85445 - DNA, 490 bp, Heterodera glycines
  misc_feature (439)..(439): n is a, c, g, or t
  SCN-specific regions: Sequence locations=1-490
gggcatcgttcgccgtttttcgcttttcccgccaacggcggaatgaaacagaggagacggcatacgacaaatctattcggagacggggcatttggagcgcattttgcgggaaaagacgagaacaattgcgaattctccacggtgattcggttcagcacgagctcaaaggacccgggaaaaaagatcaaaaagacaatcacacaaactagacttgtaaatgggaagaaaattgtgacaaaaaaggtggaggacaacggacaagtggaggaagaagtgatggagaacggagttttaaaagcgaaattgatcaatggaacgccagtggacattcgagcggaatgctgaaaatgccaaaagcgaaaggcaaagggaggggaaagggggagaagaggagagagagagcccctccggcgatggtgaccgaatgaatgaatgactntttgttttccatttcgcattttcaccacttttatcgttctttcatacaaat

SEQ ID NO: 85446 - DNA, 528 bp, Heterodera glycines
  SCN-specific regions: Sequence locations=1-125,147-151,174-186,208 -402,425-528
ggcttttaactcatcattcccatgcctctaaaaaacaatggcccagctaaaaaattggtcccaaagcgattagcactcgaacttttgtatgaaatcactcttttcatcagtccccgcaatgacttgtccagcttctgttcctcctctgctgtatttagagaatttatgtgtccacgtgtgattaagtggaatttattttggcactcagcgattgaaaaactcaagacgagctacaaagaggcgaaaaaaagtcccatttgggattccattatcagtaatgcttctggtgtggcgaagctcggtgacaactcggtcttccgttttctttcagacgccgtgaacttgtgtgaaggtgagccggtccgtttttccagtactcgccctgtcactggatcgctttgcatttcttctccgccgccaaaaaagcagaaggaatgaatggccaattgacaagtgtattaagggagaatcttttgttgttgtgtaagacatttttttgttttcgcgaaaaaacgtggccaaaaaaaa

SEQ ID NO: 85447 - DNA, 497 bp, Heterodera glycines
  SCN-specific regions: Sequence locations=1-251,275-497
ggggttcaatggtcggctgtgcgatggagaagagggcgtctggttttctgatgaagaaggagttggagtattttgccaaggcactcgagtcgcccacccgtccattcctggccattctcggcggtgccaaagtggcggacaaaattcagctgatcaacaatttgttggacaaggtggacgagatggtcatctgcggtggcatggcattcactttctacaaagtgctcaccggcaaatccattggcaaatcgctgtttgacgaggagggttccaaaattatcaacgatttgatggcaaaagcgaaggacaaaaatgtgaaaattcaccaaccggttgattttgtggttggcgatgagttcaaagagggcactccattcgccaatgttgacgcaaaggatggaattccgaacggaaaaatgggcttggacattggtcaggaaactctcaaacaatttgccgaagtgattggacgtgcaaaaactgtcgtatggaatggg

SEQ ID NO: 85448 - DNA, 235 bp, Heterodera glycines
  SCN-specific regions: Sequence locations=1-119,144-168,234-235
gggatcaaaaatcttttttcggaaagagagcccattacattattcccgaccatttttattgagttttatagccattggattgttgtgctaaatatcaaaaattgctaattatatcattgtttttatttttttaaaattattttgtgcttaataaatgctcctccgttcaaaaaaaaaaaaaaaaaaaaaaaaaaaaaaaaaaaaaaaaaaaaaaaaaaaaaaaaaaaaaaaaagg

SEQ ID NO: 85449 - DNA, 384 bp, Heterodera glycines
  SCN-specific regions: Sequence locations=1-148,170-384
ggggaggccattttccgtcggaaaagtgacggacaactgattgtgaaggcgagccaacagttggccatcctccattatttgccattgaaaacgaagggaaagggcggtgacggaaatgacgccaaaaaggggccgactgattgtgaacaacagcagcagcagaacggactgacagaagcggacagaacaaacggaggacagcaaaggagcgacgcggacggagggacgacggacgaagcagcaaatttggaccgagcggaaaaattgctgacccggaggggaaatgctaagaacttcaacagaatgggcgagaatttgcgtgtgacccgggcggagccactcgttttggaagcggagatcgaacttggctctaaacaccttaac

SEQ ID NO: 85450 - DNA, 154 bp, Heterodera glycines
  SCN-specific regions: Sequence locations=1-154
gggtgatgaccaacaaggagccgttctcgatccggcagtggatcaaccacaaagaacgacgccccggcttcctcttcctgtctgctcccgaatcccacatcgcgaccctgcgcccgcttctaggcttctgggcggacatcgccgtctccgcgct

SEQ ID NO: 85451 - DNA, 329 bp, Heterodera glycines
  SCN-specific regions: Sequence locations=27-31,67-91,248-253,307-329
ttttttttttttttttttttttttttgcttccttgctttctgacttcttttcctccttctctgcggggcgcttctccttcttaccaacaggcttttgctcctcattctcctttttctctggttccttgctttctgacttcttttcctccttctctgcggggcgcttctccttcttaccaacaggcttttgctcctcattctcctttttctctgcttccttgctttctgacttcttttcctccttctctgcggggcgcttctccttcttaccagcaggcttttgctcctcattctcctttttctctggttccttgctttctgacttcttt

SEQ ID NO: 85452 - DNA, 442 bp, Heterodera glycines
  misc_feature (396)..(396): n is a, c, g, or t
  SCN-specific regions: Sequence locations=1-442
gggcattctttccgaacaatggttgggtagcaaacggatgtttttcggcttggacatgtcccacgcgccgccacagactttattcgaacgacgtacgggaaaagcgccggccattccgacgattgttggcatggcctacacgatctccgagcacttgctgcagatgaatggcacctattggatgcagcagccgcgtgttgccaccgtacaaatggcttctccgatggtcaacgcggtcaaggaggcactgatgactttcaatgccaaaaacgggttcttccctgaacacatcttcgtgttcagagctggtgcttcggaaggcgaatacaaaaaggtggcatattgggagggcggggcattcgccactgctttcgctgaactgacgaaggaacgcanaatgtcgaagaagcctgcgttgacactgattgtgtgtcaacgtaat

SEQ ID NO: 85453 - DNA, 441 bp, Heterodera glycines
  misc_feature (405)..(405): n is a, c, g, or t
  SCN-specific regions: Sequence locations=1-441
gggggatggcgccgattgtttgaactttgcatggatcatgtcaacggattgggctgttcctatcaaaatgtccgcttgcgtatcggaagctgtcttgccaccatttcatcgtccgatttcaagaaagcacttgtcgaggcgaatggaggagaagcgaacgccgacgacgacagccaattgaaacatgtcaccgttgaggaagtgatctcgcgcataaatgccatgcttactccactgtggagtgaagcactccgttcgtccgttggtgtgtccgccgatgttcctcacaccgaatcggcactttccttggatggcattgtcgtcactcccgccgatgaacacaaacgagaaaagctggcgctaattacactgcttaactacttcagcagtttgagcacgcattgngcacagttactgcgcccatttgcaacgtccatcttc

SEQ ID NO: 85454 - DNA, 346 bp, Heterodera glycines
  SCN-specific regions: Sequence locations=27-346
ttttttttttttttttttttttttttcgttgaccatataattctttaaattcatcaaatcgttcaatgaatttgcgctttttctcatcatataattggtttttcattttctttttatttaattttaattcatttttccatttgggtattaattgccgatttgcgcctaataattttgcaatttttctttcaattttgtcataatctttccttttgtattttattttttcacgtaatttttctttaattgcatcaaatttttgaacaatttctctcttttgctgatcatttgggtcttctataatattctgatcacttttcgaatggttctgatcgggataatttct

SEQ ID NO: 85455 - DNA, 451 bp, Heterodera glycines
  SCN-specific regions: Sequence locations=1-254,276-451
gggattcattcactcattttgaaacaaagccacccatttaccaattacacctttcaccttctactcccaccaagtccaaaaaccaaaaacaagtcatggaacgcactttcgtctgcattaaacccgaatccgtccgaaggtgcctcgtaggaaagatcattgaacgctttgaagccaacggctttcggctaattgccataaaaatgatcgttgcaactcgcaaacaagcgatggaccattacgtcgcttgtgccggccaaccctttttccccaaagtgatcagttatatgacctcgggtccggtggtggcaatgatctgggaaggtgtcggtgttgtgagaggaatccgcaaaattttgggtgccacccccgacaaagttcctccgcccggcaccctccgtgccgattaccgtaacaacagcgacgtgggcaaataccatgacacggtttg

SEQ ID NO: 85456 - DNA, 273 bp, Heterodera glycines
  SCN-specific regions: Sequence locations=30-33,55-88,110-273
tttttttttttttttttttttttttttttgaaattaaactttaaaacaaaaatagaatgttgaaatgcagcgaacaaaaggaaaacatttttcatcgaattgggtcggctacttgttgttcttctcccctgtaatattccacaagtgtcggatgcgttggctcgaacaccttttcgtcctccaaactgaccaattggccaggctcgagtccaagaaacacttggtccgggcttttttgttcattttcgaaaggggggggaccggggaccaatg

SEQ ID NO: 85457 - DNA, 479 bp, Heterodera glycines
  SCN-specific regions: Sequence locations=1-116,138-288,311-479
ggggattgagattaaatttcctctgcctttcgacaactttttcttcctaacaatggtccaaatgtggtgcatggagacctacccgtgtggtgatccgcgtcttccgcaccactgtttcccaccaaaattggtgaatccggacgaattgaccaaacggacgggcgccctctattataagttggatttggaagaccaagtggcattatcaaaacgaattgcaattatgaaattggagcgcaacttcaccaaggaggacacgtacacattggacgcacagacaacgaacgattttaaggaaaagatcgcagaacttttcgaagagacggaaagtgacgaggatcaagcacggatggttttggaagggtcggcatattacgacgtcgaagccaaagacggagtttggatacgcatcttttgtgagtatggcgacttactcatcatccctaagggcatcgcacatcgaatgaccacaacgccga

SEQ ID NO: 85458 - DNA, 430 bp, Heterodera glycines
  SCN-specific regions: Sequence locations=1-6,63-430
ggggacaaataaatttaattttttaattttttcaaatctattacaaaattcaaaaattaaaaccatgaattggatgcattattgtttaatcgcttgctttgctttttattatttcaatactgttgagtcatccactattaattcggtaaccgtacaagtgaacaagattgaaaacaatgaaaatggaagacaattcaatttggaatttacaaaccaagtttatgagcgagtgtgccacgttgactttcgaattgatctgccagacacagtaaaattgaacaaatattcaaaaatggtgccaattcctgacacctgcggccagtacgcattgcccaagagtttggacttgcttcccggcgagtcatttgatgcacaattaacactgcttggccatgatgggaagccgaatgtgactgtgctgaacacgaac

SEQ ID NO: 85459 - DNA, 232 bp, Heterodera glycines
  SCN-specific regions: Sequence locations=30-232
tttttttttttttttttttttttttttttgagaccaaatttgtcatttctgtctccataataatccgtctttgttccgtgcgcactggcggggtattaatcgacccctccagcgcgttcaaaaattgccgttgtcgcaaatgcctctgatagtattggtcgtcgtccataaacggttgagcgaatgtcggatgattgggaggaacgtggcgaggagtggtcggctgggagga

SEQ ID NO: 85460 - DNA, 194 bp, Heterodera glycines
  SCN-specific regions: Sequence locations=28-194
tttttttttttttttttttttttttttgcgaacactgtttttttacacatcccacaaatgttgttcaaaatgataaaattgatagggttggaaatggaccaccaatacaaaatcaattatgtctgaaaatggaatttttttttgcatcgatcccttccgacgaatttgttcaatcacagcgtcgttcaattggt

SEQ ID NO: 85461 - DNA, 311 bp, Heterodera glycines
  SCN-specific regions: Sequence locations=25-81,103-311
ttttttttttttttttttttttttgcaaattggggatttatttggttcataagatgttttccaagaatagatttataagcgttatgtgacattaacaaataacgggtcctgctggagagaacacataataatataatagtttttctgatgaaatcaaaaggaatagcacaaggagaaggacaattaatcggaccatcacataaatttctgtccgttccctccttttcactgatatttttacttctcaaacactgccgggcggaggctgctggttgttgttgttctgattgcctccagctccggcgccacca

SEQ ID NO: 85462 - DNA, 509 bp, Heterodera glycines
  SCN-specific regions: Sequence locations=1-121,161-509
ggggaaacacttcaccattactcgtcgtccatttcgtccgatttacacatttcctttccctccgttctgtcgtccaactgctgccactttcaattgcccttcacggcaattgttgatgacattcctcctcctcctgctgttgctgctgatggtggtgatgtcgtcgttgatttggagcaacatgttcgccaactcatcatgtccatcggccagggaagcgaggacgcagtgcacgagctttccattctgatcgagccattcaaccaggagcagctcgtcgactttctggagattatggcaagaatgtacgtcgagagcggagtcagcgttgacttgccgggtggccaaggaatcaacatgttgatggtcgctgcgtcctctggaagggtggactttgcgcgctacttgctcgcccacggtgcaaccgttggacacttggacgccaccggaagcgtcttcccactaatgctagctgccgaatctggtgagttggaggtgtgccgtctgct

SEQ ID NO: 85463 - DNA, 458 bp, Heterodera glycines
  SCN-specific regions: Sequence locations=1-111,133-458
gggatataaatacccattagcttcaccaacgcttaattgattctcaggatatattaattcatctgttttttaaaaatcccaccgattggcactttcattccttggactttctctgcacttagaattatttaaatggataaattggttttaaaaatccgtgagctcctcgatgagaacgaagtaaattttggggaagtgcagcgaattttggaagagtataaaagtgagccgaaggattggagacaattcacacattttgacgaacacaagtgaacggatgaagtgaagcaagtggaaagcaaagtgttgttcagatacacgcgaaatttggtggacgcggggaatggaaaatacaatttgatgattttgtgctggggacccggcatggggtcgagcatccacgaccacagtgctgcgcaatgcttcgtcaaagttttggatgggcaacttttggagac

SEQ ID NO: 85464 - DNA, 437 bp, Heterodera glycines
  SCN-specific regions: Sequence locations=26-119,141-255,277-342,380 -437
tttttttttttttttttttttttttcggcttcaaatgacattttattacataaaaggcacaaacaattcaaaagaaaggcacaatattactcaaaaaagtgaagagaggacacaactttaaacaaacaaaaggaattcaatgatcggaaaaaatgtttgggaacaaaatgttggcatattaaagaggagagatatttgggatcattcattttctatccgtccgtttcttcttccaccgttcactgactgtcgtcgttctgctgcttcttctgctgcatcttcgacaaaagttccgtgtgaatgttgggcaacacaccgccacgagaaatggtgacctccgcgagaagcttgttcaactcctcgtcgttgcgcacagccaattgcaaatggcgcggagtgattcgcaactttttgttctccctcgccgcgttgccggc

SEQ ID NO: 85465 - DNA, 324 bp, Heterodera glycines
  SCN-specific regions: Sequence locations=37-136,159-324
ttttttttttttttttttttttttttgattttttttaggggtttagatttatctaaaaagattcaaaacaacaaatagtttaaaaagttgtggaaaaaatttgttttgaaaaactaataaataaaagaggattgaataaaatctgaaaactaagcatccattctttcttcctccgttagatccatccatggccctaatgatgatgagggtcgggtccactcggtgacagacgcttcgattcattgaccggcattttctcagcaagttcgcgtaggtgtgccctcattttttctaatcgatttgcccccatttcaaattgtacag

SEQ ID NO: 85466 - DNA, 371 bp, Heterodera glycines
  SCN-specific regions: Sequence locations=1-371
gggcagggtgagatcactggcctttcgcccggaaaacacggtttccacgtccacgctttcggtgacctgtccagcgggtgtatgtctgctgggccccacttcaatccgacgaacaaaacccatggtggaccggaggatgagacgcgccatgtgggcgatctcggcaacgtgttggccgggcaggacggagtggcaaaactcgatttcacggacaaagtgatttcactggtcggtccgcacaacatcatcggccgcgcgcttgtcgtgcacaagctcgaggacgacttgggccgtggtgaaggactcaagaagccggagagcatggagactggcaatgcgggtccccgtttggcgtgcggagtgatcggaat

SEQ ID NO: 85467 - DNA, 401 bp, Heterodera glycines
  SCN-specific regions: Sequence locations=34-401
tttttttttttttttttttttttttttttttttcaaatcgaaagatttatcaacaacaataaacgatcaggaaaggctaaatgttagccaattgaagtcaaacttttctccacttgatcgagcacttcctttcggtaatcgtcaaaatcgccatcaatttggtagattttctgatcctccacaacccacaaacgacagtttgtggctttgataagccgttcgtcgtgagttaccatcacaacaccgccactgaagtcttcaatgccttcaaccaaagcttggatggattcgatgtccaagttgttggttggttcgtccagtatcaaaatgtccggctgctttagggacagctcggccaatgccacccgcgatttttgaccgccggacaaatttttgatgtg

SEQ ID NO: 85468 - DNA, 144 bp, Heterodera glycines
  SCN-specific regions: Sequence locations=29-144
ttttttttttttttttttttttttttttgcattttggcgcttttattttgtttaaatttgcgaaactttgacaaattgaaatggcagttgtggtttacaaataaaattttctattcccatcctccagtcaggggatggaaccct

SEQ ID NO: 85469 - DNA, 284 bp, Heterodera glycines
  SCN-specific regions: Sequence locations=27-67,89-284
ttttttttttttttttttttttttttgcacactttttttgttttcgagaattaaaacagctagcattaattactgtgcatttccattgactcggttggtacgcctcccaacccaaaagttttctgacgacagggtcatgcaaatgacccaacggttctttaaaatcttccaattgggggtcaggaatatatttggagcgttggtagcgcggggaatgtttcttaacaacaattttcattccaacgggtgcgtgcgcttgcaaaagggcaatgaaaagggggagt

SEQ ID NO: 85470 - DNA, 546 bp, Heterodera glycines
  SCN-specific regions: Sequence locations=1-546
gggggccattaatttcattcattaattatcagcaattcatcttcgtcaattatctcttctttgtgtacaacaataacgacgacaattgagcaatgtcggaccatccaaatgttgcgctggccgaccttagccgcgtggcaaacgacgtttggctggacactctgttctggattgatcgcgctgaagtgggcatgaagtttgcactgatcgacgcacgtttcggccggctggtggccacgcatttcaacctgcgcaagtggtggctgggcgagctgggcgttcatcgcgcaccgaggcgatggcagtgcggcggtacggcagcggtcagcgcaatggacgactacgcgatgtccaatcgactgccgctcgccacgtgtcctgcaccgaacggcgtgatcggcttccgtgccatctacatttggtacgtcgacctggaagtgatcgcatttctgcagtgcctgcaacgtgtcatcaaccgcggcatcgctgtgcagttcaccatccactcgacggacgtgcgctgctgggcgctgatggcgcaacgca

SEQ ID NO: 85471 - DNA, 603 bp, Heterodera glycines
  SCN-specific regions: Sequence locations=1-73,127-151,175-231,286-603
gaacggccattgcttctgctgctattgcgacgaaacgggccaaaccaagttcaaagtgccggtgcgacggttccgttcaatgctaatcagctaattgctcactaattaccccaaataacaaaactgtgcctgcttctcccaacaatggcccccaaatgccttccgctcgaacttttgttcgaaattgtgcctttcatccctgccgaaaaagccgtcccgaatgcgctctcttcctgtcggctgctgcacaaacttttgctgccacgtgtcatcaaatggaaagagcaactgctaaccgatttgatgagtctctcggcgaaagtggacaatctctcggcgaaagtggacaatctatcgggcgtcgtcaacaatctctcggcgaaagtggacaatctggagaagaaagtggacaatcactcggtgaaactggacaatctggagaagaaagtggacaatcactcggtgaaactggacaatctggagaagaaagtggacaatcactcggtgaaactggacaatctggagaagaaagtggacaatcactcggtgaaactggacaatctggagaagaaagtggacaatcactcggtgaaactggagacg

SEQ ID NO: 85472 - DNA, 354 bp, Heterodera glycines
  SCN-specific regions: Sequence locations=1-354
ctgttgttccgatgttggtggtactgtgcagcggcggcagttgcggccaccggctgagacaaagacggcggcggggcggtatcaaccgttcttcggaacatcgacaatggaggaaagaggagcaacggcggaaatcgccataacttcatccttcttattcggtgtagacgtcggagagggcaatgagtcaacaacggttggagcagcatcagatggcgcatccggctttttctccggttccttttgaggtgagcgatccacgacaacggacgcctttttaggttccggactcaacaacgatttgatggagtttgccacttccaccattaaccattggaggaggagcaacctggc

SEQ ID NO: 85473 - DNA, 171 bp, Heterodera glycines
  SCN-specific regions: Sequence locations=33-171
ttttttttttttttttttttttttttttatttataggcgatttatttaacccaaaattataccaaaaacgtgaaacaaatttaaaatcgccaatgggtgaaatcgcatcagttcgtcacaacttcttcggaaattgtagatccctcccatttttcaacgggaacgcgagcg

SEQ ID NO: 85474 - DNA, 429 bp, Heterodera glycines
  SCN-specific regions: Sequence locations=1-429
gggcggttcgaagactgtgtcagcgatcggacagttctcaaatactgcactgatggaatgcttttgcgcgaggctatgaacaacccacttctggagcagtacaacgtggtcctcttggatgaagctcacgaacgcactttagccaccgacattttgatggggctgatcaaggaaataatccgacagcgtcaggatctcaaaattgtcgtgatgagtgccactttagatgcggggaaatttcagaattacttcgacagctgtccgttactttcggtccctggccgtacttttccagttgaaatattctatacacccgagccggaaagagactatttggaggccgcagttcgaacagtcattcaaattcatgtctgcgaagaagtggagggcgacattctgcttttcctcaccggacaggaggaaatcgaa

SEQ ID NO: 85475 - DNA, 412 bp, Heterodera glycines
  SCN-specific regions: Sequence locations=40-157,179-412
gggagcaggtggtaacaacgcagagtacgcgggactctttcatccgaaaactttttcgaggacgaagaacggccggaggagaacatttacgagaggcattttgcccagcagcaaatgaccaaggaggagacgaggctggtcgagttgcaaaagcgcaaagagaaagcgatggaaaaggcggacgcaacgcaacaaattgcgcaggacataaatgacttgaatcagatcatgcaggacttggcccaacttgttcatgaacaacatgacatggtcgacagtattgaggatcacgtggagcgttcaatgcaagaggtcaaatcgggcgagcgcaatttgcgtcgtgcggtcgcttcaaacagtgccaagtacccagtggccgccgctgcagttggcggtgcggtgatgggcggac

SEQ ID NO: 85476 - DNA, 424 bp, Heterodera glycines
  SCN-specific regions: Sequence locations=28-58,103-424
tttttttttttttttttttttttttttctaacacattttaatggctcaaacacaatatatacatcaaaatcaatatgaaacagaattcaataaagacaatttgtcgtcatcttgatcaattgaccatatcattatcccaccaatgcccttttccgcaacatattttgccttgtccttcagtgattgggggttgtcaaaggttaaaaaatttttggtagctgtatcataaatgtatgcagttttggccgttttatgatacgttgtcttggtcatgtcaaaacttttgcccatgttacgccaggctaattcggtgccataagtgcccaactgacgccaaagtccgtcaccgtttagtggtgctccaacattggtccaagattttccgtagaatggcacacccatgttcaactttgctcgattatac

SEQ ID NO: 85477 - DNA, 207 bp, Heterodera glycines
  SCN-specific regions: Sequence locations=28-207
tttttttttttttttttttttttttttgcgggcacacaagtttattaacaataaatatgattttgtgctcaataaaatgtaacagaacatgcaaaagagtaataagcagtcaaacgttgattggtttgaaaacgtggaagccgtccaacgcagtggaaaatgccaacccaggggactgtttgtgccaatgaacttccttcacttctt

SEQ ID NO: 85478 - DNA, 453 bp, Heterodera glycines
  SCN-specific regions: Sequence locations=1-52,74-374,396-453
gggcacggacatcaacatcagtcagtctcttaccactcgcttccatgaggaaatggtgaagcaagaagtcaggatggatgtgcctatccatgtcatggtgctccaagccggggcatggcctctctccgtgccaacggctcccgctgagccttcgtcatcgtcacaacaacatgagacttcggctgactatgtgccgcctccggtgctgcaaaattcactcaaactgttcgaacagttctacacgaccagtcacagcggaaggaagctgacttggttatacggaaattcgaccgccgaagtgcacctcaattaccttgacaaattataccaagtcacaatgagcgtttatcagctgtccattctgttgctcttctcccaccaaaacacccaacaacttgcacaaattgccttcctttgcagcttatccgtcccagcggtgatcagagcctcgag

SEQ ID NO: 85479 - DNA, 491 bp, Heterodera glycines
  SCN-specific regions: Sequence locations=1-491
ggggtggcagcagccaatgcaatggccgacacttctggtcaactgaatgaacgtttcgctgacttggaatgtttggcggatgcccatcagtcgttgtcccgtgaatccgctcaaggcaataaaaatgcgcaccaaattctacacaaagtgctcacacaattggaggagttgcttaatgatatgaaaagcgatgtttctcgtcttcctaccacattggcccgacttcgtccggtgactgaacgacttggaatgacagaaagagcaattcttggacgtctgacaagcaaagacccggacgcagtggctgggcaaagtccattacctccgcccggaccctttgtaactccaatggcacaaagtcgcttctcgggcatacagccgaaattcgccgcacttttgaagccgaaacaccaatcaaagaaagaaaatctaccagagaaagatggaaacgacaaacaaaatcaggaggaaaagcgaccgagcaaagagga

SEQ ID NO: 85480 - DNA, 503 bp, Heterodera glycines
  SCN-specific regions: Sequence locations=1-503
gggcgactctcttgaaatggactaacggcacttttcccgaaatgaattactctcgtgttgtttgtggccaggatccccggtactgtgctcgcccgcgttcagtacatccttatgtgtggggactgaacatttcgaattggccgatttgcgaaaagcattctccatcaatacccaaatccgaaaagcatatgcactgtacggtcacaggacggccttgctgcattcaaatgcacggacaatgtcggataacgtccagggagtactgcgactttgtccgtgggcatttccacccgaatgcgaccctttgttctcagatttcctgtctgaatgaggtttgcggaatgactccatttctgaggcgtgacattcccgaccaactctaccgtcttttcactccactctttattcatgctgggataatccgatgcgttatttcgctcacactttacctgaccataatgtgccgattcgaaattatgattggttggcttcgtctctcctct

SEQ ID NO: 85481 - DNA, 370 bp, Heterodera glycines
  SCN-specific regions: Sequence locations=1-51,73-206,228-322,345-370
ggggatccaaatcaacgcggcacagtaataaaatattaaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgatta

SEQ ID NO: 85482 - DNA, 213 bp, Heterodera glycines
  SCN-specific regions: Sequence locations=31-46,68-213
ttttttttttttttttttttttttttctttaaataatttattcattaatcggaaaattttcaaatctgtacatggactaaataggagtgggagattttaaacataataaggaacgggcgaatggaaccgtcacaaagcgattttcaaaaagacctaatgatgaccaacaattaacacaataaagaatgggtaataaattaggaatatttgggc

SEQ ID NO: 85483 - DNA, 119 bp, Heterodera glycines
  SCN-specific regions: Sequence locations=1-119
aaaggaagaagataaatcgagggtgcaatggcaaatttcacaccggcaaaatttattagtcacatggcccgaaggattcttaagcaaaaattaaacttttttttggcgaattgaatgac

SEQ ID NO: 85484 - DNA, 299 bp, Heterodera glycines
  SCN-specific regions: Sequence locations=1-299
cgttgggagctctccccatggtcgacctgcaggcggccgcgaattcctagtgatttcggaggatttttggcatttgcgttttacagtttgttttgtccctctttcatgacgtcctctgctgatcactgttccccgttcacgttgaacaaccgaatggcctcagcgtcgaattgcagacaaagtccgtcgttgatcagacgccaaatgtacggcacaaaaaagtccaccgtatcttcgtcttcgatgtatttgaagcgcaagtcgggaaatttctttagccgatcgcttggccattcgat

SEQ ID NO: 85485 - DNA, 393 bp, Heterodera glycines
  SCN-specific regions: Sequence locations=1-64,86-393
ggggacacgtagttgtccaataagatttgttacaaacgcttggaacttgcagtgagaacaacaattgcaacaatttttggccttgagccaacacaccatcagttattctgttcaacacttagtacgaccaaagaagacccctttcaattgcatgtgaacatggccgagaaaaggaagcttctgaacgaaattgataaatgttataaaaagatcgacgaaggctttgaaattttagatgacatcatggagaaaatgaacgaagcaaacagcgacaatcaacgagagaaattccaggacgacctgaaaaaggagataaagaagctccaaaggttaagggatcagatcaaaggatggcaaaactcttcggagatcaaggacaaggactctctgtca

SEQ ID NO: 85486 - DNA, 243 bp, Heterodera glycines
  SCN-specific regions: Sequence locations=29-85,107-243
ttttttttttttttttttttttttttttggaaatgaaaatttatgaatgctttaaagtgcagaaaatagtgcgaacaaagtacataaatcaaatcctgttgaaatggataagtaccatcaaacgcgtgtgtttaatggagttttcaggcatgacaaataatttgctgggacgtatccttgctgctgatcaatacaatgtctgggttgggtttttttcctaaccaaccaccattcattgtttcc

SEQ ID NO: 85487 - DNA, 437 bp, Heterodera glycines
  SCN-specific regions: Sequence locations=27-36,59-97,141-175,198-437
ttttttttttttttttttttttttttcgtagtaaattttattcatttaaataaaattgtaacaaaaaaatcacggtcataaaaagcactggtttttcaattaataaaaaataaataaataaaattttaatttaaatttaacggattttctgtgataaagccgcttgcttcattatttgtttcttctgctgctgttggccgatcagcagtgaccaaattcccattcacatcgaactgttgcggtggcagcgattgctttacggacaaacggcgagcttcggcttgttgaatttgtctgatcaaatcgtaaacggattcttttgtcctgaactgttcataaatgttgccgactcgtgcacgttcttcaccgtgcctttgttcaatttgtgttggcacttttctatttcgaattaaatcaaaattaatttgcgggaaaac

SEQ ID NO: 85488 - DNA, 499 bp, Heterodera glycines
  SCN-specific regions: Sequence locations=1-68,90-499
ggggtgtccaggccattcattattcattttctttaacgaagtaccacaacaacttctgcatcccagaacattcgttcattcattcatcattcataatggccagaccaagaggcggtggaagaaacccagcaaaagcacgcggtgccagggcaaagcgtcgcatcggcaacaaaagaaaagcggccgcagggactgctgcaaacgttcaagctgccgacaggcgccccatttgtccgatctgcttgaagaagatgaccggagtccgtcaggtgcgcaccatctgtgaccacgtgttccactacgtctgcttccaccgttggctcaaatatcgcctgttttgtcccgtctgtgagcgcaactttcgcacggaattgtatcatgcgggaaacgccgtggttgagggagcgtacgccgacggacacgttgtgctccgaactgatggtgaacagagcaacagtggctaattgatcattgatcggcactcacctccaattgtgat

SEQ ID NO: 85489 - DNA, 220 bp, Heterodera glycines
  SCN-specific regions: Sequence locations=1-220
gtgcccgcggtggtcagtgccggcgacgacagcgcaaatggtccgccgctctctctgtccggcgtcacttcgaaaggctcgccgcatgttcaaagcgaatgatggcgaaaagggcaaaaacagcgacaaaaaggaaagtgccagcgacggcgtcggcaaagaggacgacggaggacgagagggcgacatcgacggacatggcggggagaaggaagggacg

SEQ ID NO: 85490 - DNA, 326 bp, Heterodera glycines
  SCN-specific regions: Sequence locations=28-57,79-326
tttttttttttttttttttttttttttgaaaattgaaacatttattggatattagccaatttctcaattaattgctttcatttgccttatacactgaaaagtcacaaaaaggcagagaataacaaaagggcatccaatcataaaaggggcagtgcaaagcccattttccttctctaatccgtccccttcgactacaatcgcgaaatgatttcttgcaactccgattcctctaaccacacaattttgcccaacgttttgccttccttgtccgtctgcgggttaatcataacaatttccacatttttggaattgattttctcttccat

SEQ ID NO: 85491 - DNA, 477 bp, Heterodera glycines
  SCN-specific regions: Sequence locations=1-249,271-394,417-442,465-477
gggaagcaatttgcggaaaaaatttgccgaaacggaagacgaattcaccagagagattgaacgagtgactgcagaaagagacgaactgagaaatgagaaggaaactttgagcaatttgcaaacgcagcggaaaaaatcggacgaaaggcaaagccaaacggacgatgaaccgaagcaaagaatgacggagcagcaaattgcggaaatggtcgagcagaatgtgcagctgaagacggaactgaacgagcgagaggaggagctgtacaggctgcgcaacgacaaagtgttggccgaaattacgacgtcggagggacatagcaaaaggcctcccagtgacacggactcagcgacttcaaacaacgattgggaacggatgggcaaagaggaaatcgaagccgaaggggtgagcagcagtgccggcagcgaagagaaggaaacgcccatggcaaatagacacaaaaaatcttcggaactgag

SEQ ID NO: 85492 - DNA, 374 bp, Heterodera glycines
  SCN-specific regions: Sequence locations=1-374
gggtggaccggcattttgctctctgttttgatgaatttcatgttcatgtatacctcaactgtgctggacaaatgttgggtgattctccaacgtcggtggccctccagctacagtaagcagcattgtcgccaaccgtaccccgaactcggaggcagggcatgcgggccgaagttacgagcggcggttgcggcgtgcatcgatctgaaccaattcagcaccaccaccgtttatctgctgctgtccgctaaaaacattcacgatgcgctgaaggcctttctcgacctgaacatttccttctgtctgctgctcatttttctcgttttgctgctgcttccgctgatctttttgaattcgcccgtcgatttttggggtgc

SEQ ID NO: 85493 - DNA, 440 bp, Heterodera glycines
  SCN-specific regions: Sequence locations=1-113,135-440
ggggagatcggaccaaatcaacccacgccttcgcgaagaagcacgcagtgatttcccaacgtcaagcagaaacatcatcagagaagtgcgtgccgatttgccaattgaagttagggcagcttctgctccttcaccatcaaatatgcgttggaattacaactatgccaaacgaaaacaccaagaagaggtggtgtggctgatgcatggatcagagggcgtgtcattgccttgaacttggcccattcgaacgcaatgttcccccgtgaactctggaatgtggttgatcgtgttgccgctgggataggaagaacaaataacagtgtcgaggcgtggcactccatatggaatgttcatctgaaaggaaaccaacgattgagctcattcattcgaaaaatgattgaagaggataatatgtgggcaaacagaattgcagattttca

SEQ ID NO: 85494 - DNA, 289 bp, Heterodera glycines
  SCN-specific regions: Sequence locations=29-131,153-159,181-289
ttttttttttttttttttttttttttttggcaaaaaatgttttattcgtaaaaaacaacagaaacagaaaaaaattccgcccaaggggaaaaacacacaaattaattctgacaatgagcagaaaaacaaccactttcaaaaccaaagaaagagtccaacaaaagttaaacaaagaaagggaattaataaattggggggtataaagggaatgaactttaatggtatgatattctcaaagaacgttacgccaacttattcattaccaaacattgtgatcagagcagaacaa

SEQ ID NO: 85495 - DNA, 348 bp, Heterodera glycines
  SCN-specific regions: Sequence locations=29-348
ttttttttttttttttttttttttttttcaagcagggtaattttatcaaaaaatcagacttttatgacaacccggcaaatgaaagaattttgcaacaaaaaatgcagtaaatatgattcaaaaatgtattaattgcactaactatcgaacataaacaaccgagatttggtcacaagggcaatgagcaattgccacgtgtttggataattaaagcttcactaattaaaggcgtcaacaaatgcttcggcttcttcttccgtatcaaaaacatcggccaagggtgaacagctcgccctcatttcgccaattttcaaattttcactaactgccgcagccacttggaggatg

SEQ ID NO: 85496 - DNA, 437 bp, Heterodera glycines
  SCN-specific regions: Sequence locations=1-437
gggcccaattcgccctatagtggagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaaccttgattagggtgatggttcacgtagtgggc

SEQ ID NO: 85497 - DNA, 221 bp, Heterodera glycines
  SCN-specific regions: Sequence locations=29-221
ttttttttttttttttttttttttttttgcgaatggggctttttttatgcacctcaaaataaaaacacttagaatttaagaaaaacattaaaaacctataaattatcgtctaattaggggctaatcggggccggtggggctctctctggcatccttcggtgcttttcccttattcgtttttctgggcgtcgtccgatggggggacgtgacgaccaaacata

SEQ ID NO: 85498 - DNA, 378 bp, Heterodera glycines
  SCN-specific regions: Sequence locations=1-2,28-41,72-128,153-233,271- 278,310-310,334-378
gggggtttaattacccaagtttgaggacaaatggttgccgccaatctgaagctttccctgatttttgtggccggcttttgcctgctgttcatcgccgactccgatgccgggaagtcgtgcaaaccgggagaaaagggaccgccaggccctccagggaagccgggaaacaaggggaagcccggcgtgtgcaagcccaaatatgaaacaacttccaagtacggtacgactacttccaagtacgacaccaccacttccaagtacggtacaacaacacccgaatacgatacgacaacatccaaatacgatacaacgacttccaaatacgacacaacaacttccgactacggtacgacaacttccaaatacgatacaaccact

SEQ ID NO: 85499 - DNA, 225 bp, Heterodera glycines
  SCN-specific regions: Sequence locations=1-2,33-225
tgttttttttttttttttttttttttttttttaccaaaattaaaagctttttatgcgttaattaattttaatttcatttccgaatcgtacaacacaaatctcttttgccattatcttaactcccttttcacccattggccattcgatgggacaaaacccgcgcagcattccctttgctcttcgcccccatttccattcgttttgggattggtttcttgcggccct

SEQ ID NO: 85500 - DNA, 492 bp, Heterodera glycines
  SCN-specific regions: Sequence locations=1-140,162-492
gggccgtcaactacggcggaactccttctcccgggcggaagcattggtcgtcttcatgcaagcgaactcactcattctaaaagcgaatggagcgaaggaactttcccaatgcaaaactttatggcacggagctcgggcaaaacaataacagtgaaagtgatttgcgtgagccgttccaaatcgatcagtgcccggggacgggagttactcatggaaaggcgtcagagtgacagaatcgtcgaatgcactgccatctccgagaaggttcaagaaccgcgaaagaagctctctcttatcagataccgagaacagtttgactttggaaatgtcgtccccgtgttcatcgtcgacacggcaaaaaaagagggcactgatcagacacactttaccggggagatcaatcccgaattccgtgcaataattcaaatcactcaatcggcaaaaccggcagccaaaaaggacgggacggacactgatcagtctgaaaacacc

SEQ ID NO: 85501 - DNA, 438 bp, Heterodera glycines
  SCN-specific regions: Sequence locations=1-4,311-382,417-438
ggggagtgcgacggtttcgttcaatgctaatcagctaatttgctcactaattaccccaaataacaaaactgccccctgcatctcccaacaatggccaccaaatgccttccgctcgaacttctgtacgaaattgtgcctctcatccctgccgaaaatgccacaccgaatgcgctctcgtcctgtcggctgctgcacaaacttttgctgccacgtgtcatcaaatggaaagagataatgagtgaaaataccggcttccaaaagcaacttcttgaaatggtaaaggccctccatgaaaaagtcgccgtcattgaaaaaaagcgtcgccatcattgaaaaaaaacgtcgccgtcattgaaaaaaaagccaccgtcattgaaaaaaatgtcaccgtcattgaaaaagaagtcaccgtcattgaaaaaaatgtcaccgtcattg

SEQ ID NO: 85502 - DNA, 266 bp, Heterodera glycines
  SCN-specific regions: Sequence locations=27-266
ttttttttttttttttttttttttttgcttatgtttatttgccagtttaaatatgatgtgcatgtgaagaaatacataacaaagtatagtgagggcagagaatcaaacaagaaaaaaacggaacgtaaagcccttggaaaaattatgaggaaattaaacgtttatgaatttacagcaaatgatcgcatggatttaaagttagggtaggccactctttacacacatatttcgatcgcctcattgccccattcatctgacagtcgact

SEQ ID NO: 85503 - DNA, 461 bp, Heterodera glycines
  SCN-specific regions: Sequence locations=1-168,190-461
ggggacacgtagttgtccaataaggttaattattttgtccgtcctttttgtcccactcaaaaatgctcagtcgaatgttgtcctcggctgttgccgtccctcggatgtgtgaatcaaacaaaaaattgttgaggaaaggcgcgattttcgttggtcttctctgtgggcgaatggccaactcaactttcactgccacagttacccctcctcatcggctcttacgtccgttgcatatcaacgaaaaaaaattgttcggacctggtcccagtaacatgccaccactcgtccaggagggactcgttcaaccgttgctcggacatatgcatcccgagttcttcgaaattatggatgatgtgaaagccggcatcaaatacattttccaaactgagaatgcgctgaccttcgctgtttcgggcactggccatgccgggatggaatgtgccattttgaatctgctggag

SEQ ID NO: 85504 - DNA, 340 bp, Heterodera glycines
  SCN-specific regions: Sequence locations=1-340
ggggattttttcatttgcttcatttccgggattcttaatcattccaaattgcaataataaactgaaatgctttttacaatgaacttcgtcctttgcttctcgcttttacgaccacttttggggttcaaccatttactcaagtgctcctcctcgttcatccacgcgggcccatggggaaattgacgctgtgcgactttgatcaacgacctgagcggaactctgcgggccacggatgagaagcggaacatcagctgcatttcctatgcggggtgcatgtgtctgaatgcgacgtgccgtgtcgacagtcgccatgcctatttggcctatcaccactgcgtgt

SEQ ID NO: 85505 - DNA, 172 bp, Heterodera glycines
  SCN-specific regions: Sequence locations=32-172
ttttttttttttttttttttttttttttcttccgatcaaatcgtccttcatcaaaagcccatccgaaacaatcaaatggttttcccagtggcggccaacacgcgcgccttgttcttgttgggcaacaaaaatccctcccgttccaactggttcaccgcatcctcaaagcatt

SEQ ID NO: 85506 - DNA, 435 bp, Heterodera glycines
  SCN-specific regions: Sequence locations=30-137,159-171,194-435
tttttttttttttttttttttttttttttgagtaaacaatgtttttatccaattaacatagggtcatataagcacattaagtaaattggtatcacacatttcaattagagaattaacaatttgaataattgggggcgtaaagaaacttaattatgggatacaatccttttcaaaatctaagggaacaaaaattggcggaggggataaaatttatcgactgggcatcaataccattttaataattgatatcatatgtcttgaggagcaattaagtcaattcagttctcttcataaagctgcctgatttcctcctcgaacttcttctcgatgttcttgcgcttcagtttcaatgcttcgggcagcattcccgaatcggcagtccacgggtccgcacaaatgatgactttcctggggatttcctccctacgcaatttg

SEQ ID NO: 85507 - DNA, 492 bp, Heterodera glycines
  SCN-specific regions: Sequence locations=1-492
gggcgcttccgtgtggaagcattgggccaattttctgggcaatctttacctggctaaccactctgagagttcagcactgagcaccggtgtgcaggccatggcgtccactttggagcacatttcgatggtcggtgcgcaaaagtcgcgcacttctgtcgccaaattgttgtggctgctcaaaattgcctccgcatgcccttccgaaaagctgatgaatgccgtggatgagctgctgttccgctacgtggacaccattcagccggcgaattggctttttggttgaacgaactgatcactgatgttcaacagcggaggggtaacgcgatggccgagattctaaagcgagtcggtctcctgcagccgcaagaagtgttctgcgcattgcgcgtcgaacttgggccaagccatgttggccgttacatccaacaattcataaatcaacgacaactgcttgcttcttcgggtgcaaatgcctctgctgctactactgcc

SEQ ID NO: 85508 - DNA, 364 bp, Heterodera glycines
  SCN-specific regions: Sequence locations=1-364
gggatcggtctgaataacatcaaagcgaacgactacaccaatgttgagtaccacgctcttttccatgttccgaccttacgcgattatttccttcgcgagcaaaattacatgcacattaagcgaccgaccggtgacaaattgacactgatgccacaacggtttggagaattgttgcgcaagttgtggaacccaaaggcgttcaaagcgcacgtgtcgccccatgagatgctgcaagcagttgcgttgtgcagggacaaaaagtttcaaatcatacgacaaggcgatgcccatgagtctatgatgtgctttctaaatacgcttcacattggcttgaatggcaccggaaagacgaattcgtcaatcg

SEQ ID NO: 85509 - DNA, 404 bp, Heterodera glycines
  SCN-specific regions: Sequence locations=1-404
gggggttcagcgttctcttcgtccgtacatcgcctcctctcatcaattaaattaccactctgaggacaacgggggtgcttctgctgtgaatgtttgcgcggaactctgcgcttttctctgtgctaatggattcgcacgcgcagccaaacggagaaaaacggcgccgggaatcgaagagaatgtggcgcgcgatggaaactgtttgcctgctgaaatgggcaacaaaaagggtcgtggagtgcagcttggacttcgttcgttgctgcgttttcacaacaaacgttacactgcgccaaagtcggaggagaaaacgcagcggcgtctcctcgtggtgctgctggacgccgacttcgcgaagcccatagcactgcgtcatgtgttcgctttgcttgcactcggtccca

SEQ ID NO: 85510 - DNA, 146 bp, Heterodera glycines
  SCN-specific regions: Sequence locations=29-45
ttttttttttttttttttttttttttttctcgcccgatgccgctgcttcctccttcttctcttccgtctcgcgtttctccttcttctcggcctcctttttttcctccacctccttggatgcctccgccttttcctccttcttctct

SEQ ID NO: 85511 - DNA, 418 bp, Heterodera glycines
  SCN-specific regions: Sequence locations=1-418
gggaagagctgttggagggcaccatttacgcgctgtggcccgaggcatcgttgacgttgccccgctttttggccgaccggaaattctttgacgcactgatgagttattgcacaatgagttcacgtccggtgctgccgcccgagctggcgcatgccttccgcttctttcaagcaattgcactgtccggcaagggggagccggagggcgcttggaatctgttcgaagaagttgcttatggtgttgcgcacgaggacgaagtgctgaacacagtgttgtcccaaatgtacgcgtcgccatccaccgaattgttgcctccgaacggcacgaccgcggcacaacgaagcgcaaaggtggcggcgacaaggacgacgaacacaaacagcccagtgctggccaacgaacgtcgcggcagcaacca

SEQ ID NO: 85512 - DNA, 115 bp, Heterodera glycines
  SCN-specific regions: Sequence locations=1-39,68-115
aggcgcattcttcgatcaaggggatggcaccagaaatttcggaggatctttaccatttgatcaagaaggcggttagcattcgtaagcatttggagcgttttaaaaggacattgac

SEQ ID NO: 85513 - DNA, 403 bp, Heterodera glycines
  SCN-specific regions: Sequence locations=1-193,218-403
ggggctcactttggtcatttactcgttggacaccgttttgcttatgctctttccccgcccatcggctggcgtcggaatggattttggcccatatctgaaattgaccgccattttcatcgtcctctctacttttgggctcggcttatcattggcccacatgaaaaaaatgctgcaaatcggcaaagaattggccaaacaaaacgaaacgacaaaaacagcgtcggccacttttgttggacaggacaatttgcgaacacttcgggcattcaccgggtgtcaggccggcctttccgtactttccatttatgtggccgcctcattagcatttatgaaattttggtatgtgcgtactcatctcgtccaagagttctcctgctctttgatggccattactttggccgtt

SEQ ID NO: 85514 - DNA, 457 bp, Heterodera glycines
  SCN-specific regions: Sequence locations=1-121,143-356,381-457
ggggaagatgacttctttaagaaagtcatccatgaaatgacaatcaaaaacattgactggtacactttggaccgaacaacgcatttggcagaaaccacgttgggcggtctcattgtgctggtgttttcaaagacaattcaaatcaatacagttcgaattcgggaccgttactttcacatgaattcgttggccactttggcaaatctcgcctccttcttcaagcagttgtcccctttggcctctcagaaactcattggactgctcgagacgatgaccaaacggcgtgcaaaattaattcgattactgagagaacgtgcagaaaatgaaccccagcaacagattaaccgagaggaggcgaaggacgggggaggagaggaggaaacagcgacggaaagactaacggaggcggaggagggcgacgatttgcaccatgacatcactgcgctggaggagggca

SEQ ID NO: 85515 - DNA, 254 bp, Heterodera glycines
  SCN-specific regions: Sequence locations=28-254
tttttttttttttttttttttttttttgggttataatattctcttcagcaattaatatgtaaaagtcagacgccgtaattgaccatcaaaatcatcctttcattgggcacgggcacgttcactgagtggcacatcgcaccgcttgcgggtctccgttgcttgcctcttcgtcgtgcgctcgccggcgtaacatttcttcagagatgggcaccaatttgatagcgttctgcgcgttcgctccgattggttccggc

SEQ ID NO: 85516 - DNA, 344 bp, Heterodera glycines
  SCN-specific regions: Sequence locations=1-344
gggccaattgtcgctgcacaatccctggcgcagttacaacgtcgtccgtctccgtcccctcaccaattacactttctgtctggagtaccatctcgtccattttccacttcatttggctgattcgtcctcatccattttcaaaacttgcatcgacgttcaaacggaagaaccgctcggcttttggacttcgctaagtccgatttcaattggcattcttttggcgttctgtttctgtctgagtgccctcctctgtttccgcgctttgtatctccgtttttacatttggcacgaggcgaagctgcgtgcgagaatgaaccaaagcatgagtgggcaaagctttttgt

SEQ ID NO: 85517 - DNA, 518 bp, Heterodera glycines
  SCN-specific regions: Sequence locations=1-518
gggagcttcattacgtgcaagacaaggacgtggacaaggaaatgtccgatgccaatttggtcggcactgccgaccatcctctgtcgtctttacaccatcgcccatccgcctatgcatggcctccaccttcccactcgttgatggaacgtttccgtcaggctgccgtcacctcagataacggcatttgttccgaaattggccgtgacgtgatgatgcagaaaaatggcaatgccgtggacgccgcggttgccgccatgttgtgcattggtgtgaccaacgcacagagcagtggacttggtggcggaatggtgctgaccttttatgatgccaaaacgcgctcatgcaaagtgattgatgcgcgtgaaacggcgccggcacgcgcgactgccaaagcgtattctgaacgtgtgaccgcaaaccgaacgacagcgcgtgctacgggttaccatgaaattgcaacgcccggagagcttgctggattgtggcttgcatacaaaaagtttggcagtggccgagtg

SEQ ID NO: 85518 - DNA, 517 bp, Heterodera glycines
  SCN-specific regions: Sequence locations=1-517
ggggactagtgatagtccaattaagcatgaatacgaagacaaatcaaaagccgatcaaagttttatgtgcgggcgatgtcaatggaaagtttgcgcaactctcagcgcgtgttaaagcggttgaccaaaaatgcggccctttcgatgcacttttttgtgttggcgaatttttcggaccgaacgacgagcagaacaaatccgttttggagggagagatgcagctgccgctgcccacttacattctcggtgtccttcttgccagttcaccaccgtttactttccgtctgaaagttcggagctttgccaaagtctcacatttttgggtagaaaaggcattttgacaacagcgagcggaatttctgtcgcttatttctccggcgttgaagaaagccctggaggacaccagcaggacgagacgaaaccatttgaattcgaccagaaagcggttgatgatttacttttgccactctccgccaattcgggctttctcggcgtcgatttgctgttgacctcagtt

SEQ ID NO: 85519 - DNA, 331 bp, Heterodera glycines
  SCN-specific regions: Sequence locations=28-46,69-331
tttttttttttttttttttttttttttcgggtgggacttttttatcattttatttaaaaagggtgcaaaatgacaatttgtttccgtttaattcacaacgaacgccatcttcacttttctgttttgaacacgttctcaatgaacgatgccaatttgacgtccctttcggaaatgccttgcacgtcgtgactgctcagtgtgatgtccactttgttatagacgttgaaccattctgggtgggggtccattttgtccgcctttagtgcgattcgcgtcataaaaccgaacgcttgattgaagtctttgaaagtgaagctttttttgatggcat

SEQ ID NO: 85520 - DNA, 338 bp, Heterodera glycines
  SCN-specific regions: Sequence locations=29-56,79-338
ttttttttttttttttttttttttttttaacacaaacaatttatttatcgagtatttaatggtgttaggcacaataatacaaaacagtatgtacagtcagagcagcagcaaatatcgagcgtgacaagcaaaatatatatggggataaaacatacatatgtacgtacgtatccatacatggaaaatgatcgaatataaaatcacatccgtccgattgtttgtgagccgcaattccctctcatcattgtcagtgccgtgtccatctgctgctgctgttggtcgtccgtcgttttgccttcaacgttccgccgcctccgttcgttcggctgccgtggtag

SEQ ID NO: 85521 - DNA, 292 bp, Heterodera glycines
  SCN-specific regions: Sequence locations=26-151,174-237,260-292
tttttttttttttttttttttttttgggagaaaccatctttaatttcaaaaagaacaaaaaaaggggaaggggcactgaaagcagaaagaaattggtaatccccggttagtccttaaaaggatagaattttgaattgaataccaagtgataaaagaaagagggaagaggaggaaaccaaaaagtcgaaagccaatgccttccgcgtaaggggaatttgtgagggagggacagagtgaagaaaaaagagatgtagcacaagcagaaaagctgggcacattcactccatttctt

SEQ ID NO: 85522 - DNA, 356 bp, Heterodera glycines
  SCN-specific regions: Sequence locations=29-63,85-176,198-356
ttttttttttttttttttttttttttttagagagattaattcattgtacattaataaatcaaaataaaagaaagagaaagcaaattaagggttaagattaaaaaacaaacaaaaaaagaacgaataaattacaaaaaaagggaccaagagacagagagatgagtgagtgatacaaagtgaatgccgttgagatcgtccgtctccttcctacgacaaagtgccggtccccgagtcgtcgtcactcgtcggtgtgttggcggccgactcgtaattctgtcgttggtccgtttggtaatcaagcgaaaaggtaggtggaaaagcgagcagtccatcagctcccaattcctccaattcca

SEQ ID NO: 85523 - DNA, 494 bp, Heterodera glycines
  SCN-specific regions: Sequence locations=1-494
ggggggtcgcatgggcaacgaaaagggcattccgattgcggagccggagattgtggctttcaacagcccggataactcggaccgagaatggatgacgatgttcgagcgatgcgtcaacaagcacatccaattcatcatgctggtggatgaaaagcgcaaggacacccacggactgctcaagctgtcggaggcaatgcacaaagtcaccacgcagcatgtgacgctggagaaagcgaatgacgttgtgcggaagaaccagcgccaaacgctggagaacatcctgaacaagctgaacatgaagaactttggcctcaactacgtgccggtgatggagccgtcggcgtgccgtcgcttttcgctcgaaaacggaaatgtgcttgtgatcggctacgatgtcaaccatcctgctcccatgccgcaacagacccgtcgtttgttggcatcgcagggcgaatcgcaattgagctcgcttgacccgtcatgtgtcgggattt

SEQ ID NO: 85524 - DNA, 345 bp, Heterodera glycines
  SCN-specific regions: Sequence locations=30-158,180-345
tttttttttttttttttttttttttttttatcaaaaaaaatttgtcgcataaatttgagtaaaaacaataaaatacggagtgtaaatagttttccttctctcatttaggaaggcatttgaaacaaaaatttcatcaaaaagacagtcgaatttgaaagttcccatccaaatatcaatcattttccccatttctttacacaaaatacccatttatctcggcttgctgccgctgttggcctgctgctgttgctgaacccgtctttcctgcgcacgcaagttgcgctcccgctcaaattggctgtagtccgcacggagcaaaaactcctgcttgtccaaataggcgtc

SEQ ID NO: 85525 - DNA, 362 bp, Heterodera glycines
  SCN-specific regions: Sequence locations=30-93,142-246,268-362
tttttttttttttttttttttttttttttatgcagttcaaatttaaaagggattttcggaataaaccgaatacctaaaaattagctcataatcaataaaataataatttttaaaatgtgaaaaaataataattgttaaaatgtgaaaagtaaattagggttaagtgtgaggtgaaagggggggggcgtggcataaaaatttggaaattctcagtgtgtgtaagtgatgttgaagcggtacattccgttttttcccgggggtttatttgtacaaaatcatcaattggtcgccaccgtttcactttggcttcttctctccctcgccaattgagtacgggtccgcctttccgtccgtctgttgct

SEQ ID NO: 85526 - DNA, 449 bp, Heterodera glycines
  SCN-specific regions: Sequence locations=1-449
ggggggggggccagcctccccaacccaaactctgctggggtcactgcttttaattctaatggaagaagtcgcttcgaatttaactccgaatgaggcgccctttttgaattttgaccattcgaattccatggccgtgccttcccaattcgcggctgaccaatgtccgcttcgttttcctcggcctcttccgccgcctttccccgctgaacatccgaaggaaaagcgagaaaattctctgctccacaatctgatcactccttggaaccgatcgttcgttccttcgtcggatttctcccatcgattgctctcatctcccgaatccactgaatcctcgcagagtttcatggttaagaatgacatgacatgctccgccagacgaagtttgagttcggaattggagaaaaatgcaactggcgatgggaaagtgccaatggccgattgggaattga

SEQ ID NO: 85527 - DNA, 396 bp, Heterodera glycines
  misc_feature (285)..(285): n is a, c, g, or t
  SCN-specific regions: Sequence locations=1-51,73-206,228-322,345-396
ggggatccaaatcaacgcggcacagtaataaaatattaaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgncggattggtgccatcgcatgtgaccaatcgctcaatggctccaccacctcctcctgtgcaatttgaaatgggggcaaatcgattagaaaaaatgagggcacacctacgcga

SEQ ID NO: 85528 - DNA, 266 bp, Heterodera glycines
  SCN-specific regions: Sequence locations=25-266
ttttttttttttttttttttttttgctaaaattgtttttttttcacaatggccaatgattaagacgcaattagtgtgactaattgccccgcttaacggacccctttctcgcttgggtcgtttttggggctgcagtttcttggtccatcatctccagcagatgtgctcccttacgggaaccttttctggacgggggcttttctgttgatgatggggtttgcttgctccggtctaagtccatctctttcatcgctttgctcaacgacg

SEQ ID NO: 85529 - DNA, 175 bp, Heterodera glycines
  SCN-specific regions: Sequence locations=1-175
agcgtaacatttaaccgtcggcgttccgcgctccaatcgccgaacgtattcaaattgctggacgaagccgaagaagtcgtccggcgatcagacaacgcggggcataaaaatggcggcagccggaggcaattccgggcgattgggacaaccgacgctgggaaaaaggacttcaatt

SEQ ID NO: 85530 - DNA, 492 bp, Heterodera glycines
  SCN-specific regions: Sequence locations=1-270,292-492
gggaattaagaaaccaactattgcgatggctgctaatgaaaatatgcaaacagaagacaataaaaaaggaaaagtgaccaatgatgagcgtaacttggtcgtctcatttattcagtttttgcgtcacaaagtctcatcgaaccaatgcactgatgaacagattgaaggccttgaagttgctattcaatgccttgagaccgccttctttgtttctgacagaaactatgcgttccaaccgtccaaacctctcatcgaaattttcaaagcagctgaaggacttcccgatggggatcaagagtttcctaagccgactcaaacggacgttgagaagtcaaacgcattgaaggaagaaggcaacgaactcgtgaagtcgaacaagttcgaagaagccatcctcaaatacaacgaagcaattaagttgaatcgcgaccctattttcttctgaacagagcggctgcttattgtcgtctggagcaatatgatctcgcaatc

SEQ ID NO: 85531 - DNA, 554 bp, Heterodera glycines
  SCN-specific regions: Sequence locations=1-115,137-554
gggaatcattcttcatttcacttccttcccattttttcaccagcgttaaactgcacagcaccgcggatggtctacgaggagtactgcttcgatgtgaggctcgacgacttcaacgaggagtactgtttcgaggtgagcaacgccgacatcgtacacaacagctgcctctatgtggaacagacgaatccgaactacatgaccatccatggcgtcgactacgacattttcgtctgtgagaagacaatcagcgggctcaaagatgaccgaagcgaaaatgtgttcaaccgtagacaaggagcatgtgcaagcggggacgaccgatgcgataacgttttcaaccgtggacaagtggcaagtgcgcgcaatggtgaaggaagagacagcatcctcattcaaggattggcgttcgtcattgtgaaagtggtcaatgcagtgtacgatatgattgtttaattgtgatcaggatatattcatcacgtatatgtaaacaattatttttgtgtgtgtcgtatatgtacgaactgaatttctgaacattcgtcatatgtatgtaa

SEQ ID NO: 85532 - DNA, 465 bp, Heterodera glycines
  SCN-specific regions: Sequence locations=1-465
gggattgcatcagttcctgaactcccgcaaaaattcctcaaatcctggtcggttgatcattccgaaaatttcgacgaatacctggaggccaaagggtacggctggttcatgcgccaagtggtcaagcttgccggcatcaccaaaacattttcgaagaatgagaacggcacatatgcatgcaaaattgaaaccaccaaaaagaatgtggagtggcccagcttcaaattgggcgaggagttccaagccgagtatttggacgactcagtgcctaagatcaccttcgactacaacccaacaaccgacgagctgatcgaaacgcacaaaaaggtggactcggaggagaagccggacatctacaaatacaacatcgactcggacggctttctggtgatgcaaatggaatataacggagtgaaaacgaagcgcttctataagaagaatgaatgagcggagggtgaatgcttt

SEQ ID NO: 85533 - DNA, 438 bp, Heterodera glycines
  SCN-specific regions: Sequence locations=1-3
ggggaggcgagcgacaccatcgagaatgtgagggcgaagatccaggacaaggagggcatcccaccggaccaacagcgtctcatcttcgctggaaagcagctggaggatggccgaaccctcgcggactacaacatccagaaggagtctactctccatcttgtcctgcgtcttcgtggaggaatgcagatctttgtgaagactctcaccggcaagacgatcaccctcgaagttgaggcgagcgacaccatcgagaatgtgaaggcgaagatccaggacaaggagggcatcccaccggaccaacagcgtctcatcttcgctggaaagcagctggaggacggtcgaaccctcgcggactacaacatccagaaggagtctactctccatcttgtcctgcgtcttcgtggaggaatgcagatctttgtgaagactctcaccggc

SEQ ID NO: 85534 - DNA, 294 bp, Heterodera glycines
  SCN-specific regions: Sequence locations=28-85,121-154,176-294
tttttttttttttttttttttttttttgagcaaaagggctttttttttttacaacaaatgacaaaattaaatgctgacactaataaagagaagcagcaaaaatgaagaaaagcaaaggcaacgattggaagaaattgacagcaaaaagtgatcaaatgatggccattttgattgggtgggcatttgattgattattaattggccaattgttgctgattcgtcctcctccttcacttcacaattgcaatgtgcaacatttggctgctccgccacttttcataaattcggacatat

SEQ ID NO: 85535 - DNA, 566 bp, Heterodera glycines
  SCN-specific regions: Sequence locations=1-60,82-566
gggtgtgtactctaaggaaggaattaccgggcaacaattaagtgacgaaaaactacgcagaatggccaccagaaacaacagcagtccgtacattttgccccggaggacccccaacagcgcacgccctgggacatttattaccacaaggaatctgtcagcgctgcacatacaaccgcggcctacaccatttttgagtgggactatctcgaaatcctcaccacagccgttgcgagtggtcggtcgaatcattgacccaatggctctcggttcgtctcgtcaaattttattagcaccctcttctacggtgctgtcacctgccgaacagttttcaaatgtccagccagtagtcaatgacaatttccatcgccctctgtcccgtcagcagagaacgcctctgttcaagttgggccaggatcagtccgaagaagacgagtttgaccttgatgagatgtaccgattgcttgacgaaagtgccggctacagagcccaagaaatgagtcttccgaggcggcgagagcgactcaacaatttgtcacaggaagagaaaatcaacagacgaaagcaca

SEQ ID NO: 85536 - DNA, 284 bp, Heterodera glycines
  SCN-specific regions: Sequence locations=28-30,63-95,127-284
tttttttttttttttttttttttttttgggaaaaagaatttatgcaaaaatgcagtttaaagtctaaataaatgcgcactattgccccacttcgtcttccattttctcctcctcctcctctccattggcggcaccggtctccattccctgttcgcagtcgctttgtccatcctcttgctggcctttttcttctggctccccttttcctttgggttcaaaccggttttcctctctttggtttgcccttctctctcttcgggggtggtggcgctgattcttctttt

SEQ ID NO: 85537 - DNA, 263 bp, Heterodera glycines
  SCN-specific regions: Sequence locations=28-28,56-263
tttttttttttttttttttttttttttgtaaataaaaaattttattttataatttctaccggatgtttattgggttttcatgtttatctcttttacatctatcctaatctcttgcaaaatcccttctgccgctgctccatcactgctccgtgttgcccttgaccaatgccaaaagtgcgtctcggtaaactccgctggtgtcccctttgatcgcctcctccaagctcttcttgtgcaacgtgtgaaaagcgtgtttgatgtca

SEQ ID NO: 85538 - DNA, 328 bp, Heterodera glycines
  SCN-specific regions: Sequence locations=28-49,73-118,141-235,257 -283,305-328
tttttttttttttttttttttttttttatgatttattcatcgtcttttgtatattacagtagtatcaatgatgcaataaaaaggcaatatttggcatgggtatctgtgctgggcgataattaataatattttgaacacagtaataggcgatgcaatgtacaataaacaatcaagtgggagtaaatgcacatgaaggcggaagaaatcattttaaatactaaaaagatgtcccgttgatcttgaacagggtggccgggtcaagcaatttgctcttgaactgttcgacccagtgactgagggaaatctctttgatgttgagtttggcaga

SEQ ID NO: 85539 - DNA, 307 bp, Heterodera glycines
  SCN-specific regions: Sequence locations=27-58,81-307
ttttttttttttttttttttttttttagtcaattaaccattttacttgtccatacaatttcataatgcaatacattttctgaccctatagacctatacaaaaatacaattttgtgattaaagcaatgcaattacgaggcgtcaaatggatatagatatttaattcattcacttcgacgccttctcaagttcaatgagtttcttaacaccgtcatacatttgcttgaccgcctcaaattcggtaagtccaagccgagccttgttcgacacgtcgtaaaccccgccttcactttccgagtggtctccgt

SEQ ID NO: 85540 - DNA, 412 bp, Heterodera glycines
  SCN-specific regions: Sequence locations=1-188,214-412
aggactcgacggtgaatagcgaggcgaacttggagagtattgaggcgatgttggagaataattaggagacgtcggagtgtagctgggcgacgtcggactgtaggtgggacttgtaggagaatagcgaggcgaacttggagagtattgaggcgatgttggcgaatagcttggagatgtcggagaataacttggtgatgttgggctgtaactggggcttgttggcgaataacgcggagaactcggcgaatattgcggcgatgttggtgaatagctcggagatgttggtgaatagctgggcgacgtcggactgtaggttggacttgttgccgaatagcgtggagagcttggtgagtactgaggcgatgtcaacgaataatttggtgatgtttgagagtagctcggcgatgttgtc

SEQ ID NO: 85541 - DNA, 240 bp, Heterodera glycines
  SCN-specific regions: Sequence locations=29-32,55-151,176-240
ttttttttttttttttttttttttttttagatattcatttataaatacaaaaaagtttcatttttgtaaaaaaaagacaatctgagcctaatgaaatgtcgtcgtcataatgtaaaacacagtaattcatcagcgacgtttaccgtacccatagccaccgccgcttccgccgcccattccacctccaaaaccggtgcccattccgcctccaaaaccattgcccattccgcctccaaatcc

SEQ ID NO: 85542 - DNA, 239 bp, Heterodera glycines
  SCN-specific regions: Sequence locations=28-239
tttttttttttttttttttttttttttggtaaagggtttttctgaacatttcctttctttgcattcactttggcgcctctttctcgtaattgcttctgatgcttcctcttattttctcccccattggtttggcaaaaaattcggatacaaagttcggcaggggccacaacagaacaatgccatctcttggggctttatgggatcttggcaatcattttcatgcttctgacattcgtccg

SEQ ID NO: 85543 - DNA, 337 bp, Heterodera glycines
  SCN-specific regions: Sequence locations=28-31,53-337
tttttttttttttttttttttttttttaccaaatatttattactttaaataaatgttcgacatgtcaacaaaatggttttctattctatttcctcctgatttgtttgtcctcaaaaatcgaggtccgatgacaacggttcttctttctttccttggccaaccgaactgtgttggccagggttggcaatcacatggctcggactcggcacattttgatgtgcaaaaacccctttgcttgggactccaaaatgcacatccgtaacttcaaagttcttttcttgtccaattgctttgattgcttggctttcctgctcaaattgtactttcatgtattgcc

SEQ ID NO: 85544 - DNA, 422 bp, Heterodera glycines
  SCN-specific regions: Sequence locations=1-86,108-156,179-422
ggggttctttttggcattcgcccaaatttggtgccaatcggccgaggaccccgccaaaacgtcccggcgccttcttctcgacccgcaccccccgcccaaattccgcgtcctcggctctctccaaaatttccccgctttccaaaacgcatttaactgccccaaggacagtttatacgcacctaaagaacactgtgacgtgtggatcagcgaagtgaagcaggtgaacggcgataactttcttccgccgccgccttcgcttaacattccccaaaaagaaagtgaattgacaccgaaattccgcgaagcttccgaatattttgaaaaatccgtggacatagcgcaggacccgtgcaacaatttctacgaatacgcgtgcaatgctttcgatgagatcgctcatttcgacagaatcagcattcaga

SEQ ID NO: 85545 - DNA, 267 bp, Heterodera glycines
  SCN-specific regions: Sequence locations=26-63,85-141,166-239,265-267
tttttttttttttttttttttttttataacaatttatttatcgagtattaaatgttgttaggcacaatatacctaatacaatatgtacagtcagagcagcaaatatccgagcgtgacaaagcacatcaaatatacatgacgataatatatatgtacatacataaaaatgatcgaatataaataacatccgtccgattgtttgtgagccgcagttccgtctcattgtcagtgccaccatcacatctgctgctgctgctactgttggtc

SEQ ID NO: 85546 - DNA, 150 bp, Heterodera glycines
  SCN-specific regions: Sequence locations=29-150
ttttttttttttttttttttttttttttaatgccgatcagtttaccaaaaatttcaaaaaaaaaaacattttttgaaatttgcaactcccaagaaagttgaatgaaaaatgtaaatcccccaatcaacaaccatccattttccaccacct

SEQ ID NO: 85547 - DNA, 414 bp, Heterodera glycines
  SCN-specific regions: Sequence locations=1-36,58-117,139-226,248 -342,364-414
gggcttcatcgccgccgcatttctgctcaactttggctgctgtcagcaaaatgagagccaaacgacggaaactcttcgcgccagaaatgcgtcgtcatcaccgcaatttcctttgaacaccacaacattcacaaccaccaaaaaagaaacgacggttgccactccttcgactacagaagctggcactgaggcggcgacaactgatgatactaatgacgaacaatcattgctgttttggattttgattggcgtcattgtagcaattgtgctcttcttggtcctgctggtgtgcattgtgtgctgcatgcgaggaggaagccaaaaagatgcacgcgaaaccgtcaatggcgagagcggaggggctgtgaccaaattaacgatgaatggggacaacgccgacagttccagtgcttc

SEQ ID NO: 85548 - DNA, 162 bp, Heterodera glycines
  SCN-specific regions: Sequence locations=90-111,133-162
tttttttttttttttttttttttttttctttttttttttttttttttttttttttttttttttttttttttttttttttttttttttttccctggggtaggttattccgaaaacccccgggaattaaaaaaaggggggggaaatttcccccccaaagccggt

SEQ ID NO: 85549 - DNA, 257 bp, Heterodera glycines
  SCN-specific regions: Sequence locations=28-257
tttttttttttttttttttttttttttgcgggcgggtaaaccccacaaataaatcacaacatccatcaaatgcaacaatcagtcaaaaagaaaaaaacaaacaacaacagatcatcatttttttcgcgccctaagggataataccccctccaaaaaaaagctcgtcattttgcggcctctccctctctttaaagttcgtctcgcgccgccggttcctcctcctcctctccctccacaacaattttcttttcctcatc

SEQ ID NO: 85550 - DNA, 454 bp, Heterodera glycines
  SCN-specific regions: Sequence locations=1-342,371-454
ggggattccctcaaaagcaaagccatccatccgatcattcgcttcatctgccaatccgcaaaatgtcccttttccgtcctcaatcgctgcttcttctggccgctctttgcctgtcctttgcgctgctctttgtcacttcgtcggaagagggagggcgagtgaagcgcggcggatggccttgggattgggccggcaaacaactgtgcaaaacatcggcaaattgcaagtgcaaggatggcaaaaattgggccaaatgtgtaaagtcggaaggctacgcggccagcaattgttgcgacaaaaattacgtgtgggcatgttgcgggaagaagcccaaacattgatgagagaagagaaagggagagaatgagaagcgagttcacataattcattctgttttggatttttagtcttttttttctttttgggtttttttggtaaatattttctttagcaa

SEQ ID NO: 85551 - DNA, 547 bp, Heterodera glycines
  SCN-specific regions: Sequence locations=1-547
gggggtctgtctgtccgtctccactcaccgcccactctgtcgttcattcgcagtgttacacatgcatctgaacagtttttcgtggcgatgtatcgccagtcgaattggccgtggtcgcacttttcactgaacacgaggggccgtcggtagagtgcgcaactgagaaaggaaatggcgttggtccatcagtcgcggccgattgtgaggcgaacaaattggccgaagtcaccgagggattggcgagaatcaccgcgacggcggagggcggcgagactttctacaaccgagtgcaggagttcaaccgagacttgacgggtttagggtcgtcgttttgagggcattcgctgccgaaatacccaacgaaaaagagccgaaaacggaagaggagggcccaaaagccaaacagaggaaaatggacgagggaaaagcacccgaagcaaatgcagcgcaatcccagccccgtgccttttctgtgctcgatgccttgtccgcttctggtctgcgcgccattcgcttcgcgttggaagtgccaaatgtgacgcgagtg

SEQ ID NO: 85552 - DNA, 119 bp, Heterodera glycines
  SCN-specific regions: Sequence locations=1-119
ggaagaagataaatcgagggtgcaatggcaaatttcacaccggcaaaatttattagtcacatggcccgaaggattcttaagcaaaaattaaacttttttttggcgaattgaatgacccc

SEQ ID NO: 85553 - DNA, 298 bp, Heterodera glycines
  SCN-specific regions: Sequence locations=30-298
tttttttttttttttttttttttttttttgaaagcgttgaataatttattttccatcacccagtcaatgcacaattcgccactcatttaaggacccccaacaaatgagaggacattaaaacgttaatttctgttttacgaacgattcttttttaattctttcttttttggatggaataaatagtcaggggtttttttcatttttttttggtttccttacatttttggcattgccttttccgaagggattagccgttcatttcattgccccttgggcgcatcattcgcgggacaaaacc

SEQ ID NO: 85554 - DNA, 330 bp, Heterodera glycines
  SCN-specific regions: Sequence locations=23-216,238-330
ttttttttttttttttttttttgtaatgtaatataaaaaattgactaattaatgacagaatcgatctagggagggtttagggatgctttgaaagtagtcttacaaattgaaatgcattggatgcagaattaaaaatttggttctgtgcttaagttgtttccaatcatattatatcacagggttattaaaataagcatatttggtttcaaaaacagcagcaatgaatggctcacaatcgggtggcattgggcttatcaataataccttaacaattttatttagagagagtcgatatctcaatttgtccccatttttattcgttgccaaagc

SEQ ID NO: 85555 - DNA, 215 bp, Heterodera glycines
  SCN-specific regions: Sequence locations=31-215
ttttttttttttttttttttttttttttttgcgggcgctcaaatcatagtacgctttacatgcacattgccccgggcagctacctcaaagatcattcgaccaagtgccaaagacccgccagttagcaatatgggtcaaagccttggcgtgagcgctggttaaccagcatttatgaaccccacttcacttaccaacgcgcttactgggccgaactc

SEQ ID NO: 85556 - DNA, 126 bp, Heterodera glycines
  SCN-specific regions: Sequence locations=90-126
tttttttttttttttttttttttttttttccttttttttttttttttttttttttttttttttttttttttttttttttttttttttttgggccccaaccccaaaaaattttttttcccctttggc

SEQ ID NO: 85557 - DNA, 322 bp, Heterodera glycines
  SCN-specific regions: Sequence locations=28-29,56-322
tttttttttttttttttttttttttttggaaataaaaaattttattttataatttccacaggatgtttattgggttttcatgtttatctcttttacctctatcctaatctcttgcaaaatcccttctgccgctgctccatcactgctccgtgttgcccttgaccaatgccaaaagtgcgtctcggtaagctccgctggtgtcccctttgatcgcctcctccaagctcttcttgtgcaacgtgtgaaaagcgtgtttgatgtcagccaggtcaatctcagaccgagaaatgaccagaccaatcaaatcccagtcgcgtgtgcc

SEQ ID NO: 85558 - DNA, 323 bp, Heterodera glycines
  SCN-specific regions: Sequence locations=25-323
ttttttttttttttttttttttttgctacgcccctcaacagcgcggaacatttacgtcgaaaaattttacatattaaaagtaagaaatgaatccctcaaagatgggcatatcataagtcacaccatcacaacgaaacaacattatttgtagaagggatatgacggaaagccttgtgccgggggaatcgtgccaatgcctcccgtgggatacccgggtgcgtttggagtcgtcgcggcgggggagtacgcgggcagcatcagttgggggtcaatcagacttccgcttcgctgttgctggtctttgacctcctccttgcgttcca

SEQ ID NO: 85559 - DNA, 368 bp, Heterodera glycines
  SCN-specific regions: Sequence locations=26-57,79-368
tttttttttttttttttttttttttacgaaaattgaaacatttattggatattagccaatttctcaattaattgctttcatttgccttatacactgaaaagtcacaaaaaggcagagaataacaaaagggcatccaatcataaaaggggcagtgcaaagcccattttccttctctaatccgtccccttcgactacaatcgcgaaatgatttcttgcaactccgattcctctaaccacacaattttgcccaacgttttgccttccttgtccgtctgcggcttaatcataacaatttccacatttttggaattgattttctcttccatcagctgtttgagtgtgttcagtgcgacttgttttgcctcggc

SEQ ID NO: 85560 - DNA, 492 bp, Heterodera glycines
  SCN-specific regions: Sequence locations=1-492
gcggggattatgctattccattcattttcattcctaatcaattttttttaaattttgcctataattaattctctttttgacgaattgagtttgcaatgtctatggatgaactgaagaaacgcgccaaagccattggtacatttgaggaactaagaaaaatcatagatatccgtggtgtgaatcggtacaacccaaacaatgcgccggttttggaacgggcggtggatttgatgattaaagagacgaaatacgacaaggacattctgatgacactgttgaagctgtaccagttgaacccatttctttacaacgaagagtacgtgtgccttgtgctattgaaaacgatgaccaattttccacgcaacgattttgctttggcaaaatatttggtggacgctgccaaagtgaacgctccggagttgcgacgcgtctgtcagattggctctcttcttgagtcttgcaatttcgcgctcttttggcgtctcgtcgacg

SEQ ID NO: 85561 - DNA, 569 bp, Heterodera glycines
  SCN-specific regions: Sequence locations=1-569
gttggattatgtggtggagaggaaaaccctcgacgacctccggaggagcatcaaagaaacgcgctatttggagcagaaacagcggctgaaaaagtgtgggctaagaaatgttgtttttgtgctggagggtggtactacggccaacgaccggcagttggagcaggcgatggtgtcgagcggcgtggagagcggtttcctcgtccatcggacgccgaatgtgcaggggacggccaaatttctgcaaaatttgacgcgatggctcagagagcgttgttcgaagcaaaaggtcactggcccccctttcgactcgtttcaacaagagagcaaaaaagcccatgccgctactgtttccgattattgggttcgccaattgaccgtttgcccggggttgagcaccgaccgagcacgcatcattcgcaatcgcttcccgacttttcgttcatttgtcgaattttgccgcaaaaattccaccgacaaaaattcgataagagacgactattcgagtgccattggagtcgaattgccccaattgtcagctgcccctactaaaaaccttatgagctttttta

SEQ ID NO: 85562 - DNA, 146 bp, Heterodera glycines
  SCN-specific regions: Sequence locations=1-146
ggggacagagctggcgtatctggtctgcattcacccgtttgttgctgtacgttgggctgctatcctccacactggggtttgctgtccttctgtctcagcggcgaatggggctttttcaggcggagtgcgctgatatgctcagagta

SEQ ID NO: 85563 - DNA, 345 bp, Heterodera glycines
  SCN-specific regions: Sequence locations=32-32,54-345
tttttttttttttttttttttttttttttttaatatctcattctttatccatttcgctagcacaattgcaaatcaaaatcccttttttctattacatgcattaaaatttccatcaaaaattttcctgggcatataattttccgatgccaaaatgccattttcgtcttccaaaaagtgccaatttcggaaatgcaacattcgcccttccgttgatggcaccaggcgtgttgcagtgttcggctttatgatcactggccaatgaatccacaacgattccgcgcgcgaagtgttcaccacatatttgggatcatcgggctgataaaacgcaacttttgctgatgttaa

SEQ ID NO: 85564 - DNA, 308 bp, Heterodera glycines
  SCN-specific regions: Sequence locations=29-77,119-246,271-308
ttttttttttttttctttttttttttttaatgatcattttgtatacgggttcacaaatattttcaataatagcattcaaaatattataaaatatttgttttttaaatacaatattaaagcatcgggtctaagtgattgcctcttttggggctccttctaattaacaccgtatttggccaccattttttcgacaattttcacataatcaatccgagccttctcctgagagatgccttgcttttttttccacgcctcccacttggccttcccacggaaatcaaaagtgccaggtttgcatgtgttgttgt

SEQ ID NO: 85565 - DNA, 263 bp, Heterodera glycines
  SCN-specific regions: Sequence locations=1-8,30-263
ggggacagcgatgatgagaacagcggcgatgtgccgctgagtgacgaggcggacaactgctccgacaggttgaactcggctacgctcaaaattcggcaacaaattacgacaggagttcccaaaagcagcaaacaatggccgacgatcagtgcgcattggacagcgaatgtgcttcgtcggtgttgcaaaatgtcatctcggatgcccttcgcgcgccttccccgtccaatctgcccaacagaacggtgttcgatggcggtcaa

SEQ ID NO: 85566 - DNA, 276 bp, Heterodera glycines
  SCN-specific regions: Sequence locations=29-36,58-276
ttttttttttttttttttttttttttttgccgctcgtttattgattacaattttagtcctgaaaatagaagaaaatcaatgccagaatattcagacagaaatgggagtcacgggtaacaacaattggacttggtactcctgtccgcgccatctgtcaacggctttatattcggaccggggcccatcgagtttctgtccggcaccttgtccaaaatgggttcgggcaagtcgtaaaacgccttttcgatgtttatgtttgccttggccgatgtctcc

SEQ ID NO: 85567 - DNA, 309 bp, Heterodera glycines
  SCN-specific regions: Sequence locations=26-30,76-87,128-170,206-309
tttttttttttttttttttttttttggcctttccttttggtcttgtttttcttctcctcctcctctttcttcttccaacaattggtggtgcttttccttctcttcctcctcattctcttcattgatgggcattggctcatcacagttttcatccctccccttttgctggtggtcttggtcttcttcctcttcctcttcctgtgcccgactttttccggggatcaattccgctaacactgggtttgcgcgtcaatcggcttccaatttggcctggattgcggcctgctttgtctggaactggtcccatgc

SEQ ID NO: 85568 - DNA, 396 bp, Heterodera glycines
  SCN-specific regions: Sequence locations=1-30,62-396
ggggatcatcaaaaattcattcaaccatagaatttattttttttaataaataagtttttttgtacaaaatgagcaactttatatttgtcgcctctttaactgcagcgttttttagctcaggcctcgctctaccggctccttatgatgctgaatcggtggtatcttctgaattaaatgttccactactttcagctgacgcaaatgttgaagcagcaattaccaatgaaagtgatgctgctgctgagatacaagctccatcaattccggtaccaattgaacatcaaactgctgctgacattactcatccaactgaaactggcaatgagtcttctattgcatcatcatcatccacgccgaaaagtgagcagacgccaaaaaaagtgatgaacatgaaaa

SEQ ID NO: 85569 - DNA, 323 bp, Heterodera glycines
  SCN-specific regions: Sequence locations=29-221,243-323
ttttttttttttttttttttttttttttgggttttaatttgaaaatcaaaaaaatgaaaatgaattctttggccttttgtcccttttctttggcgggtcattccctgctcttttgggcaactggttttcccctcacttttctgttccgtcgtttattttggtaaagggttccccaagaaaagggtcacaattccctcgctgaatatcggcgaactcatataattcaatattaatttttccatggattcgaatcggcgattgccaattataaattgggcgctcgcggcgtcgaattgcacccaaaagtgtttgtttttggccga

SEQ ID NO: 85570 - DNA, 225 bp, Heterodera glycines
  SCN-specific regions: Sequence locations=26-184
tttttttttttttttttttttttttggcattggaatatctttgggtcagcaaatcctttaaattggcgacacaattcataacacatcggaggaagcagacttattacttttttaattatcgctaaacaaaagagggcgcatttcgctcattcgcctccgttcactttcgtgtcttcctccggctgcgtttgttcttttttctgttcgccttcattttctgtgcca

SEQ ID NO: 85571 - DNA, 483 bp, Heterodera glycines
  SCN-specific regions: Sequence locations=1-106,130-483
ggggaaataaaaattaaaaagacacaagaaaataatgaaaatgaaagaaacaaaaataaattcattcctgccgaaaatttttgtgagaaaataattaaaattcttcgaaataccaaaagtaaataaattctttccttggctaaatgttcatcgaatttctctctcttccaatggatttgaaatgccgtggagaaaagtgaaaattgacaattagtggcggcatttctgcagagacgaggatggttttattaattcggcacaacaaaaaagagaaacaatgccattaattcaagcggaaattatccaatcggtggcgtcgaattgtgcttttacttcgtcgtttggctttcccattcgcttttggcatttttgctggcgaccaatgcctcgcggagtgtcggccattggctcgaccattggctggagccgagcagctattcgcgcgcactaagaatggacaattcggacattgaactgaaattg

SEQ ID NO: 85572 - DNA, 336 bp, Heterodera glycines
  SCN-specific regions: Sequence locations=26-68,90-99,132-336
tttttttttttttttttttttttttgacaaacatacttttatacctcgcatttgaagcgtgtttgtatatgaaaggggagaaaagagagagttacggacaataaatatttttatataaatgaaaataattagggaaattcaatgggatagaaatacacaggagaactacaatatatgaccattcgtcagcagcagatttatatttgcttcgcgagatccctccctccattattcagcacatcatcgtccgtttaagcgcctccaaagcgctccaaatttttatgtgcgggcccagcttgaacttcagctccgttttcaactgctccgactggaggc

SEQ ID NO: 85573 - DNA, 455 bp, Heterodera glycines
  SCN-specific regions: Sequence locations=1-455
gggcaacaatgcaacaacaacggcaatgtcacggcaccaaccgaacgcattttccgtgacgcgctcaatcggtcgcgacgccttttcttcagcttcactctgctgacagaacacattgcatttgttgaactgttcgacaaagtttggattgctggatggacttcggccgtggatttgcgtcttcgtgaaaatggctgttccctaaactttggcgacgaggttgaacaaattgatgggagcgtagtgcgcaatttgcgagcactgactgaaatataccaaaggataatgccaggggcacagattccgcttttgttgcgtgccaaccccacaatgatggtcttcacactggtcaaacctgaaaatgcccgcctcaatctcggcatcaaatttaaccgccctgccaaattccttctccgtcacccattcgactgtcttaccatcgattcgatcgccct

SEQ ID NO: 85574 - DNA, 413 bp, Heterodera glycines
  SCN-specific regions: Sequence locations=1-50,72-205,227-321,344-413
gggatccaaatcaacgcggcacagtaataaaatattaaaagatccgaaaaaatgccaaacattttcaaaatccttctgattgtgcttttggccgtcgtctcattccgcctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgcc

SEQ ID NO: 85575 - DNA, 317 bp, Heterodera glycines
  SCN-specific regions: Sequence locations=29-317
ttttttttttttttttttttttttttttgctgatggccaatagcttttcaatgtgtcccaccaactcttcgtttccgtcttttgactttcgctcattggtttttcgtccgtcggatttcgcgtgccgtttttcaaattggcaatttcgtcggcactgagcttttcgggcactactggcaattccgtgccatttacaagcgcaacaaacgctttttccaacagttggagtagtttttggtcatccaaaatttcttcgcttattttggattctttggattgcgtttcccccccccgtttcattggcctgccaatgctcg

SEQ ID NO: 85576 - DNA, 401 bp, Heterodera glycines
  SCN-specific regions: Sequence locations=1-255,277-401
ggggattttttcaaattcccaaatggctttttccaaaattttttcatcccttttaatcagtttcctttttcttttacgaaaagcattttcatatactgacaattatatcaagccgtatgaagaaagttacggttcccaggagattccaaatgatgggtttaagcaaaatgatgaacaactacagcaacagtattcaaaagatgaccttaatacttatgacagaaatgaccgccgttacggtaattatgcgccacgaagtggctttccggaagattacaactttaatgacctaaatcgtgacaattatgatccaagttatgataattatattccaagcatagataatgacaagcgttattcaaagaatggtaatagttgctataatgtcaagttgccaaaaa

SEQ ID NO: 85577 - DNA, 393 bp, Heterodera glycines
  SCN-specific regions: Sequence locations=1-2,36-393
gggggtttaattacccaagtttgagttttttgagtgacgtcaagcaccaatgaatatgagctataatgacaaagttggcttcatcaacagtgccagcaaacagttgggggacagattgtcggagcagaacaaaaagatgcacgaaatgttgaaggaggacaaaaacgaacggagcagcacatcgcattttgatgagggcaataaaaagggaagttcgtataattttgaaaaattttcttcatccgaaagtcgtcctgctccctattcatattcgggaaagcccgcggtttattttcgaggtcctaccatcagagatgtgccaccatgagacggttccattggtggcacagtgaccacttgggaatggggaacagtgagcaattgaaaaagcat

SEQ ID NO: 85578 - DNA, 459 bp, Heterodera glycines
  SCN-specific regions: Sequence locations=1-2,36-459
gggggtttaattacccaagtttgagttttttgagtgacgtcaagcaccaatgaatatgagctataatgacaaagttggcttcatcaacagtgccagcaaacagttgggggacagattgtcggagcagaacaaaaagatgcacgaaatgttgaaggaggacaaaaacgaacggagcagcacatcgcattttgatgagggcaataaaaagggaagttcgtataattttgaaaaattttcttcatccgaaagtcgtcctgctccctattcatattcgggaaagcccgcggtttattttcgaggtcctaccatcagagatgtgccaccatcggacggttccattggtggcacagtgaccacttgggaatggggaacagtgagcaattgaaaaagcattaataagaaaaagattgtccatcgccagcaggagaagatttagacgattttgatatgatgatatct

SEQ ID NO: 85579 - DNA, 418 bp, Heterodera glycines
  SCN-specific regions: Sequence locations=1-64,86-257,279-418
gggccaattaagcctaatttgatataacgaatatcaatggaacatggaagtttgccgcttcaactcattattttattcgttttaacgttgcaaatttcaactcagtcgccagaaatttcagtgccttctgatgttcaaattttgtcagcagtccgaaacgtagatttgaccactcaaattgtcaaggttaaaactgactttgagttgaaaaatggaagaaacgaggaattgagcagttttgtacatgccatgtcggctgaggaggctgcaagactttcttggatgtccgcttatgagagcggcaaagaatcgggcaaattacggatttctcgtgttagagtcaaaggggtctcatcggacatggttttccacaaaattgagtttctcgatttgttaatgtccggttccaatatcaaac

SEQ ID NO: 85580 - DNA, 531 bp, Heterodera glycines
  SCN-specific regions: Sequence locations=25-63,85-206,228-329,352 -386,409-531
ttttttttttttttttttttttttcccttttaattggacaaaaaaaacttcatacattttacattaacatttaaattgtttttcctacgtttgaacaaagtttcttctcttcatgaaattcgatattgtgtcaaatgttcgtcaattccgaattccttggtcaattcctcgcgtttcttctcccattctttgctgagttttgcgtgttctccaaaaacatttattttggtgggaagacaaacgaaaacatgggccaattcaccgacgaaactcgtatggagacaaatcgggaaaatgttgagcaatttgcgcttttgttctgcaacatatttgtcttcttctttctcatccgacattaaaatgttgaccacaaatgctcctgtaggttttaaaattgctttgattttttgcaatatcttttcatcagagaataccgaagcgggacaaattaaatcgatgtacatttcgcacgcatccaatgccaccaaatcgaactgttcgccgttttccgctgccttttcaattccgaca

SEQ ID NO: 85581 - DNA, 576 bp, Heterodera glycines
  SCN-specific regions: Sequence locations=1-576
ccgtctgtatcttgcaccaatccatacgcattaacgttctcgtcgggcacgaacttttccgggatgacattgtccaaataccatttgaaacttttacagcccaaacgctccctcaacgctttgcgggcgcttaaatcgccgacttcaacatccttcaatcccattctgtgcacataaaacaaccgtttgtagtcgcccatccaaacttcggccagtcgcttggagttggtgccgtgcacgtccttgttgccgccagggcccgtcatgttgtacgggtggccggcacggaaaatgtgcccgacgtgggagcaggggacgacttcgatggacccaccgcacatccacaccctaaacgaaatctccaaattttcgcctccccaaatgtccattcccgggtcgtaggctccgatttcgaaaaagtattcccggctgactgcaaacagtccgccggccattgtcgggctgtccaaatggtccgcgtgtttccgcatctttgccactctctccggaatggggtccattttgaaatgcaaactccaccaaagagtgccaatgccagcggctggtccgcccgag

SEQ ID NO: 85582 - DNA, 371 bp, Heterodera glycines
  SCN-specific regions: Sequence locations=1-371
ggggttctgcggcaccgacgacgcggacgacaaagtgtggagcaaatcggtgctgcagcattgcatccgcccggaccacggctatacatacgattcgcagcaaatcaaatggctgatcgacatgctgcacggatttcccaaagagaagcgtcgtcgctttcttcaattttgcaccggttcgcctcgtttgcccgtcggcggttttaaggggttgtcgcctccgctgactgtcgtcaagaaaaccgcatcattcgtcggcaacgaaaacgaactgccgtccgcgatgacttgctacaactatctgaaaatacctccgtacgaaagctacaacacatttttggaccgttttgaagtggctcttcaacatgtgt

SEQ ID NO: 85583 - DNA, 608 bp, Heterodera glycines
  SCN-specific regions: Sequence locations=1-235,257-608
gggatattttgttggactgtaaaggccatgtaaaactgacggacttcggcctgtgtaaagaggccatcgaaggggaccaaaagacgcacactttttgtggtaccattgagtacatggcacccgaaattctgatgagaactgggcatggcaaagcggtcgattggtggagtttgggggcgttgacttttgacatgctcaccgggggaccgcctttttcggcagagaatcgcaaaaggacaattgacaaaatcctcaagggacgccttacacttccgccctatttaagtttcgaagcgaaagacttgataaaacggttgctgaagcgacacgtggacactcgccttggggccgggccgggggacgccgaagagataaagaaacacgcctttttcacccaccacgtcgagaattggacaaatgtttatcggcgagagatcgaagccccgtacaagccgaacatcaccagtgaggaggacgcctctctgttcgactccaaattcaccaaaatgactcccgtcggttctccgaccgccgaattgccaccaatgtccgtcaatcccttcgaaggattcacttatatagcgctttccgtcctcgaacaagtcagc

SEQ ID NO: 85584 - DNA, 510 bp, Heterodera glycines
  SCN-specific regions: Sequence locations=1-490
cgggattatggaattttttactatgaagtgaaagttttgaacattaaacgttacatcaaaattggattcgctaccaaaaaattagagttggataccggggtgggggaaaaaccggacagttacggatatgtgaacggtggatgtctttggcggaacggtacggaatactctgggaatcctaaatttgctcgtgacgacactgttgggtgtggcattaatttggtcaccggacggatcattttcacgaaaaacggagagcaattggatacggccgatgtattcgcttctcccacttctcaatggttcccttgtgtttcgttgttggattcgggcgatttaatcaatgcgaattttggccccaacttcaaattcgatccttccgctgtttgagggaaaaatcgacaaatgatggattattttaatttcctttttgtcacttcgaaattcgaaacaatatttttgaattttttattcggataaaaaatgcactaaaaaaaaaaaaaaaaaaaa

SEQ ID NO: 85585 - DNA, 415 bp, Heterodera glycines
  SCN-specific regions: Sequence locations=1-415
ggcagtgattgagcggtgagtttcgtccgcattccgtcgttttgactcccccaagggtttcccattcggccctctccgtcccctcgggcgccaacttcggctccgacatggtccaattccgtcaaatggcgcactctccgcccattctctccgtgccgttggcgacttcagtccatcagtcttcagctggtcgccttataaattctccgcaagctgagaatacgacagaagagtcgaacggccgactcagcggccaactgaaacattcgccgaccgtcggcagcgcagcgacgtcgccgttggcgagcagttcgaccatcggagtccacgaaatctctctttcctacgtccgtcccaacactttttcgccttcggccggggatgaccgtcgttctttgccaacctatttaagttc

SEQ ID NO: 85586 - DNA, 469 bp, Heterodera glycines
  SCN-specific regions: Sequence locations=28-69,98-113,136-411,433-469
tttctttttttttttttttttttttttatctaaaaagattcaaaacaacaaatagtttaaaaagttgtggaagaaatttgttttgaaaaactaataaataaaagaggatagaataaaatctgaaaactaagcatccattctttctttctccgttagatccatccatggccctaatgatgatgtgggtcgggtccactcggtgacagacgcttcgattcattgaccggcattttctcagcaagttcgcgtaggtgtgccctcattttttctaatcgatttgcccccatttcaaattgcacaggagaggtggtggagccattgagcgattggtcacatgcgatggcaccaatccggcggcatttcctccctgagcattgcttcgcccaatcgctttcgccccacccgtcgccagggaagtgaagagcagtccagcggtgacaattcttttgatcttcgtaccaatcccaac

SEQ ID NO: 85587 - DNA, 485 bp, Heterodera glycines
  SCN-specific regions: Sequence locations=23-35,68-275,297-349,371-485
ttttttttttttttttttttttagcgaaacagccatttaaacaacaaaataaaaatcaacagaaaaacaacataattccgcgtcataggcagaccattttcattcactgttattttgaagtgtttccatttttcagggcgattttggcgatcagttcgttaatcagtttgtcggtatgcaaatccaatccttctggcgacttatcagcctcacgcaatttgtttaactctttcaaaatcgtttcaggtttcgggtgcaaatcgatcagatggacaactgcttgggaagccaactgccgaagattttgagaagacgggtcttgtagaattttgaggaggacactttgcatttgggggagaaacgctttgaggaggagagagacattctccagcaatctcagcaacgcgttgacagcagcgaccttcacggggaccgggtgccgttcacccaaaattctgattaatggaccggccatgttcacaacg

SEQ ID NO: 85588 - DNA, 384 bp, Heterodera glycines
  SCN-specific regions: Sequence locations=31-384
ttttttttttttttttttttttttttttttgacttaattggggatttattctttttgaataccaacaaaaaaacaaaacaattagttgaacaataatgctaataaagtgattttccattggggggctttgcatccgtttttcgtccttaatttccgttaatccaaattcggttctccgtttgaacttttgtcacgtcacgggggtcacccaaacattgcaatgcttttcggggggtattttgaattcaacggacaattgaaagcgttgcggaaggggggaaaattgcgcaaggagccgaacacccggaactttgcgggagaatgaaaatcgccgatcagctgaagggacctctcgaaatcgtcgggctgatcacaccacgggtg

SEQ ID NO: 85589 - DNA, 623 bp, Heterodera glycines
  SCN-specific regions: Sequence locations=31-131,154-585,607-623
ttttttttttttttttttttttttttttttaaggggtttaaatttatctaaaaagattcaaaacaacaaatagtttaaaaagttgtggaaaaaatttgttttgaaaaactaataaataaaagaggatagaataaaatctgaaaactaagcatccattctttcttcctccgttagatccatccatggccctaatgatgatgtgggtcgggtccactcggtgacagacccttcgattcattgaccggcattttctcaacaagttcgcgtaggggtgccctcattttttctaatcgatttgcccccatttcaaattgcacaggaggaggggggggagccattgagcgattggtcacatgcgatggcaccaatccggcggcatttcctccctgagcattgcttcgcccaatcgcttccgccccacccgtcgccagggaagtgaaaagcagtccaacgggggcaattcttttgatcttcgtaccaatcccagctgatgagttgtttccactcccatcattagcagtttttttgtcaccagtagaagcccagagacggaatgagaccaccgccaaaagcacaatcagaaggattttgaaaatgtttggcattttttcggatcttttaat

SEQ ID NO: 85590 - DNA, 567 bp, Heterodera glycines
  SCN-specific regions: Sequence locations=28-506,563-567
ttttttttttttcttttttttttttttcacgtatttgtttatttttggaatcaaattacaatgataaagtcaagcaaaagtgtttgattccaatcatacaaaaactgcttttgtgagaataaattaaatgagtcggcagcggcaaagtccctgagattcgtagaggcctcaacgacgagacatctgagaagacacggcacggcactcaactacggaaggaggcggccggtgacgcgggggagggtgcacagtttctccccgcgcgcatcaatcgcgataattttaaatttgtattcttcgttggaaggcgctccgacttgaaacgtcaaactgtaagactccatggagctgcgaacaggaagacttccaattcgtgcccaatcgtccaccccggacagttgcttaacaaatgcctcataacggtcaattcttcggtcctccattccgttccagttgatgcgaaagtaacgcgggtatttttcgagccaaacgatattttcagcgtgcatttttatctctttccatttgatgacacgtggcagcaaaagtttgtgcagcagccaacag

SEQ ID NO: 85591 - DNA, 551 bp, Heterodera glycines
  SCN-specific regions: Sequence locations=1-551
cattccccattctgttccctcccgtgtcccatcaaaatgtgctcgctgaatggctcagtaaactgaaagtgtctcaattccattgcgcagagtccgaaaagtatgcccatgtgactttctttttcaacggtggacgagaagaggcatttgagggtgaagaacacgtgatggtcccatcgccgagggttgccacttatgacaagaagccggagatgaactgtgaaggcattgcggacaaagtggtcaaacaaattgaattaggcaagcacccgttcatcatgtgcaattttgcagcacccgacatggttggtcacaccggtaaatttgagccgacggtgaaggcgtgtgaagcgactgatgtggcaattggacgcattttggaggcatgcaaaagtcacggttatgtgctgttggtgaccgcggaccatgggaatgcggagcaaatgatagccaaggatggcggcccacacaccgcccacacgtgcaacaaggttccgttcgcctgctcttccacctcacactccttcaaaagtgcgccgcccaccactgcg

SEQ ID NO: 85592 - DNA, 277 bp, Heterodera glycines
  SCN-specific regions: Sequence locations=50-97,119-183,206-277
ttttttttttttttttttttttttttttggtttttttttttttttttttaaagcttgtcaaatttattgaactcaaaaaacacgggaatttcgtaataatttctttggcatttcatcaatttaattggttttggcacaaagtgcaattgccttgcatgaaatggcctccaattggcccattagctttttgcaaattttcccaacctcagttaaaaaaatctcctcgctggaagggccacagtcgcgcggaaattcctgtccccagtcaaattccaaa

SEQ ID NO: 85593 - DNA, 577 bp, Heterodera glycines
  SCN-specific regions: Sequence locations=1-577
gggtgaaatggccaaagtcaaacagacggaatggcatgagacggacatcaaaaaattttgcttcgctgaaatgagcgttgatggtctcagggcattgaaggccaaaactgctgcattgtgtttcatttttgagaagacaaccaaaaatgattgttcatgcaaagatttggagaaggaactgctccaacttgggctgccctccgaccatgtcagtgtactggttgaactctacaattcaaacagggccgcattgtgtgacagtttggcagggcctgcaatcaaagccccttcactaacagtggtgtgcaaagagcaggttccaacggctgccgacccgtcagtgaaaagtgactattttcgcttggacacaacaagttcggacgggtcaacagcaaccctgctcatccaccgagatgagttggtacagttgagaacctgcatggaagatgccgtgagagtgctcgagtcgttggtggtcaacaaagaatgatgcccgcttattggagacacgccccatgtccaatttttcaatttgtgacttgccacttaaactaaagcatggcacttacaactagtg

SEQ ID NO: 85594 - DNA, 168 bp, Heterodera glycines
  SCN-specific regions: Sequence locations=86-168
tttttttttttttttttttttttttttacttttttttttttttttttttttttttttttttttttttcacattttttttttttttgaaattccattttttttgccaaataattaataaattaaggggtttaacaagggttggaatcaaagtaaatcaaattttaaggg

SEQ ID NO: 85595 - DNA, 440 bp, Heterodera glycines
  misc_feature (415)..(418): n is a, c, g, or t
  SCN-specific regions: Sequence locations=1-142,166-176,203-418
gggcaatgaccagcagaccattcgcgacctttcacggaacaaacaggaaccggtgaagtcggagcagggaaaggcaattgcagaacaaattggtgcatatgcttatttggagtgcagtgcgaagaccaaggagggaatccgagaagtatttgagaaggcaactcaggcagcacttcagcagaagaaaaagaagaagaagggctgcaacgtgctttgattgggcttcgcttctgatggagggaatcgcacttaaaatgaaaaacagaatttccttttttctttggtcgttttgtcgccattttccatcaaatgctttttgtgctaatattctgttcatgagtggcgtcattcaacttgaactttcaattaaatttgactttatttttcctcttcgcaattaaaacattttttgccnnnnaaaaaaaaaaaaaaaaaaaaaa

SEQ ID NO: 85596 - DNA, 513 bp, Heterodera glycines
  misc_feature (335)..(335): n is a, c, g, or t
  SCN-specific regions: Sequence locations=1-51,73-206,228-513
ggggatccaaatcaacgcggcacagtaataaaatatcaaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctnctactgtgcaatttgaaatgggggcaaatcgattagaaaaaatgagggcacacctacgcgaacttgctgagaaaatgccggtcaatgaatcgaagcgtctgtcaccgagtggacccgacccttatcatcattagggccatggatggatctaacggaggaagaaagaatggatgcttag

SEQ ID NO: 85597 - DNA, 473 bp, Heterodera glycines
  SCN-specific regions: Sequence locations=27-473
ttttttttttttttttttttttttttccctgccaatcagtttaccaaaaatttcaaaaaaaaaaacattttttgaaatttgcaactcccaaaaaagttgaatgaaaaatgtaaatcccccaatcaacaaccatccattatccaccaccttcattatccaaagagctcgtcatcctttcttccctcctccggggccgtcctgtggcattggtctcctagttggccgggatcccggtcgagcacgagtccccggcagcgccagttgcaataccatttttttccatttgttcattggtgaagctcaaagcattttccataaaagtgttggcttttggcaacaacacaacaagctcctcgttaaatttctcaacgctcatgcccatcaattggtcgttccattcattaacagccgggggctcattagtggccacctcttgcctcgctttggttttcggggcttttccatttttagtt

SEQ ID NO: 85598 - DNA, 454 bp, Heterodera glycines
  SCN-specific regions: Sequence locations=30-454
tttttttttttttttttttttttttttttacaaaattcatatttatgcgacaaaagtaattcaaattcacgaactggcaacaaaactttaagtcattatttcggaaaaacatgtgcaaaaaccaacaacaatttattacaactccaaaacgcttaaatgtctcatcaacaatactttgcaacaccaattaagcacacattaaatactaaattttcatcaaacaaatccctccgcttttttctcatcgacgggggcacgtacttggacttctgaggctgctgctgcgactgggctgcctgttgctgttgttcgtcctccttcgccttcttgggctgttgctgtgtctgtggcgtttgctgctgctcgacttccctcggcttttggggctggtgcgtctgtctttgctccttcgccttttgcgtctgcgcctgtgctgcctgttgctgttcggcct

SEQ ID NO: 85599 - DNA, 629 bp, Heterodera glycines
  SCN-specific regions: Sequence locations=1-401,423-629
ggggaaatggcattttgtttctttttaacaattaccttttgtttttcatttaccttttccgtgaataacttgatgaagaaatgacttccccagcggaatcgctcaatttggacgcagcggaagtccccgaattgcttaggaaggaactcgatacgcttcacaaagcattgggtgagaatatgcaacggtacacggaatgcaaagagataaaagtggacgaaggactgcgaactttggaggcgaaggtcggcagattggcactgtccataaattcgcacaaaggcattttaaagcgggagcgaatgcgattggcagaaactgcgaaaagattggggctggaccaacgcattgcgcacaatgttcagcggacccgggataatttggcaaagagcccacaatttgggcgcgcccattccgtggattttttacacgaagtggcgactcagaatgaccaatccctggcggaacaatgcgaaaccgtcgaaaaattgcgaaaattgttggaccgactgagcaattcagacgaagagccgtcattgtcgcgaaatgacctggtcgatcatcttactcgatttgaccgcatttttgagcaagttgcttcgcaagtgtatgctctgaatgattcggca

SEQ ID NO: 85600 - DNA, 694 bp, Heterodera glycines
  SCN-specific regions: Sequence locations=1-694
ccacgcgttgggagctctccatatggtcgacctgcaggcggccggaattcccgcggccgccatggcggccgggagcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaa

SEQ ID NO: 85601 - DNA, 452 bp, Heterodera glycines
  SCN-specific regions: Sequence locations=25-54,76-106,128-243,266-452
ttttttttttttttttttttttttgcttcgactttatctaccggtaaccactcattaacaaacaaaatgaaagcatttgtcaatatgatttgtttgcttttcccggggcttttcctcctctcatttcgaatgcttaaccttccaccgtttgtcagtttttcgactcgctttttattacatttgaaaagcccattgatcatgctttgaaatatcgttgcgctttggaatatgcgtcgatatgcacattgtaaattgggtgaacagattccacgatgttttggttaccactgtggattccacctgaataaatttggctaacggaaagtccaaaaagcgtatagcacgtgtggtacaagtcgggacttttgtcgggtttgtccctgagaccccctgaaggcgcttggcatgcctccaacacataggactgcaagggcaaagtgtcaaaaagctta

SEQ ID NO: 85602 - DNA, 400 bp, Heterodera glycines
  SCN-specific regions: Sequence locations=27-164,188-400
ttttttttttttttttttttttttttgcatcaaaaatttaaattcgttaaagttgaaagaaaaatgccaaaagcgaaacaaaaaaaaagtaaagaattaaatggataaaaacaataaaaaatgcttaattttgaattttcggaatggccaaaacatattttccattggctcttttctttctcttccgcgttcatttcgtgccaaaaatctccgcgtggggttccttcagttctttgaccgcttcggcgtccaattgtttgttgtccaaaagattgccgacgaatttctcgccggcaacagcgaagtcatccttggtcatgtccttgagcactttcttcttcatgggaaccatttcgcattggtgggccaaacggaatttgcaaatgggcgtctttttgct

SEQ ID NO: 85603 - DNA, 526 bp, Heterodera glycines
  SCN-specific regions: Sequence locations=1-526
ctgttgttccgatgttggtggtggtgcagcggcggcagttgcggccaccggctgagacaaagacggcggcggggcggtatcaaccgttttcggaacatcgacaatggaggaaagaggagcaacggcggaaatcgccataacttcatccttcttattcggtgtagacgtcggagagggcaatgagtcaacaacggttggagcagcatcagatggcgcatccggctttttctccggttccttttgaggtgagtgatccacgacaacggacgcctttttaggttccgactcaacaacgatttgatggagtttgccacttccaccattaaccattggaggaggagcaacctggccaccaccattttcgaggggctgttgctgttcagcgacagtagtcggcggacttggcacagtagcaccggcgttgttggccgcgttgtatttttcactaacggtaaccagaaaggcggtatccaaccactgaaacacatcgctcttcacgtacaaaacggtgggcgtttggtgggcc

SEQ ID NO: 85604 - DNA, 483 bp, Heterodera glycines
  SCN-specific regions: Sequence locations=50-483
tttttttttttttttttttttttttttaaataataaatttataaaaaaagccaaaaatactcaaatatattaaaacgagaatatacaaaagcatgaattaattaaattaaagccagtttgtacacgagctgcgtgggcaattcaatccggcaattcttttccccgcgtttctggcaacaaaaatgttaaaaatgttgcgatgaatgcgtaaccgccaaagaaaaacattggcatcataggcgaaaaggacagcatcactcgaatcattggcgggaaaatgatgcaacacaattgcgagacgggcgtgcaaatgcccatacaaattccacgcttcgatgtcgggaacacttcgctggcgtacacaaaaagggcagtgaacgaggaagcaatggcaaatttggcgatcagccaaaggcacagttggacaaatgggggcacattcggcagccaaagaatggacgtgccagaaaagaatgccaacgc

SEQ ID NO: 85605 - DNA, 409 bp, Heterodera glycines
  SCN-specific regions: Sequence locations=25-409
ttttttttttttttttttttttttcacaatcagttccaattatttatccggtcagcacaacacagcaaaaatacaatatatacacatagcaatcagtgatcagaaaagaacaatacatcgatatgaacattgatcacgcaaatatacaatagacagggttatgtacatctctgttattcgtctgccgcgctcgttctcccgttcttcagctcagctctggccctgaacgatcgccaccacgtcgatcatgacgtacgcgctcttcggtaacttgaccacttggaagaagctgcgcgcagggtacgtgtcctcggggaagaagttcttgatcgtctcgttgaccgcctggaagtcgctcatgtcggccaccatgatgttgcagttgatcacgtgcttgaaggacgagccg

SEQ ID NO: 85606 - DNA, 617 bp, Heterodera glycines
  misc_feature (606)..(606): n is a, c, g, or t
  SCN-specific regions: Sequence locations=1-57,79-617
gggcagtgatatttattttttggtgtgatttaaaagtttatttgagtaaaaaaaaagtgaaaaataaatgaaaatggtggagaaagagaacgacatcgctgccgctgtgccaaacaacgctgcaaacaacggtcatgttgaagctgtcgacccatcggcatcgaagagcgctaaggaggtgccgaacaacaccgagaagcatagtgccgaagatctaatggggttggcccgtctcttcctgaaggaatattacaccaagcttagcgaccttcctagcgaagctgggattttctacggcgatgactcgcattttgtccatgctgatgtggaggagacgggccgcgagaacattcaacgcgctatcggcaacatgggcttcgaggattgtaaggctcgcttctactcgctgaaaacggtgtcgctgccgatgcaaggtgacaatgccaagctgatccaagtttgcggcgagctgacgctggtcaaggcggctgtgcaaaaacagcagcctgttcttccacgacgctttgtccaaaccatcattttggcccaccaaacgcccaccgttttgtacgtgaagagcgatgtgtttcagtggttggataccgnctttctggtta

SEQ ID NO: 85607 - DNA, 608 bp, Heterodera glycines
  SCN-specific regions: Sequence locations=1-608
gggaatcacgacaaataccattaaatatgtggacgccggcgaaagtgacgatgttgtgcttgcggaactgttgcgttatgagccgtctacggcgcataagaaaatccaagcaaatggactggttgttcgcaaacggcccgaatatttgctcatgtacaaccccaaatacggactaagcatactgttgcccaagtacgccaatgtgcagagcgcgtgcgaattcgatgaaaaattttcacttggcgaattctattcatgcgcatttattcgtgtggccgagcgagaggcgcgtcgtttgacctacgaatggatgtgtaagggtgactttaaattgcatgaaccaatgctgaaaacgcggctgatcatggaccgatttgtgcatgttcatgtcaattgcgaatttaccaaggaaaaaataacgaagcttcatggcgatcattatgttcttaagacagacttgggaaatgttcgattcggcaaggaatttttaactcacaatgacttgtacgacaaatcagcgaatgtttgggtgacttttgtcaaagaaactgaaggctgtcactgggaaattgtgcaggactcgtggggctcactgctggatgacgagc

SEQ ID NO: 85608 - DNA, 324 bp, Heterodera glycines
  SCN-specific regions: Sequence locations=77-84,120-287,311-324
ttttttttttttttttttttttttttctttttttttttttttttttttttttttttttttttttttttttttttttggggggggccttttttgttgggccaaaaattattaaaaatttttgggaaaaaaaggggggcgaaaattggccccccatttaaccaaggggcatgggggggcccgggaaaaaaaccaaaaattttttttttagggggaaaaagggtggaaaaaggggggggccaaaaatgtcccaaattttggaaaaaaaattgggattttcccccccaaaagggggggggggggccccccccccaaaaagggaagggg

SEQ ID NO: 85609 - DNA, 430 bp, Heterodera glycines
  SCN-specific regions: Sequence locations=24-28,64-430
tttttttttttttttttttttttgcaacataaatatttattcaaaacaacaacaaaaaattcttacccgccaaaataaatttcaaaacgagatccgagtgaaattaacaataaaccaatcaagtccatgacagaacatcaattctaacaacagcaggagaaagtgaaaatcgtcctaataattatttcatttgcctctctctctctcttaattcgccgccgttcccaataagttctgaccgtccatctcctccgggttagtcagtcccataagggaaagcacagtcggggccacgtcgcacaatgctcgcgcccggggcacaccctccgcagtggtgggcggcgcacttttgaaggagtgtgagggggaagagcaggcgaacggaaccttgttgcacgtgtgggcggtgtgtgggcccccatccttggct

SEQ ID NO: 85610 - DNA, 616 bp, Heterodera glycines
  SCN-specific regions: Sequence locations=1-159,181-616
ggggtccgttgtccaacaaaattcgcttcaaggaccttcaaattgcgtacattgaccattacgtcatcgcatttctccgtgccaataaacaacttttcgatggaaatggcaccgctttgaaattttctatttggtcagccaaaaacgatgtgcagccgatttgggatgttttggcccgtgacatttggcccatttttgcgccaaacattcgccacttgggcttgaccaatgctgaccatcttgacaaattgcgtcgtttcatctcaccaacaattctttctgatctgaaatggcttaattcaatcaatgcctatcgcctgttgcccgaagcaattggtggtgattttgatcagtcaaatgcaactggtggccaaattctgtcaaaatggctgcacacgccgacaaccaatggccaacccaagcgatttaactgtgtttattatcaggagccagcaattaacatcgacgaatggatcaacaccttcaaagaagcatttctccgtgccacttcttctgcttgctacgcaattcaatttgctgttcatgccacgtcgacgtccatggtgccgtttgaagaggtgaacaaacgaaccaacgagaagctgacactgatcag

SEQ ID NO: 85611 - DNA, 580 bp, Heterodera glycines
  SCN-specific regions: Sequence locations=1-580
gggacaaacgagaagttctttttactgtgggctgtcctcttttcatcgccgttttactgccccgtgggtgctgtgccggtgtatttttaaaggtggcgctgaagtggcccaaaagttgcgaaattacgaattcgctgttgaactgctcgaatttcttttggaaactgatcttcttcgcaatttttgcatgagttctcgcggtaaatggtacgaacgcattgcactcaatttggaacgccatctgaagagtttggacaagtcagcacacttttgtcgactcggcatggcggatgagttggtggggaagtcggacaaactcatcctgcagcatcggctgacccaaatgaacaaccgcaagaaacagacacaaagccaaacggacttgggatttgttgagttggaagaccctgaaaagatggaaattaacgggacaactttggccaaaagccttggcgacggagaacaggtcaaccacttttacattccgacaagcgaccggggggaaatcaacaaatgcagcgtcgaggaattggtgttgcaccatttcattacggtggagcatttcacgcacgggttccat

SEQ ID NO: 85612 - DNA, 683 bp, Heterodera glycines
  SCN-specific regions: Sequence locations=1-93,115-357,379-683
ccacgcgttgggagctctccatatggtcgacctgcaggcggccgcgaattcactagtgattaacgaaagaatctttcttaatcggcgctgaaatggaaattttgtttttataaacgctaataaaaaaatatagaaaaatccaacagagaattttgcagttttgttttatgtcttcatctatatgcgcgctgctttatttcaatcatcaaatgttgtcattattctcgcgtccggtcagaatgcgttccatgtactcaatgtcttttttcatcgacaatagccattcacgagtgttcaacagatcaattaattgatctggtggcaaatccgtatgtttcaacaaatcattcatttctttttcaattgtctttttaaattcgatgatcttcaccgtttgattaggatttttcgattttcgcaaaattttttgcatgcattcagcgaataattgacgactttttttgtattcatcaacatatttttcaattattggttcaaggaatggaattttcatcgaaggaattttatttaaatcaacccgtaaattgttcaaataggtttgtgccgcttcctccgccgtctccatttcactgctgcccaaattttcactttttggcacattgctttccgacgatgatgtcattatttccgccgaatgtatgccgtgcttggtagtgccaatt

SEQ ID NO: 85613 - DNA, 507 bp, Heterodera glycines
  SCN-specific regions: Sequence locations=30-71,485-507
ggggggagggaagaggaggaggaagagactgacgatgacgaaataattgtgattgagcagagtaagagcacaggggaagagaagacgaaaagcggaagagaagaagcctttcagaagacacaagcaatgcagggggaaaaggaagaaaagcaaatcgatgagaaggaagaagagcaaatggaagatgaagaaaaggaggcagagcaaattggagaggaaatggaagaagggcaaatggaagatgaagaaaaggaggcagagcaaattgaagaggaaatggaagaagggcaaatggaagacgaagaaaaggaggcagagcaaattggagaggaaatggaagaagggcaaatggaagatgaagaaaaggaggcagagcaaattgaagaggaaatggaagaagggcaaatggaagatgaagaaaaggaggcagagcaaattggagaggaaatggaagaagggcaaattgaagaagaggagagagaagtgcacagccgagggggagaaaac

SEQ ID NO: 85614 - DNA, 287 bp, Heterodera glycines
  SCN-specific regions: Sequence locations=31-287
ttttttttttttttttttttttttttttttatcaattcatatttatgcgaaaaatgggacccttgggataatccccaaccaaaaaatatgtaaaaaatttgttttgcgtaaaaaatgaacagaaaaaacgcttatttaaaataaataggcaactaaaaaggaaagtgtgtttgattcccaaaagtcaattaaattcccaaacaaaaatgccgtctttcattccttggtcggcacaattcactgattcatcgtccgccggttggagtgccggtgttttcccatccgtt

SEQ ID NO: 85615 - DNA, 282 bp, Heterodera glycines
  SCN-specific regions: Sequence locations=68-73,95-282
ttttttttttttttttttttttttttttcctttttttttttttttttttttttttttttttttttttaaacaaattttatttgatttttgctaatttttcaaaaaagcaaataacaatgaataaaaccgtaattataaccacaaacgggtcaagcttggtggggtttcccctctctttttttttgaaagggggctggtgccttttttggattttttcgaccagggcccccgccatttaccccccaatgttcccccgggggggggtttttgcctttgccccat

SEQ ID NO: 85616 - DNA, 416 bp, Heterodera glycines
  SCN-specific regions: Sequence locations=28-40,76-121,232-232,254 -254,374-416
tttttttttttttttttttttttttttgggaaaaaaagtgaaagttttagaacaccaatttttgggcatgtacataaaaattttttaaaaacaaaacaacaaaacgagaagaataccaatttgatgtgtaagtgtgttatatgacattcgatgaaaagaaaattttaaaaaatttacatttcaaaacataatgctgcaggcaaatttttaattcattcatttcttcggagggcgcccatttgggttattggaaaaaggaattgcgggcggacaactgtcagctttgggttgcctttgagaagaattatcagcagaatgacgctgaacattattgtcattggcaccaacagcaacaaaagcaggcggaagtgacgcattgtctctgccccgtagtgaacggactgctgaaaaaaaac

SEQ ID NO: 85617 - DNA, 639 bp, Heterodera glycines
  SCN-specific regions: Sequence locations=1-639
gggaaggctacggtcagacggagtgtgttgcggcagcaacgattaccatcgaaggtgacccagttccgggccacgttggtgtgccggttccgtgctgtgccgtcaagttgattgatgtgcccgatctcaactattttgccacgcatggtgcgggcgaagtgtgcatcaaggggcccaacgtgtttcgcggctactacaaaatggctgaacaaacggcggaaacgctggacacagacgggtggctgcacacgggtgacattggacgatggacagagcaggggacgctgaaaattgtggaccgcaagaagcacatcttcaagttggcccagggcgaatacgttgcacctgagaagattgaactcatctacatgcgttcaaaatacgtggcccaatgctttgtgcatggcgaaagtctgaagacatgtctggtggctgttgttgtgcccgattttgatgtgttgccggaggcggcgaaaaaacaattgggcattgagggaaaaacaatggaggaattgtgccgaaagcagcaagtgaaagcgatggtcatggaggacattcacgaagttggaaagaaggctgggctcttcacctttgaacaggcgaaagacattcatttgtacgccgagctgttcacggtgg

SEQ ID NO: 85618 - DNA, 149 bp, Heterodera glycines
  SCN-specific regions: Sequence locations=26-149
tttttttttttttttttttttttttgttgtcttaaatttattggtttaataatataaaaaaaccgtagtataataagggttttcgtccattcccatcactcaaacacaataaaatcaccccggttgatcaatcaatgatgaaaatttcc

SEQ ID NO: 85619 - DNA, 457 bp, Heterodera glycines
  SCN-specific regions: Sequence locations=28-91,115-457
tttttttttttttttttttttttttttgggtttaataacaaaagtttaacaaaaaaacaacaaatgaagtgcattaaagaaaaagcatcagtttttcccaaaaaatcttaaatgacaggggattcttgtcgaaacattcttttccacatgctttacaagaacaaatctggagtttaaacaatttgtcgatagatcggatcgggcctcgagccaaaaagggtcaattcgggaatcactgctcttaacgatttcatgctcattggattctgcagattcatcaacaaatagacgtattttgctctcttctatgctcaaaagtctcaaccgcgctttgtttgttgttgcaacgacagtccccctcatattcacatgcaaataagcgacccattcatttgaaaccaaatccaactcggcattgccaatagtaaacaaaatcgaatttgaatttaaatcatag

SEQ ID NO: 85620 - DNA, 673 bp, Heterodera glycines
  misc_feature (633)..(633): n is a, c, g, or t
  SCN-specific regions: Sequence locations=1-400,422-673
ggggtcacaattatgtcagtcatgcggtggcatctttctccttgtcgttttcctattgatgccaagcccaccgggtggtagcgagcaggaaacatccatttctgtgcaaactgtccgcttcatctacggcacattcaccgctctcactgttctcggcactgccattttggcattgttaccagtgccaacagccacaacaccggcacgacaaacaaatacagtcgacggcacttcctctgctgccgctgttcgtgacccctcaacagtgtcaacggaattggcacattcgatcgatgaaggggcggaagggagcggtgaagcagtggcagttgctgaacagccttcccatctggccatcttgagttcaactgttaaactgatgggcacccgtcggatggtcttcttttcgttgccttttatgtacacgggcatcagccaaagcttttggagttccatttatccaacaacagtggcaaacacggaaatgttccagctgaaccagggagtcaatcccaaactgttgttggcattgaccgccattgtccaaggcgtgggccaagcaacatctggtttctttttcggcattttggacagtcggacacggcgttttggacgcaccaaaattgttggctntggtgccgctttgcaactgtgctcctttttgctggcctac

SEQ ID NO: 85621 - DNA, 181 bp, Heterodera glycines
  SCN-specific regions: Sequence locations=1-12,34-181
ggggcacaaagcggaaggcgtctgttcaagccagtccgctcctctcgttagcatttctttcactcactccagcggacagaatcgcaactgtatcgaaatagcggagcataatttgacatcgaaacagacaattggcacgggaaaaatgaaaagaaatgcatcgattcgtttaaatgcgaat

SEQ ID NO: 85622 - DNA, 508 bp, Heterodera glycines
  SCN-specific regions: Sequence locations=30-45,67-340,362-508
tttttttttttttttttttttttttttttgaaaagcaatatttatcaaaaaacacccaaaattttcagaataaaagtctcattgtcaataaatatgaagatgtctggagtaaaataagtaacaataatgaaaacctagaaatgaaacaaagaaaaaaaatcaaaaaatgcttggcacttgcaactcgtccaatttaatcacttttgtctctgggaagtgctctttcaactcatccacacccgacggattcagtgcaatggaacaaaacgactgttccggttcgaaaagtcgtcggattggcgggccaccaatcgccaacacatcctccgctttggcattccaaatttttaagcacaaatcacgtgtgaagttgttgtccacagaacgaatggttgcaaggatcgccgaattgactctcagctccaccgtgctttcctttgagatcaggttgaagatcaaactacgcttggcagactccagcaattttgcgtcaagttggcccgatctg

SEQ ID NO: 85623 - DNA, 546 bp, Heterodera glycines
  SCN-specific regions: Sequence locations=1-524
gggatatctttcgattttatttgttctgctgtttgtcatttcgtttgcaactgggccaggctcgattccatggctttttgttaatgaaatctttccatcgaatgctcgtggcaatgccaattcaattgcggtcctttccaattggggctcaaatgccattgttggctactcctttccaatgcttaataccgctcttggtgagtatgtgttcttcgtgttcaccacagtgtccgttctgtgcattgtatttgcggtgaaattcatgccggaaacaaagaacaaaagcctggaggacattcaagcggaaattgatcgacgccgaggcatcaccaattagccaaagcaatgccaaacggaacggtgacttagaatgttgcacccaataaaacgtgaaatagggatttaattatttatgtgtataccaataagacgtactgcgatttaattatttaagtgtacaccaacaaaacgtgaaattgtgatttaattatttatgtgtacaccaataaacggtgaaactgcggaaaaaaaaaaaaaaaaaaaaaa

SEQ ID NO: 85624 - DNA, 614 bp, Heterodera glycines
  SCN-specific regions: Sequence locations=1-58,89-614
ccacgcgttgggagctctccatatggtcgacctgcaggcggccgcgaattactagtgatttggtaacaacgcagagtacgcgggctgcaaagctggagcgtctcgaattgtttcacttgacttataccgcaaggaaattcaaggcttttttagcattcctgtggataatcttcgcgcgtctccttttttttgcttcaatacatgaaatacaatattcccgactacaaaaatgcggtaattgttgctaaaacgcccggagtcatgaacaaagcgacgtcatacagcgagagactgagaattggcattgctgtaattcacggtgaggagaagggagtccaggaggatggacggcaaagtccgccgccatcgccgacggacaaacgaaaaggcgtttcatacgaactttttccatcacaagttgcaaaggagaagcccccactgactgttgttggggatgttggcggcaaaattgccatccttgtcgacgatattattgacgatgcacaatcctttgtggcagcagctgaagttttaaaagcgcgtggtgcctacaaaatttacgtggttgcgactcacgggttaatgtcactcgacgccccttccttactcgagcc

SEQ ID NO: 85625 - DNA, 467 bp, Heterodera glycines
  SCN-specific regions: Sequence locations=1-444
ggacttaagaatattatctgttcacattgggaggtggacgatgaaaagaaaagatggacactgagcgagcaggacaaagtgtctgtcaaacagcagaccattccggcaatcattcgctctcctgagccgattaggatccatctatgcacctcaattcaaaacattatgcgtaacgactttcctgctcgatgggcaaatttcaccgatgaaattttgccacttctccgcgtgtcagagcctgaaacacttatgggcactttgctaatacttcacagactttgcaaaatttacgagttggtctttgattatatataagagcacttctccttataatatatagaattcagatctaattaacattgaaaacccggtggtctgatcggtccattttgggcattgtcccacgggcacttgccctttcccagtcggaaaggtataaacggcaaaaaaaaaaaaaaaaaaaaaaa

SEQ ID NO: 85626 - DNA, 223 bp, Heterodera glycines
  SCN-specific regions: Sequence locations=27-223
ttttttctttttttttttttttttttggcattatttcccgtgtaccaatggtaatttgttgttgcttgggaaaaaaaactgaccgaagcggatgcagcaacagaagacgggtgttgtggcgaattggcccaccaattctgctgattgtgaaacccaacagcgggaatttgtaatttgagaaacggggcgggcccgggagacatgttactgaccccacatgaaa

SEQ ID NO: 85627 - DNA, 247 bp, Heterodera glycines
  SCN-specific regions: Sequence locations=27-112,135-154,177-247
ttttttttttttttttttttttttttacggaatgacagtgtttaacgggaaattcagtagcaatttatcgttttcggcatcactcatcttgcatgtcttctccattttcggcattattctttgtcgtctctttgtcctcctccccattttcggcattattctttgtcgtctctttgtcctcctccccattttcggcattggtttttgtcgcccctttgtcctcctccccattttcggcattattctt

SEQ ID NO: 85628 - DNA, 562 bp, Heterodera glycines
  SCN-specific regions: Sequence locations=28-502,524-562
tttttttttttttttttttttttttttaaatgttacactaatgagatctctaccaaaaaaacaactttacttttcatcttcgattatattatgccccttttaatgcttttgctcatattgggccgtcaattgaatgtgaaccaatgggccactaaaaccattctttgtccgataccccttcaaaatgacggcgttaaattgttcggaaagcatcgaattcagtgcttctttccaactattccaattgttcgtactttccgactcattttctgaagcgatttgctcgtccaattcgatgccaaccaaccaaattttgaagaaaacattttttttgggattctttttattagcggggcttccatccaaattctctcccaaaatttgttccttttcaacaatttgcttcgcatgggccaatcgaatgcgatcaaatcgttcgacatcgatcagcaattggagacgaattcgcgtctccacgtagccgcaaaagtcgtaaaagtcggccaaagcgaaggctttgcaattaatgcgaatgaaatgggaaaacttttccttgaatttt

SEQ ID NO: 85629 - DNA, 600 bp, Heterodera glycines
  SCN-specific regions: Sequence locations=1-573,595-600
ggggacaattaattgtccaattaagatgaaattaaacgacactgtgaaaactgattttgagaccatttttgccaaattctattcccatatatgtgacgacacagaagaaacaattcaacgaaaacagctcaaaaaactattcagtttcattgataccaataaacataatccgaattttcgcgatcggattggcccacgctgcgatctccgtttcctcgccggcctcctcaggcgttaccaatgctcagtgagtggcgaggacagactgctcttctccatcttggaactgctggagaagcatatggcgttggatttcagaattatttctcctcttgtgtttggcccttcctccaaaacttattacgaagagctgatccaatatgggcgtgctttgcacaaatacctaacacctgagcaggttcttgcctatttcgattcaaaacgaatgtggaaatccttgctgaaattggcccattttgaccgtcatttcagtgccgcactgtctaaaggatccaccgtcaatgcggcgatggaaattgcaacgggagagattgatccgagctgttacgaccctcgttttgtgcttcgtttgctcgtcca

SEQ ID NO: 85630 - DNA, 491 bp, Heterodera glycines
  SCN-specific regions: Sequence locations=27-56,78-491
ttttttttttttttttttttttttttgatcttaataaatctgattgctcaatgcataaaaagaaagacaaaaattttaaggcaaccatcggaagatggttttttgacaaaaaaaattgcttctgacggggaatgtgtttaaaaaaaccgggattattccacttgtgatgaaccgtcccttctggcccaattgctccttttcatcgttgtccctcctgctccaaatttacataattgtagcagcgagtcggcaatgaatctctgatttgacccaaattctccaactcttttgccaatgtatcgatttccctcttctgcttcaccgctttggtctccgcttgtatgatccgttctcgcattttcacttcgtcgccgctcgaatcgaaacgattttccgcttctttcaacagtttctccacggggtccaattgcccatcgtccacattgtctaaggaacctaaaataaaaataaaatttcgacaaaacaaacgc

SEQ ID NO: 85631 - DNA, 505 bp, Heterodera glycines
  SCN-specific regions: Sequence locations=1-117,139-505
ggggagttgaaaattttttttataacaaaatgatgaacaaaatttataccaccattcatttcttattgcttttgactgttattgctaacaaatcgactaattgtgctacaaatgttcaaggaactcaaactgttaaaacagcagatgcaacctatgatgaagctggaaaaatttcgcgtgattcatcatcaagttccgatgaagatgactcaacaactgcagcttcaaaaatgctactgaatgaagcaaatcacgctttctccaaagataatgatgagcccattaaccatcagcagaaaatgaggcctgaagctaattttagcgttaaatatcttcccccgagactgaacgctgcacaaattgacaacattgcacaacaagcatcatccatgatcacattacgcacattaaaacatgtgaaagaagttttttcaaaatttgcgccagattcatggctggaagcactggaagatattccactgccgactattcgctgcactgtcaa

SEQ ID NO: 85632 - DNA, 175 bp, Heterodera glycines
  SCN-specific regions: Sequence locations=1-175
aaaatggcaggccgggtcaggtgggacacctcgctgtggacaggtgtgcccaaccatcaaatacggttcttcgtcgccaatttcgctctcacctccgcgcacttcaaagcgcccgtcgggcgccgaccgttcttcgcccaacaaatcatccggatcaagcgtgtcagcctccatc

SEQ ID NO: 85633 - DNA, 230 bp, Heterodera glycines
  SCN-specific regions: Sequence locations=1-230
gggacagatggcccgtgacgccggcccgccgcgccgcctctacgtccgtcggctggtctccgatcatcagggacttggacgggtcgatcccatgttcttcaatcgcgcgcagcagcatgcccggattgggcttgcggtcgggatgatccgggtgacgatagcgttcgatcacggcatcggcgtgatagggcgcggcatagacggcgtcgatcactccgccgttctgggcc

SEQ ID NO: 85634 - DNA, 495 bp, Heterodera glycines
  SCN-specific regions: Sequence locations=1-247,270-495
ggggcttaagcgtggcgtttctggggttcgacggtccggcattgaactgaacaaacctctgaacacaatttcgactcagtccaaagtcatcggtcggaaggcaatcacgcttcaagacaccgacatcacttcctcgacggcatttgtccctttggggtcaatgcgaagcgattcgatctccacgaaaacgaccgttgtggccgacaacactggcaactcgagacctgtgagtgtggcaaatcggtttgcctctctctccggtgctgcgccaaacattcgctttcaattggggaaaagtcgtcattccctccgcacaactcatcccatcaaatggccccctcgtacgatacagcagtgacattgacgacttctccacaaccgccgagccattcagcgaacttacaacagaaatggtcataaaagtgcgcaagaataacagcgtaacatttcaaccgccggcgttccgtgctccaatcgccgaacgtattcaaattg

SEQ ID NO: 85635 - DNA, 559 bp, Heterodera glycines
  SCN-specific regions: Sequence locations=1-23,92-110,146-175,382 -423,458-492
gggagcaagaatattgctatcttgcctaggcgggattctgacttagaggcgttcagtcataatccctcagatggtagcttcgcaccattggtctatcgaccaagcacatgaaccaaatgtctgaacctgcggttcctctcgcactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagctacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaact

SEQ ID NO: 85636 - DNA, 296 bp, Heterodera glycines
  SCN-specific regions: Sequence locations=25-178,205-296
ttttttttttttttttttttttttggtcttttaacatttattactttaaataccgataaaaaattgcaagtaaatatatgaaatgtaaatgtgtaaaacacctattaattgctcattttccaatattgcccagttgcgtcttccactgtcagcacgacgtgactttttgccgatttgctccatttttctgtttctcctttcctccgtccaccgtgggacgacagttgtgaaaacgtcgatggatgcgcaaattggcggattgtgcgaattgtttatgacagaatggacactgaaaa

SEQ ID NO: 85637 - DNA, 200 bp, Heterodera glycines
  SCN-specific regions: Sequence locations=1-130,172-200
acctgcggcggccgcaattactattgattagtccagtgacaaattgccggctttgatcaactgattgcttcagcttggatgcatttgcaataagaatttctcggaccaataattggtaaaaatggacatgcttttggtggcctttgtcagcaaaaaacaaaagccaaacaatcaggcgttcgatgtaaatcagctcaatc

SEQ ID NO: 85638 - DNA, 297 bp, Heterodera glycines
  SCN-specific regions: Sequence locations=71-273
ttttttttttttttttttttttttttttggttttttttttttttttttttttttttttttttttttttttgggcccttttacctttattaaaaaaagggcccttcaaaagggccaaggggaaaacaattgaataatttgaaaggggggaaaaaaaaaaacaccgggggggggggaaaaaaaaaatttccccccttacaaagaaaaaaaaaaaaacctttgggtggtaaaaaaaaaaaaaccaaggggtccggggccaaaaaaaaaaaaccggcaaaagaaaagggaaggggaaaaga

SEQ ID NO: 85639 - DNA, 355 bp, Heterodera glycines
  SCN-specific regions: Sequence locations=29-355
ttttttttttttttttttttttttttttgctctttgtaagggtttcatccattttctccaacgccttttctgagctgcacaccaccgaaccggacatgtctcgcagttgggccgttttcttttcattggtcggactgttcaccatttccacactcatccccttaatcgccttacaaccaaattctttgatttgctgggcattaacgtcgcaattatgtgttatcgggtccatttcttccttgggcggactgactatttccacactcattccctcgatttccttaaattgttgctcgaaaatgtcgcgatgccgtttccggttcttctttaacttcttctttttggtctttgggag

SEQ ID NO: 85640 - DNA, 533 bp, Heterodera glycines
  SCN-specific regions: Sequence locations=1-409,431-533
gggcgaaaaatgaagcgacgacgttcaagaaaatctggatttgcaacgacattttggatggacattctcccctttttgaccgtcttcaaattggactcaatttgggatgtttttgtccgtcaaatttggcccatttttacgacgccgaactctcacaatttgtcgccttcttatgccgatcatttggacaatttgttgcgcctcacaacgccaacaattctctccgatctcaacattaattcaatccattcaagcagttttttgtccgtgcccgcacttctgtcaattacaacatgcagtttcatttgcccgtgtcaacgccaattgtgccatttgaattggagaatgagcggacgaaagaaaagctgacattggagaaagtgccaccttatgatgattgttgaagcgatgtccaattgaggagaagaaagatgaaaattcggcagaaatttgaacatttcttttacttttgaccacctatattttgatcaaattgtgaatatggtaaaataaatcaaataaatgtttatgtc

SEQ ID NO: 85641 - DNA, 643 bp, Heterodera glycines
  SCN-specific regions: Sequence locations=1-519,547-643
gggtcgtttgaccacgctcaacttggcctcaaaatggcattgctttcgccacgttttaatgcgctggtggacaaacattttgacggcaaaacgcaatttacgatttggaaagcaattaaaattcgcaaggacaaagatgaaatgccaaaactttttgttgaaggaaaatcggagggatttccattgccggaccgtccgctgcccaacaaaatcatctttaagaagcttcggattgagtacattgatcacttcgtcatcgaatttctccgttccaatcagcagatttgggacaaaggcaccacattgtatatcactgtttgggaaaaaaacgaagataacaaaccgatttgggatgtttttgtcgctgaaatatggccactttttgcgacaaacatttgccaattgtgctttgccggtgccgaatttttggactatttgcgtcgactcatttcgccaacaattctatccgatctcaatcgattggattcaatcatttcttgtcatctgttccccgatgtgcttgctgatgatgatgattttgatggaccaaatacgacttctgccggccaagcgttggccaaatggttgcacaatccgagaaaagatggccaaccaaagtcattgcattgctgggaattgaatg

SEQ ID NO: 85642 - DNA, 544 bp, Heterodera glycines
  SCN-specific regions: Sequence locations=34-121,143-544
tttttttttttttttttttttttttcgttttttaatttatttttccaacaaacaaaacgattttacgatgatactctgaccactaaagggaaaatgccataaaaagaacaaagtaaatgataataatgttttggaaataatgtgcaggtttcgatgaaaaatttgtggggaaatgcgtgtccttacagtactcatctggcgagggcacaggcttaaagatttccgaacgctcgacaaagcgattcaaagttgagtttgtctcacaaccggtgatgtttcccgtcatttcctcgaagctgggcgaattgggaggccaataaaacgcctttatatagtgctcgagattagtagcgttttgccacagctcaaacgtcacacaggcggaataatggggataaccgtcaacgtcaaaattcgttttgttgaagccaagggctgaaaacagtgcggcaattgttgtgtcatgcgcggaatatgcgaaatatttcctggtacgaatccaatcgcaaagtggcgacccaattggcgatttcagacccgaaaa

SEQ ID NO: 85643 - DNA, 565 bp, Heterodera glycines
  SCN-specific regions: Sequence locations=27-228,250-501,523-565
ttttttttttttttttttttttttttagatgttacactaatgagatctctaccaaaaaaacaactttacttttcatcttcgattatattatgccccttttaatgcttttgctcatattgggccgtcaattgaatgtgaaccaatgggccactaaaaccattctttgtccgatacgccttcaaaatgacggggttaaattgttcggaaagcatcgaattcagtgcttctttccaattattccaattgttcgtactttccgactcattttctgaagcgatttgctcgtccaattcgatgccaaccaaccaaattttgaagaaaacattttttttgtgattctttttattagcggggcttccatccaaattctctcccaaaatttgttccttttcaacaatttgcttcgcatgggccaatcgaatgcgatcaaatcgttcgacatcgatcagcaattggagacgaattcgcgtctccacgtagccgcaaaagtcgtaaaagtcggccaaagcgaaggctttgcaattaatgcgaatgaaatgggaaaacttttccttgaattttgtag

SEQ ID NO: 85644 - DNA, 458 bp, Heterodera glycines
  SCN-specific regions: Sequence locations=1-108,130-182,204-410,443-458
gggatggccggtccattaatcagaattttgggtgaacggcacccggtccccgtgaaggtcgctgctgtcaacgcgttcctgagattgctggagaatgtctctctcctcctcaaagcgtttctcccccaaatgcaaagtgtcctcctcaaaattctacaagacccgtcttctcaaaatcttcggcagttggcttcccaagcagttgtccatctgatcgatttgcacccgaaacctgaaacgattttgaaagagttaaacaaattgcgtgaggctgataagtcgccagaaggattggatttgcataccgacaaactgatcaacgaactgatcgccaaaatcgacctgaaaaatggaaacacttcaaaataacagtgaatgaaaatggtctgcctatgacgcgaattatgttgtttttctgttgatttttattttgttgtttaaatggctgtttcgccaaa

SEQ ID NO: 85645 - DNA, 443 bp, Heterodera glycines
  SCN-specific regions: Sequence locations=1-36,67-133,178-307,338 -350,372-421
gggatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaa

SEQ ID NO: 85646 - DNA, 423 bp, Heterodera glycines
  SCN-specific regions: Sequence locations=27-32,54-423
ttttttttttttttttttttttttttcgggtgaaaaaatctttttcaacaaaattgtatttaccttgtgcttcagtccaaaaatttctcttgtcgattgcatattttggccttggatttttttgtgcgattttacagagttggcaaattggagaaagtagcgaattttcttctttttgctgtacttccgtgtccaattgaaaaattgcatgtatcggtcagtgtcatgtcggagtgtcaacaaatgttgtgccaattcttgcgcactgcaaaagtcgtcggctgcgatgtaagcgtcgtccggcacgcccattccgcggagcaccgcccggcgcagcaccaccggcacagtcagtgcgcggaaagcgttccaaaacttctcagtcacatattgagggcacaccgaattttcaaatgccaaata

SEQ ID NO: 85647 - DNA, 584 bp, Heterodera glycines
  SCN-specific regions: Sequence locations=1-382,404-584
gggatcgccaatcagttgcgttacccgaattcgcacacacattacttcagttgtgcgctgctctatctgtttttgggtgccaattctaagcacattcaggagcagataactcgtattctctttgaacgtttggttgctctccgtcctcacccgtggggcctgttgatcacattcatcgagctgatccgcaaccagcgctacggcttttggaagcacgaatttgtttattgtgccaccgaaattgaacgtttgttcctcagtgttgcaaattcctgcagtgtaagcggaccggaaagccatcactcgaacggaatttaagtttgattgcgtttaatattaaatatatgtattagtgacgaattgtgtttattctcgatcctattttcctcatcccctcccccaagtcgtcatatatactccccatgtttatttgtttttgtttttttacctttatagcaatttgtataattcagcccatgaccagaaccactgttgtgccccccgggtaattgtaaaataaacagcattattggtccttttacttattttttttcactaaataaaaaacccttcaaaaaaaaaaa

SEQ ID NO: 85648 - DNA, 367 bp, Heterodera glycines
  SCN-specific regions: Sequence locations=25-54,76-139,161-367
ttttttttttttttttttttttttggttaataaaatttatcaaatcaacaaagcaatggaaaaatgtgaaagggaatgagttcttctgtgctcaattggtaaacagtgcgatttgtccgtctgcgcccgaagtgagcagccaccgctgggtggggtggaaaacggcacagagaatggccaaccgatcgttgctcattgtcagtgccatgcccgccccttcgtccgctccttcatcgtcttccccctcgacatgtggcttttccccgtcggcactcttttcctctccgccctcgtctaattttgttgtccttcgcaatttgtccaattcgcgtttggcgaaaaatttgtggccaaaaagtcgtttcac

SEQ ID NO: 85649 - DNA, 303 bp, Heterodera glycines
  SCN-specific regions: Sequence locations=23-303
ttttttttttttttttttttttgtaatctcgaacatttattttctgtcaacataagcacaataatacatacatatcaatcaggaggaaattgggagtgtgttcagtaaacaataagtgccggaaggaatgcctggaggggaaaggacaaatggtgtgacaaatattatatacaatatacgagcaaatagatcagcgtcctcgcggcacgtcattcggttcattaacgccgttcaattatcggtcatccccttcgggttgccaatcgcgcgcattttatccaatgccttctttgtcttctcttc

SEQ ID NO: 85650 - DNA, 601 bp, Heterodera glycines
  SCN-specific regions: Sequence locations=1-601
gggggcaattaattgtccaaataagcaaaaaatgtactcaaaatatttttttgaaaattttatgaaatttttgacaatttttgttttcattggcattcactcgccaaccgttgctgaagttattcatcagcttcctgaagacaatatttgtgccaagttcacagttcaatttttggaggaattttatcaacaaaattcgtcttctccaatattcggatggattacagctgaaggcgatgtgacacttggccaacagaatggcacccattttggcattaaatgtttggcattggcactgtccgattgggacttcgtcgtcgaccgtgcatgcttaatgacattggcaccaccaaattcccatcggcgttttattgcaagcccatggcatcaacaaaatgatcaattgaacaatggcacaaatcaaacagctgatcaaaatgtcagctacattgtaccattgaaaagtgctgaagtgcgcagtccgcaactgatcagttttgtccaaaaatgggcgaataagcgtccaactgctcgaccatgcattttcccaattgacgacaaaatcgggtccaaattgagttggaatggcaccatttgtggc

SEQ ID NO: 85651 - DNA, 501 bp, Heterodera glycines
  SCN-specific regions: Sequence locations=1-37,61-94,116-464,486-501
ggaaaatctcttgttttttcactttaaagtttgtatacttctgtgctctgttcccatattttctgatccttgttttgctcatccgtggcttaactttggagggtgctgggaaaggcattatattttatctgaaaccaaatatcacgaaattgaccgacacgacagtgtggaaagatgctggcactcaagtgttttacagttatggcgtcgggtttggcactttgatcgctctcggctcacacaacaaattccaccacaactgctaccacgatgcgatggtcgtgtgtgttatcaatggaatgacttcaattttggccggttttgccatcttttccgttcttggccatttgtccgagtctgcaaaaaaccaatcgctgaaattgtgaagcccggtgttggacttgcctttttggcatatcctgaggttgccagtaacttgccgttcaagcagatttgggcatttctgttttttctgatgatcacaattctcgggctggacag

SEQ ID NO: 85652 - DNA, 489 bp, Heterodera glycines
  SCN-specific regions: Sequence locations=1-356,378-389,412-489
gggattgagaatgtagttgatccggtgttaagccggacgattggatgaaagcgaccattgacaccatcataatgaccattcgttgaaattgccaggtatagcaccgcctctttcaacaacaaataatcaatattgctcattccaaaacaaaatgtgacggaagatcccatcgccttatgtgacttactcggggctattggtgaaacatcgaccgcaacaacccaagacttacaggatttgacggagaaaacggatgtagtggaacgactacggaaagctttggaattgctggagaaagagaagaccattttaagaatgcggaaccaaataaaggaggacgttgagcgaaaagtgaacgaacagcacagaaaagcagtgctttacgaacatctgaaagcaataaaacgggaacttggtatcgaaaaagaggacaaacgagctgttcttgagaagatggaagaacgattagccaacctcaaagttcccgag

SEQ ID NO: 85653 - DNA, 248 bp, Heterodera glycines
  SCN-specific regions: Sequence locations=94-201,223-248
tttttttttttttttttttttttcttttttttttttttttttttttttttttttttttttttttttttttttgggggaaagggattttttgggttttaaaggaccaaaccaaaacccctttgaaaaggaaatttaataaataaaaaaccaatttaaaaaatccaaaaacccttggggaaaccggggaaaaaaagtttttttaaccggccttttttctgggggtttttttttttttttgggggccaaaa

SEQ ID NO: 85654 - DNA, 515 bp, Heterodera glycines
  SCN-specific regions: Sequence locations=1-113,136-515
gggcgtcattcgtcgtccatctcgtccaattccgatcggtgccattgttcgctcaaaagccgtctgggccattctgatcgggcactttgccggcgattggggcgcatacatgatggcattggggttaccatcttttttgaacgacgtgctcggaatgcagatgacttcaatgggttttgcctcagcgataccatatgtcgtctattttgcggtgatcaatctcggcggtcatctgtccgattcattgctacaacgtcagctgctctcaacgctgaactgtcgacggttggcaatggcattggcactcggtggccaagcatttttcctgctgctgatcagcttttgcccttgcggctatgataaattggtgatcgcgctgctcacattatccattggcatttccggatttcagtattctggctttgtaatcaattacctggacattgcacctgagttggccggcctactgcttggacttggcaacactctttcttgcttggccggctttcttggac

SEQ ID NO: 85655 - DNA, 576 bp, Heterodera glycines
  SCN-specific regions: Sequence locations=1-222,244-576
gggggcagaggcgccttttttaccctttaaaactgagggccaacatttcggatgccaaaaaaacctaaaaatgcgctatccaatcttccaaatctttctgattatgtcttttatttgtcgctttaaatcggcggtaatcttccgatcggacacaatgaatcagacggattatggcccaatggttcttgctcataatggcacatctccgagtgatcaggataaaattcaagatgaagagactgatcactggctaacattaacgcaaactgatcaaacaacaactgatcagaattcaacattgagcatcgattggatgagcaacacaataatgaaagccgatcatgacgcaactttgagcttgggagaagaccatggacagactttggaagccaaaaacgatgatgaacccaatttggaaaatggtcattatggcacaactccgaccgattacgagccaaatgaggagaaaaatgcagtggataatgctgatcataatgatatggcagtggacggcgcgcatgatttatcctcagcagaagattatgacgggaatgattcaattagcgctaaaaatca

SEQ ID NO: 85656 - DNA, 511 bp, Heterodera glycines
  SCN-specific regions: Sequence locations=25-27,62-193,216-511
ttttttttttttttttttttttttcgcatttaaaatttatttttaataaaaaaaatatttacaaaaacaattgacaaataaccgaaacaaaatgaataagcgaaaagtgcaacattggcctgaaataaatgacatataaacgaccgacggaggacgccgaccttttttaatagcaaatggggaaccgttcccgggagaatttccatttttgggggtcgtccatcggactttgtgggttgaccaaacgtctttcatgaaaaacggccgtcccttcaatgtctaccaaaagcactgaagtggacgttgttccgtaatttattccttcggagcttccatcgacgaaaatcgaacaaagaaatttgtacgcatcgctattctgaggacagccggtctgttggcgaatctgatcgtcgggaaaaagtattgtcctgtcggaggcaatgccaaagagagtttggaccaattcccactcagcgcgacgggcgaaatcgaattcgtttagcactttctc

SEQ ID NO: 85657 - DNA, 623 bp, Heterodera glycines
  misc_feature (558)..(558): n is a, c, g, or t
  SCN-specific regions: Sequence locations=1-623
ggggactagtgatagtccaattaagagtaataaaataaatttggttcgtcataaatcttaaaatgcttcacggatggcgagtttttgcctcatgtagcaaatcggttttgaaatcgccttccttacaatcgggtggctatggtttgtcgcgaagactcaagagcgatgaagttcgtggtccagttatcggaattgacctgggtacaacgaattcgtgtgttgctgttatggaggggaaacaggctaaggttatcgaaaatgcagagggctctcgtaccactccatcaattgttgcgtttaccaaagacaatgaacgactcgttggtgcaccagcgcgaagacaggcagttacaaacagtgagaacactttatacgcgacgaaacgactcattggccgccgctttgatgaccctgaagtgcagaaggacataaaagttgtgccgtacaaaattgtgaaggcgtctaatggcgatgcttggcttgaagctcaaggaaagttgtattcgccttctcagatcggcgcttttgttttgatgaagatgaaggagacggctgaanagtttttgggcacttccgttgcgaattctgtcgtcacagtcccggcgtatttcaatgactcacaa

SEQ ID NO: 85658 - DNA, 593 bp, Heterodera glycines
  SCN-specific regions: Sequence locations=1-115,137-351,373-380,416 -490,512-593
gggcaaaaatgagcaaacggcgccggagggcagaggcaccgtattccgaatggaagacagactcagactaccgtacacccacgcggttgaaagccttcgcttgtccaaccttcttccgctgaacctccacaaagtgcttcaaacggacgtcgaaatcggtggccataagctcaaaaagggcaccgccgttgtcaatcaaatcgcaacagtgcttttcgacgacaaaattttccctgaccatgagaagttcatgccgagccgttttttggaggaagacggaaaaatgcgaagagtggacgaattaattccgtttggaatcggcaaaaggtcgtgccctggcgaaaccctcggcagaatggaattggtccttttcacggcgaatttcttccacaaattccatgtttatccttgtgatcctttaaatccgccgaaatttgaaaagcgacaaacattcgctgtcaaattggcggattacaaatgcaaagtgacgaaaagaaagtgagaaaagagcaaatggaagtgccaatttggacattattaagcacatccatttaactttttgctgttgaaattgccaaacattcgcttaatta

SEQ ID NO: 85659 - DNA, 607 bp, Heterodera glycines
  SCN-specific regions: Sequence locations=1-214,236-387,417-454,476-607
gggcctcagaaaacattcgctaccaatgagaaatatgacccggaaaaggcgggcgaggaaaagtttcaaaaagtgaacgaaccttggcacagtgtgccgtacagccctccgaccaaagcattgcttttcaatgccatttccgccgccattggcggcacgcctttggtcaaattgcagaggctgccgagggaagacggcattgaggcggaaattctggtcaaatgtgagtttttaaatgccggtgggtcggtgaaggatcgaattgctcgtaaaatggtcgaattggccgaagcgaagggcattctccgtgccggccaaagtacgatcattgagcccacctcgggcaacacgggcattggcctggcactgatggccgccattcgcggctaccgctgtatcattgtgatgccggagaaaatgagctgggagaaggagtgcgttctgcgcgcgttgggcgcccaaattgtgcggacgccgtcagagaagggatacaccgatgcggacagtcacattggggtggcattgcggctgcagcgggaaatcctcggggccgtcattttggaccaggcaaaagaagcgggtggatggggaaacacgccacggggga

SEQ ID NO: 85660 - DNA, 527 bp, Heterodera glycines
  SCN-specific regions: Sequence locations=1-9,32-527
gggaagaaatatttctgtttttcaaataatccaacgaaaatccgcgtaaaatgtctaataaacaacaaaagaacgcaaactttggacagagatggcaacttgaatcgaatacgtccggaagtgattcgaagacctttctttgggggcagccacctgattttggatttactgccaagactcggaatgatttggtcgggcctcttccgccctcacaaggcgtcagtccgtcgaaaaaaaaaaagccgagttcaaagagtcgtgtagacgcattccgtcccccgtgggaggacagttcggaggaagaaaaggagggcaccgcgacagagggaaagggcacggaggaaaagcgctgggacatggaggagagtgggtgggggcagcgcacgacggaacaggtcggaagttcgtccgttccgaatgctgaagtcacaaatgtcgcaagtacttccgtcgatgttgaccaaaacaaagacaaaaaccgagtggcccagcagcctttcttcggtcggcggcgacgtgtcgtcagc

SEQ ID NO: 85661 - DNA, 442 bp, Heterodera glycines
  SCN-specific regions: Sequence locations=25-442
ttttttttttttttttttttttttcgggagttgtttatttcgatattttgtacgcatatttacgaagacaaatgatgattggcaatagtctcacaatcatttgtaaaagcgctaatatataatttattgagtaacaattaataaatgtataaaagtggaagtgaccttaagttataactccaattggtaaacaattaaatttaaaggcagaaactcgggaagttgtcgaatccatcataagtcatacgttccatcattttgtcttctttgagtcggctttttttacatttggcgatttcttttcgtccgataaaacttccttttggccatttgctttctcagcgctttcttttgcatttttcttggcactttgttgctccttccttcgctcggcttccttcttcttaagcgccccagttgggaacacatagtcaataatgca

SEQ ID NO: 85662 - DNA, 292 bp, Heterodera glycines
  SCN-specific regions: Sequence locations=1-267
gggcaattcactcaagtcctctccaagctctacgatgactttcaggagctcagagccgtagaggaagtgaacgtgaacaatgtgcttaagaaggagccgccgaaggaagcgatcaccgattccaacgaagagtcacccaaaaaagagaccaagtccactgattgatattgagacaaattaatactcattcttattggaagacgattaatgtttagaccaaattattttggagttgattgatattgggacagtttttcattgttgaataaaaaaaaaaaaaaaaaaaaaaaaa

SEQ ID NO: 85663 - DNA, 626 bp, Heterodera glycines
  SCN-specific regions: Sequence locations=1-157,179-626
gggaagtttgaggttaattattttgtccgtcctttttgtcccactcaaaaatgctcagtcgaatgttgtcctcggctgttgccgtccctcggatgtgtgaatcaaacaaaaaaattgttgaggaaaggcgcgactttcgttggtcttctccgtgggcgaatggccaactcaactttcactgccacagttacccctcctcatcggctcttacgtccgttgcatatcaacgaaaaaaaattgttcggacctggtcccagtaacatgccaccactcgtccaggagggactcgttcaaccgttgctcggacatatgcatcccgagttcttcgaaattatggatgatgtgaaagccggcatcaaatacattttccaaactgagaatgcgctgaccttcgctgtttcgggcactggccatgccgggatggaatgtgccattttgaatctgctggagcctggccaggccattttggtggtgcaaaacggagtgtggggctcgcgggcagcgaatttggcggagagacttggcattaaagtgcatcgattggtcgtaccggagggagaagtgattaatttggacgattttgccgaggctgtggataactaccgtccccaagtggcattcgtttg

SEQ ID NO: 85664 - DNA, 220 bp, Heterodera glycines
  SCN-specific regions: Sequence locations=29-31,62-79,101-220
ttttttttttttttttttttttttttttgccatttatttttattttaatgttattaattttgataaccatgcgggaaataaatgtacaattttattgtttgttgtgtcccaattgtgttgcgtttgctgtctttttcactcttttttgctgttaaacgatgcttcgcatttgctccgattttcccaaataatgcgccttcaaaaaaaaaacgaactcgtc

SEQ ID NO: 85665 - DNA, 630 bp, Heterodera glycines
  SCN-specific regions: Sequence locations=1-630
gggatttggcgccaattttgggcccatttccgccccgtccacctctgacgggccccatttcccggacaatgtttggttcctttgtgaaaattacgtcctgcaatccgacgcggcattggaaacggtacacgaggagtttgacatcatttttgcgctggcctgctcaaaatgggtgcatttgaattggggcgacgcgggcataaagcggctttttctgcgcgcatttcgccaactacggacgggcggtcgctttgtgctcgaaacagcgccgttcaaagattaccgaaagcattgcaaaaaggcggccgccgaccgaccgccggacgaagtgttgcgaaactttggtgccattcgactccacccggacgaattcaccgcctttctgctgaacgttgtcggcttcagtcaccacgaggagttagacagtgctcactccaaggcattgggcatttctggacgtctccaagtgttctacaagggccaatttatgctgacggacgcgccggagggcgctcgggacgaaacgccgggggcgacgccgcaacaacaacaatgaggactgaatggtgatgatgatggttgacctttgatcgatggtcgctttcatgttttttcttcatgggggaagca

SEQ ID NO: 85666 - DNA, 440 bp, Heterodera glycines
  SCN-specific regions: Sequence locations=28-36,59-182,204-234,264-440
tttttttttttttttttttttttttttgctggtgtatgttgtttatccacattctttaacaaaaaaaacacattttcatgaaaaccctaactgggtcgctccaccataattttctacatcgtcgtggggggggaagcgcctaaattagccgacaaatgaaaaaaatcgtgtgcgtgccgggccattcatttcatcatccatcgggcagtgggcgccgctcaatgctttttcccctcgccgccggtgtcccccttctttttgtgcgcattgccgggccacgggggttcgtagccaacgccaggcacccaattagtggccgggttgtgcaataaaaaatgggtgccgtcgccccaagggaaagggtttcgacgcgtggccaaatattcgtatgcgacgtactcagggcgtggagaatggggcacattctgatgggccttcca

SEQ ID NO: 85667 - DNA, 520 bp, Heterodera glycines
  SCN-specific regions: Sequence locations=1-349,371-520
gggaatgtcaaggcgggcttcatgatggccaagctgttcgcgccagaaattgaacagagcggtggagggtccatcgttttcaactcgtccatcggcgcctatcggtccccccagggaattgctgcttacggcatcacaaaaacggcactgctaggtcttaccagagctctggcagaatcacttgcacccaaagggattcgcgtgaatgcaattgcgccagggattatcaaaacaaaaatgagcaaagcgctttgggaaggcattgacgaacggagcagtgccgaagccattggcacacttatgggacggctgggaatgccggaagaatgtgctgcactcgtcgcttttctctgctcttccgacgccagttacataacgggcgaaactgtgccggtcgccggaggcgcctactcacgattataaaagggacagacaaagaagaaagaaaaacaaacatctattaaaaaataaaatacaaattgttgcaaagtagaatattcagaagaattttaaaattttt

SEQ ID NO: 85668 - DNA, 417 bp, Heterodera glycines
  SCN-specific regions: Sequence locations=26-82,104-162,184-417
tttttttttttttttttttttttttgcatagttgtccttttatgtcgggcttcatcttttcgctcccaattggggtaaaaactttgtaattggaatttatcactacatttgctaaggacttggggtacgttttgaactcaaaatgggtattggcagcgcaataaacattcactcgataaacaatttccgaattttcatccaatttcggccatatatccagcttgaaatagctgccaaattcaattcttttcgttgcgtcaacattgccatcaataaacacaattggggggtccagcataattggttttagccaagggctccagatagtgtccttcttgatcaaagcaatgccaatttcgaaccctttttcgcaatcattattgccaagtcccaaagtgacaaagtcgctttcgtttc

SEQ ID NO: 85669 - DNA, 406 bp, Heterodera glycines
  SCN-specific regions: Sequence locations=27-291,313-406
ttttttttttttttttttttttttttagtacattcaaatttattcaaatagaaaatccaaaaattacccgaagtacaagaataaacgtctagcaatctacaaatttactccaatttcgaagtcgaactggtgaaaagttgagccctcccttcttgggaggacacggaacggggaatgaacatttgcttctgagacgaagtgccgggaacgatgtctccgactgtccgtttgccgctgagtcgtcgcagaagtgcagaacctttgcgactctggtggttgtttttctgttgggcgggtggcggccgtcgcggcttcttgcgcaagggtttgccaatgtttcgacgcgggtcgccctcttttatggaggggctggacaatggaacgacatggacagtgagttcattgc

SEQ ID NO: 85670 - DNA, 535 bp, Heterodera glycines
  SCN-specific regions: Sequence locations=1-535
ggggaatctcctcgagagtctcgaacctccgcctcgaccaaaaatcagttggtccaattacctcagggcttccgacgaacaaagccatttggggagaccgattcagaccaaagtcaccactaaggacgtgagtggaatgcttgccatgagcaccgattttccgatcagcctcaatttggcacttgacattctcagcgtcatggagccggtgaatccgacggtggccaaattacgcgaattttgcaccgctaaactgcctgaggggttcccggtacgcgtggaaatgccaatttttgcgacgattcaggctcgggtcatttttcaacaatttcgctggtgcggtgaaggcgcctctccagcatttccggatgcaatgttcagaacaccggacgattatcgcgaggacccgaagagattcaaacggatgtagacagataaataaatactcattagtcttactaagtcattatcgttcattttgtctttcttcattcaacttttctcggtgccatcacactgaatactcattgtaatt

SEQ ID NO: 85671 - DNA, 393 bp, Heterodera glycines
  SCN-specific regions: Sequence locations=29-73,111-136,170-393
ttttttttttttttttttttttttttttacaaaaagcgtttttgggaattaaaaatttgtcgcatttaaaaggataaaattttaattaaataaggaaaaaataaaataatgccttcaaaaaaaaaaagcttaattcaaagaaaaagaaagaaataattgaaaatgagttttgaattcaattcattttggggcagcaaaagaataaattaccccatcgaaagaatgggaaatgtttttttaatcatcgaatgccttggctaataccccgccgggtaagtcgcggttttcccaccaaaatcactgttcccgtggataaagccgtcctccatgacaatcagtgcttgaacaacgcttggctgcttttcaattgccgtcatgctctgattgcgttcc

SEQ ID NO: 85672 - DNA, 437 bp, Heterodera glycines
  SCN-specific regions: Sequence locations=32-437
tttttttttttttttttttttttttttttttccattaaattttatacagaaataaaaatgggattacaaataattttgataaatcaaaaccaagtgcctcccgcgtttcccacttgtgaagtactgaaagctgcgtaatcgttccggggaaaatagggagccggacgattggtcgtccactccattgcaaattgggatttctttaaagcactgttcttgagtgcttccgggtggaaatttgatgcggaattagctggaatgttacgaggataacgatttaagccaaacggttgaaaagtgccatagcaaaacggagatcgcatcctcgcttgagtcattggccggggaaactggttagcatatggatgggaacccactgacctcccatacattaagtgcggtcttggccgtgaaggatcatgatgaaatggccaatg

SEQ ID NO: 85673 - DNA, 353 bp, Heterodera glycines
  SCN-specific regions: Sequence locations=1-116,152-287
tgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttc

SEQ ID NO: 85674 - DNA, 492 bp, Heterodera glycines
  SCN-specific regions: Sequence locations=1-492
ggggggcccgggaacagttcaccaaacagttggcacgcttccgtggatttgagaaggccgagcaacaaaacgtgaaacttttcgacgccaaattgcgccagcgtctgtgtgtggctgacattgaccgtgagcgcgtgctgtcgctggaggacgagttgggaaaagttaaaacggaactcactgtgcaggcccgggagaatcgccagctgaagcgcaagtacgccgcactggagacgcgtacgcgagaatacgagacggaactcgaaaacgggcgggagcagatggaacgtgccaagcgctacattgaccaggagaagagaccggagaatgacgcacgtcgcacactgctcaaattggctgaaatgttcgagtcgcccattcccacaacatcgaatgtggcccgtttacgcaaacagtttgacgacgacgacaacgatgctgatgacaattagagaccggacactgcttcaatcgattaaccgaggaaagatc

SEQ ID NO: 85675 - DNA, 474 bp, Heterodera glycines
  SCN-specific regions: Sequence locations=26-474
tttttttttttttttttttttttttaattcaaatttatcatttcttgacgaaaatgaataataatatggacaaaggcaaaaaataatttttttggttcatttacaacggatgttttggttggaataggcactcactcagtaaggacaaatgggatgcaattatacaatgacctaggagaaattaattgaaagttcatggtctgggaccgggatgatttggagggatcagtgaaaaatgggaacattttgaataaaatggacagaaagagacatcgcagtgaaatctaaacttctttatcattcccaaagtgggtaataaaagtttcgcgtgctaatccggcatggaaaggggaattcgtggcagcgtttcaagcaaaaggacatattctgtcaggcgattggacggctcaacgggcagcctggccaacttccaatgcaagccgagcttgtcgtacaattgttggttctcatggt

SEQ ID NO: 85676 - DNA, 565 bp, Heterodera glycines
  SCN-specific regions: Sequence locations=1-196,219-565
ggggactcttttgtagtccttaagttttaattgttaatttttaccgaattcctgaaaaatggctgatccgaaaaaggctgtctgcgtgctcgtcggtgatgcggacccatccgtgaaagggatgattactttcactcaagacaaggaaggttcacccgtgtcagttcagggcgaaatcagtggtcttgagcctggtcttcacggcttccatgtccatgcctacggcgatttgtccaacgggtgcacttccgccggcccgcatttcaatccaacaaacaaaacgcacggcggaccgcaggatcaaatccgacatgtcggtgatttgggcaatgtccatgctgggtcggacggaattgccaagctgacattttctgaccatttgatttcgctgtgcggtgccaacaacattgtcggtcgtgcgcttgtcgtgcacaaatccgaagacgatttgggccgtggtctgggtgaaaaggaagatgagagtaagaaaaccggaaacgcaggggctcggctggcgtgtggaatcattggacttgcaaaaccatgactcgccagcgacggagac

SEQ ID NO: 85677 - DNA, 108 bp, Heterodera glycines
  SCN-specific regions: Sequence locations=52-108
tttttttttttttttttttttttttctttttttttttttttttttttttttggtgactttgtactggtttttggcgagggcaaaaaaaataaaaaaacatttgggggg

SEQ ID NO: 85678 - DNA, 296 bp, Heterodera glycines
  SCN-specific regions: Sequence locations=34-251,293-296
tttttttttttttttttttttttttttttttttgaaaccataatttccctcgctgtgttttatttgaaatataacaaaatgaaaaacattgcgaaaggggatcaatcctcttccatttctacctcactttcgaatcttttcacattgcctccccttttcagggctttcacttttctcgtttgaattgcgtccctactttgtcttcccgtgtgcacttgggccactttgtttcccaatgcctcaaatttcaccttctttttggcacttttctgaacttcctgggggtttctgagtgc

SEQ ID NO: 85679 - DNA, 336 bp, Heterodera glycines
  SCN-specific regions: Sequence locations=31-336
ttttttttttttttttttttttttttttttgctcatccacagcactaattttttgctgctgtttgttaatcagtaccatgggaatggcgaacaaacttcacatttttgaaaaacacctaaaattccaagttgttgtcctggtcaattttgtagttgaactcctccggggtgccggtgccgtccactttgacgtgccgttccctcagccgacttttttttgggtcgtacctgaaaatgatttcgtgtttggagccctcccaataattgccaatgaaccggtcgttagggttgaactgccaatcggggttctttttggaccccttcacccatttgctg

SEQ ID NO: 85680 - DNA, 550 bp, Heterodera glycines
  misc_feature (549)..(549): n is a, c, g, or t
  SCN-specific regions: Sequence locations=1-550
ggcgggcccgggaacagttcaccaaacagttggcacgcttccgtggatttgagaaggccgagcaacaaaacgtgaaacttttcgacgccaaattgcgccagcgtctgtgtgtggctgacattgaccgtgagcgcgtgctgtcgctggaggacgagttgggaaaagttaaaacggaactcactgtgcaggcccgggagaatcgccagctgaagcgcaagtacgccgcactggagacgcgtacgcgagaatacgagacggaactcgaaaacgggcgggagcagatggaacgtgccaagcgctacattgaccaggagaagagaccggagaaggacgcacgtcgcacactgctcaaattggctgaaatgttcgagtcgcccattcccacaacatcgaatgtggcccgtttacgcaaacagtttgacgacgacgacaacgatgctgatgacaattagagaccggacactgcttcaatcgattaaccgaggaaagatcgtcgatttttctgtatttttcataagactaatttacaataaaatgtatttttaagtna

SEQ ID NO: 85681 - DNA, 388 bp, Heterodera glycines
  SCN-specific regions: Sequence locations=26-29,61-131,153-388
tttttttttttttttttttttttttgttgaattttatttaataaaaaattaataatttttggacaacctttttttaaattaataaatctttgtccaaataatcaatcagtatagctttttatcgctgattgtaccctcctcctcctcccattagaatggcagcacactggacaaattgaacaccaatgaagggccaaagttggcacggatggcgtccttgttgtcaaccaaagtgacggcggcaaaaaggcggaccggatcagcagcaagaatccccatgtccaatttctcgccattaagcgtaaagaaaacatgacggttgaatgcgttcagtccacatccaattacatcgcccgtcgtgaactgcggaaaaccgtcaaggggtgcg

SEQ ID NO: 85682 - DNA, 324 bp, Heterodera glycines
  SCN-specific regions: Sequence locations=24-324
tttttttttttttttttttttttgccaaaatgatgatatttgatacctgaatttctgataacagttccgcgaataacgaaaatggagtaacaaaacaatgattgaatggacacaaagcaataatctcgaatcacgtttattgggtcgctttcccttttttcgcaacgggttgactgggcaaaactttaccaggaaatgactttttcccgcaggggcaactgagtcttggccaaattggccagcagagagaccattagataatctcggagcgaatgctccaccaaacactttatttttttggggggcaattgcgtgttcgccagt

SEQ ID NO: 85683 - DNA, 425 bp, Heterodera glycines
  SCN-specific regions: Sequence locations=28-93,115-203,225-425
tttttttttttttttttttttttttttggttattggacataaaagtcacatgtaaaaagggtataaattaaatgtttgggctcattatcgacagtgatttaaatatttcaaatgaacaaacacttctttctcaccaattacgggaattatttttcgaccattgacagttccaacgctttacgtggcatttcctcctcctctttgaattcctccaggcgtcttttttcttcagcctctgaaagctccaatgctttgagtaaatcgccatcaatcactgcgccttggcgttcatttgcgagttcaaaattggggggcaaactttcttcgatggcttggtgcaattgttgtgcataaattgaccaaatctgttgcgtgtcgggacccacaaaacgggccaacaaataaacatattcgtcctccacgtc

SEQ ID NO: 85684 - DNA, 185 bp, Heterodera glycines
  SCN-specific regions: Sequence locations=1-75,97-185
ttttttcgtcaatgtgcacgtttggcatgcccgaaaacgtgcaaaggttttgttatatgaaaaaaaaacattttgccaaaaatttaatttttgattcttaacagtatgccatgatgatgaattaccgcaacatggacaagaagattacggtaatagcatcaacagtacaacaacaccaataagca

SEQ ID NO: 85685 - DNA, 360 bp, Heterodera glycines
  SCN-specific regions: Sequence locations=28-59,83-360
tttttttttttttttttttttttttttggggatttatccccctaaatttccatttctccacaaaacaacaaaaagattttatggcaaatttggtcaaagtccccttcttccccaattcaccctttaaaattcgtcagtgtccaaaaccacccgccaccccaaattctcgctgtccaacaactgttcgttgagcataatcaccgaattgtcaaagcgataattgtcttgaggggaacaacgcaatttgaaaatgggcgggaaacgattgcacaggtcgaccaaagcgttggagttgggcatgggggcgcccatgggcaccaattgggaagagatttcaagcaaatgctggacccggatggc

SEQ ID NO: 85686 - DNA, 525 bp, Heterodera glycines
  SCN-specific regions: Sequence locations=28-126,159-525
tttttttttttttttttttttttttttcgcaaattggttgaaatgataacacagagatacaacacattgataatggggatcaaccaacaacagacacttatgggcgcttaaacagtaaccaggcgacataatactgtacatacagtgagatacaataatacaatctttacagttgggatcatatgtgggaatagggtcagttgaatgtatcctcctcctcctcccttttcggggggtgtcttttgcatcctttcccatccatcggtcgtttgtcgtctcatttcatcgcgtgcttctgcgtccattcacgggcatttcggttgtactgctcgcggtcgttgcggtaaataatcgcgatgtccatttccagcgcactatccggattcgggtcgcaaagaagcgaaaagatggagagcagcactttcgaaatggtcaacgacggcgcccaatgcgtcgtcttcaggacgtccaaacaaatgccaccctgcttgttgacgttcggatggtaaacgggcgtttcgaatt

SEQ ID NO: 85687 - DNA, 139 bp, Heterodera glycines
  SCN-specific regions: Sequence locations=49-54,76-139
tttttttttttttttttttttttttttttcttttttttttttttttttagggggttaaatttatttaaaaaaattcaaaacaaccaatagtttaaaaagttggggaaaaaatttgttttgaaaaactaataaataaaaa

SEQ ID NO: 85688 - DNA, 373 bp, Heterodera glycines
  SCN-specific regions: Sequence locations=30-130,153-373
tttttttttttttttttttttttttttttaagggggttagatttatctaaaaagattcaaaacaacaaatagtttaaaaagttgtggaaaaaatttgttttgaaaaactaataaataaaagaggatagaataaaatctgaaaactaagcatccattctttcttcctccgttagatccatccatggccctaatgatgatgtgggtcgggtccactcggtgacagacgcttcgattcattgaccggcattttctcagcaagttcgcgtaggtgtgccctcattttttctaatcgatttgcccccatttcaaattgcacaggaggagggggtggagccattgagcgattggtcacatgcgatggcaccaatccggc

SEQ ID NO: 85689 - DNA, 555 bp, Heterodera glycines
  misc_feature (34)..(34): n is a, c, g, or t
  SCN-specific regions: Sequence locations=28-45,67-197,220-325,358-454
tttttttttttttttttttttttttttgcaattntaattttatatttgcttatgcaatttgtttgtcttttagttcccctttttcgtttgataatgatgacttgttaatgtttttttttgcatttttcattttgcaccattattgcttgggctgtgcggaaattgcgcttttcgcgactccgaaaacttttagcttttgacaaaaaacaaattaagaattccgccaattttctgcgttcaactatttttttttcaaattttcccggggaagactttttttcatttcataaaaaaattatttagacaatgttaaaagttttcttcgtattttataacatttatttattctttgatttaatccaatttttttgatccattcataaatattattgcgatttatgcctaattttttcgctatttttccttcaattttactccattctctattcgaatatttttttcctttttggtttattttttcttttattttatagaattttccacttatttctcttttttttctgggcttcggttcttttttcttcccatttttct

SEQ ID NO: 85690 - DNA, 238 bp, Heterodera glycines
  SCN-specific regions: Sequence locations=30-116,138-238
tttttttttttttttttttttttttttttagcaataatataaatattattgagaacatttgattcaaaaaaaacattttaacatattgacaaccaaatccgagccaaaacatccaaaattctgggccaatcacttccatcattttccgttgctttacttgtaagtgccggcacacactttgatttcggcccatttgccaattatttggaattgggcgtggaatttcactccgttggcg

SEQ ID NO: 85691 - DNA, 197 bp, Heterodera glycines
  SCN-specific regions: Sequence locations=105-120,163-197
tttttttttttttttttttttttttttctcttttttttttttttttttttttttttttttttttttttttttttttttttttttttttttttttttttttttttaaaaaggggaaatgggttttttttttaaaaattttttaaaaccattttttttttttttggggggggggggccctttttttaatttaaaaaagg

SEQ ID NO: 85692 - DNA, 314 bp, Heterodera glycines
  SCN-specific regions: Sequence locations=28-31,53-314
tttttttttttttttttttttttttttataaataaattctatttattttcaatgatatgccaaaaatgataaataatattttgtgtcatttgtcccgttttgttccgtttgtaatttgtccagttggccattatagtgccatttggctgtccatttccgtctcttcccccatgccctccaattcgtccgcctcgccgtccatggcgtcgtactcgagcagttcgccctttgccaattggtcaaagtccgacttttccgcccccaagttgtcgaccgcctcagtgcccaagttgttttccttcgccaccacttcc

SEQ ID NO: 85693 - DNA, 416 bp, Heterodera glycines
  SCN-specific regions: Sequence locations=31-114,136-416
ttttttttttttttttttttttttttttttaaaaatttgatgggtttaataaagtaagtttaattacaaagcatgacacaaagtttattacataccctttgaaaacatatcataaaatcaattcccaaatattttacaggcctttttttttgcaaaattgtcgtgaaaaaattcacaacaatttttcgtatctaccctaattcgtgctagggccggcgaaattgggctgaaagccgatgggcagcacaccgtaaaccaaccgtgccgccttttgcgccacccgctccacgttgtaatcgcccgggggtttgggcgtgttctttgccttctccgccgcgtcataaatcgccttagggtggttgttttccggaagccacccgtacacacgggccgccgcgcgttccgccacgcggttc

SEQ ID NO: 85694 - DNA, 256 bp, Heterodera glycines
  SCN-specific regions: Sequence locations=28-130,153-256
tttttttttttttttttttttttttttaaagttgcctttattctttacttggcaaaaaccaaaaataaataaaacagcgaaaaatgtttaaattaatgaaaattaaattaagaccaaaatgtccaaaagagaacataaataaatgggtgtatatatgcatatgtaagtttaagtgaaagttagcgtagtaatggccgcgtagttttctcttatttcctgctccttttgttcgattttggttcgctgcctggggaaa

SEQ ID NO: 85695 - DNA, 298 bp, Heterodera glycines
  SCN-specific regions: Sequence locations=1-7,32-185,246-252,274-298
ttttacgttttttttttttttctttttttttgaaactttccaatttatcaaaacagtccacgaatgccaaaaaaaacattggcacattttttcaaaaattaattgcatcatagaataattcatcaaaaaatgggcgattttacagtagtaactcacatttctcacattttacagtatccaatcaacagaaagagggccggcccatcataataaataaaaatattaaattgcaataattaattattgcgcatttttggctgcttttcctccatcattttttggcttccaaattgccgtc

SEQ ID NO: 85696 - DNA, 528 bp, Heterodera glycines
  SCN-specific regions: Sequence locations=23-35,68-275,297-349,371-528
ttttttttttttttttttttttagcgaaacagccatttaaacaacaaaataaaaatcaacagaaaaacaacataattccgcgtcataggcagaccattttcattcactgttattttgaagtgtttccatttttcaggtcgattttggcgatcagttcgttaatcagtttgtcggtatgcaaatccaatccttctggcgacttatcagcctcacgcaatttgtttaactctttcaaaatcgtttcaggtttcgggtgcaaatcgatcagatggacaactgcttgggaagccaactgccgaagattttgaaaagacgggtcttgtaaaattttgaggaggacactttgcatttgggggagaaacgctttgaggaggagagagacattctccagcaatctcagcaacgcgttgacagcagcgaccttcacggggaccgggtgccgttcacccaaaattctgattaatggaccggccatgttcacaacgtggggtctaagtcccgcctcactgctcaaagggatgagttgcg

SEQ ID NO: 85697 - DNA, 447 bp, Heterodera glycines
  SCN-specific regions: Sequence locations=33-33,65-163,186-345,368-447
ttttttttttttttttttttttttttttctttcattattttataataaaattataatttatttaggggcttaaatttatctaaaaagattcaaaacaacaaatagtttaaaaagttgtggaaaaaatttgttttgaaaaactaataaataaaagaggatagaataaaatctgaaaactaagcatccattctttcttcctccgttaaatccatccatggccctaatgatgatgagggtcgggtccactcggtgacaaacccttcgattcattgaccggcattttctcaacaagttcgcgtaggtgtgccctcattttttctaatcgatttgcccccatttcaaattgcacaggaggaggtggtggagccattgagcgattggtcacatgcgatggcaccaatccggcggcatttcctccctgaacattgcttcgcccaatcgcttccg

SEQ ID NO: 85698 - DNA, 530 bp, Heterodera glycines
  SCN-specific regions: Sequence locations=1-530
ggggaagagtccaccgtaaatcaccagtcgccaaagaaaaaggcgccaccaaataacgctcgggtggccaggagaccgcgcgatttgcgtggactgttccctcgggcacaccgaccaatttcctcggcaagcgaacagccgaccacccaactgaagtcgaaccgattgttcgcgcgcattgacgagtcctttcggagccgttggcttaaactacgctcaaaatcgacttcgatggtcaacattacaggcattgcctcctcgaaggctcctcctttttcccatgggactccgtgggccaatcggcatcacatccatcagccattccagtcccgtccgatgacctgctgcttcggaatggtgccaaccccccaagtcacaatgggcgcttgttttgtctccctattgcacaacattccaattcatgtcaattgttgtgcccaatatttccacccggccaaccgtaaacagtttatgatcatcggtgccgagcagggcatttttgcaatggatctcacacacctcaccacgga

SEQ ID NO: 85699 - DNA, 461 bp, Heterodera glycines
  SCN-specific regions: Sequence locations=28-72,125-461
tttttttttttttttttttttttttttcgttgttttacttcagcaaaattataaatgagataattggaagagttatatttattaataaaaaactttttttacaaataaaaatttacaaaaattagcaactataaattttggtctatattacgaaaaaatgattttccggggatctctgattgatttcattgatgctcttcagtcgagcatcaccgactatgggggcacgtccaccggttgatgaccgtactcatcctgtccactgccaataccgtagtcgtccgtttgcccactcattgccccgacctcctcctcatataggtcatcctcctcctccgccgatgcatcaaattccctgctgctggcttccgttccgtagtaataattctgataatcatcattatcatcggccatgtccaaattggtggcagtcgaagtgtacgatggcaatgagttacggt

SEQ ID NO: 85700 - DNA, 395 bp, Heterodera glycines
  SCN-specific regions: Sequence locations=29-86,109-187,210-395
ttttttttttttttttttttttttttttgcaagacaatcattttattgtttacattaggcataaatattgaaaaaaaggcgaaatgttaaaatattcataaataaaatgtaatgggagatacacaccacttcgagcagtacacccgcaacagcacaacagaagagtcagttccataccttcaacagactgtcccatgagccagtgcacagcgcagttccatcgttgggcacccccaaacaccaaattcggttgtcgtggccggaaattattcccgtcctttcaacgcgcattgagtcccacaaattgcaattaaagtcgtcgcaccccacgaacagcaaacggcccgacttggaaaaggcaacacttgtaaccccccaaatgatgttgtcgtgcg

SEQ ID NO: 85701 - DNA, 467 bp, Heterodera glycines
  SCN-specific regions: Sequence locations=1-63,85-407,429-467
ggggctgtgtccacgccattcattatacctatattctccttaacgaaacacctcaacaacttttggaaacccaaacattcgttcattcattcatcgcaaaatgcaagctgccaacaggcgccccatttgtctgatctgcttgaagaaaatgacccaagtccgtcaggtgcgcaccatctgtgaccacgtgttccactacgtctgcttccaccgttggctcaaatatcgtctgttttgccccgtctgtctgctcaactttcgcacggaattgtatcattcgggaaacgccgtgtttgagggcgcgtacgacgatggacacgttgtgctcatacctgatggtgaacaaagcaacagtggataagtgatcggcactcatctccaattgtgatcggacaaaagcgatatctaattttgtattgtacataaataggttattcggacaataaaactgtaatgtgaaaaaaaaa

SEQ ID NO: 85702 - DNA, 524 bp, Heterodera glycines
  SCN-specific regions: Sequence locations=1-524
gggccgctcaatttggcatcgatcacttcgtcactcaatgcttcgccaactccaccgagctttgtcagtccggtgccacagccgagcagcagccaaatgataccatcagtcggtcaaccgcaacctcaacagcacggactgctgctgacagtgtccccaaaaaagtcgactgcagtggtgacagatgcggagaatgccagtgccattgtgccgaatggagacgatgagcaggcgatgaccaattctgcaaacaaaaagcggacggactatttgagttgggacgaatttttcatgggagtcgcattgatggcagcacaacgcagcaaagacccaatcacacaggtcggcgcatgcattgtgaaggagaacagcatcattggcattgggtacaacggaatgccaattggctgcaacgacgacgaaatgccgtggggaaagggcgacgctaacccgctgaacaacaaatatctttacgtgtgccacgccgaaatgaatgccattttgaacaaaaatagcgcttccgt

SEQ ID NO: 85703 - DNA, 592 bp, Heterodera glycines
  SCN-specific regions: Sequence locations=1-193,218-592
ggggctcactttggtcatttactcgttggacaccgttttgcttatgctctttccccgcccatcggctggcgtcggaatggattttggcccatatctgaaattgaccgccattttcatcgtcctctctacttttgggctcggcttatcattggcccacatgaaaaaaatgctgcaaatcggcaaagaattggccaaacaaaacgaaacgacaaaaacagcgtcggccacttttgttggacaggacaatttgcgaacacttcgggcattcaccgggtgtcaggccggcctttccgtactttccatttatgtggccgcctcattagcatttatgaaattttggtatgtgcgtactcatctcgtccaggagttctcctgctctttgatggccattactttggccgttgtccaattttttgtgcttcgaatggccaatggcggcggattacttctgatcaaaggaattgttttggccaatgcgtgccaaattgtccaggaattgaacatgtctctgtccgccttttacacctttttttacgcgggtcggatttacgacgcggttgaggagcgcacttcgttcttcactggtccggag

SEQ ID NO: 85704 - DNA, 431 bp, Heterodera glycines
  SCN-specific regions: Sequence locations=25-431
ttttttttttttttttttttttttgcatttattaatagtaagattcgttatgaaaataagggtcagtgggcttttttcgattcaacatcatttgattcagtgccagtccacgagtctctaaagcctagtaagtccctgtccaaaaagggggcctttgcatatttgcgaaacaaattcagaaattgtaatgctgccgaatgtaagtcccaagtcacttcaatgccgggcactttgtatgagtcggacatacagtttctcagtttaaaaacagcgatgagcacttgtttgatgtcgtcggatggctctctgattcttaaaaagtcgacgtaggaaaagtcgcgatatttattcataaaatagagtaaataatcggccacgaaattgggccgtgtggtcgtatccaacaccaaattgcaaatggccaatttcat

SEQ ID NO: 85705 - DNA, 415 bp, Heterodera glycines
  SCN-specific regions: Sequence locations=30-415
tttttttttttttttttttttttttttttcataaaataatttattcaaaagcggaaaagtcgcaaagctttcacatggactaaagaggagtgggagagtttaaacagaaaaaggaacgggcgaatggaaccgtcacaaagcgattttcaaaaagacctaatgatgaccaacaattaacacaataaagaatgggtaataagttaggaatatttggtcaataatttgactgctgtttaaaaaaataaaattctgtgagtgattatgatgacaatgtgaaggaatccccgcaaaactgagtttatcagccgatcaggtgaggaaaatcccaaagaacacaaagaatgccttcagaacgccgaacactttgataatcagccaacggttgcgggaaatgttgttgaaatacttgagcaac

SEQ ID NO: 85706 - DNA, 544 bp, Heterodera glycines
  SCN-specific regions: Sequence locations=1-544
gggtcaatcgaaattcgttgccaattccacaaaaagcgctgccaaagaaagtcgtcggatttaagagcatttcaatcaaatacatcgaccaaaatgtcatcgcttttctccgccattttcgacaacttttcgcctcgtgtacaattaatttggacatctacactgacgatgaccgcactttggatttgatgttgcgcaacatttggccaatgatcgcgaaaaacatttgcagcatggaattgtccggacatgctttcagcggtttgcgacaattcgtgccgtcaattctcaacgattgtccatcgcttcgtgttgtcgatacctattttggtggctttttcgccgaatttccggccgatgacaatgccaatgcttcgaatggacaagcgtgggccaaatggctgttcactcctcgtcctgacaatgtgccaaaggtgttcaaatgctggttggatgggaatttgtcctcgaggattggagccttgaaagcggcatttgccaatgcttcatctcccgtcaatttcattgttgtcatttggcaatt

SEQ ID NO: 85707 - DNA, 613 bp, Heterodera glycines
  SCN-specific regions: Sequence locations=1-571,593-613
gggatcaacacccgttttgcaaacaacaactgcacccaaacaaatcacggacaaagcgaagtgcaacgacaaagaagaaatccgccgagtttgtgagagctgcgaagagtacgcatgcgtgcccaaagacggatttgttgcaaacagtgcgtgctgtactgacaactttcagttccagtgctgcccgaacaaccaacagcagcggcatcctgggcattgcgcaaatgaaaccaaaaaaatcatggacttatgcggctgtggcacatactggtgccggccaaataagggctatcgtggattcggctgttgcccgagtgactacgaattcgtctgttgccatgttggcaatcaaacaattcaaatgtcaacagtgacgacagtgacgccggaattgaccaccacaacgactttgccaacgacgccaaatcttggcaaaattgagaacgatcctccgcttttttgcgcgttgaaaaaaacctgcaatccgtccaataatatgacgggctcggagaaatttggccggcgtttcaacacacataaaaaaaaatgtgccgcattgatcaaacggcagcagtcggcaccatcgacggagcttaaatcggaattgcgtcag

SEQ ID NO: 85708 - DNA, 213 bp, Heterodera glycines
  misc_feature (159)..(160): n is a, c, g, or t
  SCN-specific regions: Sequence locations=1-213
ggggacaatctaattgtccaaataaggaatgtctttgtccgacgatttgaatgtccaaatttattctgcgaaatcgacggttgtgcagccacctgagcacgaaaagaagttgaagatgttctacggggtttgtagggacgactatctgactagttatgnngcggacaaaaaacgcatgaaattggagaagagcaaagactggaagaaaaagga

SEQ ID NO: 85709 - DNA, 383 bp, Heterodera glycines
  SCN-specific regions: Sequence locations=27-121,156-383
ttttttttttttttttttttttttttggcagaaacaatttatacacatttatcgatgatctgccaattttcctcgtttatgtgattcaattccgtcgcaattttagccggggactggttttcctcctttcctttttcctctttcttctcattctttacaagccaatcaacaatggttttccagcaaaaacgcaattgttgcgggggttggattaagcccatccgatgccgcctgatgaacacgaccaatgcctccaaagagtccattttttcgtccaccgttcgatcagctcgttccctttcatcattttccgttccattcttttcgccctcttccacttgttggcctttccatttcctttcgaacatactcaaaatgctgtc

SEQ ID NO: 85710 - DNA, 578 bp, Heterodera glycines
  SCN-specific regions: Sequence locations=1-578
gggccaactaattttctcccaatctaaaaaagtctctctaattaatactaattagtacaaactgctgttgatttgatcacagaatgttggttcaactcgtcctccttgccatcattggcatttcctttgtcggtgctgccgcgccgccgtacggcgcaattgtccgtctccggcaccaaattggttggctcaaacggcaaaccggtgcagctgatcggcaattcgttgttctggcaccagtggtacccacaattttggaatactgaaacagtgaaggcactcaaatgcaattggaattccaatgtcgtgcgcaccgcaatgggcgtggaacagggcggctatctgagtgacgcgaacaccgcctaccgactgacggcagctgtgattgaggcggccattgcacagggcatttacgtgatcgtcgattggcacgcgcatgaggcgaacgcggacaaagcgattgaattcttcaccaaagttgcgaaagcgtacggctccaaccctcacttgctttacgaaacgtttaacgagccgttggacgtgtcttggaacgatgtgcttgtcccgtaccataaaaa

SEQ ID NO: 85711 - DNA, 476 bp, Heterodera glycines
  SCN-specific regions: Sequence locations=1-57,79-212,234-328,351-476
ggggaaaatcatccaaatcaacgcggcacagtaataaaatattaaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagg

SEQ ID NO: 85712 - DNA, 115 bp, Heterodera glycines
  SCN-specific regions: Sequence locations=1-30,52-115
gggactttcccagggacggaattttctctgtgtaccataattagcattttttgataatttggctactttatctcttgacaaatcacacaaatattcgtcgatgggcggcctaacc

SEQ ID NO: 85713 - DNA, 421 bp, Heterodera glycines
  SCN-specific regions: Sequence locations=1-396
gggatgccgaagtgatggctcttcggggggcaagcaaagtgttggacagcttcgacctgagcgggtgcatactgtacacgagctgttacccatgtcccatgtgtttgggcgctgttttgtggtcacggattagcaatgctttctatgctgctgcgcctaccgatgccgcttcggtcggtttcgatgatcagaatttccacgaatttgtctctaatccgaagaaatacgaaaaactgatggcattggaacatttgccagtcgaagggcatatgaaagtgttcaaaatgtgggaacagagggacgagaagagaatgtactgacaaagggccaaccaatttattcaatttacatttctcatttgttaatacatgtgaatagtaaataaattggaaattcaaaaaaaaaaaaaaaaaaaaaaaaa

SEQ ID NO: 85714 - DNA, 161 bp, Heterodera glycines
  SCN-specific regions: Sequence locations=26-31,62-161
tttttttttttttttttttttttttggaagcataaaaattttatttaaattacaaattattctatgggcatataaagtctgaaaagctcaagtttttttcatcaaatcaggcctcccacaatttctcaatttccttctcaatggtcttcgggtctttgggc

SEQ ID NO: 85715 - DNA, 403 bp, Heterodera glycines
  SCN-specific regions: Sequence locations=28-403
tttttttttttttttttttttttttttctgggccattctttcaatgtctttgcgtataatttccctgagctcggaaaaatctttcggaggacgcaaaagacgttttttaatttcactgtaatcatccgaagcattccatgggtgccaaaatccatttgttccatcaccttttcctgcggttctttccgaatgcttttgtcgcacatcacttccgatgctaacagcgggaactcgacggacaggtccagtaggcttaggcgtaaaacgtttttgtaataaaaggaaagacgttgaaagaaaccgttcggagaataattccgtcgtctgacagacacagcgaggagacaatcggacaattcgattgaaaattctcaataaatgaagatgccggaaatttgctgac

SEQ ID NO: 85716 - DNA, 537 bp, Heterodera glycines
  misc_feature (516)..(519): n is a, c, g, or t
  SCN-specific regions: Sequence locations=1-29,52-76,98-348,372-537
ggggacacattttttcatttgtcccatcattttaaaatattccccaaaatgcgtgttctcccccttctcttttctgccctcctcctcctctctgttggcctttgctttgcccagtttgatcagtctccgtccgctgctctgaatcatgtgcgggccaaaagaggctacaagccgtggaagaagcaatccttctcctcttcttcaagcgaaatgtacagaaggagaagacccagtggtaacggtcattacagggattacaacagctacggtagcaatggatactatcgacgaaaacccggcattttagaacgggcgctgggaaaaattacgcggagctattaacggacgagcagaagaagagaagcaaaaagccaaacaatgggcgtaacacttttaattgatcaaacgatattacagtatccaacaccaaaattacagtaaccaaacatccaatggaacgaatgactcatttaattcagcaaatttgctggaattgccgataaagaaacttaccannnnaaaaaaaaaaaaaaaaaa

SEQ ID NO: 85717 - DNA, 275 bp, Heterodera glycines
  SCN-specific regions: Sequence locations=25-32,54-275
ttttttttttttttttttttttttggcacaaataaaatgaacaattaacaaataattgactaataaaatatggaaaatgtctgtaattgtacgcaacatcatttcccattccatccgtttgtcctcttttcaagggtatctcctcaatatttttttgcgtttgttgcgccaccacagtttcaacgcggacatcggatggcgttggtgcaaccgcacgtccaacaaattgaaattgttgctgcgcaacacggacagcacgtggtcggcgcgaaaac

SEQ ID NO: 85718 - DNA, 397 bp, Heterodera glycines
  SCN-specific regions: Sequence locations=1-213,241-367,390-397
gggattcattgcatttcctcctatcacttcattcccaaaatgtccttccttcgtctgatcacttttgttcttctgatcactctgtgctctttgccttctctggtcgaaagcggcctcattggcattgtcggcactcccgttgaagccgcttggtgcggtgttttgggcaaagaatccagccattgccctactgctggaggcggtcaacatggcggaggaggaggaggaggaggaggaggaaattacggtggtggagccccgggtggaaattacggcggttccagcggctcatacaatggccatcgcgcacgccgattcccttgataaatgacaaataaagaaagtggatgatgatgaagtgctgctataaataaaaagtaaacaaaacaatctatct

SEQ ID NO: 85719 - DNA, 466 bp, Heterodera glycines
  SCN-specific regions: Sequence locations=1-466
cggggaaaggggtcaaaagttggctaaacgcttcctccaggcgctctcggttttcttgattggatggtaagttgagcaaatgagtaacgaaggctttgaatgaatccgggccgagaaggatgagggaaaaaagtgcgcttgaagcatcactcagcaaatccaactcgaagctgtactccatggccaattgaaacattttcggaaccaaggccagaagacgttcagtcattgtcgcatatttccccgttttcttcacggagtcttcgacacaatttgctgccaatccgttgacaatttcgagcgcagaacggactctgtccccgccgaaagagtagtcgagagcggctttcacacaacgcaaaatatcgtcgagcatttggggcggactttgggcaattccctcggcggcgatgtccgaaacaaaaatgagcagccgaaagaaagaggcgcacaaatgcggcacatt

SEQ ID NO: 85720 - DNA, 579 bp, Heterodera glycines
  SCN-specific regions: Sequence locations=1-579
ggggacgcagcggaaaagttccctttgtcggcattcactcggccgcccccaacaaaaattgttaaagccgacggggacaacgacggaacgccagcgccgccgctcattcaaacggcgaccattgcgctccaatcgttgctccgacttttgcaacaacaaaagaaggtgcgcgtaaatgctctgttggtcacccaaatcggtgtcaacgggccagaatacggcgagttcgcgtgtgtcaatgtgcggctcgaacatggttatggcctacggatcgaaggccgattcgcgcgcatgaccaggaaccggcgaaatcggcaaattcaaccgctgtgcgaaaaggtgtgcaatgcggtggtccaactgttgaagtgcgacagcgccgcctcagcgacggcgcgaattcgacgggccaattgttgggctcgtacggcgtgctgctgggcgagtggccgactggaagacactgaatgtgccggaccgtgccattctgaagcgcacagtgatgaacatggcggcggtcgcgaattgactgaaaattgaaaatggacaaaatgaaaaactgcgtgtttttttgaccaa

SEQ ID NO: 85721 - DNA, 184 bp, Heterodera glycines
  SCN-specific regions: Sequence locations=83-184
ttttttttttttttttttttttttttttctttttttttttttttttttttttttttttttttttttttttttttttttttttaaaaacctgctttttttttcgggttttttttaaacaaaaggggttccatggggttaatttccccccaattggggttttcaaattccaccctttgacccccct

SEQ ID NO: 85722 - DNA, 302 bp, Heterodera glycines
  SCN-specific regions: Sequence locations=29-166,200-302
ttttttttttttttttttttttttttttcggcaccatccagttcggcttgatgccggactttttgaaggcttccatgaccttcaggcgcttggagttcttcttgaccttgagctcggagccggtcatgtcgttgcgcaggcgatcgatctcgatgtcgagatccatttcctccagcagcttcttgatgccctcggggcccatcagcgcgatgaactcgtcgccgtactcgacgcgcttggcgtcgtagtcgtcctcgctcatgatcgaaaacttcttcagcggcgtcatgcccgagtcgacg

SEQ ID NO: 85723 - DNA, 428 bp, Heterodera glycines
  SCN-specific regions: Sequence locations=32-68,92-132,154-428
tttttttttttttttttttttttttttctttaaaatagctattaataataacaattcaagacgacccaatttttaaaggatagaataaaaatttccatttcattaatctatgatataaaaagatagaaagtgtgtgttaaaaagggggaaattcgtaaaatggtaatatttgaaaaagtgtccctatttgtcgtcagcaaatgatacttctcaaattcatctgttcaaatccaactggttctggggcctatgaatcaggcatgaagtttttgttcttctttttcccagtcggaaaatgaatgatgatgagggggggattgcttcacttccgcttcatcctcaaaaaaatgatgtttgggtgatgaaggcaaaaaaaaatgtttgggggatgatggcatcactggtgatgatgaggaggaatgatgcgg

SEQ ID NO: 85724 - DNA, 645 bp, Heterodera glycines
  SCN-specific regions: Sequence locations=1-19,44-45,67-150,172 -251,277-645
gggagtttgagcacattcatacaaatataatacatacttatatttaattatttctgtttttccaaattggcttaatcaacaaatgtcgtctcccagtgccggaaaacgaagaatggacacggatgtgctgaaattgattgaatcgaaccatgaggtggtcatcaccggtggactgaatgaattcccggtaaaattttatggcccaaaaggaactgcttacgaaggcggagtttggcgagtaagggtcgatttgccggagaaatatcccttcaagtcaccttccattggcttcatgaacagaatttatcatccgaacattgatgaagcatccggcacagtttgtctggacgtgatcaatcaaagttggacagcactttatgatctttccaacattttcgagtcgttccttccccaactgttgacctatccgaacccagcggatccgctgaacggcgaagctgcttccctgtacatgcacaagccggacgaattcaaggcaaaatgcatggaatatgtgcgcaaatatgccaacaaagaagccttggaggcgttggacaagaagacaatgaaaggaacggagaatgagggcgacgcgggcgaagagtcggacgattcgaccatttctgatttttatgaagatgaaac

SEQ ID NO: 85725 - DNA, 352 bp, Heterodera glycines
  SCN-specific regions: Sequence locations=27-81,117-211,234-352
ttttttttttttttttttttttttttgcatgatgggtttatttattggataataaatgtgattgtgacaagagtaagtaacgacaaagagctggaaaggaaatgattattcacatacagacgccgaaaaaagcccattatacaaaatgtatgcaattacaaatggactaattaaaatgaatgagtaaatgaggagcgaaggaataagggacaaatatttagatgattttatagtttaattccaaagcattgcttaattaattagctcattaaaattaaagaccaaagccgaaaaagcatcgttttcttttatccacctcatcataaatttcctcatttcgttttccattgcc

SEQ ID NO: 85726 - DNA, 363 bp, Heterodera glycines
  SCN-specific regions: Sequence locations=1-62,84-363
tttcaactggactgaacacaacagtgtggcaaattcctgccccctctttctctctgctcctcagtttcttttttctctctgtggcagcagcagagggcacccggccggccacatgaactatttctccacctcattttctctgtccacccaaacgactttggatttaacgacgtataacgcaccgcacttttactctcttccgtactgatcaacctccacatttactccactgtttctcaacttcacatttctctgtcacgacagacagcaaaacgcggcacactgtgggaatggtggggaatgccagacactgtccacgccgggcgggtgggaaacggcgtcagtgaacaacgagcgcgaccg

SEQ ID NO: 85727 - DNA, 377 bp, Heterodera glycines
  SCN-specific regions: Sequence locations=33-377
ttttttttttttttttttttttttttttttttctgttctcttcgttaactgcgcgaaaagtgccgtcgtaaaaattgacggaagaaaaatgaatgattttcggatggccccggtaactgtccctcagctggcaaaaagtccgtccctccgtgtaaacccttttttgtccattaattctaaaaaaattttcttctgctctcattggggccattaatcgttccatcaatgacaaatggcaccatttgtaagccttgaaaaaatgcgcctttacaacggggcccaattgctggtggtctccccacaaaaccacccgagtgtttcttgttgcgaaacgtgtgatcggaatcaaagtttcgggctcaattgactgacccgct

SEQ ID NO: 85728 - DNA, 353 bp, Heterodera glycines
  SCN-specific regions: Sequence locations=1-116,152-287,352-353
tgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaacttc

SEQ ID NO: 85729 - DNA, 250 bp, Heterodera glycines
  SCN-specific regions: Sequence locations=28-250
tttttttttttttttttttttttttttatgaaataatttattttcgaagaattaaattccaaaattcggcgtcgtatttttatcactccattttttgcatttgttgcttcacttttttaatggccggctttgtgggggcgatgaaattgggggacggagtgaaataagtcgaagccttcccagacgcctcctccttttgcattggcgtcacaatttccaacccatggacaggggtaaaccaaatgctcga

SEQ ID NO: 85730 - DNA, 349 bp, Heterodera glycines
  SCN-specific regions: Sequence locations=57-110,132-322,348-349
ttttttttttttttttttttttttttttatttttttttttttttttttttttttttaggaaaaaggttaattccgaataaaaatgaaaccaaatccctttgaaaattgggaagggggcaagggatttgggaaaaattaaagtgaaaaatgggtaatcccccttatagaggcaggcgatggccttaaaccttaatttttgagaaaatggcaatggggcccctttaacttgaggggttaataatttccgggaaatatttgggcaaaataggaaaaatgttaactggcccttaatcacataaaggggaatttttaagctggccatgggaaaaaataaataaatttgaaaatg

SEQ ID NO: 85731 - DNA, 272 bp, Heterodera glycines
  SCN-specific regions: Sequence locations=24-139,163-200,222-226,250 -272
tttttttttttttttttttttttgggcgaaattggggatttaatgtaatcaaaatcattcacaaaatgtcaatatgtctcaataaccaaattcccattgggcgggattgggactctttttgccgttcatccccccttcgcctttttcttccctttgggggccactgggtccacttccataatgcccctgtgaagggggaacaaaaatgagatgggaattgaactgatggggaaaaacaaaatggggggcatggagttgcgctcctttttttc

SEQ ID NO: 85732 - DNA, 501 bp, Heterodera glycines
  SCN-specific regions: Sequence locations=1-84,106-501
gggcgaaatgttcaattggttatccaaaaggagagtgccaacaaaatgaatttgcctgccatgggtgctctcctccatacgattttggaaatgccaagaaatgtggtgaaggttttcattacaaatgccgcgttagaagaatgtgccgaaagtggaggagagccgacgacgcaacttttcgattcggtggacattgtaccgtatttaaagccaaaaagtgtggttgaattgcagaagaatccgccgagtgaaaagaatgaattggagaatgagataaggaagcaacaatttctgttggaacatttgcatggacaggtccaacaaatgcgcgaggagcgattggcagagagaacggcgaaggaagagacaatgtgggaagtgcaggcggcgataacaatgctaaagcggcggttgaagacgttaaacgaaaaggggcagcggcacgacggaagagagggcgaagaaggtgacggaaatgtgaccggtgggacggcggacgga

SEQ ID NO: 85733 - DNA, 299 bp, Heterodera glycines
  SCN-specific regions: Sequence locations=24-47,69-175,197-299
tttttttttttttttttttttttgtaaattctttttacccgaaatggaacaaataaataaattatatgttcgtttttaaaacgattcatttaaaaatgacgagcgaatcgtaaaaagcgaagggaatggagggacagatacaacggaaagtccaaaggcagccttggttacagagaaacaaaataggaaagactgcgacaagacggagaaagacagcggaagcagacaatccaacaaattaatagccgtttcatccgttgttcacactgtccttctcgagcccaaccaatgaatacacg

SEQ ID NO: 85734 - DNA, 499 bp, Heterodera glycines
  SCN-specific regions: Sequence locations=1-64,87-242,264-499
aggcaccaccgactgatcaactgcgggtacgacaaaagtgtgctgaagcgggtggatgtgaagcagttgcagctgtttctgcagggggccgtcatgccgacggttaacgccggtcttttggcctacgcggagacattcaccgcaccggcgcagcagaaacggtacggcaacaaaggactgctccgcctttggaatgcactgaagactttgctggacgaattggacgaggcgatgcgcgtcaacgaagcgacgatgggcaacgagcggcgcgagtatcagcaaatgctgcgcaacgcgtacgaaaacactgtggagaaactgaacagggcattcgcacgcggcagagagtcgccggcgatggacaaacggcggagtatgagcatcgacagggcgaagcggagcagcaagcagggcatgctgatcagaccgatttttgctttgtgataagcggggcgcgacccaaaaattttaatataatgacgtgcggatttaattcgct

SEQ ID NO: 85735 - DNA, 565 bp, Heterodera glycines
  SCN-specific regions: Sequence locations=1-565
gggcgtggcccagtccagcattgacccggctatgttcgacgcctctttacgcgatcatttgaacgttactgcaccgagaacaatggcagttctcgagccgcttagacttcgcattaccaattatcgagagttgggttttataccagcgaaaagcaccttacgggtcaaacaattcccatcctcaattaatgaaagtacggacgaatgggaaatttcatttgacgagtttgtctacattgagcaggctgattttagagaggttgccgaaaaaagttatcgtcgactgacattggaacagccggtgggactgcgtcatgtcaatttggcagtcaaaattgacaaactggagcgggatgagcacggaaatcccatcgaattggtggtaactgcgaatccggtgagtagtgagtgtaagccgaaagcattcattcattgggtggcgagaccggtgctttgtgaggtgcgtctctacgacaaactatttgtacacaaaaatcctgaggaccctgccgaagtccctgggggttttttgactgacataaacccgaactcgctccatgttctt

SEQ ID NO: 85736 - DNA, 580 bp, Heterodera glycines
  SCN-specific regions: Sequence locations=1-580
ggggcgcactctccgcggcaaaaaatacttggcccctctgacgacggtgggcaatttgcccttccgccgtttgtgcgttgaattgggcgcggaagtcacttgtggtgaaatggcaattgccacgcatttgttgcagggtcttccttcagaactttctctgatgaaaagacatccgtcggaaaaaatctttggcgttcaattggcaggaggctaccccgattcacttggtaaagcagtccaactgatcaccgacaatttcaatgttgatttcatcgatttaaatttgggttgtccgctggacagtgtcaatgaaaagggtgcaggctgttcgttggcgaataaatccaacaaattggtttccgttttgcagtgcatgcaaaagagtgccacgggagtgcctgtgtccgtcaaaatgcgttacggagtgaaggaaggagaacggactgcgcattacaccatggggacaattgccgaacggagcccccctcagctgctgaccctccaccctcggtcacgggaacagcgctacacaaaggcggccgagtgggattacgtcttggagtgtgagcagcgaatcaac

SEQ ID NO: 85737 - DNA, 219 bp, Heterodera glycines
  SCN-specific regions: Sequence locations=38-219
ttttttttttttttttttttttttttttttcctttttatgggcctgcttaaccgtaaattggaagaaaagaacaaaccaaaattttttattggaaatgaaaaattggaaatattttccccaaaaataaaatctttaataaatattgtttagccttgctttcattcatccatgccggtttttccacttatttcctcccctccttttccatgaaaaattca

SEQ ID NO: 85738 - DNA, 373 bp, Heterodera glycines
  SCN-specific regions: Sequence locations=24-315,338-373
tttttttttttttttttttttttggagattcaccatttactcttttacgaaatcgtacaattccaatacaaattcaaacattacacatcaattaatagcgacaaatggggacatttctttcgacaagagccctaacgaatatcaaaaaataaataaacgcgcactgacagaagaatgaccagtgaaaacagaacaaaaattaattgcgtataattggggggacaaagctcatgatgatggcaattacgggacaatgaaactgcttgatttgatgttcgagatcaaattgaagcgaaatagcctccgggaattaacaacccaatcatttcccctcataaagctgtcggatttcctccgcaaattttctctcgat

SEQ ID NO: 85739 - DNA, 456 bp, Heterodera glycines
  SCN-specific regions: Sequence locations=30-350,380-456
tttttttttttttttttttttttttttttaaaatggcattttttatcaaagtataataaagatttagcaaacaaaagaaaaatgcaaaaaaacgaatgaatggcaagacacttttttgacttcaaaagaattatcacaaagaaacttttaaattacaaaaaccatttaaattccttcgaaattaatcactcaaatttgactccttgcgccaatggcaattccttgccgaaattaattgtgcacgtcgagcgacccatgtaattcttccacgagtccgacccgctttcgcgacccccgccggtttccttttcaccgccgaatgcgccgccaatttccgccccggaagtgccaatgttcacattcacaatgccacagtcacttcccttaggcccaatccattcggacagaagcgacacattttgggtgaacaaactgctggacaagccctggctggcc

SEQ ID NO: 85740 - DNA, 181 bp, Heterodera glycines
  SCN-specific regions: Sequence locations=1-181
ggggaactgatgagaataaccggcacatacgcactgaacgaccaaaaccgattgttagctgtcgtcccttttcttgtccgtacaaattttaatggcgctcgtgttgtgcagcgggcattgatcagtctcgtgcagtgctgcattgtccgtcaggtggacagtcagccgagcatggtcacct

SEQ ID NO: 85741 - DNA, 248 bp, Heterodera glycines
  SCN-specific regions: Sequence locations=27-248
ttttttttttttttttttttttttttacaaagacgaacacttttatcagtggaacaacaaaaaaagcgagaattaatatcactcaatttaactccatccaaagtcacagaattaaactaaaaattgttggggatcggaacacgcacattcaaaagtataggcgggttttgtcccttcatttggaacttttgtttagggacataaataaacatccgtcgcctatttgtaattatcgggagcaggaaaat

SEQ ID NO: 85742 - DNA, 301 bp, Heterodera glycines
  SCN-specific regions: Sequence locations=27-198,225-301
ttttttttttttttttttttttttttgagcataagaattttatttaaattacaaattattctatgggcatataagtctgaaaagctcaagtttttttcatcaaatcaggcctccaacaatttctcaatttccttctcaatggtcttcggttctttggtcggcgcataacgctccaccactttgccgtttttatcgatcaaaaacttggtaaagttccatttgatcgcatcaaagccgaggatgccgccttggaccctcttcagataggcgtaaatcggatgctcattgggcccgttgacgt

SEQ ID NO: 85743 - DNA, 546 bp, Heterodera glycines
  SCN-specific regions: Sequence locations=1-281,304-380,402-546
ggggccggcttcatccccaattggcaacaccttcaacgcgtgttggcactcttcgcattgccttgcatgggtctcattcttttcctcagcgaatcgccccgttttttgatcagtgcacgtaaaatgaaagaggcgaaagaggccatcattcgaatgcataaattcgacgggcgtccgtatgacgaaaaggcgttggacgcactgcttgaaaaggagctacaacaaatgttggaactttccgtcactaaaaagaagtacaattatctgcacctcttctacaacaccaaattcaccatgtacactttgtcagtgtcattcagtcttttcgtggtcactctgatcacttatgcccttgtctacaacatcgagaagatgtcgggcaacattttcctgaatatgatttggatgggcatgttcaaatacacgatgaacttggccattgcctttgccgacctcaaattcaaatggttgggccgtaaattgccccatttgctctccgaagtgctcgtcctcgctgcgcttggtctctttgttacgctgcgtttg

SEQ ID NO: 85744 - DNA, 385 bp, Heterodera glycines
  SCN-specific regions: Sequence locations=23-341,366-385
ttttttttttttttttttttttgcgaaccttttattgaatcaaacataaaattatttattgcaaaacgatattaatagcaatctttgctcattgcctcttctccgtttgaaatgctcactgggcagctgttattcacaattgggataagtgttcccacccttgcactcaaatcctccctctgttggtccttccgccgccactgtttttgccgtgccaattcttcttgtctgcattgaaatgccattttgcgctggtctccacccactctttgaccttcgtccgccgaaggagtgcatttggacaattcagtacacaaaatagctcctttctgtaggcattgttcaaattcctcctcctccaacatttgctctattatgtcatgca

SEQ ID NO: 85745 - DNA, 113 bp, Heterodera glycines
  SCN-specific regions: Sequence locations=27-113
ttttttttttttttttttttttttttgcatgcaccttttctaactttttgtgtaaaaaatctttggatggcaaaacaaaaaaaatggggcaaaaaaagaagcaaagttcgggc

SEQ ID NO: 85746 - DNA, 531 bp, Heterodera glycines
  SCN-specific regions: Sequence locations=1-240,266-288,310-334,361-531
ggggaccaccggggccgatggaatggcgcgattcgcatttgaacctgccttcgagttggccgtccatttccacgcccaattatccattgcatcgtcagcaaatagaccaacagtaacagcaacaacaccaaccagtagcagcagcacccatgcatttggtcaacgagtcggtcaagcagtacattgctcaacagcttgaacaaacacagctgatgacgacaagcaagaagaaacaacaagttgtacaacaacaaaaacaaatggtggagaaaaacaatgatgagggtcccttcctaattcaccagcagaattggatgaccgaacgccgtccggtttcgccttcctcctcctcctccgcattgtctgttcatcagccgctgttcacttttcggcattccgtcggcagttcccaggccgtacgacgagacatacgcattggcacacttttctcagcttttgatcaaaaataaatgatgctatttactatatactactcttgttaacacttccatatgaaaattttatacgaaa

SEQ ID NO: 85747 - DNA, 487 bp, Heterodera glycines
  SCN-specific regions: Sequence locations=26-39,83-193,215-487
tttttttttttttttttttttttttggatattttcaatgttaaaaaaattaatgtaaaaataaaaatattgattataaaaaagacttcaatttgaattcagtgaataatacaaatcgttctaatccatcaatgtttgttttgacaaaacggacgggcttcgccttaccaaaccttaggaatgggtcgctttttcgcgcttcggtaagaatcttctcgaactgagacaaacagccaagcttcgaaagaatttgaacaagttcaagagtgagtaccggttgcaaaacaggggcaaaatgtgagaccaattcctgttgagtgagaccagaacgatggaaaacgacggaaagcactccctcaagcatccatcttaacactttccagtttactcgcccggatgggaacaaccaagggttaggcacaaagccctgaccctcccgggtccgaatgagccacggcctgcaatggccgatgcttacaaatcgcact

SEQ ID NO: 85748 - DNA, 470 bp, Heterodera glycines
  SCN-specific regions: Sequence locations=1-470
ggggattatgacgcccgacatgccgggcttccaactgggcaaggacgagaacaagttgggctggtgcacgcagccaacgcggatccttacttttgaggacgtcaaagtgccggtgaccaaccaagtgggcgcggacgacgaaggctttaccatcgccatggagggactgaacggaggccgtgtgaacatcgccgcgtgttccctgggcgctgctcagatgagcatggacttggccatcgaacacacaaaagtccgtcaagcgtttggcaagtccatctcccaattccaatggacacagttcaaattggccgaaatggccacaaagctggtcacctcgcgacttttgctgcgcgaggcgtgccaccatttgcaggaggacactccgaacgcatcggcgatgagcgccatggccaaaatgtacataactgacgaggcattcacggtggttaaccaagcgctgcaaatgttcg

SEQ ID NO: 85749 - DNA, 282 bp, Heterodera glycines
  SCN-specific regions: Sequence locations=1-62,86-282
ggggttttttttttgttttttttttttgcaaaatgcataatttaataaattgcagagaaaaaatcacaaaacaagaagaaaaacagctcatgccaacacacattaattggggggggcaaaatgaagtcaaatgcagctgaaaagaaaattgggatatcggaacaatcaaagggatttgtgatgctcggaaaaaatcaaatcttcaaaaaatggaaaataagttaaatttttaaagggaaaaaatgcctaaaaaatgattgggacaaaaaacgcgggttaagc

SEQ ID NO: 85750 - DNA, 248 bp, Heterodera glycines
  SCN-specific regions: Sequence locations=32-248
tttttttttttttttttttttttttttttttggcaaaataaatttatcctcgtttttggataggaatgggactgttaaaatctcttacagttcattaaaaattccggaaaaatttaattatctgacaacagtggatgcgaaaatttgttgcctaatctcagggatttgagcaacgtccgttgcgataaaaactttcccggggggaaaatgcctttgaaaatttttcgcctgttctcccaaccatccca

SEQ ID NO: 85751 - DNA, 118 bp, Heterodera glycines
  SCN-specific regions: Sequence locations=31-118
ttttttttttttttttttttttttttttttggggggttagatttatctaaaaagattcaaaacaacaaatagtttaaaaagttgtggaaaaaatttgttttgaaaaacttattaatta

SEQ ID NO: 85752 - DNA, 225 bp, Heterodera glycines
  SCN-specific regions: Sequence locations=27-70,93-225
ttttttttttttttttttttttttttgagtccctatttatcatacaaacaatgttatttatgtacacaatcagagcagacaaacacgacaagtgaattcaaatatgaacaaatacactgcaataatacataagtgcatgagaatatcctccgaatgggacatccgtccaattcttttgaaccgagattccctctcatccgctgttagtggtcgttctgatgccca

SEQ ID NO: 85753 - DNA, 474 bp, Heterodera glycines
  SCN-specific regions: Sequence locations=1-474
ggggccaaatttcgcacactttttgcctattttgaggatgctcggaagttgtacgaaacacgtatgaaaaatgcctcaaatggcaacaatgaggccgattgtcgtataaagaatttggaaaaagagctgaaggtgctgaagcgacagctgagtgcgttgggcgaccttctcgaccagtttttggacacttcgttggccatgcgcgaacggacgctgcgaatggagggcgaattggggccacgattggaacgattggaagcgcaaaatgtgcagctgagggcaaatttggcggcgatggggcaacagacgcacaaaagcggggacaacgaacagaggaatgaagcggagcaaactattgaaacgatacatttcgacgaactttcgatttccgacggagttccgcttcaacaaaatgtccaacagcagccgcaaccaccgaatgtcagcaattgccctgtaaatgatgaggggggc

SEQ ID NO: 85754 - DNA, 352 bp, Heterodera glycines
  SCN-specific regions: Sequence locations=28-55,78-142,172-180,204-352
ttttttttttttttttttcttttttttagcattttaacgtgtttaatacccacttaaataaattaggaatggaatgcggcattttcgttcacaatgacaacagatcaccgatcactttcggtccgtccgatcagtccggtcgccccctttcctccctttctcttcctccgttcagatgccgccttggatgccctggtgcaggacgggcgtcagtccgttgtacaggtgcaccagctgcttcagctcgcgcaagtcgcgcacgcgcagctctccgcgcacattctccggcaaagtgttggcccactcctccaatttgcgcactttgtcctccgagttgagcttcttgtccttc

SEQ ID NO: 85755 - DNA, 225 bp, Heterodera glycines
  SCN-specific regions: Sequence locations=1-225
gggagtattcccgactacaaaaatgcggtaattgttgctaaaacgcccggagtcatgaacaaagcgacgtcatacacacgagagactgagaatgggccttgctgttattcacggtgaggagaagggagtccaggaggatggacggcaaagtgcgccgccatcgccgacggacaaacgaaaaggcgtttcataccaactttttccatcacaagtcgcaaaggagaa

SEQ ID NO: 85756 - DNA, 368 bp, Heterodera glycines
  SCN-specific regions: Sequence locations=28-368
tttttttttttttttttttttttttttgcaaaaataggcattttaatagccgagtcatagcgcaatttccggcaaataaaaaacacggtatgtgaataaactgatgaatacaattatgtccatactgaattctttcccctcatttgtcagtggactctgtccatactgaattgggtgatcgcttcttcccccgtttccgcgtcattgtaaatgtataaaacgacccgaaatttgatgttttctttgtgcaaattgtcaatttgccattctcccaatcgccaatcgttcgtttctcttctgatcagtcgcacttttttcgacgccgtcaaacttttggttggaattggcaattctttttggcggggaaa

SEQ ID NO: 85757 - DNA, 595 bp, Heterodera glycines
  SCN-specific regions: Sequence locations=1-555,589-595
gggagtccatccgacggaaaaagctgagcaaacgcgaccgacaggtcaaccgccaaaacctcccgcaaatacgaaaagtaattcagtttcaattgacaattcggtcactgaaagtcgtattcgtcagccgactgaaagtggtaagcagcaaaatcgcattccatcgccaccaaagtgtcgcccaccgccgcctcccgcacaatcagcagcgaaaaaaggcgaagaaatcacttttggtttggccggctcttctcccaaccgtcttccgtctgggcaattcgtttgcgatgcgtcaaccgctgggacgagttctcagccctctctccccgcaatcgaagcggtcgaagaagatgattacgctgaaattgtcgaaccggaagagcaaaagtcaccgcaaaagaaggagtacatctcgagacttcgcatgccaacaatcttcactcgccgcaacacgcgaaaggacacccaaaagaaatgaacttcttccacagacaacgcactcatcgcatttttgtacgaagaagcgatgaagaattctaacatttaactcatcttacacaaacatatatatatacacacacacacacaatttatc

SEQ ID NO: 85758 - DNA, 280 bp, Heterodera glycines
  SCN-specific regions: Sequence locations=1-16,65-90,112-280
ggggacaaccaaaaacaataaaaatatttttttaaaataaaaaaatgtacaaatttttatttttccctcatttttgtatcttaattaaggcaatttcggggctccattgttggaattcgaacatgattttgctgagtgaaatgccggaaaagggcagtgtcactgtacaccaatgtccgtccgggcatcaatgcgtgacggcaaattgttggcttggagtcggcaattacattgtccaaaaatgcgtgccggaccagccaggggccagaaactattgcaa

SEQ ID NO: 85759 - DNA, 379 bp, Heterodera glycines
  SCN-specific regions: Sequence locations=27-379
ttttttttttttttttttttttttttgacaattatagggcttttactccacatacaatacataacacataatataggaatcacaacaaagaatcatcctagacattacacagtgatacattatctgctcgatcaaaacatcttcttcattttgtccaatacgttcgtcacgggaagcactttgcggatatgcttcacgtacaagttgtgagcgccataagtttgcggaagggccaagtagaacaaaaagacgggcttcaaaggcacgtacagcagcagaaggcccttgatagagccaaagagatagtcgaactggcaaaactcggcgaacacgcaccaataaacgagccactgggggtattccgatgtgttttgagtgt

SEQ ID NO: 85760 - DNA, 470 bp, Heterodera glycines
  SCN-specific regions: Sequence locations=22-409,431-470
tttttttttttttttttttttcatttcgggcggactgtccgcacttcgcccctctccgctggcatttccgtttttcaacagttcgaacatttgcgactttcgcttcgcactttccaacttgcgcttctgctcctcctgtttgcgctgcaactccaacaattccttggggatcaaatttgtttcgagagttgcctgaatgcatcggttgtgaattttgtcgctgaataatgtgcaaaggtcgagcgctaaagcgacgccggaaagacggcgggcagcgaattcttcgctgactgcgtttcccccgttcagataaatgtgcttcagtctctccaatgtcgtgctcagcgtgttcagtaaatcgtccagcagacccattgaacgcatttgggaccagaaaaggacggaattctcttccatgactttccgcacatttgcgcctcctcccccgccgtttccctcatgtttcgtcg

SEQ ID NO: 85761 - DNA, 611 bp, Heterodera glycines
  misc_feature (566)..(566): n is a, c, g, or t
  SCN-specific regions: Sequence locations=1-280,302-611
ggggagaaaaataaataatttagagaaaaaaatgcttattaaaccattgtttactttctcaattttgttggcgttttttggccaaatattttgcgacattttgggccgtgaacaaagtgccggtgccaaaggtttactgacatgtgagggaaaaccggcaaaaaaatgtgaaggtgaaactgtacgatgatgaccgagggattgatgcggacgatttaatgggagagacgaaaaccaacgacaaaggatattttgaagtcactggttacactagcgaatattcaacaattgacccaaaaattaatatttatcataattgtgctgatggctataagccatgcgaccgcaaattcaccattaaaatcaaggacggttatgtgtcaagtggcaaaaacccgtccaaattgtacgacattgggcgcattgaactcgagggcggattttcgggcgaatcacgcgattgcctgaactgaaagcatcaaattcatgctttaacatcggataaaaaaggctctggcccaacgatttttaaaatttgaaaacattcttttggttattaatataantttatatgttgttttacaattaaaatcaatgatgggctcaaaaaa

SEQ ID NO: 85762 - DNA, 508 bp, Heterodera glycines
  SCN-specific regions: Sequence locations=1-247,278-508
gggggacgtaacgccactgtcacttggaattgaaacgcttggtggtgtgttcaccaaactgattacgcgtaatacgaccattcctacgaagaagagccaagtcttctcaacggctgctgacgggcagactcaagtggagatcaaagttttccaaggcgaacgcgacatggcattggacaacaaaatgctgggccagttttctctcgttggtattccgcctgcccctcgaggtgttccacaaattgaggtcgcttttgacattgatgccaacggaattgtgaatgtgtcggcacgagaccgtggaactggcaaagaacagcaaattattatccaatcgtccgggggactcaataaagaccaaatcgaaaacatggtacgtgaagcggaaagacacgcagcagccgacgcagaaaagaaagagacgatcgaggcaattaaccatgcggagtcggtgctgcacgacacggagtcaaagatcacggaatacgcggaacatctcaacgcagac

SEQ ID NO: 85763 - DNA, 481 bp, Heterodera glycines
  SCN-specific regions: Sequence locations=1-287,356-481
ggatttctggttccgtcgacaatggcaccgcggatgctgctgctattcagcatcggtttagtgatggcatttccgtctcgtcaatgccccgtgctctgatcaatcgtcaaccgccggtgatcagtgcttcgacgaaaaaaacgggccgcaaacgcatgtcagcttcgtcgagtgcctttgttcccgaagacgaggaagacgcaccggccgcctatcgcttgccatcgaatgcgatgggtgacgcacggggacagaagcggaaaaggtccgtctcttcatccagcagttcttcctccgtctcctcctccgattcttcttcttcctccggctcttccagctcgtcatccgcttcatcacatactccactgaaaaacgcaaaaccaaatgcatcagaacatccatcaaaaaggacgccgaatgagagggagaaaagcaacgacatgagcggaagtggtggcacgaccattagctgctcaactgt

SEQ ID NO: 85764 - DNA, 376 bp, Heterodera glycines
  SCN-specific regions: Sequence locations=28-162,184-270,292-314,346 -376
tttttttttttttttttttttttttttgaaagcgattaccttttattatacaaatgggggcaatccgaaaaatgagtccgcttccctttttcagtggggggggggcttcccctccttccgctttctgctggtctcccgactcgacgacctgcgatgtttgtgttttttggccgccttgagcttttcctccttcttttgcttccttcgctgttttttggccttctcgatatcggagccatcgctcacttcagtcttcatgatttttttcattaattttcttccttttttctcatccagccctttcaaaaaagcctcaaaagttttttcctctcctcctccaaccattgctgacattttttttatgtgttcgtccgct

SEQ ID NO: 85765 - DNA, 208 bp, Heterodera glycines
  SCN-specific regions: Sequence locations=1-55,124-208
gggtatttcgtgttggaacttgtgcacatcgtttgggatttcggcggaagattgttcgtccttcgctttctcctcccctttctgctcgccttcggctcccttctcttccttttcttccttcccggtgcgcacagttcgtatgtgaggcattcccagaagaaacttctttggtgtttctattggctcggcttgggcgttctctcctcaa

SEQ ID NO: 85766 - DNA, 379 bp, Heterodera glycines
  SCN-specific regions: Sequence locations=27-30,54-157,180-379
ttttttttttttttttttttttttttggtcttgtacaattttattacaacaaaaatatgaatttgggataagcccgttcatccaatataactcaatcaatttgctgttcctctatagctttaacatcattcaaattatttggcaactgctgtacattctcttcatcttctgcttcctccgttagccctcttgaacttttgttgactgtcaaccgaagcgaattgcgcaccctccccttgaaactgttgtttaatcctctgacgacgtaaatggaaatattttcttccctcgttaaacacaaacaccgaagaagtcaaaagtgttagaaaagccaaatcttttatagtgagtgcctcggtttgggatattcgctgaagtg

SEQ ID NO: 85767 - DNA, 282 bp, Heterodera glycines
  SCN-specific regions: Sequence locations=26-62,84-112,134-282
tttttttttttttttttttttttttgggccgctcgggtttgacggcataaagttgttggcgttgtttttgttgcatgtttgtacttccaatttcatcactcttaatggcaattcatcatcatcatcacgctccggtattgatgtggggggggtggtgaacaacaacaactcgtcgtacaattgacccgaatcccactcagcggccgatgaaacctccgtttggtaggcgttcacgtaattcatacccttgcgcaccacatttttgttacacacaacagcagc

SEQ ID NO: 85768 - DNA, 285 bp, Heterodera glycines
  SCN-specific regions: Sequence locations=28-285
tttttttttttttttttttttttttttgcatcttcatcatttataccgtatataatttaagcatccattttggcttataacagcagcatcaattatgaaagtgtttaaaagcatcccgtgagtgcagttttatggacatttaaaagggtccgggcagtcagtgatcattctctcctccgatcagtccgtgtcttcgctgtccctccctccgtcctcctcattctccgaactgctctcgctcaactgcaaatcttccgccaaaatgcttttccgtacgaatgacga

SEQ ID NO: 85769 - DNA, 366 bp, Heterodera glycines
  SCN-specific regions: Sequence locations=53-366
tttttttttttttttttttttttttataaatttatttatttttttgttttttaaacagttcaacccataaataatggtccgcaaatgtcggctaaccgatcaaacagtcaaatcactgcgtgcggtcgattattctcttgccactgacccctgggcttttcctcgggtttttctcctcgctgtgccgctttttgttctggtggctcggtttgcgtttccatcgttcgcctccccccaaaagtgccgtccttgtcttgcgggtgttccggcaccgtctgttttggtcgaaccttctcatagtccacccattgcatgttccacccgcccttgctgatgtccaaatcgatcgaaatgccgcgcaattct

SEQ ID NO: 85770 - DNA, 224 bp, Heterodera glycines
  SCN-specific regions: Sequence locations=29-224
ttttttttttttttttttttttttttttagggggctcagctttaatcctttaaaattaaaaaaaaaagaaagggaaaagtgaaaagtgatcacaagacaaacagtcaaatttgaaaattaagccaattttaacatttgttcaaatttatttgcccgctcccgaaaatgtgggcgttttttgacactgtgaataatcgacgggagaaattaaattgaacgctttt

SEQ ID NO: 85771 - DNA, 610 bp, Heterodera glycines
  SCN-specific regions: Sequence locations=1-610
ggggccgtgtttccgcactttggtcaagcaacggcaccggcccattatcagtaattctccgaaaaaaagtattgccagctcggccaccgtttttggctccgatgcggtggtttcacgtgaaggacgaagcactcgtaataactctgctcgcttcgtgttgtccgcaaaattcgaccaggaaatgctgcgggcgtacagagcgtctggcatcagcgaacgaatgctgttccagatgccctacttgcgcagcaacgacatggcccagctggtggtccagtatcgggagatgaagcgcgagtgcaagagcaacgtgtacttggcacggtccaaaatccaaggcatgggactgtacgcgaagagggacctggacatgaaccaaatgatcatcgagtacattggcgaactgatccgcaatgaaatatgcgaaattcgacagagtcgctacattgagcagaatcggggcgagtacatgttccgcatcgattgcgattgggtggttgacgcgacaatggccggtggattggcacggtacataaaccacagctgtgacccgaattgtggcaccaaaatactgccggtgaacgacgaaaaaaaagctcacttacgacta

SEQ ID NO: 85772 - DNA, 610 bp, Heterodera glycines
  SCN-specific regions: Sequence locations=1-486,508-610
gggagccgcagcatcgttctgcttcatcggtaatcgtcacgcaccatgaggaagttcgcctacttcaaactgtgccaagccgtgctcacttctgtttttctgtggcaaattctctcaacgcaccaattctgtggcgagtttggcgagcctacggccttcttcaactctgcagtctcctccagccattgcgaacagttcacgctcatcggaatggactccaccactggcgaatacggggccatgcccgacaagcagaagtggcacatgcaactcatggcgagcagcggcagtggccaaccaattgatgaacagcaacagaatcacatggacgagttttcgtcaaaattgccgactgttggccgtcactgtattccgattgcgttttctctcgtcaagccctgggttcgcgacaacaaaagtcatctgcagaaggtcgctgatttgtttgccattcaattgctctgcggattgctgtctctgtttgtcattgccatgcacgttttggaccaaccgcgctcttggggatatgagagcatcgactacgaacggaccactttttgtgctgtgctctggtgctgtcctgccctggtttcatctgttttgctgctcc

SEQ ID NO: 85773 - DNA, 364 bp, Heterodera glycines
  SCN-specific regions: Sequence locations=26-34,57-69,150-364
tttttttttttttttttttttttttgctggggttcatttattaaattaattggttaataaatatttgcacttttctttttcttttcgcctttccttcctctgcgtcttttgcccttccgtctcgtttcttttcccctctcatcctctctggtctggcgttggaccccctgtttcttaatcctccttttgctgcctctcttcccttcgtgccgttgtccgatacttcaacagtccgctgcctttccccaccaaacagtccaatttgacgttcatccacagaaattggagcaaaaagtcgtagtttgacttgcgcttgtacgcccccgggtatttttccataattttgcgaatgcttttggttgcc

SEQ ID NO: 85774 - DNA, 265 bp, Heterodera glycines
  SCN-specific regions: Sequence locations=29-265
ttttttttttttttttttttttttttttaaaccaattcttttccaaaaaataaataaattgaaaacaaacaaaataaaaaacaacaaaacataggcaatgagtttgttgttgatactacagatcgtttggttgaaaaataaattaaaaaaggaaaactttttttttggtaaattaataatcgaaagaatgatagtgtagggattccgttaggtcatttgtgtgcttccttccgtcctcattaattcaaaattgctgctgctactg

SEQ ID NO: 85775 - DNA, 391 bp, Heterodera glycines
  SCN-specific regions: Sequence locations=1-29,60-391
gggcaagtttgagactttattaattaaccaatcactgatttttgtgaaaatgttgcccatttttcggagtggaaacaccgacggcttctctctcatttcagcgccattccttcttggcctcctctcagctgcgcttctgctggtggcacaaacagctgctctccaaacggacccctccgcgtcggacattgattacgaaatcgttttgccggttgcgtcgttgccgtcgctggactcgccccgggggacgacgttaaattggcaggacgaatgggtgcgacgcttttcgccacggcttgttgttgtgcaaaacggcggatggaagcacaggacattgccccgaaatgacgacgacgcccaccaacggattgtgctgcacaaaaagtggtcc

SEQ ID NO: 85776 - DNA, 153 bp, Heterodera glycines
  SCN-specific regions: Sequence locations=29-153
ttttttttttttttttttttttttttttgggtattattgtttttttttgtctcccagtaattatgtttaaaccaaaaaaaaaatacaatgtgaaaattaatggggtgattgatgggggggttaaaatcatgatcatgatcaaaagttgggtgg

SEQ ID NO: 85777 - DNA, 497 bp, Heterodera glycines
  SCN-specific regions: Sequence locations=1-234,256-497
gggtacgccgccgagagtcgtcagccggagattgttgaagatctgatgcagtacttcctatcacaaggcttgaaggattgcttctccactctgctgtacaaatgctatgaatttctgcggcccgacgttgtgcttgagctcgcctggcggaacaatcttgttgattacgccatgccgttcatgatacagaccgtacgcgactatggttctcggcttgatcgtctggaaagggctgagatggaacgcaaggaggaggtcaaagagcagcaacagcgaagcggaagtctgattgaaccccaactgatgctgaccgcgtactccaccgccgcgacgactccaaatgcgaccgcgtatcccacgggaggcattggcacgattccgccggcacaaggctttccgtcatatcccttctacaaataatgttgtttcgttgtgatggtgtgacttatgatatgaccatctttgatggattcatttcttacttttaatatgtaata

SEQ ID NO: 85778 - DNA, 402 bp, Heterodera glycines
  SCN-specific regions: Sequence locations=26-59,82-402
tttttttttttttttgtttttttttgcaaatgcatttttatacgcatttatcaaaaatttggcatcaattttgattgcaaattcgggcactcaatctctctctcgctgcttcattcatcaaacaacgtcgccctattcgtacttcttcaacgcctcaattcgctcaagaattggcggatgcgaatggttacaccacgagtagagcacgtcgtcaatgggcagtgacagattgtctttacacatttttttcagtccgctgcacagttgcgatgcatggcccagctgtgcggagaagcggtcggccgaaaactcgcactttcgcgtgatcacattcatcaaaacggacaaaagttcggtgtagggggccatgacaaatcggccgatgatcaacagtccgatcag

SEQ ID NO: 85779 - DNA, 416 bp, Heterodera glycines
  SCN-specific regions: Sequence locations=28-416
tttttttctttttttttttttttttttctaacagataagcatttactcagacaaagaagccaaataacatatcaatttttttgatttttccttactcatcaatttattcatccaatccatccacttcatttatcctactgcgcctccttctgacccgtggcctggtaaagcactgttgctgcttcgtccacgcgcaaacgcaacatttcctcgtctccaagcaacaacacaatctcggcattttccatctcgagaagcattcccgtgattttgccgattttctcgacatcaccatcccggaagcaacgcgcaaccatcgcgtacagacgctcaccaagcatttgcttttgtgcggttatgttagcctcggtaagcagctgtgtgttcaacggctcctggtgtgttgaagaagtgat

SEQ ID NO: 85780 - DNA, 410 bp, Heterodera glycines
  SCN-specific regions: Sequence locations=26-410
tttttttttttttttttttttttttccgtaagaatcatttatgaactcaataggtaagtgcatttataaaataacgaataagtgtttgtcatgtgatcaatagccgggcagagcaggtccgaggatatttctctcacttttcggatcggggaaataagccttcgggtttgcccagctgacaatctttcccgttgtgtacatcactctgccggggtggtaagggtcgaccagctgagtcaaaagatcagccttttctcgggacatgcacggggtccctggacttatgaaatcatcgggtgccaaattcaatttgtcacagtgacggtacatcaaatgcacgcgcatatcgctgcagaaaaaagcgccggcgtcacaaagagagcagcgcattcgcatcactcgaatgtgag

SEQ ID NO: 85781 - DNA, 291 bp, Heterodera glycines
  SCN-specific regions: Sequence locations=27-291
ttttttttttttttttttttttttttgctttaaaagtttaaaccctaattataagaaagcaaacaaaaaacgaaaattaaccctgaagacaaaaaaaagacctaatggcattaaaatggacaaaagttaaatacaataaaaagggaaattttcaaatataaaaattcacatgatcaaaaaaggggcttcaaatggacttacgatctcacagtcggtttggaggaggcaaaccgagggcatcatcattaaagcgattcaaatgggcgtgctgagccaaccattcgtcgactg

SEQ ID NO: 85782 - DNA, 377 bp, Heterodera glycines
  SCN-specific regions: Sequence locations=27-75,97-377
tttttcttttttttttttttttttttgacatcacatgactaatgaaatgcattaatcatttgttgtgtcatatttcctgcttttcctcattttccttcatccatttttccttcaacaattggcatttttcgcccgatcccaacatcatatgggcagaacaaaaccgcactggcacacggtcgttgcacatgaattggcagtagatgatcccgtcatctcgggaacagttgcccggctcaagcggacagtcgcaaattgcgcaaacgaagcaacgcttgtgcatcatcaacttttccacttgaattttatcctcaaataagtcaatccaactccgacagatctcgcagaatttcttcgttggccccgttgcaaaatcc

SEQ ID NO: 85783 - DNA, 463 bp, Heterodera glycines
  SCN-specific regions: Sequence locations=1-294,324-463
gggagcgcgactcgggcggcggaggaacaacggcttcatcagctgggggaggagcagcgaatgcaaaggcaaccggcgccgagcagcaacaactgccccatgcccaacaccctttggacgcagtggccaccgacgacgtgttaaggtacgtgttggagtcgtacaatgcgttgagttggctttcacttgacccggtgaccggcgcgcgtcgttcctgtctgcccgttcacatgcaggccatccaacggctgaacttggcggtgaacacattctgggggagcgctgaacaaaatcaacaacaccaacagcagcagcaacagccgaaatgatcgaataattaattatcaaatcatcgaagaaaagacgcagcattcgcatcgaaaattggcattatcacatcttttacacatttctccatttttgttgttcacgtgtccctcggttcataaacataaaaccttct

SEQ ID NO: 85784 - DNA, 268 bp, Heterodera glycines
  misc_feature (120)..(120): n is a, c, g, or t
  SCN-specific regions: Sequence locations=1-268
tcggaaatcggcatgacaaaagttcttcgaaaaagacaaaaattctattcagcgatttcattgtgtgttttaagagcggaatgagctccggaacgacaaagttataccctccgggccttnctggctgcacgtgaatttgaaaatcaccgattgcgaaaccgatattagcagcagaagttggcacgagcagctgataacaaagcgtcttcaatgaatcatcgtcggagtttggaattgtctcataaaatctaagtttaagtgaagaaag

SEQ ID NO: 85785 - DNA, 269 bp, Heterodera glycines
  SCN-specific regions: Sequence locations=29-32,63-128,150-202,248-269
ttttttttttttttttttttttttttttgagcataaaaattttatttaaattacaaattattctatgggcatataaatctgaaaagctcaagtttttttcatcaaatcaggcctccaacaatttctcaatttccttctcaatgttcttcggttctttgggcggcgcataacgctccaccactttgccgtttttatcgatcaaaaacctggtaaagttccatttgatcgcatcaaagcccaggatgcccccttggaccctcttcaaatag

SEQ ID NO: 85786 - DNA, 538 bp, Heterodera glycines
  SCN-specific regions: Sequence locations=1-538
ggggacacgtagttgtccaataagaaattgaaaacggaaaagtaattttttctaattaaaatggacaccggcgacaactttttgacgactcttaaaattctaaccatcggcgaaagtggggtcgggaaatccagcctaatcgcgcgatttgtagatgataaatttgacccggacatggcagccaccatcggagttgactttcgcgttcgttcgatttcaattgatgatcgaattgtgaagttggccatttggatcacggcgggccaagaacgctttcggacgcttacaccgagttattaccgcggaggccaaggagtgattttggtgtacgatgtgtccaatcggccgtctttcgagaatctcgaccattggctgttggaggtggacacttactgcaccaaaagtgacaccgtcaaaatgttggtcggcaacaaaatcgacgcggagcgaagaatggtctcgcgggaggagggccttcaatctgcgaagaaacaccgaatgcttttcatcgaggcgagcgcaaagacgcgcgaaggag

SEQ ID NO: 85787 - DNA, 375 bp, Heterodera glycines
  SCN-specific regions: Sequence locations=1-313,341-375
gggcacctgccgccaagcaacactcagtgcctccactaccgccaaatccgccaaaacgcaacactccgccgtccaagtcgagcactccggtcaaagagatgggccgcgccagtgcaaatccgttcgacatggaggacatgctgatcgccccattggaggacggtggtgagacggacttgctctaccccgacatggcctcggcagcggggtccgaccatctgcacgtggttgcaccaccggccgacctgaacgatttgggcgagtacccaccgcttgcttgacacgatcttttcatttgataacacttttatcacgctgctttctttgtgtgtttatttcgcatgcaaaacgtagtttattaataattgcttccac

SEQ ID NO: 85788 - DNA, 520 bp, Heterodera glycines
  misc_feature (517)..(517): n is a, c, g, or t
  SCN-specific regions: Sequence locations=1-520
gggatctcgcctttggtgacaatgcgctcactctgatcaattacattgcgattagttattggcttgccattggcttggccattgcctcgttgttttatttccgtatgaaaatgccaaacgcaccgaggccaatcaaagtcaatttgattttccccgctatctttctgctcggctgtgtcgctttggtggttattccactcgttggcaagccaaaagacacggcaattggaattgcgattatgctcacttcggtgcccgtttacctcgttttcatttgttggaaggaaaggccttcctttttcaacaaagcgtccgcgtccattaccatcttttgccagaagcttttcttagtttcgaatgaagcagaaaaatagacttacaaatgacagtttttatatttgtgattagtgactgaattttgcattttaattagagagtttttcaggtggggtcactaattacaatgttatttattactttaattgttgactttcgtattcttttcttttactttttnttt

SEQ ID NO: 85789 - DNA, 548 bp, Heterodera glycines
  SCN-specific regions: Sequence locations=1-548
ggggggttgtcgggttcaggaaaaacgacactgttcaccaagttgataaactcgaagaattgttgggactcattcatttcgctgaaggaaaatcagttcgacagttacgcgacggacaatggccaaacgctcactttgctcgattttcccgggtccgattcattcaagaaaactttgtgtcgcaagcggctgaacgagaaacggaattctcttaagggcgtcgttttcgtcttggacagtgcgacgttcagcaaaaaagatgccgccgaattgctgtacgatgtgctgtttgagtcgggcaatgccgtcccggttctgatcgcatgcaacaaacaggacattggacacgccaaatcgcactctctcatcaaaaaggcattggaaaatgagttcggcttgatcaatgtttcgcgtgaagctgccctcagttcgatcagcggagaatccgaaaagcgaattttgacaaaaagcgggagggaattcgcctggtccgaattgaagaacaagaaaattgatttttttggagtgcaccacgcgaaaagatgaga

SEQ ID NO: 85790 - DNA, 126 bp, Heterodera glycines
  SCN-specific regions: Sequence locations=25-126
ttttttttttttttttttttttttgggcttacctaacccaaatcctgcaaaatttcctgcgcattgtaaattgggatgagtgaacttgcaccggcagggataattattattggaacccgtgacaca

SEQ ID NO: 85791 - DNA, 335 bp, Heterodera glycines
  SCN-specific regions: Sequence locations=1-156,180-188,210-335
gggggaggtcgacaagttccaatcgtcgcaaagtttgaccgggaaaaggacgcacaaattcacactttgggtcgacaaatacgcgccgagcacctttctggatttgttgaccaaagatgagacaaatcgaatcgtgctgctatggctccgtctttgggatgaatgtgtttttgagaaaagaggaggcaaaaaatgggaggggaaccaccgacgcatttcccagcggaacaatgccaatgcgacgtctctgtgggacaatttggaggagagggaccgaacacttcgaaatgtaaccgtcaaagggcactgacaaccgaatgccaaaacaaaaaatt

SEQ ID NO: 85792 - DNA, 558 bp, Heterodera glycines
  misc_feature (478)..(478): n is a, c, g, or t
  SCN-specific regions: Sequence locations=1-61,83-102,124-558
gggggtgtccacgccattcattatacctatattctccttaacgaaacacctcaacaacttttggaaacccaaacattcgttcattcattcatcgttcataatggccagacccaggggcagtggaagagacccattcaaagcacgcagtgccagggcaagacgtcgcgcgggcaacaaaagaaaggcggccgcagggactgctgcaaacgtgcaagctgccaacaggcgccccatttgtctgatctgcttgaagaaaatgacccaagttcgtcaggtgcgcaccatctgtgaccacgtgttccactacgtctgcttccaccgttggctcaaatatcgtctgttttgccccgtctgtctgctcaactttcgcacggaattgtatcattcgggaaacgccgtgtttgagggcgcgtacgacgatggacacgttgtgctcatacctgatggtgaacaaagcaacagtggataagtgatcggnactcatctccaattgtgatcggacaaaagcgatatctaatcttgtattgtacataaataggttattcggacaataaaact

SEQ ID NO: 85793 - DNA, 469 bp, Heterodera glycines
  SCN-specific regions: Sequence locations=1-4,29-469
ggggactcaactttattatataggatttaagaaattttcttcaccttcaattaaattttctgttttgacaattcgttaaatggcgagccctggcgatgccttacttgccctacaagggaaacgaacaacggggcagtcaattaggacacagaatgtaatgactgcagttgcaattgccaatgttgttaaatcttctttggggcccgttggattggacaaaatgcttgtggatgatgtcggcgatgttacggtgactaatgatggcgcgactattttgaaattactggaagttgaacatcccgcaggaaaaatactcgttgatcttgctcaactccaagatgaagaggttggcgatggaacaaccacagtcgtcattattgccgctgaattgctaaaagcagctgatgaattggtccggaagaagatccacccaacgaacatcattaacggatatcgcttggcctgcaaa

SEQ ID NO: 85794 - DNA, 519 bp, Heterodera glycines
  SCN-specific regions: Sequence locations=1-519
ggggatggggcaaattcattccttacgcgttttggctggtctattttggattatcaggcgaccgaactgttcgatttcgccctgcaattagccaacccaaacagtcccactttgttgtccaaatcccattattatgcaaaggttcgtcttcaatacgcgcaattgttggatgaattgggcggattcaaacatgcggttgagctctatcgactcgagaattccaactattcgaagacaccgtcgcctcctccactcgttccttctgttcacaaaaccaaattagctcatctcaaaaggcaggaccatgagccaacacctgccgttgctcctgctccacctacttttctaccagtgtagttgcagtcggcatccaaagaggaccatgagccaaccccttttgccgttgctcctgcttcacatactttccaaccagtgcagttgcagtcggcctccaaaccggaccatgagccaacccctttttccgttgctcctgcttcacatactttccaaccagcgcag

SEQ ID NO: 85795 - DNA, 506 bp, Heterodera glycines
  SCN-specific regions: Sequence locations=1-63,85-506
ggggactagtgatagtccaattaagcgaacaaacgaccaacgtcctaatttctgaaaccaccattctccaaatggctgctccctccattcgtctcatcaccacgtccaaggcgcctcctgcgacggtcacagccaggcagtgctcctcaacaaccagacgctgtacatcagtggccagaccgggatcgcggcggggtcgacgaatgtggtgccgggtggagcgcgagccgaggcgaaacaagcgatgaccaacattggcgagattctgacgtacgccggctcgtccttcaagcacgtgatcaactgcaacatcatggtggccgacatgagcgacttccaggcggtcaacgagacgatcaagaacttcttcaccgaggacacgtaccctgcgcgcagcttcttccaagtggtcaagttaccgaagagcgcgtacgtcatgatcgacgtggtggcgatcgttcagggccagagctgagctgaagaacgggagaacgagcgcggcagac

SEQ ID NO: 85796 - DNA, 162 bp, Heterodera glycines
  misc_feature (21)..(21): n is a, c, g, or t
  SCN-specific regions: Sequence locations=93-162
ttttttttttttttttttttntttttttattcttttttttttttttttttttttttttttttttttttttttttttttttttttttttttttaaacaaaatttttttaaatgggaaatttttccttgggcccaaaaaaaccccaaaagtttttaaaaaaaaa

SEQ ID NO: 85797 - DNA, 380 bp, Heterodera glycines
  SCN-specific regions: Sequence locations=1-175,199-380
ttttttttttttttttttgggtggatttagccaatgcggcggcacaatcggatgcgggtcgggcaatcccaactcccgcgccttcagttgctcttgcattccttcaggccaaatgtccgggggcggaatgacttttgatcgctttggctcctcttttttcgtccgcaattgctcgggtttgtttttaaacaaatcaatcgtcgctttttgtccccaaatattattttgttgttgttgggctgtggaggaagaagcaccgctgagaattgggaactgttcacgggaatgaagcgacaattgggaagcgcccgttgaggccgaaagcaagcggaccttttgttgggatggaggcggcggggcccacccgggcggagccccgt

SEQ ID NO: 85798 - DNA, 372 bp, Heterodera glycines
  SCN-specific regions: Sequence locations=25-372
ttttttttttttttttttttttttcgttaaccaattttatcattgaattcatcaaaaacaaaagaaattgaaaaagaaattgatgatccattaatcaaaagacacaacatatatgcacataaacactggttcatcggcgccggccaaaactgggcggtggcggcggcggacctcccattgggcccatcatcaaaatggcacgttgttcctgcggcaatgtcttgacatactcctgcagttccttttgcttgacggcccatgctttgttggtttggcgattgatctgcttcacacggttcttcacatcgtcggggagacgttcaaagccgggcggggccgggatttggtccaaaacctctcccggcaaggagc

SEQ ID NO: 85799 - DNA, 619 bp, Heterodera glycines
  SCN-specific regions: Sequence locations=1-439,581-619
ggggtttggccaaaattgcgaaataccaaacgaagcgaaaggcattggacaaagcagtcggcacaaacttttttgttggcattcaagacgaactgttggcattcagacgggccaagcagaaacagcgaattgatctgaccgcgttggaaattgcgtccgaatttgttgcccgctgtccgccggaggaacaaaacgctgtccaatcgtcgtcatcgtccgccgttttccctttcgccgctgtccatcgcatttcgaccgatcgttgtgcggcgatggatgactatgaacaccaattgggcacctttgacgaccaccaaaatgatgagggaagcgatgatggcaaattgttttcaaccgctgtgtcacgcatttggcacaagacattggcacggtggcacgaagcgagggatgcgcgggcacaaatcgaattgggactgatgaaggaggacaatgaggacgaagcccagcagcagggaggagaagcacagggaaaagcggaggacgacgacgaagatgatgaagaggaggagaaggatgaggaggaagaaagtgatgaaaatgacaaagatgatgatgaggatggactgctcggggaatatggacgactttcgccctcctg

SEQ ID NO: 85800 - DNA, 175 bp, Heterodera glycines
  SCN-specific regions: Sequence locations=1-175
aaaatggcaggccgggtcaggtgggacacctcgctgtggacaggtgtgcccaaccatcaaatacggttcttcgtcgccaatttcgctctcacctccgcgcacttcaaagcgcccgtcgggcgccgatcgttcttcgcccaacaaatcatccggatcaagcgtgtcagcctccatc

SEQ ID NO: 85801 - DNA, 363 bp, Heterodera glycines
  SCN-specific regions: Sequence locations=26-38,69-86,108-363
tttttttttttttttttttttttttccacttttctgccatttatttttattttaatgttattaattttgataacgatgcgggaaataaatgtacaattttattgtttgttgtgtcccaattgtattgcatttgctgtctttttcactttcttctgctgttaagcgatgcttcgcatttgctccgattttcccaaataatgcgccttcagaagaaaagcgaactcgtccacttcagcttctttggtggcaaatgtggtcaccaaacggaacagtcccttctccgtgtgcagcttcaactcgcgttactctccgtccggaacattccactcataaaaatgcgaaatttccccacttttgcgcaat

SEQ ID NO: 85802 - DNA, 391 bp, Heterodera glycines
  SCN-specific regions: Sequence locations=26-105,134-220,242-300,382 -391
tttttttttttttttttttttttttctgttctgcttcgtctcctttccatttcccatttctctccatccttttttgttctctgcactgtactgcttcgtcttctcgtctccttttccattttccttgtgctgtttcatttcaaaaaattgtttaattttcttccaaacgtccatcccaaattgctcttcgccagtgaactgctccatcttctccttcggtttttctgttttgttaatcattttttcagtttgcttttccccctgttgctccttcgtctccttttgcgccgtttttacctcccctttctctctctctctggctacttctcttccgtactttttccattggctctcctccctctctctgtctgcttctctcccgtactttttc

SEQ ID NO: 85803 - DNA, 330 bp, Heterodera glycines
  SCN-specific regions: Sequence locations=26-214,236-330
tttttttttttttttttttttttttgctgttgtatgttgtttatccacattctctaacaaaaaaaacacattttcatgaaaaccctaactgtgtcgctccaccataattttctacatcgtcgtggggggggaagcgcctaaattagccgacaaatgaaaaaaatcgtgtgcgtgccgtgccattcatttcattatccatcggtcagtgggcgccgctcaatgcttcttcccctcgccgccgctgtcccccttctttttgtgcgcatcgccgggccacggggcttcgtagccaacgccaggcacccaattagtggccgggttgtgcaataa

SEQ ID NO: 85804 - DNA, 402 bp, Heterodera glycines
  SCN-specific regions: Sequence locations=1-1,26-359,381-402
cttttttttttttttttttttttttgagaaaaacaacatatttgtgccacaaaaccttaccaagtccaatgttgcattcaacaaacaaatacaattcgaaaacgaattaatgatcgcactattacaatacatctcggaattagaacaaaattatagcctacaatttgacaatctttcttcctattgctcgccttccccgggctttgccttcgcttcctccgcgtccaaacgcgcgttaatcgcttttctgttacggtagctgcccggaagtttccaagcggagtgtcccagcacatcagtggaatagccaacgtaacagcaaaacatgaaaaagacgaagctcatcgccaaatacgtgatgaatttctgcttcagttccttatagaccttcttataaggttg

SEQ ID NO: 85805 - DNA, 665 bp, Heterodera glycines
  misc_feature (657)..(657): n is a, c, g, or t
  SCN-specific regions: Sequence locations=1-162,188-665
ccacgcgttgggagctctccatatggtcgacctgcaggcggccgcgaattcactagtgattactcctttcggcttcagcagttctttatgcaacacgccatttctcagctccacctgaggcaactccaaaaatcccatgccaagttggacttcgtagagacgtttcctttctggtttacgatcttccaaaatgtgctcaaagatgggctcatccggccttttagatgatccagtgagcgcaagccaaaattcttccggcgtttttagctggttacaagactcaatctcggcttttcccttcttatcccttttgttcattttcaccgcgaaaagtcgcactttattggcaatcgttaccttcgaccgagctccactccaaatccaaataactttgtcacaatcaagcaaaaagacgaagcgtgggtccaacgactcggcattcaacggaaccgcctccatttcgacggacggtccgttgacaaatgctcgatagagtttgtttgagaaagcgactttttccacagcataaaagcccgattgagtgcgggccccgtcatagtaaacgatttcctcactgaacatctccagaaactcgtccgtttcctcattcatttcttcacgaattgtccgacaagatgctcccaaatgatttcgcanattgactg

SEQ ID NO: 85806 - DNA, 492 bp, Heterodera glycines
  SCN-specific regions: Sequence locations=1-51,73-206,228-322,345-492
ggggatccaaatcaacgcggcacagtaataaaatattaaaagatccgaaaaaatgccaaacattttcaaaatccttctgattgtgcttttggccgtcgtctcgttccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggag

SEQ ID NO: 85807 - DNA, 618 bp, Heterodera glycines
  SCN-specific regions: Sequence locations=1-340,362-618
ggggttccaatcgcagtcccaaagtgcgctcgccgccggagtgtccggcgaagctttacaaaacattcgaacggtcaaagtgttcgccatggaagaggcagaaacggaactctatcgtaaagaggtgcaaacggcgtgttccctcggcgaacggctcggcgttggcatcggtctcttccaggctttgagcaatttcttcctcaatggaattgtattgggtgttttatatggcgggggacaactcgtggctgatcagcaactctccgcgggcgatttgatgtcctttatggccactgctcagataatccaacgttcggtgtcccaattttcgttaattttcggaaatggaataaaggcttggacttcttgcgcccgaattctccaattcttgcgcattgatccgaattgccataatcacttgaacggtaatgaacaaatcccaaggcattcgctgatcggtgacattcatctgcacaacatttgtttttcttacccaactcgtcctgaaaaggccgtgctcaacggaatcgatttgcatttcgccggtggacagacaacggccatttgtggcccgtcgggtgcagggaaaagtacaattgccgcattggtcgagcgttt

SEQ ID NO: 85808 - DNA, 545 bp, Heterodera glycines
  SCN-specific regions: Sequence locations=1-545
gggaagccaaccaagtcgttcaaaaatgctgaagtgactgatcgtattgggaagtttgcaaaaacatacggaacgacacctgtagaaaacatgttgtcacaccaagtggaacgtttcaaaacggtgggcgaaaagcaaatcatccaaaacccaagtgacgagcaaaagagcaaagtggagaaatgctccttcgagaactttgaagtttactccattgacattctcatttcgactggcgaaggaaaggtgaagacgcatgatgctcggacaacagttttcaaaaaggcggatgacatcgtttattcattgaagttgaaggcttctcgggctttcctttacgaagcgcagcgccgctttggcgttatgccattttcgctgaggcaatttgaagacgagaaaatggccaaagtgggcagcacggagtgctcgaagcacgacctcatgcaaccgtaccaggttttttatgagcgcgaaggcgaagtggtggcacagttcaaatgcacggccattataatgcccagtggcattttcaaaatcaccggact

SEQ ID NO: 85809 - DNA, 464 bp, Heterodera glycines
  SCN-specific regions: Sequence locations=1-464
ccgtttgttcatcgtcaacatcacttcgctgctgtccgtaaaggcatttccctcgtttacccaatattctgttggcacaagccgctcgagaggcatattttcgggcatttgctgttgagcatccaaagtgccgcgttctgaactacgcgccgggcccggtggacactgaaatgcacgcggaagtgaaagaaaaaacatatgactcgtccgtgcgcgaagtgttcgcaaatcgacgccatgacgcaaatttgcacaggaaattgctgaagccggaggaaactgtgcggaggctgatccaaatgattgtggaggaccaatttgaaagtggagcacgcgtggactatttcgatttttaatcacgaaggactgcttatggttggaaagtctgctttttgacattattcggtgattgcttttctcttctcaggctttatttttggtacgaaattaactcttttaacaaa

SEQ ID NO: 85810 - DNA, 550 bp, Heterodera glycines
  SCN-specific regions: Sequence locations=1-183,205-550
gggatcaacgcagaaacgcatgacgttgtcggcgcgggtcgtctcttcaagcgacaaatctgcaaagagttggagcaagcgccgggcattgtcacgcgggagggaatcgcaaaaggcgtgcgaatcattgacaacggcggacagcccaaagcggctttggtggcggacgtgaaaacatgtgccttttttgccaacaaaaatttggaggacattgtcaatgggatgctgcaacagaagcgcaccaaccgaaatgacccgggacaaatggaccgtttttgggtcgaattcagccgactcttccgcggcgtcagcggctatttgacctacgcgccgtcgcgagtgattgtgatcgactcgatcagtcagcgcaagatgaacgacattagcttcgaagtggacggacaagcaatgagtatggtggactttttccgcgtcaaaaaggacattcgaatcaatggccaattgcccgccgtccgtcagcagaaagaccgcgagacgctgttcccgctgtcctgcattgtgattctgcccagccaacggctcccactgg

SEQ ID NO: 85811 - DNA, 513 bp, Heterodera glycines
  SCN-specific regions: Sequence locations=1-114,139-195,218-407,431-513
ggcgatttcgtcggttgtggcattaatttggccactcggcggatcattttcacaaaaaatggccaacctttgaatacttccgatttattcctttcgcctccttttggtcttccattgtttccatttatttctttgagtgattctggcgatttaattgagacaaattttgggccaaaattcgaatttgaccccgcaaaagtccagcagcaggcatcttcaaatttccggcaaaattattgggatgccaatttttgtcatgagaatctcgaaatcattggcaacaaaagtctcattgtccattataagaaaaattcttatgatgcatggcgttccgtcttcgctaaatatccgattttgctcaacaaggattcgtctaacattttttactacgaaattttagtcaaaaataaaaattattggttcattagctttggattcgccgtcaaacagaagacaaaattggatggaataattctatatgaaaagggcatttatgtatatgaaagtgatggt

SEQ ID NO: 85812 - DNA, 379 bp, Heterodera glycines
  SCN-specific regions: Sequence locations=29-43,67-88,111-176,215 -314,336-379
ttttttttttttttttttttttttttttgcgggtatagggatgtattattcaacaaaaacacaaataaatagatgaacacaacaaatgaaatttaaaaaattaataattacacatacacattataataatataagttcaaatcatgcaacatttttccatgagggaataatttcagaaaaaataaaataaattttgctttttaaattttattttggaacgcctaattcttttaatcataattcctcgtgcttttcatcgtcatcaaatgctgtttcgtcgtcttgcgggtttccaacagcacttctattgttgctgctgcttgtcaaaagccgctttatttcgttgtccaactcggtccattcggacacaatgcgaaca

SEQ ID NO: 85813 - DNA, 367 bp, Heterodera glycines
  SCN-specific regions: Sequence locations=29-61,83-367
ttttttttttttttttttttttttttttgaatttttcatttttatcaagtgtaagtcttgaaattgtaatttttgaacataatgtacccaacggaaagggacatggaaaacaggctgatcagcagtggaagacaataaaagtgatcaatgcgggacaagaaaatctttcgtccatcgattgacaaatcagctgggaaggaggacattgtgataatttcgccattttttaccgattggaaataattaaatgtttgaacaggattattgcgatgtgatcaatcacttccccgcccccttctgtttgctcgctttctttcttcgggtttcctcttattcgagtttgtaagtgatctgctcgaattgttcc

SEQ ID NO: 85814 - DNA, 301 bp, Heterodera glycines
  SCN-specific regions: Sequence locations=32-108,131-301
tttttttttttttttttttttttttttttttgatgttacatatgtttatcggaaacaaaatattaatattttgaaaaccagtggatttgtcattttaaaattgattaaaattcgaattttattcaacaaacgaaaatagtaattataattcttattggaaaaaaagttcaatttgcgtttgattgtccaatcggaaatgaaaattgaagtgaagtatttactggatttcttctgctggcgattaaattgcatttggtttttcaatttcaaaaaaagtaaatggggatgaaaaggaagctta

SEQ ID NO: 85815 - DNA, 213 bp, Heterodera glycines
  SCN-specific regions: Sequence locations=86-86,120-154,176-213
tttttttttttttttttttttttttttgtttttttttttttttttttttttttttttttttttcttttttttttttttactttttcctccatccttctcttccccttctttttctctctaaaaaaaaaaaaaaaacttttttccccccccccccaaaaaaaaaaaaaaaaaaaaaccccccccccccaaaaaaacaaaaaaattccccctttt

SEQ ID NO: 85816 - DNA, 419 bp, Heterodera glycines
  SCN-specific regions: Sequence locations=25-43,65-398
ttttttttttttttttttttttttggcagtcgaaccattcatcgaaaaataaaaataattggaacattgagcggtattcaaaagtggtgcggggtaaaaggcataatggaattattttacacccaaagtgatcaaagacaaacgaatgaatggattagaattctttctctctcttcgatcagctgaagctgaatgttgtcggcaccgacgcattggcgtcaaaagaatagccgccggcctgcgccaagcgctttgacctctccaaattttcctctctcgtgcaaatttccatcaaatggttaagctttgcaactcgtgcctcgccaattcgttgctgatcagaaatgctgaccaaaagaggcgaattgcgggtattcatttcttccaatgtgtgtttgaacaaaacaaacacattcaga

SEQ ID NO: 85817 - DNA, 228 bp, Heterodera glycines
  SCN-specific regions: Sequence locations=1-179,201-228
gggcgttcggtggacatttctgatgcggtcagcggcgtcgactttgcctcactttcgtgtctgtcgaccattactcaatcgacctctgacgaattgggcaaaaagtcgaaaggctctcccacaattgaattgctccgtgccgagtcggactgtcttcctcccgaatggcttttgcccaactcttccgacatcattttgaagccgctgattccaatggccgagcacagc

SEQ ID NO: 85818 - DNA, 364 bp, Heterodera glycines
  SCN-specific regions: Sequence locations=27-89,111-111,134-364
ttttttttttttttttttttttttttgaaattttaatgccaaccaatcaacacgtacagacacccattggaatacggaataggagagaaatatatataaaatatgtgtgataatcatcaaatgaattatttgataggggttataaaaaacaaagaattcaattaaaagtcaaagggcatttcacattctgctggggaacttttctacgacgcctccggaagcagcagcacctgaaacagtctttcacttcgctgtgctcttcctcctgttgacgatttgggggtgggggccttgcgctttcctccatctctcctgcgtttgagtttaccacctgcgtggaaccgaagccaggcccgtggggtcc

SEQ ID NO: 85819 - DNA, 175 bp, Heterodera glycines
  SCN-specific regions: Sequence locations=1-175
ggggatggaggctgacacgcttgatccggatgatttgttgggcgaagaacgatcggcgcccgacgggcgctttgaagtgcgcggaggtgagagcgaaattggcgacgaagaaccgtatttgatggttgggcacacctgtccacagcgaggtgtcccacctgacccggcctgccat

SEQ ID NO: 85820 - DNA, 533 bp, Heterodera glycines
  SCN-specific regions: Sequence locations=1-408,438-533
gggacaacgcgagccgatcccgggagtgaaccctttgccatcttctgccaattcgagtggttcccttccctcgtctttatacccccgactgcctgaagtatctttgagtcggccaacacacacatattccgctgtgacttcgtcgccaaatatgagcattaataaatcgattgcgatgagtccgggaagagcggtggcagtgcaaataaaagagagcaaaaatgaggacgtctcccgcttccatcgtctccggcgaattcttggacttttggaccgggaaaagcccgtaccggacacagtcgtggacctggacgagctgcgcaaagagtgttggctgggcattccgcaccgtattcgcccgctcgcctggcgattgctttcggaatatattccaactagcctcgacagatgtgaaatgactttgaacaggaaaagggacgaatattggcactacgtcgagcagtatttccacacgcgatacgacgaacagcaccaaatcactttcagacagattcacatcgatatccctcgga

SEQ ID NO: 85821 - DNA, 517 bp, Heterodera glycines
  SCN-specific regions: Sequence locations=1-517
ctgttgttccgatgttggtggtggtgcagcggcggcagttgcggccaccggctgagacaaagacggcggcggggcggtatcaaccgttttcggaacatcgacaatggaggaaagaggagcaacggcggaaatcgccataacttcatccttcttattcggtgtagacgtcggagagggcaatgagtcaacaacggttggagcagcatcagatggcgcatccggctttttctccggttccttttgaggtgagtgatccacgacaacggacgcctttttaggttccgactcaacaacgatttgatggagtttgccacttccaccattaaccattggaggaggagcaacctggccaccaccattttcgaggggctgttgctgttcagcgacagtagtcggcggacttggcacagtagcaccggcgttgttggccgcgttgtatttttcactaacggtaaccagaaaggcggtatccaaccactgaaaacacatcgctcttcacgtacaaaacggtgggcgt

SEQ ID NO: 85822 - DNA, 542 bp, Heterodera glycines
  SCN-specific regions: Sequence locations=1-542
ggggatcagccacaactcggttcatccctaacaaaaccgaacaaatttgatatctaaaattattatgacgaagtcgaagtccagtagcggaacgactcgtaccaagaagcgtaccgctgaccaagttgtaaagacggtgttccgtcgcaaaatctgtctgttctgctttatggcctcactgattgttttcgcgctggtccttggtttggccatcactttgacagttatcacagtgaacaattggaaggaaatcggcgtgcttcttagcaaacaatcggcgttgaagagccgctcggacattgaagcgttttatgaaattgattgcccaatttacagtgacaactccaaacttccggacaaatgggaccaatttgatttggcattctgcaatcgctattgtgatcgcaaccaaatgttcgagttcatgtaccgtcaactcgaccccaaccggaaatcttcagccaagagcaaagacaatcaagagcttatgtgtcccatatacattgaattcaaacaatgtcagatggaggaagggggtcact

SEQ ID NO: 85823 - DNA, 434 bp, Heterodera glycines
  SCN-specific regions: Sequence locations=1-434
gggttggtgatcagcgaatgcgatattcgtatcgtaatggatgcgttaagcagtggaaaagcattgctttgtctgccgatgtttgccgaacagttttatgtgtcggaaaagctgcgacgcatgggcgctgcggttgtgcttgatccgcgcagtggcagtttcaccccggaggggattccaaaagtatcggcgaagcattgacaaagcgtcatgccgttacatttccttcaaacgaagaatccctgaagcaaacaattttgaatgcattcaagaaacttgaatgattgcggtgtgtccgctgctgctgatcgcggttgtgacatcatacaatgtgccgcactgatcaaagagagattttcttttagtttttccatatgctttttctattttctatttgggtattagatgagtgattctacccgtttttcaatagt

SEQ ID NO: 85824 - DNA, 531 bp, Heterodera glycines
  SCN-specific regions: Sequence locations=1-41,69-219,267-531
gggatgatacgccgtcgcaatttgcgtacccgttcgattagaatgctcgttttggatgaagccgatgaaatgctcaccaaggggttcaaagaacagatatatgacatttaccgatatctgccaccgaatgctcaggttgtgcttttgagtgcgactttgcctcacgatgttcttgagatgaccagcaaatttatgacagatcccattcgtgtgcttgtcaaacgtgatgaattgacattggagggcatcaaacaattttttgttgcggttgaacgcgaagaatggaaatttgacacactctgcgacctttatgacacattgacaattactcaggcggtcattttttgcaacactcgtcgaaaggttgactggttggcggacaaaatgcgagaggcaaatttcactgtttcttcgatgcattcggacacggaacaaaaggatcgcgacgctattatgaaatcattccgtgcaggggaaagtcgtgtattgattagtaccgacgtgtgggcccgtgggttggatgtgccgcag

SEQ ID NO: 85825 - DNA, 490 bp, Heterodera glycines
  SCN-specific regions: Sequence locations=23-33,55-157,179-490
ttttttttttttttttttttttcggtctcattttatacaatgttcaaattcaccaaataaaaaaaagcaaaaataatccaaacagtaaactaataaaaaaacattaaatttgtacatggcccggatttcgattattttttacaattgcttttcctccgcaaaactttctcatccacgtcaacaatgttaagcattattatccatactcatgtatccgtcgtgccaactgttcttttgctgctgtttttgaagtgttttttgacgctgtaacctcagcagtgccgtcagttcgctcatttgtccgtttggttgtgccgtcgtcgtcgccgcttccgccgacccttccgcaaacggcgattggccgtgcgaaattgacttcactcgttggcgaatttcgcgcacaatgtccgtcgctcgcttaccgcgtgtttcaggcaacaaacaataaacgaacacagcgccaccggcactgaccaaaatgaaagggacg

SEQ ID NO: 85826 - DNA, 449 bp, Heterodera glycines
  SCN-specific regions: Sequence locations=27-130,152-449
ttttttttttttttttttttttttttggtcttcgtttacgcccaccgcattttgcagtgcattgacaaattgggaaattgtgaatcaaatgtacacacaacacaaatcatatcaacgaacacttcgtttctgctgctttttgtctgtccattgttctgtcgaaatcatcccttttctcttttgttccgtttcattgtgagaaggacggcgcattggcagtccgtacgcccaccggctgttgcattcggatgagttgcaaaaattcggctgcttgttctggtgtcagtggtccgttcttctcctccccccgttctttctcgcccatttctcttccaattcgcgcctccggcactttaacttcgatcggacgcaattggaagttcacaatgtgtggacgtcgttccttcacgtccttctgactgatgttcaacgttttgatgccaatttca

SEQ ID NO: 85827 - DNA, 447 bp, Heterodera glycines
  SCN-specific regions: Sequence locations=28-50,73-117,139-389,413-447
tttttttttttttttttttttttttttccacgaattatccctttttatcaaatatttattactttaaataagtgttggacatgtcaacaaaatgattttctgtgctatgtattttcctcctaatttttctgcttttctatgccctcaaaaatcgaaatccgatgacaacggggtgttttcctttccatggccaaccgaactgtgttggccagggttggcaatcacatggcttggacttggcacattttggtgcgcggaaatccctttgcttgggtgtccaatgtgcacatccgtaacttcaatgttcatttcttggccaattgctttgattgcttggctttcctgtacaaatttgcttttcatgttttgccattctgtgtcgttgcccgcatggccagcagcagcagcggccaagtcgaacatggcacgggcaaagcccaaattgta

SEQ ID NO: 85828 - DNA, 369 bp, Heterodera glycines
  SCN-specific regions: Sequence locations=29-135,157-369
ttttttttttttttttttttttttttttactctatcatcaatttatattggcaaaaagaacatagataataatcgccggtttgccgtgtcaacatcgttcgatgggttcttttgtcccgtctcttcgctctctcagatcactgctgctgacactgcacgtgctgtgccccgcccggccccgtcggcacttcgtcgccgctgctgtcgtcatgggacgcctcacgacctccaccgccgcccgaactgcggtcatagcggcgcgggtcgaattcggtcagcgtcacttcctccacttccgaattcggagcaatcccaggctgatccggacgaggaggcaccaaaaaaagcaatttattgtatttgctctcg

SEQ ID NO: 85829 - DNA, 396 bp, Heterodera glycines
  SCN-specific regions: Sequence locations=30-104,126-396
tttttttttttttttttttttttttttttgctctaaatttgcttcatttttttacaattttctgtatttgaaacatttgaatctttttgttctttggggggttttctctaaaaaactcaatcaatcccaaaatcagaacagtccgtcttcttctccttctctgccgcctcaagggctcttcccaccaattatcatttgaatctcagcagccagccacttccaatcgtccatgtcgattggtcgctgggatttgaaccaatcgttcacgtcgtcaatgtatcgggccactttggggatcgcttcctccatgcattgcttcactaacgtgttgccctgcgggtctttcgggcatccccccaggctgttaattgccttcccaatttgccaatggggggc

SEQ ID NO: 85830 - DNA, 463 bp, Heterodera glycines
  SCN-specific regions: Sequence locations=1-213,241-364,387-389,428-463
gggattcattgcatttcctcctatcacttcattcccaaaatgtccttccttcgtctgatcacttttgttcttctgatcactctgtgctctttgccttctctggtcgaaagcggcctcattggcattgtcggcactcccgttgaagccgcttggtgcggtgttttgggcaaagaatccagccattgccctactgctggaggcggtcaacatggcggaggaggaggaggaggaggaggaggaaattacggtggtggagccccgggtggaaattacggcggttccagcggctcatacaatggccatcgcgcacgccgattcgcttgataaatgacaaataaagaaagtggatgatgatgaagtgttataaataaaaagtaaacaaaacaatctatttttaattactttattttaaattgtttttttaattctttagctattttagtgaatgttcgatgtttatttt

SEQ ID NO: 85831 - DNA, 398 bp, Heterodera glycines
  SCN-specific regions: Sequence locations=27-40,228-398
ttttttttttttttttttttttttttccatttgatcactgtcccttttcttccatttgatcactttcccttttcttccatttgatactttcccttttcttccatttgatccctttcccttttcttccatttgatcactggccctcttcttccatttgatcactttcccttttcttccatttgatcactgtcccttttcttccatttgatcactttcccttttcttccatttgatcactgtccctgccgctgatcactttgttgttcgattgggctcctttgttcttgtccatttgtcctctgctcattcctttgctgctgttctgcgttttgtccgatcacttgtgcgtatgtcggcggcagttccgttatgggcaattgattaggattggttgtctc

SEQ ID NO: 85832 - DNA, 444 bp, Heterodera glycines
  SCN-specific regions: Sequence locations=1-317,341-444
gggaagggagtgactgtggacaccgtggagcgttaccagggttcccagcgtcgggtgatcattgtcagcactgttcggaacaacgaaaaggaggcgatcggatttctgatgtcggacaagcgtttcaacacaataatcactcgtgcggaagagcttttgatcatcgtcggaaatgccaaagtgatgatgagggattcgtcttggaaggagatgatcgactattgccgcaaaaacggtgccacagttgacatgccgtctgaagcggagcttttcccatcgggccaatttcaaaatgatgtgctgacggacagtgacaagagcagcagcagtagcaacagcgaagttgatgagaaggagcgaactgaccaacttgtgaagaagggcacgtcgagtgccgccgctgctgaacaacagaatctcagggccaaggcatcttccgccgag

SEQ ID NO: 85833 - DNA, 542 bp, Heterodera glycines
  SCN-specific regions: Sequence locations=1-18,40-542
ggggacaagtaattgtccaattaagcatcatatacaataggatggtattgatcgcggcatccattttcaccaaatcgggcaaagcacttgtgacacgccaatatgtggcagacatgaccagagcacggttggaaggacttttgaacgcttttcccaagcttatcacttcggataaagctcagcgccaacatactttcgttgagacaaattctgtacgatatgtctatcagccgatggacaacatttacatggttttgatcaccacgaaagcatctaatattttggaggacctggagacgcttcgtctgttttcccgagtgatacccgagtattgccgttccaatgatgagtccgaaatcactgacaaggcattcgatttgattttcgcttttgacgaaattgtcgtgcttggttatcgcgaaagtgtcaacttggcacaaatacgaactttcactgagatggactcgcatgaggagcgtgtgttcaatcaaattcaaattgctcaacaacgcgcagcccatacactgatgaaagagaaggag

SEQ ID NO: 85834 - DNA, 280 bp, Heterodera glycines
  SCN-specific regions: Sequence locations=35-280
tttttttttttttttttttttttttttttgttttaagtaccgattttttatcggcgaataaaataagtaaatgtggagaacagaaatatgtgtaatggaaagaaacgggtgaagtaaaatatttaacagcaacggaagatttatgtcgtaaaaaacagttcactccattccgtgatcactttggtcactttcttccgatggggtttctctagacgttcctccgcattacggaaacgttcgtgctcattgccttgcgggtcgtccttaaagtacgggtcct

SEQ ID NO: 85835 - DNA, 372 bp, Heterodera glycines
  SCN-specific regions: Sequence locations=24-69,91-372
tttttttttttttttttttttttggtttgaaattccatcagctgttcttttttttgtttacaattgacaaaatgtcattcaaatttgaacattttaaaccatttgaatagggcaagcttttcagctggtgattacttatgctgttcttcgacttcgttcttcgtccttttgttcagtcctcgtcgctatcgctcgacttgaaaaagcggggcactttcacataattcttcggcgttgtggtcattcgatgtgcgatgcccttaaggatgatgagtaagtcgccatactcacaaaagatgcgtatccaaactccgtctttggcttcgacgtcgtaatatgccgacccttccaaaaccatccgtgcttgatcct

SEQ ID NO: 85836 - DNA, 340 bp, Heterodera glycines
  SCN-specific regions: Sequence locations=1-340
ggggtgcgcgacttgcagcagcaagtcaacgaattggaagagaaggccaagaaaattgaacaccaaagaacgaagaacttaagtgccatcagtgccatcaaccagcggaatagggaccatatgaaacaaacattccttggtgccggaatggtgcgggaagagcaggagaaggacgacgacccattcacacggaagtcggcgcggatgaaagtggtctcgggatccgtgaagtccaaaaccgccggcgaaggaaatggcgccaatgccgagttatccgttatggacacgatggtttcttcgttgggttcgttgtcgtcttcgtcggagtcctctccaaaca

SEQ ID NO: 85837 - DNA, 253 bp, Heterodera glycines
  SCN-specific regions: Sequence locations=1-174,198-253
gggaattgtcaccatcgtcggcgctccgatggacgttgaaaaggtttccgcccctagcgatgagctcgtcaacaaactgcatgccgaatactgcgcacgacttcgcgagctgttcaacgcacacaaagtgaagcatggcggacttggccacgacgtgcagttggaaattgtgtgaaattggcaaatgaaaggccacaaaaattagaagctcaattttcgaatctaaaggacaaagtgcactcaaatacaatat

SEQ ID NO: 85838 - DNA, 255 bp, Heterodera glycines
  SCN-specific regions: Sequence locations=1-255
ggatgataggtccgggctgggttggccagggccgcgctgccattcaagaaaccgccgtcggcgctggcaggcccccaacgaaccgagctgaaaccttcttccagactgtcacgctcactgtaggccagcgaaaacagggcgcccagttgaccgtcagcccaggtgttggacaccaatccggcgaatcggggactccaatcctgcgaaaggtcattgtagccgtactggcccgacactgcgggttggaagcccggc

SEQ ID NO: 85839 - DNA, 398 bp, Heterodera glycines
  SCN-specific regions: Sequence locations=28-31,53-367,390-398
tttttttacttttttttttttttttttggagcacacagaatttattatttttcaattgaagttttttaacaaatagaaaatgcagaatttttaaaacttttttaccgtacatttattactgggctttgggttccgggatttatgggtgcaatgcttataaatatggcaataattaaactttttgcaaaaccgggaatgtttcccatgcgccgggggggcgaattcggcacttttcgatcggataaaattttcaattcccgttcgccccctcggattgaccgagggttaagaatttgaagaaaattgatcaaatcgcatttcgcttcacatccggggattgccattggctccaaaatttgatttcgtcgataaaataatttgacaaaaaagtttttgtt

SEQ ID NO: 85840 - DNA, 272 bp, Heterodera glycines
  SCN-specific regions: Sequence locations=29-45,67-272
ttttttttttttttttttttttttttttccacttgttctgccgtttatttttattttaatggggttaattttgataacgatgcgggaaataaatgtacaatttttttgtttgtcgagtcccaattgtattgcctttggtggctttttcactctcttctgctgttaagcgatgcttcacatttgctccgattttcccaaataatgcgccttcaaaaaagaagcaaactcgtccacttgagattctttgggggcaaatgtggtcaccaaacgga

SEQ ID NO: 85841 - DNA, 393 bp, Heterodera glycines
  SCN-specific regions: Sequence locations=28-127,149-223,255-266,288 -393
tttttttttttttttttttttttttttccggaatgtttgtttaattaattaagcgaatgtttggcaatttcaacagcaaaaagttaaatggatgtgcttaataatgtccaaattggcacttccatttgctcttttctcactttcttttcgtcactttgcatttgtaatccgccaatttgacagcgaatgtttgtcgcttttcaaatttcggcggatttaaaggatcacaaggataaacatggaatttgtggaaaaaattcgccgtgaaaaggaccaattccattctgccgagggtttcgccagggcacgaccttttgccgattccaaacggaattaattcgtccactcttcgcatttttccgtcttcctccaaaaaacggctcggcatgaact

SEQ ID NO: 85842 - DNA, 480 bp, Heterodera glycines
  SCN-specific regions: Sequence locations=1-480
gggcaatttctccttaacttgtcctcttcctactctcaatggatttctaaggcttttgcttctactggaaagggaagatggtatgcacagccattagatgaaatgagtcgacatcggagtcgtccgccctgttacggcatggcgaggaggtcgaaggtgctctgcgtggacaattcagagattgccaaggaagcaaatatgagtgggaagctggcctatgtcatttgggtgtacaaagacgggtaccgcaaaaggcacatgccgaaggcagaactcggcgacagggtgttgctctcaattagaggggagatgaaacgtgctgtcgtcgtcgggtgcaagcagcacctcgccatccgaaagcacgggttgccctccaccgacaccaacaacgtcgtcctgctgaacaacgacgggaaccctcttggcaatcgcattttggcacctgtccctgcctattttatgcggtatcgcaaatggcta

SEQ ID NO: 85843 - DNA, 359 bp, Heterodera glycines
  SCN-specific regions: Sequence locations=24-82,104-255,277-359
tttttttttttttttttttttttgggcccaagtaggtttatcgacaaataagacaaagacaatagaaaatgaaatattcaatgagaagaaatatttaggggaatgtagaaatacttgaatgttgggggctgggagtatttgtcaatcaggcgagtaattctggtgggttttcaaacatttagacaccattattaatgggataaaactaaaatatcattaataaaatccgaccttcacaattaacacttcgtttagctccttcttccttcttctgtcgcttccggcgaattctcttctgtctttggctgctggtcctcctctcgaattgggcacgtttcttcctcatttctctgggaatt

SEQ ID NO: 85844 - DNA, 395 bp, Heterodera glycines
  SCN-specific regions: Sequence locations=1-395
tttttttttttttttttttcgaaaaaaaaggtttacccgttcgggaaaatggagacaaagcacaacaaacaacgaattaaattaacgaaaacaaagaatacagaaagctaatgaaatacacttgatgggaaagcataaaaagacaaggtactagaaaattaataaaagtatttatcgagtattaattataatcggcacctgacaaaacaaacagtactcgtacttaatggacgtgaacaagaactagggcataagccattaataaacaaagtggatgagtgtgtcgacgcccgtgtgagttttgtactcagtgaacattattatcaagacaaggcggtgtcatgaaatcctccaccaccactggagcccgctttctggtcgctgtcatcgtcgtc

SEQ ID NO: 85845 - DNA, 256 bp, Heterodera glycines
  SCN-specific regions: Sequence locations=30-36,60-168,191-256
tttttttttttttttttttttttttttttcgattgcattttattattaaataattaaaacttttccatttttttgttcaaatgaatttaaatcactttggcttttccaattgcttctgcttcggggccctttcaattgttcaacactgagtcccaagtgagtaaacccaaaagcaatttggccaaaatatggcccaaaaggacggacaaaatcagccatcccttcaacgtcatgacaatgatcatcaaaatgtacc

SEQ ID NO: 85846 - DNA, 446 bp, Heterodera glycines
  SCN-specific regions: Sequence locations=1-446
gggcggccgtcgtccgcagactttgctagccccgtgccacacgtaagaaacggcgcgagtctcgtcgatttttacattggtctcgggttggccatcagctcgagccttttcatcggctcctcatttatcatcaaaaagaaagcactgataaaacttgcggggtcggcagaatacaaccaaagagcgtcggaagggggtgatggctatttgaaggaatggctatggtggatgggtgtgataacaatgggagttggcgaggcttgcaatttcgccgcttacgccttcgcccccgcgagtttagtcactccgatgggcgctttgagtgttctcgtcaccgccgttctctcttccaaacttttgaaggagcggctcaatttgctcggcaaaatcggatgtgccatttgtctgctcggctcaacttccattgtcattcactcgcccaaaga

SEQ ID NO: 85847 - DNA, 337 bp, Heterodera glycines
  SCN-specific regions: Sequence locations=29-337
ttttttttttttttttttttttttttttcgatgcaaaagaatttatttcgcgcgaacgttcgttggcatttcttgcgttgtaagattaaattgggcttttctcgtcattcatccgcctttcgttcattcctttcttttcgtccttccgatttgttcgtccgtccgtccgtctttcaccaccaataccccgaatagtccgggtaagcgtggccgtagtacgacgaggcgtaagggtaagcgccgccccatccgccgtatgcgccgtagtaatacggactccaacgtttggcacgccccgcctcggcttgatgttgcccgccttcgaacattggccctt

SEQ ID NO: 85848 - DNA, 376 bp, Heterodera glycines
  SCN-specific regions: Sequence locations=29-51,87-376
ttttttttttttttttttttttttttttgcggaaaaatattttgttaatctacaaaaaatattacacattctgagggacaaagcacacaatgattaagcaagtttaaggaaaaagtaaatatgttagttttttgtttattaaaacccaatacttatttttattccgtgtttgacttcgtttgatataaccattatctcatttattcttcgatgcattgggctcgccccggcacagtgtttttaattgcacgtgaaaacggggccaaccaaccgttttcacccgagccatggattttctcgagaatactcttgaacaaacaagtgtagtttaatttcatatctcgtcaatcaccttccaaccaagcaccgattccca

SEQ ID NO: 85849 - DNA, 440 bp, Heterodera glycines
  SCN-specific regions: Sequence locations=1-440
tttttttttttttttttgtgtctgtttttgcattctctccgttccttcgtttcaatttttgtccaaaaacaaacggacaattcgttctctcacttccattcgttcacacccttccgctgaacatttgtaacccatcggacaacacttttggctttccttgcagcaaattcctttgctcaatggacaacagccgaaggtcgtcgtttgttcgccttcatttgtcgggagggagtgggcacagcaaatgtccgtcggtgaaccacagaaagtgccgtcggggcattccgttggcatttttgtgccgtggaaacgtctttttgttgcatggtgcgtcgggaacatttgggtggaaagggaaatgccattctgttcactcacacaccgttcctcctcccgcgcacatgcaaatcccgcggggcaacaatgggccgagtgggcgc

SEQ ID NO: 85850 - DNA, 435 bp, Heterodera glycines
  misc_feature (344)..(344): n is a, c, g, or t
  SCN-specific regions: Sequence locations=1-125,152-205,227-344
gggcaatccgttgcccgaccacatccaggtcaaagagccaccgattgacgtcgcgccgaccacgccgtactcggagcaccgcgaaccgatgaccactggcatgccgccccagacacaaatgccgcccgcccatcagcagcagcagctgccgatggttggccaagtgccgcccccggcacagttttaattgtgaggaagaaccgctgatgatggtcatgatggatgagtgggagatgttcaattaaaatttgttatttgtgtgtcatcggcacagaccacccatttttgttccgttaaaaattctttgttgttgtttttgttttcaatgatttttgttattgctnaaaaaaaaaaaaaaaaaaaaaaaaaaaaaaaaaaaaaaaaaaaaaaaaaaaaaaaaaaaaaaccccggaaaaaaaaaaaaaaaaaaaaaaa

SEQ ID NO: 85851 - DNA, 432 bp, Heterodera glycines
  SCN-specific regions: Sequence locations=1-74,97-132,155-188,210-432
ggggtcattggcggaagagatgtttatcacagttgctccatcggacaatgcgcggcaaatgatttattcctccatggaacaaatgcagcaatttttgaattttgacgaacagattgaagcggcggagaagcaaacggaaagagaaaaagacgaccaaaattcggaggaatcggagaaaatggcactgaaaaaattatttgagcaaaaaagtgccgaatttgaaattaacaaagcaaaagcaaccgaaaaactttccgagatgttggcagtacgatttgagccaattttgcagaaggaggaggaacgaatgatggaagtgcaaaggaaacacttttgggaatgggccgaacgcagaaagcgactcattcacagtcaggcgcaacgcgcggaacatttggcacgactgaacgaaattcaaaaaaggagggccga

SEQ ID NO: 85852 - DNA, 315 bp, Heterodera glycines
  SCN-specific regions: Sequence locations=27-138,161-315
ttttttttttttttttttttttttttgcatttcgctgcgttttctgaagccaacaaaatcatttccgtcaagaacatccaatgctcttttgcccaaatcagtgaagtcgtccccgtccgctgtagtcaaagccttctttttcttcagccccatgaaatcgtcgccttcgagtgaatccaacgctcttttttgaaatgaaccgaacccattggcgtccatcacattcaatggtcttttccgaaatccgccaaaaccatccgattccaaaatgtccaaggggcgccttggacgaaaggggatgactttgaagggtcc

SEQ ID NO: 85853 - DNA, 553 bp, Heterodera glycines
  SCN-specific regions: Sequence locations=1-553
ctgttgttccgatgttggtggtggtgcagcggcggcagttgcggccaccggctgagacaaagacggcggcggggcggtatcaaccgttttcggaacatcgacaatggaggaaagaggagcaacggcggaaatcgccataacttcatccttcttattcggtgtagacgtcggagagggcaatgagtcaacaacggttggagcagcatcagatggcgcatccggctttttctccggttccttttgaggtgagtgatccacgacaacggacgcctttttaggttccgactcaacaacgatttgatggagtttgccacttccaccattaaccattggaggaggagcaacctggccaccaccattttcgaggggctgttgctgttcagcgacagtagtcggcggacttggcacagtagcaccggcgttgttggccgcgttgtatttttcactaacggtaaccagaaaggcggtatccaaccactgaaacacatcgctcttcacgtacaaaacggtgggcgtttggtgggccaaaatgatggtttggacaaagcgtcgt

SEQ ID NO: 85854 - DNA, 413 bp, Heterodera glycines
  SCN-specific regions: Sequence locations=39-413
tttttttttttttttttttttttttttttggtttttttaaaaccactaacatttatcacaagcttccatccaatacgttcatataatatttaatagcaattaaaattttagggataattcacagattaaattcattagaaaattattgaaacatctctccattctggcgggtcttgaaagcccattacgggccgttaattacagaagatttgctcttttcacatcgtttgcctgagcatttgatcgcacctttcttgtcgagttgattgacgttgacactttcagcgggtggagatccgcatcatattccagtcggaaaccatgaagcacttggccattaaagggtttccattttttttgggcttggttacaatcgttggcaatttcattggctttctcgaaattttcaagaa

SEQ ID NO: 85855 - DNA, 584 bp, Heterodera glycines
  SCN-specific regions: Sequence locations=1-73,95-401,423-584
ggggaaatggcattttgtttctttttaacaattaccttttgtttttcatttaccctttccgtgaataacttgatgaaaaaatgacttccccagcggaatcgctcaatttggacgcagcggaagtccccgaattgcttaggaaggaactcgatacgcttcacaaagcattgggtgagaatatgcaacggtacacggaatgcaaagagataaaagtggacgaaggactgcgaactttggaggcgaaggtcggcagattggcactgtccataaattcgcacaaaggcattttgaagcgggagcgaatgcgattggcagaaactgcgaaaagattggggctggaccaacgcattgcgcacaatgttcagcggacccgggataatttggcaaagagcccacaatttgggcgcgcccattccgtggattttttacacgaagtggcgactcagaatgaccaatccctggcggaacaatgcgaaaccgtcgaaaaattgcgaaaattgttggaccgactgagcaattcagacgaagagccgtcattgtcgcgaaatgacctggtcgatcatcttactcgatttgaccgcatt

SEQ ID NO: 85856 - DNA, 204 bp, Heterodera glycines
  SCN-specific regions: Sequence locations=28-74,200-204
tttttttttttttttttttttttttttcggaaactaatttaaattaccaacaaattacaataattaatatttgttcttctcttcctttttgcactttttccttctttttctccccttagcttctctccgctctttccgtcttcagttctctctcaagcctcttaacttctctctccgctctctccggcttcagttctctctcat

SEQ ID NO: 85857 - DNA, 560 bp, Heterodera glycines
  SCN-specific regions: Sequence locations=1-204,226-560
ggggattttgtctggctcggcacatccctggtacatactaaataaagtacatttttgaccattgaaagtagtgctttatattgccattcttcaaattaaacttttgctaaaattccatggacgaatcggcgaaaaagacgctaaaacaaattccactgctgaaaacaaatgcagggccacgagacggacccctttggcttgaacggttgaaggaggagtacaacagtttgatcgcgttcattgagcacaacaagcagggcgatgccgactggtttcgacttgagtcgagcgcggatggcactcgatggttcggcaaatgttggacctaccacaacaaaatcaaatacgaattcgatgtggagttcgacgtgccgattacatacccaaaaactgctccagaaattgcccttcccgaattggacggaaaaacggcgaaaatgtacaggggaggcaaaatttgtttaagtgatcacttcaagccattgtgggcgagaaatgtgccgaagtttggcattgcccatgccttctcacttggccttggcccatggatggctgtcgag

SEQ ID NO: 85858 - DNA, 291 bp, Heterodera glycines
  SCN-specific regions: Sequence locations=30-116,138-291
tttttttttttttttttttttttttttttgctctaaaatttttttatccaattttgacattcattaaaatttgaagtttggggccataccaatgttttgtgaatggaacgcttgaaaaattattaatttttacataattagagctagataaaaaaaattagcttttaagcgaatataaaatgcaaatgttcaaaaatctgagaaatatgtttttacaaaaatcctggtgttcttcaatcgagcattaccgactttggtggcacttccaccgattgatgaccgtactcctgt

SEQ ID NO: 85859 - DNA, 467 bp, Heterodera glycines
  SCN-specific regions: Sequence locations=1-129,152-276,300-467
gggagaatttaaaaatcataaaaattcaaactcatcaaattcactcaacatcatcaccaaccgtgaacattatgctgaggattgctctactcatctccattttggcactgtttggtgattgcatggacatgggaaaaagaaaattaggaggaatcagtattaatgagccaagtgaatatggaaccaaagaaaaagaagccatcgcaacaaaagaaaatgcacaaacatcaaaggacccgccgacatcggcgggtggtcaaaatgaagcaatcccttcaccaaaaaagccaagccccaaggggaagttgaaaagcgattttggcctaaacttagccaaggcttttccacggccggttccgaaaggcagaaggggcaaagaaaaagtcggcgaaaaaataagcgttatgaacacagctgaacgcattgaaaaaatggacattgcccaagacaaagctaaaatggaaata

SEQ ID NO: 85860 - DNA, 244 bp, Heterodera glycines
  SCN-specific regions: Sequence locations=59-200,225-244
ttttttttttttttttttttttttccttttttttttttttttttttttttttttttttatcgcaaaatttatttttaaccctgcccaaaatagtcaacaaaaccggacattttcccccaacaactcgatcaaaaaatgggatggggtaaatcccaaaaaaaacaaaaaccgaatccagatctggaaaattcccattacctaaataaatgaaaaacccaaaaaattgggggggaaggaaggggga

SEQ ID NO: 85861 - DNA, 268 bp, Heterodera glycines
  SCN-specific regions: Sequence locations=29-30,57-268
ttttttttttttttttttttttttttttgcaaataaaaaattttattttataatttctacaggatgtttattgggttttcatgtttatctcttttacctctatcctaatctcttgcaaaatcccttctgccgctgctccatcactgctccctgttgcccttgaccaatgccaaaagtgcgtctcggtaagctcccctggtgtcccctttgatcccctcctccaagctcttcttgtgcaacgtgtgaaaagcgtgtttgatgtcagcca

SEQ ID NO: 85862 - DNA, 354 bp, Heterodera glycines
  SCN-specific regions: Sequence locations=27-103,125-147,171-354
ttttttttttttttttttttttttttggccagttaagtctttatgtataggagcaaaaaaaattggataaaaaacacatctcaattttccatcaaatttgtcctttttgcttccatcatttgacccgttccacttttctatttcggtttccccttgccgcctttctttttcgttccaaacaactgagggcgagagaagcgagaagtactgctttcggcgctgacggaagatttcttcgaaacagtgtgagtgcgggtgggatcgccgggagaaaaaccacctgcgggggggccggcagatgtcttcgatacaatgtgagtgcggttggtttccctgcccccctttgtttgaatg

SEQ ID NO: 85863 - DNA, 474 bp, Heterodera glycines
  SCN-specific regions: Sequence locations=1-48,71-385,407-474
gggaccaaacagtgcccgggactatgcaaactgctgtttcacaagcagcacagctccattcaacccaaatgcagcagcaacaaatccatcaacagcagcaagcgaccattgctcagcctcagcaagctgtttccgccggaatgggcgcagtttcttcttctggcggacctgcgattaatccgcaaactggacaaccggactacagtgcccagtgggccgaatactaccgcaccatgggaatgcatgaacaggccgcactcatcgaagctcagatgaagcaaacccacgccgccgctcaggcacaacgtcctcagcaacaactttacatgcaatgaaggcttgcagaactcgtcgaagaaagacaataatgtggctgaatttctggttatttggattgctttttctaatattatcagtttccgttcgatttcttttatatttaatcatcattacgaaccgttctttgactgattt

SEQ ID NO: 85864 - DNA, 419 bp, Heterodera glycines
  SCN-specific regions: Sequence locations=25-48,70-419
ttttttttttttttttttttttttaaaacttgctttttatttcggatattttttaatcaaaatggattcgataggattaatatcagtcaaattgcgtttttcaaattcgatcatatgacaccgctaagttcgacttcggcacactgttcaatcagtgccattttgatacgttcggcgtccaactcgggtcgctcgcataaattggccaaaacataggcatatttaagcgcgtacggattttcgctaaatttgaagcagaaattgctgaacgtgtgcaccacctcatggtgacagtccaagtcgcgaatttgttgcggatacgtcgtcaaaatctgtcgccggttgttcatgtcgtgcacaagttggtgcacaatttgtttaatcgtttgctcgagaaagcttctttttttccacgccac

SEQ ID NO: 85865 - DNA, 427 bp, Heterodera glycines
  SCN-specific regions: Sequence locations=1-50,72-427
gggggcagcgatcggagtcggcgtcaacttgatgtgtgttttttgggtcgaaatgagaaaaatactcgacacgaatgtttcctatttgagcatgggcctcttactgtaccttggcggacattcgcacagccattcccaccatgggcatggcacacattcgcaacggcaaaccgaccgtacgaactttgcagagaacgagtggggtacggtagacggacggccgggccaaaacggtggcaatcgccagacgcacggcacgcggagacagacgaacatcaacgtcagggcagcatttgtccatgtgctcggtgatctgatccaaagtgtcggggttttgttcgccggattgctaatttattggaaaccgaattggcacattctcgacccaatttgcacgttgcttttctccgcaattgttctcagcacc

SEQ ID NO: 85866 - DNA, 165 bp, Heterodera glycines
  SCN-specific regions: Sequence locations=30-42,66-73,101-165
tttttttttttttttttttttttttttttccagaaaaattccattgttttttgcctattccttcttctctttttcgacttcatcatcatcatcaccagccgcagcagcagaaggtttctccgagtcgtcgacattgctcttgtcagtgctagggccggcgaagct

SEQ ID NO: 85867 - DNA, 437 bp, Heterodera glycines
  SCN-specific regions: Sequence locations=35-75,97-437
ttttttttttttttttttttttttttttttttttacacaattacaacttcactttcgttattaaactgttttttcctctagggagagactcaaaagtcccttctctttctctggtgtggcgtctgacaggggactctcttcgtccccccttttttttcccttcccttcactctgtgtttcttcattgccaacacttcctttttcctggggtttcttttcccccagtcttttctcttccgccctctttttttcagtgtcttccacaagtgtttccatggcgaccaaatgcggattccgcccctcttcttttgtcgcgagagtctgcccctttttctcaagccttgccccgtgtatggacattccggtgtccgccgcccattttgcaaaattccaggcgagtgccatattcccaaacaccaacccattttccagcttca

SEQ ID NO: 85868 - DNA, 466 bp, Heterodera glycines
  SCN-specific regions: Sequence locations=48-466
tttttttttttttttttttttttttttggttttttttttttttttttaaacatttttttattattattattcctattaacaagggggggtttgtacaaacaaagactaaagatacgcctacgaaatgaagaaaagcttaggcttggatttaatcctatcaaatgtatcttctgtccattgggcatcacatggcctatcatcgcccacgcacttgacccatcactccaacaccgggacgacgaccaccgcaacacaaagaggcggaatcttgagcaaaccattccaacttggcacattcggaaatgttcggacgaaaagccggttggtaagtcagcaaggcatcgatggcagtgcggcattgcttcgtaatgttaggccatgacgggtatttgtaacggcgcttccgctgcgagtcaacgatttgctggttgggcaagtcttcatggaaaggcattgtgtttgtgat

SEQ ID NO: 85869 - DNA, 339 bp, Heterodera glycines
  SCN-specific regions: Sequence locations=27-44,66-72,94-339
ttttttttttttttttttttttttttggatcataatttacgcacaaaagaagagaaagaaagggacgaaaccattatagaaataaaacaaaaggtgtccaaattcggcgccaaaaatcagtcaaattcccctcattgttcacacattgtgcgcccacacattgctctcttcccctactcttccttcctccgcatcatcatcctttgctcttttcattcgtcatcagccttgtcccgtcggttgcgctgcggcgcctgaaaccttcgaccaccgcctccaccagcacgatgtttctgcccaccgcccccgcctttgccgcccccattgtacggcacgggc

SEQ ID NO: 85870 - DNA, 313 bp, Heterodera glycines
  SCN-specific regions: Sequence locations=29-313
ttttttttttttttttttttttttttttgcgctttttgtctttggggttcaaccaccagcagtctctctctcgtccacttttgttgccaactttctgagttttttcggggacatcgcaactcttttgttgtttgtaagtcgcgccactgacattgagttggttgatggcagaatcacttggttttctgctgcttgtcgaaggcgtgttctgagatgtgatactcgacgactttcgtgatgcaggaggagtcatcacctgcggcggcgacgcttgctgaataagtttttgaagaaaaggtctcagttttgatgc

SEQ ID NO: 85871 - DNA, 354 bp, Heterodera glycines
  SCN-specific regions: Sequence locations=118-152,183-354
tttttttttttttttttttttttttttttggccttttttttttttttttttttttttttttttttttttttttttttttttttttttttttttttttttttttttttttttttttttggggaaaaaatttttaggggaaaaaaaagggccccaaaaaaattttttttttaaaaaaaaaaaaaggggccatttggggggggttttttttccccccggggggttttttttttggggggcccccccaatttgggggggaaaaaaaaaggggggggggggggaaaccccccccgggggggggaaaaacgggtttataaaccccccccaaaaaaacccccccccccccggggtttttcg

SEQ ID NO: 85872 - DNA, 411 bp, Heterodera glycines
  misc_feature (309)..(309): n is a, c, g, or t
  misc_feature (343)..(344): n is a, c, g, or t
  SCN-specific regions: Sequence locations=1-210,232-250,272-411
ggggatgaggcggacactgagcccggtgttcagtgccgaggattggcttgagtttgtgctgcccgaaagtgtcggaatggacggggatggggtgccacgaccattgtccttcaacgtcgtgctgttcaaccacgacggggtaaagcgcaatgagccgatcggacatttcaccgtggacgccgagtcggcacttttcaacgcgacgttcaaaagggcggaggaaggcggagaaaaggcggaatggcacgcaataatgccattctgagcagcaggggaaaggcggaaacagaaaggacggaagagccccgnggaatagactgatcggacggaacggaacccccgnnggacggattgatcggacggaacggaaggaaagaccctcggtgggacaaactgatcggacggaacgga

SEQ ID NO: 85873 - DNA, 379 bp, Heterodera glycines
  misc_feature (359)..(362): n is a, c, g, or t
  misc_feature (365)..(365): n is a, c, g, or t
  misc_feature (371)..(373): n is a, c, g, or t
  SCN-specific regions: Sequence locations=1-29,56-146,168-379
ggaattggacgaacaattggacaggcgaaaggcggaggaggagcagcagcagcgggcgaagggacgcgagtatttttgcgacatttgcggacggacactttggtttgcggacaatgtgcaggcgatcaaacacaaaaagggacaccagcaaaaggaggaggagaagccgaagcaggacgaagacggagaaagaacagatggatgaccaatagacacaccgtttcaaaaaacgagagatgaaccaataaatagggagtgcacagaaaaaaacattcttattttggcgtactatttctttgtctctgataatagagaaaaatcgaattaacaccgatagagaaaaaaattctgcatcgacnnnnaanaaaaannnaaaaaa

SEQ ID NO: 85874 - DNA, 273 bp, Heterodera glycines
  SCN-specific regions: Sequence locations=1-273
ggggagttcaacctgctctaccacctggacactgtctatgtgattgacctcgcccaagccatggacatttcgcatccgtcctcgctgcgcttcctccaccgggacatcacgaatgttttgaacttttttggtcgcattggctgtgagccgttgcccacgccgcacgcattctttcacgaagtgaccgacattgagttcgacccgaacaaaaatttgtatgttcaggtggagtctttcgagcgcgagaatcggaacatggacttgaagggggcg

SEQ ID NO: 85875 - DNA, 562 bp, Heterodera glycines
  SCN-specific regions: Sequence locations=1-32,54-430,452-562
gggacttacagttggatccgtcaattttcaaggagagccaaccacaaatcatcatgcctgaaggttatgagtctggtcggggaaaatttgagttcgctctcggttacatcggttgttcggttatcggaggattcggagttggaagtgttcgtggaatgttcggcgagttaggaaatccacagaacagaactttggcttggaatccgtggtacactcggatgctgaatgccgccactaagcatggcagcggatacgcacaaactgctgggactgccatgtttctctattcggtcactgagttggggctgaagctgtcacgagccgatgacttgcttaattcttttatcgccggaccaatcgctggcggacttttccacggattgcctcatgggctgcgtgctggcggtgttggtgcattggccggactgggtttggtcaccgtctggaatttgtgtgatcgagacagcagaagagagttgcgcgaaatcctccgattgtcttaaatacgttgttgctcaaccttctttattatagtcgttattgaataaatttgtttgaaact

SEQ ID NO: 85876 - DNA, 264 bp, Heterodera glycines
  SCN-specific regions: Sequence locations=97-103,128-264
ttttttttttttttttttttttttttggttttttttttttttttttttttttttttttttttttttttttttttttttttttttttttttttttttgggggggtttttcccccctttccccaaagggaaaaaaaaaaccaaaaaaaccgggggggggggaaaaggggggccaaaaaaaaaaaaaaggggcttttttccccccccccggggggaaacccccccgaaaaaaaaaagggccccccttggggggggggggggggggtt

SEQ ID NO: 85877 - DNA, 360 bp, Heterodera glycines
  misc_feature (309)..(309): n is a, c, g, or t
  SCN-specific regions: Sequence locations=1-8,30-306
gggaaaaattatgtgtgtgtttgcctcgtaaattagaagagtaccaactccccccccccccccttcttgacgatgcatagtcacaatcactgtttagcctgccttccaatatctgatgaatatccaatctccgccgatgttcgtttggcttttcgcccccgtcgtcggcctttaccttctcattttcaacgaaagccgtaaatatttcattcgcaaccacccaaacaacagaattgtgcgattactaaagttttaattggatacttttgtattgatatttttcaagaaatattcaaattaaaatttaanaaaaaaaaaaaaaaaaaaaaaaaaaaaaaaaaaaaaaaaaaaaaaaaaaaa

SEQ ID NO: 85878 - DNA, 151 bp, Heterodera glycines
  SCN-specific regions: Sequence locations=1-11,33-151
cgaaaggggcgggggagggaaacggagggagggcatttgccagtttaagggagtgatcagcaaattcctcctcttgcgatcactttctccttctttaagttgaagaaaggtcgcgctctcatatcacttcattgtgaagagtcccatcagt

SEQ ID NO: 85879 - DNA, 525 bp, Heterodera glycines
  SCN-specific regions: Sequence locations=1-525
gatctgatcattgaccctcagcataatattctcactcccagatcacttttgttgcaatttcactcttcaacattctccgttttccgattgccatcttcgcaatgatcggctctcaagccattcaaacagccgttagcaatcgacgcctcaaacattttttggccgccgaggaaatggagcctttgttgagagggagaccaacttctgaaatttcgataaccattaaaaatgctgactttgcctgggaaaaagatcgatctttggttctcaaggacatcaatttgtctgttcggaagggaactctgttcgcaattgtcggaaggaccgggtccggaaagagcagccttttgtctgcaatgcttggcgaattataccgcaaatcgggggaaaattctctaaacggaagtgttgcgtatgtgccgcaacaggcttggattcagaatatgacgctggagaacaatgttttgtttggccatgagtttgactccgaccgttaccaaagtgtgctcgacgtgtgcgctttga

SEQ ID NO: 85880 - DNA, 596 bp, Heterodera glycines
  SCN-specific regions: Sequence locations=1-423,447-596
gggctgctcacttctcggcctcaatgtttacttaaacgcgctgatgatgttcaaagtgggaccgaattcccagcgcaatgttttgccgtcggtggtgaagcgcgactttcacttctgccacctttgccaatcgaattcgcctccgcgttcatttcactgtccggtttgcaacttttgcgtcttccgccgtgaccaccactgttccttcaccggttcttgcgtgggtcacttcaatcagcgttattttgttgccgctgtatttaacctgtggccagtcgtgttttcatgctgcgtttggaattggcatgcgcttttgctcgccttctctccgatcagtctgtccgactttctcaaatgggtcttcccgcacatggctttgctgttccgcttcgtctctttccaccaattcttcgtgattttggcctttgccttctctttcatcactttgctcttcactacttatctcatctttgcccagattttctgtttttggcatggccaaacgcgtgtcgaatatttgatggatgtccacgcttataatttgtcctttcgagaaaatcttagcgcctgtcttggctcgcgatggcccttcattt

SEQ ID NO: 85881 - DNA, 288 bp, Heterodera glycines
  SCN-specific regions: Sequence locations=27-29,51-288
ttttttttttttttttttttttttttgccttttattagtaaattatcaaagacataaatagtattaagagcaatcaatcattttgtcaaagtgaatgtgaaaaatcacaaaaaaacaacctaagaaaataatttatttcaaattcttattttttggtccgcctattcgttcgtccgacagccaattcaattgtcagtcagtcgaggcaattcagtttgttcacggagcatcgctcaaagcggcgacgccgggcagaaccttgccttcgagcagttcaagactggcacc

SEQ ID NO: 85882 - DNA, 229 bp, Heterodera glycines
  SCN-specific regions: Sequence locations=29-229
ttttttttttttttttttttttttttttcgaaactttttctttaacacgaaacggatcaacaaattaaaaataacaattgtcggttggttttctgtgctcgtgcattcgtttgcccccataatgcctcaagcgacaatttcgaatttgacgggagccagccgctcaactttggtgctcttcactttgaccaagtgcgccccccggggctccttcggcttccgcttcagc

SEQ ID NO: 85883 - DNA, 389 bp, Heterodera glycines
  misc_feature (48)..(48): n is a, c, g, or t
  misc_feature (267)..(267): n is a, c, g, or t
  SCN-specific regions: Sequence locations=1-55,77-128,172-173,195 -243,267-389
cgggggaaatctaaacgaagaaacgttcagaaatttagttacctttgncctttgctcagctctttcaagtgttttaaaaccaaaatgcaaaatgctttacgtgccaaattggccgagttacagaacagcagacgaacaaaagaagaagaaaaggagcagcagaaagaggaaccaccacaaaaattagatttttccctcttcgacgactccgaattcgcgaatcgttcgtgggtcgaactcattgaagaggaggaggcggcggcgcgnaagacgcaaaaaacaaaagcggcgaccgctgaaacgaccgccgcgtccgctgcccctccaattgcttctgttgctgcggtcgcttcgtcttccgcttcccccagcaataagcgacgcaacag

SEQ ID NO: 85884 - DNA, 349 bp, Heterodera glycines
  SCN-specific regions: Sequence locations=27-301,324-349
ttttttttttttttttttttttttttgaaaattcaaagttttcctattgaaatattgggaaaattattaatgcacagaaatttggtaatcttttacaatccacagcttgcacttggtaatgtcatttcggctttgggcggtgcaaaaggtcgaattggtagtgtccatgttccgtatcgcgactcgaagctcactcgtctcctccaggactcacttggcggaaacaggtcggaattgcaatttcttttgtgtgtcagtcctaatgaagtggatgccaatgagacgctcagctcgttgaattatgccaaccgagccaaaaatataaagaacaaggtcaaaagtatttcac

SEQ ID NO: 85885 - DNA, 437 bp, Heterodera glycines
  misc_feature (406)..(406): n is a, c, g, or t
  SCN-specific regions: Sequence locations=1-167,189-381
ggcagacaaattcctggcgatgattgtggattcttcgaagatcaatcggttagatgttttactgcttttggtgcaaaattgggccgtttatattgcgaccttgagcatagggaccttcaggaatgtgtttcgcgcacaaaaaagaataaacggttctggaagatcagagatgttcgcttcaaaaaatggctcagaggtgaaacgccacacattttcgaaccattggctgactatttgaaatcggttcatggtgctccgacttcctatccgactggtcatcgtgtgaagaaatgattagattagatacatcgtgagattctggtttttaataggagtcacatatgcatatgtatatttctgcgcgataaaatgcttttgttcaaaaaaaaaaaaaaaaaaaaaaaanaaagggggaaaaaaaaaaaaaaaaaaaaaaa

SEQ ID NO: 85886 - DNA, 510 bp, Heterodera glycines
  SCN-specific regions: Sequence locations=30-68,98-197,220-510
tttttttttttttttttttttttttttttaattagcccttttatcaacgattaatttactcacaatgaatttcatatacatatatacataaaatacaatggaaatggacgcatttgcgagcaagcaaacgtcaaatacatacatatagacaatatttaatgacaaagtgccaacataatttcggtcacataattacaccaattaattaattaattgattcatttctgctgctgatcattcggcccgggagaagcgtcgtcgagaagaccgtcgtcgaatccgccatctttgatccgaatgacaattgggttcgttcgatttttcagtttatccttcacattgtcccattttcgctcatcccatccaatttggaaacggatgagccaaaaatcatttgctgatgattgtataagtgccaattcctccccagtcacttcgttgatcagatcaaatggcacaatgaagtcaagcggagaagacatcagaaagtaaatgcaaaaaggaaccgga

SEQ ID NO: 85887 - DNA, 275 bp, Heterodera glycines
  SCN-specific regions: Sequence locations=28-275
tttttttttttttttttttttttttttggcctccaaccctttatgtcccaaaagactaaggccgtaaaggccaaaaacagtatggaaagggtcagattcatctccaggccgatcggcgatccctcccttttcatcatcttgactggcgattatgaagtgggtgagagattcgccatcaatccaatgtaatcgttttatgatggccaatgatgcaagtacccaccaagaataacacacatcaggcagtttctcgggccgtccgcaaagtccgccgg

SEQ ID NO: 85888 - DNA, 510 bp, Heterodera glycines
  SCN-specific regions: Sequence locations=27-510
ttttttttttttttttttttttttttggaactttaaaaaatttatcaatcatttaaaaaatgaaatcttgatgcgttttttaaataatttttggttcgaaatatcattttaatctgatttcacggttcctcattttccacttggtcttcttgagaataatccgaaggctttccttaagttagcgggcccctcccaatagccattgagcaaaaacatccaataaagagaaggcatcaaatagcgcttcatcagataggcaaatattgtcggccggctttggtcatacggagaagtttccaacgcaccgtctggggaaaattcagcaagaataacgtggcgacggtcgaccaccaatggacacgaggcgtaaccatcgtactgtaaatttttgttgatctaccaatgtaaaacatttcgttcctgaatatttcaatgctttgaatagtaggaaaacactttctttttttgtagttgcgaacaaaaggctgggaatttatttacatattttcg

SEQ ID NO: 85889 - DNA, 266 bp, Heterodera glycines
  SCN-specific regions: Sequence locations=58-80,102-146,168-266
tttttttttttttttttttttttttttgcttttttttttttttttttttttttttttaattttacaaaggttatgaacaaacgcaacacaacatggctttacaaaattaggcgttaaaattggaattgaatatgccccacggataccaaatacaatacaggacatttaccatatacccgggcgtactccaaccgcggaaccctaatagaccgaatataccataccttcccctcaatgtcgccctcaaaaatcgttatcaaaattca

SEQ ID NO: 85890 - DNA, 364 bp, Heterodera glycines
  SCN-specific regions: Sequence locations=25-364
ttttttttttttttttttttttttgctggccactttttatacagagaaaattaattttctgggaataaatatagaaaaatagtgacaagaaatttatgtcaatcaaaattatgcactcaaaaaacgaaagaagaaatgggacaggcagagttggtcatcatcataatcaatcagtacgggcagggcagtccttggttgcgaattcggttggccagccacgaagtttgcaggtcgccgatgttccgccgtcggagaaaggtcactgggcccaacaaaccgccgtcggggaagaaaacactgacagcggaaccatccgaagttgaggcagcaaaggtggaggacgtggaggaagacggacactgaa

SEQ ID NO: 85891 - DNA, 381 bp, Heterodera glycines
  SCN-specific regions: Sequence locations=30-30,55-381
tttttttttttttttttttttttttttttcaaaattttataaatttttaaatttcatttttggacatcagaattgaatggttcattggcatatcgcgtggcaatcccatccattccttgcttcagttcgcatgggcattgtcgttctgtcacgccatcagcagaaatgcaaaagttgttgccactattgtcctcgagtccatgccaagaacgcattgcgaaatgatcacctgcggtatattccatcacttgtttggtgttagaagtgccacccgttgttggtccaatgccattgtttttttcctcatcggcattcgtaggaccgtagcaacggcgaatgttgcccgatgttaaactcattaatccgacatcttcatcggtg

SEQ ID NO: 85892 - DNA, 370 bp, Heterodera glycines
  SCN-specific regions: Sequence locations=26-70,99-370
tttttttttttttttttttttttttgcaaagcataatatatttgccgaataatcaaaacacaaaaagtacgtatgaattcaaaacaaaacaacaaaaggctgatgaaagatgaagtacacgtcaaaaccctgttttggaacaaaaacattgagagatctgagaatgtttggaccgtaagcgtatttaacaacaaaatgataaagatcaattgattatgtttcattcatccgccagcaaactgcgcaccaaatcattgatgaactgagtgcaaatgtgaagcgcaacgcaaaatgcaacgaggcgttcctcaggcggcaatttcattttgtcaccattcgccactccgatgacatcagaaagagcattttt

SEQ ID NO: 85893 - DNA, 269 bp, Heterodera glycines
  SCN-specific regions: Sequence locations=1-204,226-269
ggggatccaaatcaacgcggcacagtaataaaatattaaaagatccgaaaaaatgccaacattttcaaatccttctgattgtgcttttggccgtcgtctcattccgtctctcggcttctactggtgacaaaaaaactgctaatgatgggagtggaaacaactcatcagctgggattggtacgaagatcaaaagaactgtcaccgctggactgctcttcacttccctggcgacgggtggggcggaagcgattgggcgaagaatgctcagg

SEQ ID NO: 85894 - DNA, 520 bp, Heterodera glycines
  SCN-specific regions: Sequence locations=27-33,68-520
ttttttttttttttttttttttttttgcataacattatttattgttttaatgtattagaaatctatgtgtttgtgaaagacaatttttgagcaaggaatcacttatgtgcataaccggaattctgtgatatttaaaagttccggggaatcactcacacacaaagacgtgcttgaacttcgtcatcggttccatggcattctcggccgcttctttgtattcctcaattttccattttcgaaagggcggcgtcgaaagcttcccacttttataccaatcgtcaaagactttgtacatattcgcacgttcctccgaatgtccacaattgtaccatcgcgacatccaaaagccgtacaaagtgatatcattgaaaatcaacgaggaagtgggcacttggaccgggtttttggacattcctccgtaagtgaccatgcacccgccgttggccaacgctctgataaggtaaattgtgcttttcccaccgacgcaattcaacgccaattttgctccaatttttgactt

SEQ ID NO: 85895 - DNA, 527 bp, Heterodera glycines
  SCN-specific regions: Sequence locations=1-133,156-527
ggggactagaaattgtccatttaaggccaccataatctgtctgtctgaatatttgtttgcttccccaccgtcgaatttatgcaacttttggcaaccgatgattattattttattaaatctgttaaaacgattctgagatgctgccggaccacagcgaccattgcagcttttcgccattgtgaccttgccgcacttgaagatattgagctattgggagatgtttttgcatttatcgggaaaatcactgtcgatgacatttctcatcttcttctcgtctccgaatgttcggagatagccgaaattgacacggtgaatgcaacattaacacgagttgagagagtatgcgcattacctgtgttaactgatggtatgatccataagaaattgttcgacattccgtcacttgacagatttgaacgtctgaaaaatcgtccgaggaatttgcttaagcttatgtcacacaaagtgccgatcaaaaacctgccaacttcgcctaaactcatcgacgaaattatcgcctttttcaa

SEQ ID NO: 85896 - DNA, 237 bp, Heterodera glycines
  SCN-specific regions: Sequence locations=1-237
ggttcgttagcgttggtcaccgtcgctccatccgcgttcgtcgttgtcgttggagtagtcgcagcgggcgcctcagtgtcggtcgccgtagtcgcaccgggttcgttggcgttggtcaccgtcgctccgtccgtctgttgttggttgaggcgccctgctgtcgtcgacgagctctctgaacaacggcggggagggcgtaaaatgagacacggaattagttgcagcaaaaaagagggc

SEQ ID NO: 85897 - DNA, 288 bp, Heterodera glycines
  SCN-specific regions: Sequence locations=30-53,76-130,152-288
tttttttttttttttttttttttttttttgagcacctttctttttgcaccttcaacaaataaaataacaaaacaattcaattgaaactttccaaaaatttcaacagttcttcttgttccgtctgttcgtcgccgtctattcattttcttcggtgcgcagtcgggcatttccgttggtgagcacaatgcgcaactgttgggcacgctccacaatttgcttgcgctttttgctggacaccgcgtggccaatctcaccgcaatagcgtttgttctgcatcaacaacacgtc

SEQ ID NO: 85898 - DNA, 514 bp, Heterodera glycines
  SCN-specific regions: Sequence locations=1-37,71-127,150-514
tatggtcgacctgcaggcggccgcgaattcactagtgattggtaacaacgcagagtacgcgggcaattaatttgcttataagcaaagtttcctaaaatctgataactgaattgtcgttgctccgaatttgacaaaaaagaaaatgactctccagtggaccgtggttgcgttcatcctttacgcagaaatagccacaattattgtgcttcttttgccatgggttcggccgacaatgtggaaaaaagtgtttaacagtcgcgttgtgcacaaactcaaacagttttccaatgtttacgcctacgctttcatttttgtgctcattcttttgttcgttgatgccacccgtgaggtgcgtaagtacagccacgtggacacgactagagagatggtgggacgagtggccgaggcggacgccgtcgttcacatgcgtctcttcagagctcagcgaaacctttatttgagtggtttttctctgcttatggcactgattatcagtcgcatcgtcactttgctc

SEQ ID NO: 85899 - DNA, 462 bp, Heterodera glycines
  SCN-specific regions: Sequence locations=28-41,64-69,91-123,145-462
tttttttttttttttttttttttttttcaaaacggcgttaatttttaaaaatttcatttgtttacaataaataaaagttgaaggcaaaaaggaagctaacacaaaacgtatggcaaagtgaaaagggataaaccaatcacagaagtgaaaagggagaagagcaaataagtacaaaatgggaaaagtacgccttcagcgcagttcggctaacatcgtctcgggctgttccaagaactctttgaggcaattgctgaagcgcgccaaagttgcaccatcaaccacccggtggtccgccgaccaagaaaaagtcaccacatgcgtggccaccaaattgccgtttccgtcaaaacgtggaatcttacgaattgacccaattgcaccaatgaccaactgtgggggcaataacaaaggactcatgtaagtaccaccgatcgatccaacattggacagggcaaatgttcc

SEQ ID NO: 85900 - DNA, 366 bp, Heterodera glycines
  SCN-specific regions: Sequence locations=28-244,266-366
tttttttttttttttttttttttttttgcccttagcatatttacttaagcataaaactaattaatctggataataattgcaaaaaccttgaaatgtccgtcttttttttatcaccttttgcaaagtcttcgtttctccaattcacaaacatttcacctcaccgtcagtgttcttctcaatccaaccacagtaacgcgatactcgcgtgtacagtattgcaagacgattatcctttttgagcgttgaaatgcttgacactccaatctgtgtccaaacggtaccattttgtgtcagttgcataagcggtccgccgctgtcccccggttccgaattttggtgcccaatttccatgcaaactcttccgtc

SEQ ID NO: 85901 - DNA, 664 bp, Heterodera glycines
  misc_feature (631)..(631): n is a, c, g, or t
  SCN-specific regions: Sequence locations=1-664
ggggactagtgatagtccaattaaggttagttaatctcattgtcaaccatcacgtaacgatatgtctattaactgtcattctttgaacaacattgaagtgtcggatgacgaggatgacgttcaacccaacaacaaacgacggccagagagcgtgcgcaacaaaattcacgaaattgagaagagactcaatgactccaagcttgaggagaaggatcgctttaaatcaccgattacaaattcgcttaattcttcgatcgccaaaatgacccctattcgtgtaattgctatggatgacgtacaggagattttaaatcggaaggataaacgagatgcggagttcaacaaaattattgccgccatcaaaagtccggctctcgaacagcgcacgacgccgggttttaaggttacttccgctgccaaaaatccgaatcgcgaacaacacacatcaccgattcctattacgccaaccagtaccaaaaaccaaggcatgaaaagaagtgccggatacaacgaaacaattgcagcggagagccgctttcgcaaacaatacgctccaccaccgccaccgattactgaaacgtcgacttccattagcaccaaaaacgacaaagtgtttagaccagtcactcanaccgatcaaattattggatcacttttggatgac

SEQ ID NO: 85902 - DNA, 285 bp, Heterodera glycines
  SCN-specific regions: Sequence locations=29-139,165-179,201-285
ttttttttttttttttttttttttttttggattactgaaagggtatttacgtattgaaattaacaaaaatgaagcagcaacaatactttcttaaagcaaaaactcggcaatgagttctgtgactgtgctgattaagccatcccagtgtcatcgtcgtcgtcgtcctgccctttggcgcctttggttttatgccgcccaccggtttggccatgattatctgatcaatcttcagcacagaaatggccgcgttcgtcgctaatttcaatgccaacgatttcccggagt

SEQ ID NO: 85903 - DNA, 366 bp, Heterodera glycines
  SCN-specific regions: Sequence locations=104-116,147-163,186-272,295 -366
tttttttttttttttttttttttttttttttttttttttttttttttttttttttttttttttttttttttttttttttttttttttttttttttttttttttaagggggggggggttttccccaaaaaaaccccaacccccaaagttttcaaaaggggggggaaaaattttttttaccacccctaaaaacaaacaggggccaaaaaaaaacgggaaacgggccccccccctttccccccccccgaaaaccccccccggcccccaaaaaaaagggggggggggcccccccccggaaaaacccctccattttccccccccccttttccccccagagggggggggggggccccccctttttttaaaac

SEQ ID NO: 85904 - DNA, 412 bp, Heterodera glycines
  SCN-specific regions: Sequence locations=32-412
tttttttttttttttttttttttttttttttggaaattgggcaaatttaattccatgggatgtaattatgtaatattgcggcaaattattctgtttttcatcattggggcttcttttgccgacttctcttcatcgccgcttcttccctgtacaattcgtccatttttttcctcctctgcttgaacatatgtttaatgagggtgaaaccaatgaaagggaagcaaatgaagctgaaaagggccaacacaacgccaaaattgtaactgaaattgagcgcatttggaagttgcagtgaataaacgccggaagagtaaaaaaacggaacggaaatgagcaaaacgagggcctcaaggaaaaggccgagcggataaagcagcagccaaacgttgtaacgaagccaagtgacaaatcg

SEQ ID NO: 85905 - DNA, 432 bp, Heterodera glycines
  SCN-specific regions: Sequence locations=29-53,87-351,373-432
ttttttttttttttttttttttttttttggattgcttttatgcgcaaattatactgtacacaataaatacatacacatacatacatcgaacagccatatgaaatgtgggaattatacaatagctttgcccacatatatgaacattataatcaatcagaaatggcatgtcgtcgcgtttcatctgtgccgccctccgtcgattaggtccttttgattcgcacttgaattgacgtgcccctcgtgttctttttgttgttgcagctggtacagtcatgagccgaaatgccaaaatgctgcctcaaaatggacgacgcctgttccgaaagtgcattcataagtgacggcgccgaattgtttgttgttgctcctctggcgacgcacagcagttgcccgacaatgccgacgtgatgaaacaaagccatggtgaagtgc

SEQ ID NO: 85906 - DNA, 349 bp, Heterodera glycines
  misc_feature (332)..(338): n is a, c, g, or t
  misc_feature (340)..(342): n is a, c, g, or t
  misc_feature (345)..(346): n is a, c, g, or t
  SCN-specific regions: Sequence locations=1-272,294-349
gggtcgcactgaaccactcaacgctgatggaagagaaaatcattccaaaatgtggaaattgttatgattaagccgcagacggacaaggaaggcaaaacgttgggcaaaattgtgtggttagaggaatcggagttgcaagaaatcatttcgcgattgtagtcgaaggggacggattagagaaggaaaatgggctttgcactgccccttttatgattggatgaccttttgttattctctgcctttttgtgacttttcagtgtataaggcaaatgaaagcaattaattgagaaattggctaatatccaataaatgtttcaattctgaaaaaaaannnnnnnannnaannaaa

SEQ ID NO: 85907 - DNA, 477 bp, Heterodera glycines
  misc_feature (467)..(467): n is a, c, g, or t
  SCN-specific regions: Sequence locations=1-330,352-353,375-383,406-477
gggggctgctcgaatggcggcgatcgaactcttttggccgacatcgaagcatcccttgccactcattctgctgatgagtgtgccctcagcctcggcttcgtccgtgccatgttcgccattgccgcctccgcttcttcccatgccagcaacaacagcgaatggcagacattgagtgggcagtttggtcagaaagtcactgagattgactcgaaatgtgctgagtttggcattagcattggcaaagtgcccatcaacggtcccaagggtgcccatgttcaaaatgtgcccaactcggaaagtgtgatttctatgcctggattggccggctcacacacccaatgaatgctgaaccgaaataacattgcttgaaattagatgatgaattgagaagattattattatttttgatatttatttgtagttggacatgaagtagttagtgaacactctttttataaataaattanagcaattttt

SEQ ID NO: 85908 - DNA, 342 bp, Heterodera glycines
  SCN-specific regions: Sequence locations=86-206,235-256,336-342
ttttttttttttttttttactttttttttttttttttttttttttttttttttttttttttttttttttttttttttttttttttaaaaaaagggcccttttttacccccaaaaaggggggccccccaaattggggggttttaaaaagggaaaagttcccaccccgaaaaagttttggcccccccttaaattttttttccaaaaacttaaaaaatttttttaattaatttttttgcccccccaattgggaaaaaaacccccttttcccccccctctttttgccccccccccccaaaattcccctcccccccccctttttaaaaccccccccccccaaaaccg

SEQ ID NO: 85909 - DNA, 388 bp, Heterodera glycines
  SCN-specific regions: Sequence locations=29-388
ttttttttttttttttttttttttttttgtgcaaaagaaaagagtaaaaataaaatcatacgaaaatacaagaaaaaaagagttagtcatcaaaggtcagtgttaagtgagtttaaagtctgagtctttttggaggaggtgtagaagcagtcggggaaatatgaacaatttcgggcaacaaatttcacaaaatccatgccgtaggagaggcaaacttgcaacagagcctcacagtccgattgtgcccgatgaaattgcggggcaatggagaaaaacctcttgaacatgttctccagtttgaaattgccacgtccgcacaacaaccgcctggcatggttaccattgaaattccattcaccgcgattgttgctctcaaaaaatttggcgt

SEQ ID NO: 85910 - DNA, 526 bp, Heterodera glycines
  SCN-specific regions: Sequence locations=1-526
ggggatttccagtcagttgacaatgagtttgatgccctcatgatgaagcacatgtatgccaccgttcgtttcttattgctgttgactgcgattgctgccaaatcgactaactgtgctacgaatgttcaaggaactcaaactgttacaacatcagatgcaacccatgatgaagctggaaaaatttcgcgtgattcatcatcaagttccgatgaagatgactcaacaactgcagcctcacaaatgctactgaatgaagcaaataacgctttctccaaagataatgatgagccgattaaccagcagcagaaaatgaggcctgaagctaattttagcgttaaatatcttcccccgagactgaacgctgctcaaattgacatcattgcacaacgagcatcatcagtgatcacattacgcacattaaaacatgtgaaagaagttttttcaaaatttgcgccagattcatggctggaagcactggaagatattccactgccgactactcgctgcactgtcaaagtgagcgcca

SEQ ID NO: 85911 - DNA, 359 bp, Heterodera glycines
  SCN-specific regions: Sequence locations=35-49,81-114,136-359
ttttttttttttttttttttttttttttttttttgcaaccaaattttaattgaagaagaaaaacataaaaatgaataaaaagagcaaattggtcgaaaacattagggaataattaattcttccttcagagagtcgccaaatcgaatttgaaattgggcccaaaattcgcctcaattttgtcaccagagtcaagcaaagaaacgaatggataaagagaatcatcagcaaaagatggatcaacgaaaaaatcagaagtatccaaacgaagcccatttttggtgaaaatgatctgtcgagtggccgaattgacgccaattcctacggtatcaccagcaccgtataaatattcggcatttggg

SEQ ID NO: 85912 - DNA, 459 bp, Heterodera glycines
  SCN-specific regions: Sequence locations=41-96,125-140,163-322,345-459
ttttttttttttttttttttttttttttttgattttttttaggggtttagatttatctaaaaagattcaaaacaacaaatagtttaaaaagttgtggaagaaatttgttttgaaaaactaataaataaaagaggatagaataaaatctgaaaactaagcatccattctttcttcctccgttagatccatccatggccctaatgatgatgagggccgggtccactcggtgacagacgcttcgattcattgaccggcattttctcagcaagttcgcgtaggtgtgccctcattttttctaatcgatttgcccccatttcaaattgcacaggaggaggtggtggagccattgagcgattggtcacatgcgatggcaccaatccggcggcatttcctccctgagcattgcttcgcccaatcgcttccgccccacccgtcgccagggaagtgaagagcagtcca

SEQ ID NO: 85913 - DNA, 507 bp, Heterodera glycines
  SCN-specific regions: Sequence locations=26-180,202-507
tttttttttttttttttttttttttgcttattcattttaagccattgacaaaaaaggaaatgaaaataaacaatatacagtagggagtcgaggaggtaattaattgtgaggagctatcatattgacaagggatggggaggagtgatgagattatctgcatattatcatcgtttgcctgaaaacccttccgattgtgttcatgtcattctctgttcaactgttagcaattgtttcatttcgagcaaagtcttcttcaaatcctcccgaaaacgaattgaactcgtgttagtagcgcttttctttgacgaaatgtggaaagaaatttggtcttcgcccgcaacgatgtacgaaactccgtaacccgcgtcagtgaccgggccaaaaccgccgccagcactcaccagcttcaatttctgtgccatggaaatgccttcctgctcggaatcgaattggttgagtggggtttgtgaagttgacagcaaatattgaggcgggaaaatcttgtcg

SEQ ID NO: 85914 - DNA, 426 bp, Heterodera glycines
  misc_feature (20)..(20): n is a, c, g, or t
  SCN-specific regions: Sequence locations=1-426
gggactcatggggaacgganggcgcacttctcggcatcaaattccatccgtttcaatggaaaaatcgaatctccccagcaacaaaaacacgtggcgcactccgtccagattgatctgcaatttcgaggaaagcattctcaacggacgcatcccagcaaatagtgttgtcagcggtttccgtctccaacttacggtcatcggtaacggagtgtctacggacaatcgcctttcattcccggcaagcaaacgcctgacattgccagtgcttacttacttcttcaacgatttgatgtctcaacattcgggacggtttccagtggcggttccgccttcgccattgcatttggctcgctgcgagttggcggcggagaacgtccccattccgaaacggtgcacactgcaaatagtgctcttacgtccgtgcgg

SEQ ID NO: 85915 - DNA, 464 bp, Heterodera glycines
  SCN-specific regions: Sequence locations=29-99,121-166,192-232,256 -299,330-366,427-443
ttttttttttttttttttttttttttttgggtttggttatttattcttccaaaaaataccaatgagagaaaatctggtataaagcggagaagaaagggaataccttctttaaaattaaaagaaaacagaacaactcaatattgggggagcaataataagcaaacgaagaaggggggaaaacaaaacggaggaaatgcactcaaataaaggataaagctcagacgaaacatacaaaaaaccaaatcaccataaaaagcgctaattgtccatatccacgcccgtcggtgggcccccttcagtcagtgctgctcctcctcctcgtctgtgtccgtcaaaaattcgtccccatctccagaggaagaggattcgtcaaagtcgtcctcatcctcgtcgtcttcctcctcgtcatcgtcttccgtcgttgtctccccagcaacactcgaatcgtcttcatcctcttcctc

SEQ ID NO: 85916 - DNA, 261 bp, Heterodera glycines
  SCN-specific regions: Sequence locations=1-209,231-261
gggaaaatcatccaaatcaacgcggcacagtaataaaatattaaaagatccgaaaaaatgccaacattttcaaatccttctgattgtgcttttggccgtcgtctcattccgtctctcggcttctattggtgacaaaaaaactgctaatgatgggagtggaaacaactcatcagctgggattggtacgaagatcaaaagaattgtcaccgctggactgctcttcacttccctggcgacgggtggggcggaagcgattgggcg

SEQ ID NO: 85917 - DNA, 209 bp, Heterodera glycines
  SCN-specific regions: Sequence locations=1-137,159-209
ggtccatcgccgccgcctgcgccgtctccttcgtctgtttcgccctgaccggttcgctgagccgcctgctgggcgaggtcggcatggcgatcatcgtcaaggttctgggtctgatcctgtgcgctctggccatccagttcatcctgctggggctgggcgaggccattcccggcatgatctcgggcgcggtgaccacgccctatccggcg

SEQ ID NO: 85918 - DNA, 410 bp, Heterodera glycines
  SCN-specific regions: Sequence locations=70-119,142-410
ttttttttttttttttttttttttgctttttttttttttttttttttttttttttttttttttttttttacctgggattgggggttaagccaaacgcctcccgaaaaataaaaataaaacccaccggggggaaatgcccatcatattctggtactatccctcttcggcaaaaaaaacctttttttttcccccccggattttttcttcaagggcggctgccagttcggcggaaaaaacatcttccccggcctggaattccgaaggggcggggggcggggcttcctcgccctaaacagggaattctctgccaaattccccggcttgggggaccctttcattttcttcgaaaaaaatttggcgccccggttcggtacttggactttgccccgggtttgggggaaaaattccgg

SEQ ID NO: 85919 - DNA, 297 bp, Heterodera glycines
  SCN-specific regions: Sequence locations=28-149,171-297
tttttttttttttttttttttttttttggaaccaattttatcattgaattcatcaaaaacaaaagaaattgaaaaagaaattgatgatccattaatcaaaagacacaacatatatgcacataaacactgcttcatcggcgccggccaaagctgggcggtggcggcggcggacctcccattgggcccatcatcagaatggcacgttgttcctgcggcaatgtcttgacatactcctgcagttccttttgcttgtcggcccatgctttgttggtttggcgattgatctgcttcagacgg

SEQ ID NO: 85920 - DNA, 286 bp, Heterodera glycines
  SCN-specific regions: Sequence locations=1-286
ggggaacaatgctgaacatctcgtcaccaaatccaatcgcggacaaagaagtgctcaacggatttgaggatttgtacgaggcgtttgtgcacttttttacgcgtggtgcgcctgccgagcgatgtatggtcaatgacgcggcctttgaccggatgatccacaccgttgaagacaaacatctccgtgcacagcattatattggtggcaatgccgcattaatggctcagaaaatcgcctcttcgttccccgctgcaacggcttatttggttggtccgattggcccgcg

SEQ ID NO: 85921 - DNA, 425 bp, Heterodera glycines
  SCN-specific regions: Sequence locations=45-124,154-154,238-243,276 -425
aggctccactcctggtggtgcccttccgtcaattcctttagtttagctttgcaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagt

SEQ ID NO: 85922 - DNA, 698 bp, Heterodera glycines
  misc_feature (585)..(585): n is a, c, g, or t
  SCN-specific regions: Sequence locations=1-54,76-82,107-563,585 -673,696-698
gggagtggggcatcgttctgaagagaagaaaaaatgacaatggtaaaggtgcgaactttttacacatttatttataaatcactgataaaaataataacactgaaattttcgcatggaaaataaatctcattattagtaaaatttataatttgccaaatgggcgcgacttcgtctcggagtgtgtccagcagttccttcaatccgctgtcccctcctcccactaattttgcgcatcgactcgcgtcatccctcgcccgtcctttcagtcccattctgttcaatgccaaggctcgcctgaacaatgctttgctgttgttcgcttctcgcttcaacgctccacaggcgtccatgtacgctttttcaggaatttcctacttcaactttcccaatgtatcattaccaatatcgcatcatagtaattggtgattcgactgtcggaaaaagcagcttacttcgttatttcactgaaggcaaaaatgctgaaataagtgatccgacagttggagttgatttttacgctcgaatgattgagaccaaaccaaattatcgcatcaaattgcaactatgggacacagccgggcaggnaaagtttcgttcgataacaggtcgtattgtcgaattccgtcggagtattgtcgtctacgatatcacgaacagacgcacttttgagcatgttgttgattggatgactgaagcag

SEQ ID NO: 85923 - DNA, 310 bp, Heterodera glycines
  misc_feature (59)..(59): n is a, c, g, or t
  SCN-specific regions: Sequence locations=1-137,159-310
gggcgtcgagcagtacgccttccgtgccttcgccgatgctttagagagtattccggcgnctttggccgagaactcgggtcttccgccgatcgatacgctcactgaactgaaagcgaaacaaatcgaagcgcaaaacccgtggttgggcgttgattgtctgcagacgggcaccaacgacatgaaggagcagggcataatcgaaacacttctctcgaagagggagcaaatctctctggccacccaagtggtgcgaatggttctcaaaattgacgacgtgcgagtgccggacgacgacgagcgcagcttcgca

SEQ ID NO: 85924 - DNA, 434 bp, Heterodera glycines
  SCN-specific regions: Sequence locations=27-27,49-434
ttttttttttttttttttttttttttggcagagattttatacataaatggaacgcaaatacatacaacatatacagaaagatacaaatgaaacacttaggcgtttatgtacaaacaaaggcaagtgttaagtcaagacagagcatcagaatttgcatcattaaccgcagaagcaaaccacggcaaattacgaacatcgaagatactcggacgatcatccggctcaaacgtcaacatattgtcaatggtgcagcgacaatgctcagtgacgctcatttgagaagggaatcggtagcgccgacttcgctgtgccctctacaagatgtgccgtgctcacatctccacggaagggcattctgttggtgagcatgacgtagccaacgatgccaagggaccaaacatcggccttaaaagggtcgtagtcagtgctttgca

SEQ ID NO: 85925 - DNA, 267 bp, Heterodera glycines
  SCN-specific regions: Sequence locations=1-243
tggtcgacctgcaggcggccgcgaattcactagtgattctgttgacttttttttgaatgagttcgtaatgtctgatggaaatacatttgtcacatattcggctaacccactgagaatttactgggcaatgttacagcatcggtctcaacttttgtggtttcgatatttatatttggcaatatctcgatatatttatgtaaacaattttgtcgttataatttaataaagcctggtttcttttccaaaaaaaaaaaaaaaaaaaaaaaa

SEQ ID NO: 85926 - DNA, 335 bp, Heterodera glycines
  misc_feature (316)..(330): n is a, c, g, or t
  SCN-specific regions: Sequence locations=1-3,32-180,205-335
agacggcgagggaagaggaggaggaggacgtaacggtggaacacgtgtgcccaaagtgcgagtggaccacggcgacttacaccacacaacagacgcggtcagcagacgagggacagacagtgttctaccaatgtgtgcgatgcaaacaccggagcatcgaatattcatagagagagggcgaagatcagagaagagagacaaagaaagggcagacggacggacggacaaattgccacgcttttgagtctgtcgtctacgacaatcgcacaattttctttgactttttattggcaaaaaagttgttgagttgcgaaannnnnnnnnnnnnnnaaaaa

SEQ ID NO: 85927 - DNA, 461 bp, Heterodera glycines
  SCN-specific regions: Sequence locations=29-165,188-208,230-279,302 -461
ttttttttttttttttttttttttttttgaatggttaacaaatttatataacaggaagaacaattgcatataatgtcacctcacgaaaaggtaaatgtaatatttaccaagcctcatatttaatatttcttaatgtttgcctggccacataattaatatcccacgttctgcaaatatttgtccaaatcgggcacgttattcttcagcaaactctctttgactttaatggattcgacggcttgacgaagaggccgctccaatgttttcagagaatgttcgtccaattcttttttaaaaaactccataatgtcctcggccatggcattcgaacagaaacccgaagtcacgcagtcaaagcaatgcaagaacacgttgctgttgacgctgccgtacttctcgatcaaaagtgcgaaattgtttttgaaaaagtcccatgcgaaatgtccacagcacgccatcgg

SEQ ID NO: 85928 - DNA, 515 bp, Heterodera glycines
  SCN-specific regions: Sequence locations=1-515
ggggaatgcaatgtgcctacaggttcaatgtggcaacgttaaattgctggcttttaccacacccttggccaatcggaagcaaacacaaacaattccgtttgcaaaaattaatcgacgaactgaaaaattcgcgctttgacgtcattgctttgaaagaagtatggagcgaaaagatttttcttcaaatcgcccatgaactcaatggattttttccccattcacattatttccacagcggatttacgggtagcggcacgtgcgttatcagcaagcatcccatagtttcaactttactccataggtattccctgaatggctttcctcatcacgtccaccgggtgactggtttggcggcaaaattgttggaatggttgaaataatggtggagcagtatcgcgttgcattttatacgacacaccttcatgccgaatacaatcgagagaacgatctcttccttccgcaccgcatctcacagtgttttgagatgtcccaattcatccgccatacctcccgag

SEQ ID NO: 85929 - DNA, 290 bp, Heterodera glycines
  SCN-specific regions: Sequence locations=28-290
tttttttttttttttttttttttttttggtgcattgtggcagccaatttgtgccgtttgccccacggattttgcacaaaacgacggcgccggcgcgaatcgtcttcccacacatcgagtttccagaagattttctttttgtcgtccggtgatgaccatgggccgtgcgggtgggtgagaacggcaccaatcttgtccaatgtacgcgacgccaacacaaactcgcgatgttttgaagcgaccaacagctgctcggacaactgatcgtcgcccttcctgttcgtcagctgt

SEQ ID NO: 85930 - DNA, 289 bp, Heterodera glycines
  misc_feature (251)..(251): n is a, c, g, or t
  SCN-specific regions: Sequence locations=1-289
ggggatgactgattgtgagcatcactccgtgcccccgtccgcccctcccgtcgacttttgtccgtcttcgccccctccgagttatgcttcctctcccacggcaccgccgcaacaatgccaacgacggacagcagcaaaacactgcaaaaggctgctttttaccctcgtgtaaaaatgccaaaagagcgacaaaagagaatgacgcgggcggcactgaaccatcccagccgacttcggccgctgtggtcgtntcaacggccaaagacaaagtgaccattctatgccttgg

SEQ ID NO: 85931 - DNA, 372 bp, Heterodera glycines
  SCN-specific regions: Sequence locations=26-29,51-109,133-210,232-372
tttttttttttttttttttttttttggcaattttgttttatttaatttaaggcacaacatttaccggcgattagaattaaatagaaagtcatatgaaaattaatggtcgatgggcaaaataaacaaataaaattagtgtccatatacgaagctattcagagaagtgcgaatgaaacggtcaaaatgggataatgctaggcacatttaaggggaaggcggggggaggagggaaacaccgtcacgacagcgagcagtccatcaatttttagtctaacgaaggtagtcgccaaagtcccggagaagggccaattgctcgttggtgatgataaagtggagccggtacttctcgcgcagggcacacagcttctcggt

SEQ ID NO: 85932 - DNA, 460 bp, Heterodera glycines
  misc_feature (141)..(141): n is a, c, g, or t
  SCN-specific regions: Sequence locations=1-60,83-460
gggattcaaagaatttttcattttccaaccaataaaagatggcaataattgcgaaagtgtttccccttctccttctgtttctcatgtcaatggcttctctttcattttgcgcgaattggccaaaaaataccgtccctttgnagacttatgtggacgaatcgctccatctccattgcaaattgtgcaacaaaatcgccaattcagcttcggacggagccaaatggctacagaaatcggaggagggctatgtgtctctgctgaagttttgcatcgacgaactgcgcaacagcgacgaacgcagccaaacattgccggctgaggagggccatcaccaatttctgttcgcgtgccacggattcaccgcagacaaacgaaaattgagcgaaacgattggggcgatagcgaaaaaagaagccgacttctgcaaggagcagaaatattgccaaatgttttgatgtgt

SEQ ID NO: 85933 - DNA, 377 bp, Heterodera glycines
  misc_feature (359)..(360): n is a, c, g, or t
  misc_feature (368)..(371): n is a, c, g, or t
  misc_feature (377)..(377): n is a, c, g, or t
  SCN-specific regions: Sequence locations=1-377
ggggccgcacttcgttgggccgacaaaaaatgccgtcaaaatggcaccgaacgttccgctgagaatcgtcgtgccgtgcttggcccggcactgttcaaaattcgttttccactcttcacaaaagagcaattttcagagaaaattgttttgtccggcgtgttgactcatcgcgaagtgatcagtgtgttcctttaccattctctccccaccaaacgctctgcccaaatgtttccgttgcaatttgccgccaaacatcgcgctggccatcacgcttattcggcttattacgatgatggatattactagcatttcttttcagaagtttattgtgttgaaataaaaccaagtctagcataggnnaaaagaannnncaagan

SEQ ID NO: 85934 - DNA, 613 bp, Heterodera glycines
  SCN-specific regions: Sequence locations=1-560,582-613
ggtcggtccagtcaaatcagtgccgatgagcttcaacaggcgctgtccaatggcacatggaagccgttcaacccggagacgtgccgaatgatgatttcaatgttcgactcaaacaacgatgggggcatcaattttcaggaattcggcgcactttgggagtacatcaacgattggacgcgcacttttcgcactttcgaccgcgacaacagcggaaacatcgaccgcgacgaattggtcaatgcgttgacccaattcggttatcgtctgtccggcactttttacgatatgttaatgcgcaaatttgaccgaactcaaagcggtcgcataaacttcgacgacttcatccaactttgcgttgtgctccaaacactgactaccgcttttcgagaaaaggacaccgaccgggacggatggattcgaatttattatgaggaattcctcgccatggttttctcgctgaagatgtcaatgatggctaaacaatgagcaaaagaagggggaattattgactgatgaggatttgctaatacagtaacccacttatttttgtatgttttctattaaacattatttacatatcactttcaattttacgacatttttgtttgaataa

SEQ ID NO: 85935 - DNA, 308 bp, Heterodera glycines
  SCN-specific regions: Sequence locations=27-308
ttttttttttttttttttttttttttgcgaaaggctttaacctatagatttttttcaaaaacaatcctaacaataattggacacgcaataggacaataaggcaaacagaaagcaaaatttgtggggcaagagaaataattaacggactgaagaaaacaattggcgggggggggggggcatccgtcggtgaaatgtttgttgaggcataaatggaaaagggaaggaatcgcatggccaatcgcatcacaatcagtaggggcaccagacattcttctcacgaatcgccttcttttcctcctccgtcaacg

SEQ ID NO: 85936 - DNA, 512 bp, Heterodera glycines
  misc_feature (477)..(477): n is a, c, g, or t
  SCN-specific regions: Sequence locations=1-137,159-512
ggggattccttcgtcgccttcgttttggacactttcgacggactttccctctcaccactcttttcactcacattttgcaactcggcactgatttcttggccactttggtgcatattccgctcgaacaacaacatcaaagtgaggaggaggacgaagagaccgacgaaagtcggcgattgccattgaaacacttccgccgctttttgcacttcgtcctcagcttttggcacagtgtctcgccgtcgttcgccccctcccctccactctctcatcactctctcaatcttcccctttcgactcaatttgactttgtccgtctgcttgtccgttgtctccaatatttgtgcatcatttggccaactgtccatcgcactttccttccctctgccgccgatcagtcgccgctgattgaagacgaagagattgtgcagcaattgatggagcagcaacagaaccaactgcaacttgacgaagacnaggccgagcaaagccaattcaatgtcacactttta

SEQ ID NO: 85937 - DNA, 508 bp, Heterodera glycines
  SCN-specific regions: Sequence locations=1-276,298-508
gggggtcaaattttcaccatttctctggacttggccgacggaaacggagtccgggttcgcttctcatttgggagtgtgagtccgactccgtggtacagtgtgcgttatcctccgtataaatcagacttttctctcgtcatcgaagtggacaaaaaggcggtgttgaggcggtcgtacgaagaaacgcgtcttctcaaaagtggatggactgcggaagaaagagaggcgcaatgggacagtggggagcaaagggcggaagtgaacatcggactgaacacggagctggttaagggcgagtgtgtgatgtgccttgagccaaacagcgacacacttttctacccatgctgccatttaaatgttcacagaaagtgtctgagagacgaaaatgtggaggaatgctacgcctgcagggaaaaatgcgaggaactgatatccatccgacaacgagacatcgactgccagttctgccatccaaacgaatgccgtgaattcaactcttttttctacc

SEQ ID NO: 85938 - DNA, 393 bp, Heterodera glycines
  SCN-specific regions: Sequence locations=1-393
gggctgcccaccgtttgctgctcattgtcggtgctccaattggcgtcagtgttgcgcatggacaaataaacgacacggaaaacaacgaaatcagtgccgggaaagaattcgtggattaccaacgcatttacacggaaccaattggcgatttggacagtgctcatgcaattcttggtgaattgccatcgatggtctctttgctgttggaaacatctgatgccgttgaatctgaggagttgcgctggaacgacttggaagtgttcaactgtttggagatgcttacaacatttcccgagccttgggtgcttcgcaattttgccgctttgctcataatggcccctggcctcgcccgtgtggcggtgcaaacgcgcgcaatgcatggaaatcctggcg

SEQ ID NO: 85939 - DNA, 297 bp, Heterodera glycines
  SCN-specific regions: Sequence locations=29-85,114-129,152-297
ttttttttttttttttttttttttttttgagggggttagatttatctaaaaagattcaaaacaacaaatagtttaaaaagttgtggaagaaatttgttttgaaaaactaataaataaaagaggatagaataaaatctgaaaactaagcatccattctttcttcctccgttagatccatccatggccctaatgatgatgagggtcgggtccactcggtgacagacgcttcgattcattgaccggcattttctcagcaagttcgcgtaggtgtgccctcattttttctaatcgatttgc

SEQ ID NO: 85940 - DNA, 248 bp, Heterodera glycines
  SCN-specific regions: Sequence locations=1-248
gggattcattcactcattttgaaacaaagccacccatttaccaattacacctttcaccttctacccccaccaagtccaaaaaccaaaaacaagtcatggaacgcactttcgtctgcattaaacccgaatccgtccgaaggtgcctcgtaggaaagatcattgaacgctttgaagccaacgtctttcggctaattgccataaaaatgatcgttgcaactcgcaaacaagcgatggaccattacgtcgct

SEQ ID NO: 85941 - DNA, 471 bp, Heterodera glycines
  SCN-specific regions: Sequence locations=1-20,42-378,468-471
gggcagatggacaacattcggaaggagatggtggaggaggaaaaacgggagaaggcgaagcaaaaacgtcccaccaccggcaacactccgaatgcgaacaaaaagaaattggctgacgaaaagaagaaagcggtgcaccgttggttgaaaaatcgaaacacataaattaagaaacgtaaacaaacaaaaacgatatatgttgttacttttggacaaaatcccctgtaaaccttacacagaacgatcttccatcttcgtcctttgcctttttggctaatctttcgcctcctttcatctttgttatttttgttgtttaatttttgctattttctaaggcatttcagttttgtatgtaataccgaataaataaacttagttaaaaaaaaaaaaaaaaaaaaaaaaaaaaaaaaaaaaaaaaaaaaaaaaaaaaaaaaaaaagggaaaaaaaaaaaaaaaaaaaaaaaaaagggc

SEQ ID NO: 85942 - DNA, 598 bp, Heterodera glycines
  SCN-specific regions: Sequence locations=1-4,109-397,423-598
gggggagaaagggagagagtgagaaagaaaagcaggaaaagggtgaggtgaggagaaagggagagaaagagagagtgaggagagcagagagaaaaggaggaaaagagatggagtaaggcccgttatattgcggcatgcattgacgagatcaaagtggagctacgccaggactccatttttgtgaaggcaaatgccatcgaaaagttggcatatttgcatatgctcggctacgacatttcatgggcagcatttaacatcattgaagtgatgtcgagcacgcgttacagcgaaaaacgcattggttatttggccgcggtgcaagcattcaatgacgaaaccgattgtcaacaatgtcaccgccgttttggacgcaatgttacgcatcaaattatccgttgtgcccggcccgttgctcagcgtgttcgtgcaaaacattgccaagctgtacaccttccaactgtgcaaattggaggcggacgacgattgggacagaattgaaacaacaaaaaacccaacccgtcatgcagaatttgtagcaattgacgaagccgatgaatggtgcaaattgcacaacaaaaatttcactcaaatcatgagg

SEQ ID NO: 85943 - DNA, 426 bp, Heterodera glycines
  SCN-specific regions: Sequence locations=27-115,138-426
ttttttttttttttttttttttttttacttgaacgctttatatttttcatgataaaatcacattaaagacgagccatttgcaaaaatatcgacacagaaaggttatgcacgattcgatgcttgatcaatcatcgattgtaaggtctctgaaaagagggcccatcgattcgttgttataaatgcggcgaatcgcttcactgagcagcaaggaaatgtcaacggtttttatcttatggcaacgcagcttttgcatttcgtgtggcacagtattcgtaacaattatttcgtcaattggggatgactcgagtaaggaaggggcgtcgagtgacattaacccgtgagtcgcaaccacgtaaattttgtaggcaccacgcgcttttaaaacttcagctgctgccacaaaggattgtgcatcgtcaataatat

SEQ ID NO: 85944 - DNA, 644 bp, Heterodera glycines
  SCN-specific regions: Sequence locations=1-8,30-644
ggggaatattttacgcagtttttgcaacaaattgtggacggttcgcgccctttgcctccttcgcttttcgcccattgccgcgtccttccattgtctttttgtgcccagaaaaacagaaagccaaaaatggaggaccgccaccttttgctgccatcattggacatcgtcgagccggaaatttcgcaaaagctttccaaaaaggtcgacccatcggcggcacttttcgccgttttcgacgggcacaatggcgccgaatgcgccacttttgcgagtgcccatttgacggagtgttttttggacgcttttgcccaatcggacgatatcgaaaaaatattgaatgacgcatttgaacgactcgacaaacgcataacagaaaaatgcacgagtgagaacatcaaaagcggcaccacggttagctgtgtttatttggagggcacaacatctgcttatttggcgtggtgtggggacagtgcaattgggcttctcactgacacggcggtggacactttgtcgacgccgcataaaccagaggacaaaggtgaaatgcgacggattgagcaggcgggcggaatggtcgtgtccatccacggggtgccgcggctgaacggcgttttgaatctttcgcgttcccttggcgatgtgat

SEQ ID NO: 85945 - DNA, 354 bp, Heterodera glycines
  SCN-specific regions: Sequence locations=1-73,112-270,293-354
gggatttgtctcaaattgttctactgttttgaccctcagaaaatattttaacaaaaactatccacagagtaagtaatattttattttattttaaatttttattatatatttccatcgcaattcgatgtttcttttttaaaatttgactccatttgcctacttaatttatacacttatacatcatcacatgttgtttttgcagacgctcgatcactctcccgattgtccactttcgaactctgatcgctcttggtttctaatccgagtactttgtttggattttgtgttgtgttgtgatttctgtttcatgatgaagaccattttgtcatcattttccccctttttttatttttg

SEQ ID NO: 85946 - DNA, 516 bp, Heterodera glycines
  SCN-specific regions: Sequence locations=1-123,153-277,301-431,454-516
ggggagaatttaaaaatcataaaaattcaaactcatcaaattcactcaacatcatcaccaaccgtgaacattatgctgaggattgctctactcatctccattttggcactgtttggtgattgcatggacaagggaaaaagaaaattaggaggaatcagtattaatgagccaagtgaatatggaaccaaagaaaaagaagccatcgcaacaaaagaaaatgctctaacatcaaaggacccgccgacatcggcgggtggtcaaaatgaagcaatcccttcaccaaaaaagccaagccccaaggggaagttgaaaagcgattttggcctaaacttagccaaggcttttccacggccggttccgaaaggaaaaaaagttgaaaatacactatcatcaaaggactcggcatctgaagctcacaaagaattggccaaagagaaaaatgaagaaaatgcacagacctcaaaggtcccgacatcgatggaaaggcaaaatgaaccaatcccttcaccaaaaaac

SEQ ID NO: 85947 - DNA, 568 bp, Heterodera glycines
  SCN-specific regions: Sequence locations=1-21,43-117,139-568
gggatatctatcatattttcatttaaattatcctcccaaaatgcgcaccattctcttcatagccatggtttgcttggtgatggctgtcctaatggaaatggcaaattcaaaggctgtcaaaaaagacaacaaaaaaggagcagtggcggcatcaccagcaaaaggaaaagcatcgccaaaaggaggcaaaagcccagcaaaaggaaaagcggcaaaaaaattgaaacctaaaaaggatgctaaaggcattaaagctaaaaaagcaaagccagcaaagaaaggcaaagcggcaaaagcagtaaagggagcgcctaagacagtcaaaaaactcgcaattgccaaaacagcacaagcaaaagacaaaaagtcaccagccaagccaatggttctaaaagcagtgccgccccaccaaatgcatttaatgaatgagaaagttcaaacagctgtgtctccacccgcccatgctcgttcacttgcgaccgttccttacagtacaccggtggcagccgaccgtaactcactgccatcgtacacttcggatggcaccaatttggacatggcccatgag

SEQ ID NO: 85948 - DNA, 152 bp, Heterodera glycines
  SCN-specific regions: Sequence locations=92-152
tttttttttttttttttttttttttttttttttttttttttttttttttttttttttttttttttttttttttttttttttttttttttttaaaaaaaaaaaaattttttccaaaaaaaaccccccctttttttaaaaaaaaagggccaaaa

SEQ ID NO: 85949 - DNA, 312 bp, Heterodera glycines
  SCN-specific regions: Sequence locations=1-312
ggggtggtcaccaatgttcgcattgtgtacgaccgcgagaccaatcgcccaaagggctttggcttctgtgaattccaggaccaacaaggagctcagaatgcggttacaaatctgaacggagccgagctcaatgggcgtgcgctgcgtgtcaattggaccaacaaataagaaggttgtgcttgaactggacggatgatgatggatggattgtcatttttgaggatcgttttgacaattttcatttttctttgttgattggttttttgaaataaaggaatggttcgccggacgaaaaaaagaaaaaaaaacaaa

SEQ ID NO: 85950 - DNA, 228 bp, Heterodera glycines
  SCN-specific regions: Sequence locations=24-85,107-228
tttttttttttttttttttttttccaacctttggtattggtccgtgccaaaacctttaaggcttatgggaacaaaccaaacctttcccgggggaaatttaacccccttaattcccaccaccggggaaaaccatggactggtggcccaaaggccaaaccgggcccccaaacccctccttatttccatttcgcctccgccggggggttcctttccaatttggcccttttt

SEQ ID NO: 85951 - DNA, 357 bp, Heterodera glycines
  SCN-specific regions: Sequence locations=32-50,78-193,217-357
tttttttttttttttttttttttttttgtttggaatacgggattttatcgaaaataatttaacaatgaaaatgccgacgaattccaattcaatttttttccccaattttttttcttttttttcggtcactttttatttgcatttttttgataaatattttgtttcttattattctcattggttttcaattagcgctggctttctttcttttctttcatccgatttcattcgctttttttcgcttcgattttttcccctcccaccgccacgtctttgtagaacaaattgccacgttcgttctgttccgcctcgatgctttcaaataacgctttgaagttgccggcgccaaagccctgg

SEQ ID NO: 85952 - DNA, 546 bp, Heterodera glycines
  SCN-specific regions: Sequence locations=1-166,188-546
ggggactagtgatagtccaattaaggtttttacctgtattaatggatgtccatgacgaggaagttgaaattattgggactaggtcaaatgagaggcaaatggaccgggcccatcgacaagaacaacagcagtgtaaaaattttactcccaacaacaaatgtctgaggaaagtgaagaagcattgttttgcatttctaagcatgacgttaaagaaataagccaagtggtcaaagcaatggcattccgaggccattgcacattaaatgtaagcaatgagggcattcgcttggcagttgacgaccaacacaatcagcaaggcagtgcctacttcagatccgagcacttccaagacttcaactttcgtacccaaacatgcagcattaaaataccgatgaggcctcttatggaagcactgaatatgttttccggtacgatgacaatggtgcaaatttcgtggaatggcaaaggctttccattgctcgtcattttggaagacgaaggagttgttgtccacaccgaaattcgaactttgatagcgcccgagat

SEQ ID NO: 85953 - DNA, 480 bp, Heterodera glycines
  SCN-specific regions: Sequence locations=1-136,158-480
gggaagcgaattttcgtcccgcgggcacaaattggtgtcccccgttgctgaaacgccggtcggtcgccttggcctgtcaatttgttacgatttgcgctttcccgaactgtcgttgtaccagcggaacagaggggcccaggtgctgtcctttccctcctcattcacgctgaacactgggctagcacactgggagccccttctccgcgcgcgtgccatcgaatgccaatgttacgtggtggcagcggcacagaccggcaaacacaatgacaagcgaatttcgtacggacactcaatggtggtggacccgtggggcactgtggttgcacaatgcacggacagagaggacctttgtttcgcggagttggacttggattatgtggaggaagtgcgtacgaatatgcctgttttttctcaccggcgctccgacctctattcgctgcactttaatgagtgggatgagccaaaagactctgacacttt

SEQ ID NO: 85954 - DNA, 478 bp, Heterodera glycines
  SCN-specific regions: Sequence locations=1-257,279-478
ggggacaagaaattgtccatttaagatgtacataatatattaaaatcgtccgtggtttttacggttggcttctccgttccttggattggattaaccggcaaattttacaccgactctctctctctgctcataatcgcgaggacatgataatcgaaaagtttccagcagatcgtcaccctggactgctccagcgtttgaacgaattgaaacggagcgaaaccgtttacaacggcggagtgttcatcttgttcacaattccttatcgatattatgaggactacgcgtccatcactgtcaaccaagcagttaacgacatcaacgccatggacaagacgggcgttttgcagaatctgaagattgcgtacatcgaatgcaatgtcggatattggcacgagtgggacacgacgaagaaagagccgaaatccatcttcaaaactgacgagacgttgggcctgcgacaattgccgacgctgctcga

SEQ ID NO: 85955 - DNA, 470 bp, Heterodera glycines
  SCN-specific regions: Sequence locations=27-152,174-470
ttttttttttttttttttttttttttcaccgcctcattgtttatcataacactcgcaaagttaatataaacagcaatggttatacatacttataaaaacatcaaattacaataatccacaattaaggaatggaataattatcacatctgtttgggggatgaacaaaaagaggggacacatttatacaacaatgaaattaatttgatatgatcgcactccgtctgcgcctgttcttttacacgaagccgaatttggacgatggggctcccttcttggtaatgttgcccgcgtatgcgcttggtggtcgtcccatgcccgtggacattccgcctcctcttcgtaccctgtgcaactttcaccacagggaggcgtcttcggaaaatcattatggccaacaaaagtgccttttttcttgcatcctttgctgtcctctttgattttgaattgctccttgcactccttgctgttaa

SEQ ID NO: 85956 - DNA, 526 bp, Heterodera glycines
  SCN-specific regions: Sequence locations=25-526
ttttttttttttttttttttttttgtaaaaaacaaatacattttttccaatggcataattagaccaaacaatttttaataactaaagaaaatatttaccaaaaaaaacccaaaaagaaaaaaagactaaaaatccaaaacagaatgaattatgggaactcgcttctcattctctcccgttctcttctctcatcaatgtttgggcttcttcccgcaacatgcccacacgtaatttttgtcgcaacaattgctggccgcgtagccttccgactttacacatttggcccaacttttgccatccttgcacttgcaatttgccgatgttttgcacagttgtttgccggcccaatcccaagggcatccgccgggcttcactcgccctccctcttccgacgaagtgacaaagagcagcgcaaaggacagggaaagagcgggcacaagaagcagcgattgaggacggagaagggacattttgcggattgacagatgaagcgaatgatcggatggatggctttgcttttgaggga

SEQ ID NO: 85957 - DNA, 485 bp, Heterodera glycines
  SCN-specific regions: Sequence locations=44-485
tttttattttttttttttttttttttttttaatttttatttttctattattgtacgacataacaacgactcaaaaaataaacaaaaacaaatcaaatcatcaaaatgtctcatcatctggtcaattcaaccatcatcgccaaaattcgttttctaattgcctcactcgcattaacgcaaaattgcgccttgcttggagagcgggtaaatgctttccaagttcaccgaacaaatacgtggagagcgcgtcccgtcggggaaaagtgcaccgccggtgtagtgaagacagccagtcaaataaacacgagtgccccgttccacgtttttctccacgtatttggccatggagccgaatgcgacaacactgtgcacttccgtgttggtcgttgtggtgccatcgccaagtcgacgctccacatttgtgtacaagttgaaagaggcaaaagcggggccttgcgcggtctgttttaccaatggctgactgcc

SEQ ID NO: 85958 - DNA, 557 bp, Heterodera glycines
  SCN-specific regions: Sequence locations=1-557
gggactccgtcatcacgtttcttcgttacaacaagcaaatttttgacaaaggcatcaatttgcgtttggatgttcatttcttgtataagaatgccaaggatgcgcagccaatttgggatgtttttgctcgtaaaatctggcccattgttgtgccaaacattcgccatttggccttttccgaagctgatcacctggacaatatgcgtcgtcgcatttcgccaacaattctcaccgatctcgatcaattggattcaatcgattacgaatatttgttgcccgatgcaataattagtgatgatgggccaaatgcaactgcgggccaagcattggccaaatggttgaacactccgacaacaaatgggcagccaaagcaattccattgtgattttatgtcagcaaccattaaatgggtcaacgctttcaaagaggcatttctccatgccaccacttcttcggccaattatataattcgacttgcactaattgatgaagaaacgccaattgagtcatttgaattggtgaatggacggaccaacgaaaaagctgacaatggagaa

SEQ ID NO: 85959 - DNA, 570 bp, Heterodera glycines
  SCN-specific regions: Sequence locations=1-570
gggcgagtacttttggaacgaaatgaaatttggcgggatgtgagaacggatggccaaagaagcgccattttggagaaagcgaacaaaacccaacgcattgggccagcatttgctgcactcattgcgaaaatttgttttgccgcttcaattgacccctccgacgatggcttttccttcaaagaccgccatggcttctctctaatgttggctaaattggctgagctgctcgctgaggacactggagaaagttgcaatttgagtcggaaaacaatttttgagttgttgggcagcagttcggaatggaatttgggcttaattggtccattgcttcccaaatattcgttttttatgacaaagcgggcttctcggagcttctccgttcgctctttccatcgctcattcgacgtgatcatcagccgtgtgccgactcggccatttcctcctttgtcgaagcattgttcggcactgactcattctcggagaccatttcccgggcgtttgaccagttcattccacaccttttggattcccgtctttcggcacgaaatttcttctgtaccttctgcaaaa

SEQ ID NO: 85960 - DNA, 535 bp, Heterodera glycines
  SCN-specific regions: Sequence locations=1-301,323-535
ggggtttttttgcggtgttgttttaaaaaaaaaactttttcggcgccgataggcgccgcaattcgactgaattcaattaaacgtaaatacaatggaaatatttgacgaatttattgttgttgacgaagaagctatcggtcaattccgtggtgcgtttactggaaaatcttcacattggaaaatgatcagatttgttaaactggaattcacgattgtgacaaccgactttaacaaagtattgaaaatcgcggacattggcaatgcttcttcttccaatccgttgaatgaggagccattggcacaaattatccattggaattgggacaaaaatgggacgcaacaaatcagtgaaacaaaaacattggacaagggcagtgaagttaattttgccatttttgacgatacttcatcatttgtaattcgaattctcaaaaagcgggagaaaaagtcggaggagaaacgaaatactttaaccaactttccggcgccttccgacagctcacccgacgacgatttgaccgtgaaaattggtgaa

SEQ ID NO: 85961 - DNA, 368 bp, Heterodera glycines
  SCN-specific regions: Sequence locations=30-215,237-368
tttttttttttttttttttttttttttttaagaataaatcttttgtttgtgtgtacgcgcattaacagaatgtgtgtgataaagataagtgtcaacaaaacaacttttaaatagagaacatcatcagcgtcactaaacaattgtcattaacagcgtccaatggtccttcagtgcatggcattgtcctcctcttccgactgttcgtcccccatttcctcctcgtcatcgaactcgtcatattcgtcttcctctgccgcctcaccagtgaagaaaagcaccgcacggggaatcagctgttcacgaatgatctgtccaacctcgaagtcatcattggttttctgttcctcgatgtcgtccatttcctctgt

SEQ ID NO: 85962 - DNA, 293 bp, Heterodera glycines
  SCN-specific regions: Sequence locations=28-36,66-293
tttttttttttttttttttttttttttgccaatggattacacatatacatacatacaatatatattaagcaaatgcgattaagatgattaaatcggtgtggtgtacgattgcgttgtcgccgtgacatttccgctagtcgtagcatttgcagcgcacttccaatcttcctctttgttagccatcgtaatgacattcaccaccaatccgccaataagaatgacaaatccgaaaccgataataccaatgtttatgccaagccgaacatttgcttcacgaaggcgattctgactgc

SEQ ID NO: 85963 - DNA, 397 bp, Heterodera glycines
  SCN-specific regions: Sequence locations=24-41,63-158,180-305,356-397
tttttttttttttttttttttttatgggataatttttatttaatttccaaaattgaaacaaatatttgaccaactgacgaataaaaaagacatagcagcactttgatcaaagtgaataaagaaaaaaaagaagacaaaaaagaaatttttaaaattccataagagagagaaacagcagatcatcaacagacagttaacgaatttgaagcataggtaaatttaagaaatttttgttgtcgacggcacattcaattgttcgccgagagaagagaccatctcacggagtttggaacattcgcgaccactaaaaattaattaaaaaagagtgaaaaataaaattttaacaaaaaaaaatgctgcctgcttttacatcgaagcaactaattttttttttatt

SEQ ID NO: 85964 - DNA, 302 bp, Heterodera glycines
  SCN-specific regions: Sequence locations=26-203,228-302
tttttttttttttttttttttttttgatggaaaaaaaaattaccaggatacataaataggtcagaagatgctacagtcaaatacaaataaacatccgaaccaaacgaaacgcatcaatcggacaggccaaacgtttgctacaaatttagaagaagcttctgttgacactcgcacatcggtcgctctgttcgttcagcacttgcttcttttcctcctccttcttttgctgataaatcgcaaattcgcggtttgacatcttcggtgtgtccacgtatttgaaggagcctctgtaaggagtgtac

SEQ ID NO: 85965 - DNA, 456 bp, Heterodera glycines
  SCN-specific regions: Sequence locations=43-456
tttttttttttttttttttttttttatagtttctttctttttaatcaacaccagaaatcaccaaataaaaacaacaaaacaattgcgaatacttccacatgaatacactgtctcaattaacaatctttgccttcttcgtctcttttccttcctttttcgtctcttttccctctggccccttttgcgctgcgtttttcgtctctctgtcgtccggaatttcgatgagtgtcattgagttggctgtcttcgcgtcgcaaatgtaaaagcttttgcgctgaatttgcaaaatgtctccacagttcactttttgaagtgccggctcggccaacaaagtgccaaaatgctcactgtcgcgattgacgaactccttccagtcctcctccttgccaatgatcggagtgctgatcaaatgatcaaaacggaccgttttcaccgcgaagttttcggcacgtttgg

SEQ ID NO: 85966 - DNA, 351 bp, Heterodera glycines
  SCN-specific regions: Sequence locations=1-3,40-40,150-150,190 -212,251-251,298-323,345-351
ggggaaatttccattggctttcttttctctgtgtttatttgcatttgctgaagtggcagccgaccgggtcctccttcttatagacaatcccacaattcgggaatcgcactccgtcttcatcaaatccctcgaagagcgtggccactccgttattattgccatggctgatgacccaaacctttcgcttatcaaatttggcgaatttctctacgaccatttgatcattttcgcaccttcggtggatgactttggtgggaatataaacgttgacgagatcaccaaattcattgacggtggtgggaatgttctcgtcgctgcagaccaaaatttgggcgatgcgattcacgacct

SEQ ID NO: 85967 - DNA, 526 bp, Heterodera glycines
  SCN-specific regions: Sequence locations=1-41,63-159,181-293,315 -330,353-526
gggggaataataattaatcaaatgcttttttttctgttgctcctctctctgtccctttttctgctgctcgtgccaaatgtctgctgtcataatgccgaattggtgctgctcgacccctctcagatcggcttctttctgcccaattattttgttaaaaaatttgagaaaaaacttttcgtgaaatttgccagagaatttcggcctgtttttgtcgcatttgcaatgctcgaaccgccttatttatacgtggaccaatcggaaaacattcgatcggtggaccgagcggaggttgagaaattaatgaagttcaaattggtgtcacgactgaggaaggagaagaagctgatggagacggcacagtttaatctgacgctagcacatgacatccaaggcgcactgttctcagttccggttccgtcggatgaacgatcgcttaaattcgacagaaacagcgtcatttttgagcattgcaatgcgaatttgatagacaatgacaacaacccgcgctgcatttacttttaccttt

SEQ ID NO: 85968 - DNA, 542 bp, Heterodera glycines
  SCN-specific regions: Sequence locations=28-472,494-542
tttttttttttttttttttttttttttcaaatacccttttaatttacattttggggaagaaatgaaatattacaaaagaataaaattcctaatatgctaataataatggatcggtatggaatacaaattattagtacaaatacataggcatttccatgaactgaggaataatcaagcggggctaaggttcctaatgcaaaataatccatcaaaatgccccattttcggcgtcccactcggcccattcgtcgccttttgaattgttcttcttccgtttctttttgagcagcgtcgccaaaaaagtgtccggaggactgaattcgttcgcctcgtttttcacctggacaattttcgtgcaattctctccgtcaaccgttttcgaattcaatcgcaaaaattgggccaccgcgtgcaaatgaaagcgtttcacgcgcgaaattatttcctccgcgaaaacatcggccggcgattcgccaaagaattctctcaaagcgaattccattctgtagaggcaatcaaattggacgttccgtcgtttgagc

SEQ ID NO: 85969 - DNA, 450 bp, Heterodera glycines
  SCN-specific regions: Sequence locations=1-450
gggaattacccaagtttgagatagttgtcaaagtttcagcggagtagaaaatgagtgcaaagcctttgctcgagttgtatgtgaaggcctcagggattgacagccgacgcatcggtgcatgcttattttgccaagaattttggatggaactctacgctctttacgaagtgggctgtgttcgtgttgaggtaaaaactgtgaatgtcgattcggaaggatacaaaaagcacttttcgggagcacagccgccaataatggtggaacaagacaaaggcacggcaaatgcggacaacactgacatcgagcgacgcattttccaactttgcaaccaattccatgtgccattgttcgagaaggatccggaagtggcaaagaccatccaggatttgtacaggaacttcaaaatatttctccaagccaaaacgaattttggacaaaggcaagcagcaa

SEQ ID NO: 85970 - DNA, 447 bp, Heterodera glycines
  misc_feature (431)..(431): n is a, c, g, or t
  misc_feature (433)..(433): n is a, c, g, or t
  misc_feature (435)..(435): n is a, c, g, or t
  misc_feature (440)..(440): n is a, c, g, or t
  SCN-specific regions: Sequence locations=1-282,304-346,373-422
gggaaattcaacaaatccatgacgatgggtcgttgagcgcggagcaaaaaatggagcgaattgactcgatcatttgcactctgccggagaatgtcattgaccaaattccggacccgccagaagttgcgcaactcccggctgatgtgcgccagcgcgtcaaacaaattgaacgccagcagggaaagtcattcagcactaaatttgaagagatcatgaaatatgtggacactttgcctgaaggcacaaaatcggctgccaaaaacattttccattgaatttttcatggaaaaggaggagaggaaagaagtggaaaaagcagcatggattaatgaaagcaaggctaaacaatatttattaaatattttattttttggtaaaatatttccaatttttcatttccaataaatatttttgctttgttgaaaaaaaanananaaaanaaaaaaa

SEQ ID NO: 85971 - DNA, 397 bp, Heterodera glycines
  SCN-specific regions: Sequence locations=28-397
tttttttttttttttttttttttttttgccagagaacatttattaatcgcgagcatcggaatggacaattacaatacaataacataggccaacaataaatacaataatttcgcaatgagtgcacacacttacaaacaaatcacaacagaattggcatatcaatatatttgggtggcatatcgaaattcttctggcaccgtccgtctttgcgttgtgtttggtcatccatcgtccagtccctcacagtttcgccgtcgttttcccagttgttgttgcgcctccgacgaacttggatttgccggccctcgtcgtggtgcccaacttgctcatgccgacgtttgcagctgtcactcccatggcggtgcggctttgttgcatctccttcgtcgtctttgcg

SEQ ID NO: 85972 - DNA, 358 bp, Heterodera glycines
  SCN-specific regions: Sequence locations=28-358
tttttttttttttttttttttttttttgccagagaacatttattaatcgcgagcatcggaatggacaattacaatacaataacataggccaacaataaatacaataatttcgcaatgagtgcacacacttacaaacaaatcacaacagaattggcatatcaatatatttgtgtggcatatcgaaattcttctggcaccgtccgtctttgcgttgtgtttggtcatccatcgtccagtccctcacagtttcgccgtcgttttcccagttgttgttgcgcctccgacgaacttggatttgccggccctcgtcgtggtgcccaacttgctcatgccgacgtttgcagctgtcactcccatg

SEQ ID NO: 85973 - DNA, 616 bp, Heterodera glycines
  SCN-specific regions: Sequence locations=1-616
ggggcaattccgcgctgaatcttttacgtgtgattggccgtttccttcaaatggccaccgttttgcggtcgtccgctgaactctccgtcgagtcgattgtcgctttgttcaattgttacgtccattcgattttcacatttttttgctcggattttgatgcacaacaacaacagcaaaggttcggcaccaatttcgtcacttttcgcctccgccaatttgtgcaatcaatcgaaaagaaaatgaatggcccggggacgacagagggtgggcaagacagtgtggaaaatgcggagctttcgttgttttgccgtcggtcgtcgctttgccacgcgttggacagaaacgactcggacaaattgtttttgctcgtcgaaagaattgttggcgttgagtcagttgttttcctcgccaaacaaatggaattgcttcggcctttcctcgaggcgcttttgccaaaaagcggcggaggcggcgacagcaatttgtccttggactccttctatcgttcccttgcggcggtgttcgatttgggcgacgcttcgtttggctgtgtggcggccaaaattatactcgttcagtcaattctgaagcaaatttcggcgaccgattggacacc

SEQ ID NO: 85974 - DNA, 440 bp, Heterodera glycines
  SCN-specific regions: Sequence locations=30-123,145-408,432-440
tttttttttttttttttttttttttttttggggagttttggccatcatgcacataagtgtcaacttgagtatgttggtcttctctttgattgtcataaggataagtttccgggcgattaagataatattgactttcattttcatcgagtggattggcataaatctgttctttggctctttgatcgtcataattaccactttccgctcgattttgatgctgttcacgattttgttcgaagttattgtaaaatttgtcttggggcatgcttggaacttcttgttgatacaatccattaatttcagtttcttcataaaattcatcattggatttgttttcggcatttttggaatgatattctttgttgtccttgcgggaattgagttctgcctctttattattcatacgctcttcttcttctttggtttggtttgctctttca

SEQ ID NO: 85975 - DNA, 490 bp, Heterodera glycines
  SCN-specific regions: Sequence locations=1-200,222-490
ggggcatgacatccaaagcgtttggagttgctttcgtctggcgccaaccaaacggtggtcagatggtcctactcagattcggactccatttggcttccaatttctcgctttggcgacattgttggcgacgaggtcaattgctatgacatcacttattcgccttgtggacggtacgcactgtgccattcattcctcggcggattccatttttggcaaattgactcgaaaggtgcggtgttgcccaagtgtttccccattagcggacactttgccgaagtgaccgacctctgctggtcaccggatgggtcttttttgctcagttgctctgccgacatgacgacacgaatttttgccaagcacaaacagttggactttttcttcgagattgccaggccccaaacgcatggtcatccaattaattgtctgacttcggttgaccgcaatttgttcgtttccgggggagaagagaaaattttccgcgtgtttcagg

SEQ ID NO: 85976 - DNA, 579 bp, Heterodera glycines
  misc_feature (490)..(490): n is a, c, g, or t
  SCN-specific regions: Sequence locations=1-498,521-579
ggggacaatgataatgatgtatttgtaaagcgacgagaatatttgtgtgtaccatttcgactttagactttcgatcggcttaactatcaaatcacgccgtttctctttgtgctcctttctctcctcaacatttcccggctttacattggcagcgccataaattgttttgccaaagctgaattccgtgccggatgggttcaatatgcgcacgattattgccttgtcgaaagcacttattacctgcgtacggacgaatcaattccaattgaacacgaaatgaggggacagaaaagggtggcctattatcaggctctcaaatccacgcaattacttccgctgcgaaagatgccgtggaacaatcggcggacgaaggccaagagacggcggacaaaattgcgcggtcgcttttgcatgccacgcggcacagagagcgaacatttttttgcataaaatctcaatgctttgtcaccgtgctttatctaagcatganattcgcttatctgctgctgatctgctcccatctgctcattttccaccactttttgggcagtctcaacttcgccctcggattcgcccgtc

SEQ ID NO: 85977 - DNA, 366 bp, Heterodera glycines
  SCN-specific regions: Sequence locations=25-323,346-366
ttttttttttttttttttttttttctaaaaaaaatcaaaaattcattggataataataataattctgtcaaaagcaaataaaccgtacttttgagagcatgaaaaattaacaaataataatgttaaaaatgagggtcaacaagttgaacaaagggaattcattcattcagtgcataatgtacgtgttgtcctcgtccaagtcgcacaaatcgccatggaaactgatctgaatgcgaaagtccaagtcgcgtgggttgcggacgttcgggacaacgctaaaaacgccatggatttcctcgtttttcttcactgtcagcgattcgtaaaggtaaaagactgtctgtttccaatgcgtgtatttgcagt

SEQ ID NO: 85978 - DNA, 467 bp, Heterodera glycines
  SCN-specific regions: Sequence locations=1-203,225-444,466-467
gggaattcaaagcggcatttgccaatgcttcttcccccgtcaatttcatcgttttcatttgcactccgttgccttttgctgactccgttttggcctttgattttaccaacgaattgacccgggaacaattgacactgaaaagaactgactacatcgactgttttctgttggtccgttgtccaattgcgcgagacgaaagcaaatggacaaaatgggaggaggaagcgattggatgggaagattctgatcagtggaacgaaatttacattgaagtttttggcgataaggtcggcgacgggcttctcgacacaactcccgacccgagtgatcagcagaagtgaatgaaatgaattgttgagaagagaccgatcaatttgaatgatttaattgttgacgtgctcatgaaaattgttccttttttgttgttgaaatgatcaatcaaccttttttgtctgtgtaaatcatta

SEQ ID NO: 85979 - DNA, 282 bp, Heterodera glycines
  SCN-specific regions: Sequence locations=26-43,67-282
tttttttttttttttttttttttttgcactttttgttttatgcatgaaaaacacaaataaatgaaagatagtataaaagttaagttgaatacgtaaaaacaaaaaacaatcctaatgaaatgctaaaatattgaaaaaatagtgaggcagagaacgaaagggttaaaataaataggtaattttggtgctttcatcgaatgatatttccagcggcgccctgaaactgtttcctcgcatttgccgttacactttcctgcgtctgttttcgcatcgattcgtcca

SEQ ID NO: 85980 - DNA, 509 bp, Heterodera glycines
  misc_feature (467)..(467): n is a, c, g, or t
  SCN-specific regions: Sequence locations=1-117,139-509
ggggagccttggatggtcactgatcagctgttgcccgctttaccgaaaataaccagcaaagacccgagtgttttgatggcagtgctgggcatttacaaaattgttcacgaaaacaccaaattcgggatcaacaaagagcaatgtgctcggagtgtgctaccttatcttatttccaccgcagtcgagcccactctgaacctccaacagttcggccagtacatggaactggtccatcaactgatccgacgggtcgaaaccgagcaaaggcattgtttggagcagctgagtgccagtcaggaggaacaaaggaaaatcactgactttgcggactttctgaatgcccaatcgaatgaaatgaacaaaaccaatcagagcgaagtcgatttgggcgacttggcacgagcattgagcggcacatcggcaaatgatggcatctgcaacagaacaacggacaaaagggacagtgngacgacagaaaacagtggcgaaacaatggcaaagggagcact

SEQ ID NO: 85981 - DNA, 430 bp, Heterodera glycines
  SCN-specific regions: Sequence locations=1-2,34-198,223-430
tgtttttttttatttattttatttttttattttgatcattgttcgcatttgtcagaactgaaaaattaagatcgattcgatcgacaaaggcaaaaaagaaaaatgcaatgtgtaaaagtttcgtccgcttaaatgtttagcgattgcaagtcattcccccacagcatttgccttcactcaactccatgtccaacattacctcctcctcctctcttttcttctgccgctccgcctctctttgtgccaattctaattccgctccaattcgatgctgagaatgccaaagatcggcgtatttaccacctggcaaccccaccagttgggagtgcgtgccatactcgacgaccatcccccgatccaacacgtaaatgatgtccgcgtcgacaatggtggccaaccggtgggcaatgaacaacgacgttcgaccaga

SEQ ID NO: 85982 - DNA, 590 bp, Heterodera glycines
  SCN-specific regions: Sequence locations=1-324,349-590
gggatcttaaaggcgttctgttccgtcccgaccgtgtggtgatcgctgcgcgaaatttggccaacaatgctgcggagagcaagcgggacgggaacacagtgtgccatttcctcaacgcgtgttcgacctattcaccggaagctaccacgcatttctacagttacttgggcctggagaagttccacaaaggcgtggcaaaagcgatggaaagtggccgtagcgacgaagtgctggcccggcttgaggctgttcggcgccgtgtgctcgccgcaccgatgaacgtccacttcggcggagatccgagtcaaattcggctcggcacatgttcatcttccgcttcgtcgccgccaatcacggacattgcctcacaatgggccttcctcgaacagccgatccaccaacttctgcagtgtcccgctgactacggggcctccgaagcacaatttggacaaagccgtgccattgtcgtgggcggtgccgacagtgcgtttttgctgcagaaaactcggtttgacgacgactggaatggacccagcaccatgtccactttgctgctttgctcatacttgcaacagtctgagggaccgctg

SEQ ID NO: 85983 - DNA, 105 bp, Heterodera glycines
  SCN-specific regions: Sequence locations=1-6,29-105
ttttggttttttttttttttttttttttggaacacacctatcttctttatcattacccaaatgaccgaatatgacgcaacacaaacaaatatactaagaagatca

SEQ ID NO: 85984 - DNA, 519 bp, Heterodera glycines
  SCN-specific regions: Sequence locations=1-75,97-197,219-519
gggaacgaacccaaaacaattccaatggacacagaaacactcactgccgcggattctctccgctcgcatttcggctcactgaccaaaggaattccaaaccgaatgcatcgttcgtctcttctcagtgcctgggaaccgccgacttcgtccgcatctattctcaaaaatcccgaacaacagcagcctccccttttgtcggacattacagaagtgttcagtgcacaacaaaatgtactcggaccatcgacttcaattgggaaaattacggaaatgactcacaatgttccgtcccaattcaacgacaaagataccgttaaagagctcatctcccaatcatttggagagacaaaaggcgaagaattgggcagaattgtacaagccaaagggagaccagtaacaatgggaaaagacagaagtaccgaacagctcaataaaagtggcgaaactcacaggaaggacaatttgagacggaaatcaggggtggacaacgctcttctgccttccccatttacggatgga

SEQ ID NO: 85985 - DNA, 410 bp, Heterodera glycines
  misc_feature (386)..(390): n is a, c, g, or t
  misc_feature (392)..(392): n is a, c, g, or t
  SCN-specific regions: Sequence locations=1-143,166-352,374-410
ggggctcattttcatgacgttcaatgtttggctgtgtttcgccgttgtttttggcgaagtgtgcgctcgactgatgctcgccttctttttcccccaattagaccttgtgaatgccattttaaacaatgccactggcgaaccatgctgcggatgagcgaacggactgcctttttgaactccttcatttaagtggaatccatttcctatctctttttgccagttaaacctttccctctttttggaggtttaggtaattaacacaaacctatgagtgaggaattaacttttggaaccgatgaattctcattttattttcactttgcctttaagttcttttttacaaatattacaattaaattaaatgaattgtggttaaaatttaagcnnnnnanaaaaaaaaaaaaaaaaaa

SEQ ID NO: 85986 - DNA, 483 bp, Heterodera glycines
  SCN-specific regions: Sequence locations=1-483
gggggataaataaatcaatgctaaacggacaaaatgttttggtgagcgatgtccattatccattccctaatgggaatgatgtgatgtatgttgatcaggaagaagaggcggaacatttcgcagaaggcacaagcacgcagcaccaaccaaatttgagaagcgatcaacaacgacgactctcatttattcaaacgactgcactaatcaaagatgaacttcgcaaggcggagcaaggccaggcttccgggaacgccatcgaaatactgttcgaacaagtgcatcggagtaatgttgagattgacaatgtggacaatttgcggacgttgtgcaggggaggtgagacgttggatcagctcatccaactttcggtcactcaggtggaggggatgaaggatgagacggcgcactgtctcgaccctgggaagcttgttgcgcgattgaaatcttttgcaatttctcatcggaagacgggcgatagcgatc

SEQ ID NO: 85987 - DNA, 351 bp, Heterodera glycines
  SCN-specific regions: Sequence locations=28-52,74-135,157-240,262-351
tatttttttttattttttattttttatgctttatgcccatcttctccactatttccgcttcatcctcatctttccgctccgactcttccgccggcccttcccccgccgggggcactgactttttccgtttcgtcaaagtcccaaatttgctcaaaatgctgccctcctcctctcactgctgttgctgtactgccaacattttcttttctccgattaattgcccacctttttactggtgctgcccaaagtgcccattttcatattcccctgcagggatttttaattgaaccacaaaaaagcgaatttaatggaaggaatggaaaataatggaagatcggaagggcataaagc

SEQ ID NO: 85988 - DNA, 228 bp, Heterodera glycines
  SCN-specific regions: Sequence locations=49-206
tttttttttttttttttttttttttttcccggtttttattttttttttccttcacccctcctttattcctatggaccttccttccaatggattttccccttccttccttttccaccaccatttttccccttttttccaccaagggtttccccccctttccttcccattgggaaccaattgattttccgcgttggaaaaacccaaggattgcttttcccgggtcccctt

SEQ ID NO: 85989 - DNA, 524 bp, Heterodera glycines
  SCN-specific regions: Sequence locations=1-96,119-524
ggggatgatgtacaacgacaacaacagccaagcaccatcgcaacagccgccccttccgtacgcgacgaatgaccaccaaaggcaacaccaccacttccaacaaccagcacagcagcaggacccgcgcatttacccacagcaaatgttttacaatccgccgcagcctatgccgcatcaataccaccaccaaactctgctgaaccgtctgcccaatgttccgcagccgtccgttgccgatgcgcaagtgacggtgccaccgccagcgatgaccgatattgcgcttgccggtgccgaacaggccattcagatgttctacaacaatgccgggattcacaatcaacagacgcaccagcagaatggtcggccccaatagggagggaatgaacggcacggcaaggaccgacgaaagcgttcaaattttgcaatttgtttcgccccttctcttcccattgactccacattttccttcaatttacccattcattttattggtcactaaaacacaaaactttttgacggccttt

SEQ ID NO: 85990 - DNA, 408 bp, Heterodera glycines
  SCN-specific regions: Sequence locations=29-70,103-146,169-408
ttttttttttttttttttttttttttttgaaattgcttatgtatttattgtcattaaaaaagatgccccctaaattaaaaaataaatgaataaatattatttcggctctcttctaaatcaaattttcgttctgtctttctccgtccgctacaaaaaagcctctcttccgaagttctttgtagccgaaaacggccaacataacgcaggcgactaaccctccaaaaaaaaacaccaagtcccaaaaaacgttggcgcccccgcccaaattgccctgctgctgttgcgaaaaaacgtacgttttttcacttgcggaattcgacggaccaaccacaatttgcctcacatcataaagattgaccggcggcagaagcggcggcacactttcattggccattttttgcccctttt

SEQ ID NO: 85991 - DNA, 539 bp, Heterodera glycines
  SCN-specific regions: Sequence locations=28-252,321-380,403-453,475 -539
tttttttttttttttttttttttttttccaattttcaatttattaaagctcagaatataataaacaacaaaaggattggtacaataaaacggagaaggaaaaaatcattcaaaaaaagaaaagagaatgcacgaagaaagaccaaaagaaacgaaaacaaatgcacgaattgaagaggcaaaggtgaggggagttaaacaatcaaattgagcaaaatattagaagagaaaagtatcaatgctaagcaaaccgaagaaaaaaaacgaaaactaaacaaaaagaaaaacaatcaaatggaaaacaaaaacaatcaatcaaaatccatccatcactaacttatcaggcgttgatgcgcagctccctcaggtaggtggtgttgaggaaagaaaggactttggtcatgtccgcataagtgcgcagcggccattccacccctttgttctttgcgaagagctgcaaatttttgctgttgtcaataccgttcttggcgtagtgtgagtagatgtttcgaccgcgtttcgcatattcatcggcgatgt

SEQ ID NO: 85992 - DNA, 493 bp, Heterodera glycines
  SCN-specific regions: Sequence locations=1-51,73-206,228-322,345-493
ggggatccaaatcaacgcggcacagtaataaaatattaaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccgggcaatgaatcgaagcgtctgtcaccgagtggacccgacccacatcatcattagggccatggatggatctaacggagg

SEQ ID NO: 85993 - DNA, 493 bp, Heterodera glycines
  SCN-specific regions: Sequence locations=1-277,299-493
ggggactagtgatagtccaattaagatattaatcatacctaacaagtaagagttgaaactttaaaagcttttttattgcacaaaaatcatggttgcttcttcattctctaataatggcaaaaatattttggaatcgccgttcaaactaacaggagaatgcaaattgctctattattgtacaaacgaattgggtcattttttgaaccaaacatcaaatgctttaatcggcaatcctctgagaatagttccgtttgatgggcttagctctccacaaaagcaagtctgtacaaatacatcaaattctttggaatttaattgtactgagcgatacatttcattgactaatggcactgctctttggatttacgatttacagaaagggagcacactacgagaactgcatgaccatgatgggaacatcagtggggtcgcctggcacagacaaagtccttggctcttggcaagtgtgggcgacgattgcacgttgcgcttg

SEQ ID NO: 85994 - DNA, 315 bp, Heterodera glycines
  SCN-specific regions: Sequence locations=1-250,272-291
cagtccgtttcctcctaaagaaataccttctggcagcagacttcctctgaaactgctctatcggctataacactttgtaacgggctcctctaatttctctgttgcgtccaatttgtctcagcaaacaccaatcgctaatgtgaacaatgcattttcgttgaaaatgcgacctcccaaatcactcagtgaaattgttattaattactttagaaatgaacatttcatgtgtcgtgttcctgtcgctaactgtcctcccttttcccttttttatcctcatcgttgtcctgaaccaaaaaaaaaaaaaaaaaaaaaaaa

SEQ ID NO: 85995 - DNA, 341 bp, Heterodera glycines
  SCN-specific regions: Sequence locations=1-212,234-313
acgcttaaagagttcgaaggattactcagaacgaatacaaagttagaaaaagaaaaggaaaaaagaaaggaaaaagttacagacttacgaaagtgtcgaagcgaaattcgacctgcaaaaaatcgaaaaaatgagcactttgacgaatcgactgaacaaattggcggatcatttgggggaaattggccatttgcattttgaaaagggtgagcttaatgcaatggatttggaggagaagctaatgttcgaaattgttcggcttgcggaacaaaaacagcacgaaattgaagaaggacgaaggaatggcaaatcgaaaaaaaaaaaaaaaaaaaaaaaaaaaa

SEQ ID NO: 85996 - DNA, 749 bp, Heterodera glycines
  SCN-specific regions: Sequence locations=1-21,43-644,666-749
cacagttttttttgccctttgtgacacacaaataaattgaaaaaattggtgagacctgtgctgattgaaccacaaaatgaaccgacgttggctttgcagcgacgtgtggatggacattctcccatcatttgaccatgcccaactcggactcaaaatggcattgctttccgactgtttcgatgttttggtggacaaacatttcgatcgaaaaagcgaattgacaatttggagagaaataataattcgcggggacaaaggacaaaaaccgttattgtctgtagaggtcgatggcaaatttgtggattttcctctgccggacgattcgctgcccaacaaaatcagctttaataaccttcatattcagtacattgaccattccgtgatcaaatttctccgctccaagaagcgattctttgacaaaagtggcaccaaattggaagtgtttgtggatgcaattgatacggatgtccaaccgatttgggatgtttttatccgtgaaatttggcctatttttgagaaaagcattcgccatttgggctttcataatggcgatcatttggacaatttccgtcgtcgcacttcaccaacgattctcactgatcttgatcaattggtttcaatcgattgcggttatctgcgccccgatggaattgctgatgatgggccaaacgcaactgctggccaagcgttgaccaaatgggtgcgcactccgagcaaaaatgggcaaccgaagcgattgcatcgtaatg

SEQ ID NO: 85997 - DNA, 658 bp, Heterodera glycines
  misc_feature (48)..(48): n is a, c, g, or t
  SCN-specific regions: Sequence locations=1-78,102-658
catagttgaggcaattaacacaaccttagccagtgctcgatttggccngacaagaacagaaacgccttgcgctggaattccaattaaaaaccaaagaattcgcaagttgtcgtgacaatttcaaatttttcgagcggacttatttcaccgaacaacagaaattacgttctgaagtgcatttgaaggtttcggctgactttttagacgaaattggacgcttagaagcgatcattgaccgtttcaaacacccatttgttgatgaccccgaactgatcagcgattacaaacgccaattggccatccatgtgaatggaatgttgtcggaagggctgcaaaatcagtgcacgggcggactaatggcccaaatttggagtttggagcagtctatgcacgcctttgtcaaaaaaattcttaacgaacggcacgctgcgcagctggacaaaatttggcagtataaacagcccttcaaattcgcaattgtggtgaactgtcctgaattgatgtccgatttttacgaggacttggaattccgcttttcacttggagttgagaatgtcgcacgttggattttgtccataacacgaggccaaccgatcaccgccattgaccgaaacgttttgcggatgaacgtattgtcacgacagggacacaatgacgg

SEQ ID NO: 85998 - DNA, 680 bp, Heterodera glycines
  SCN-specific regions: Sequence locations=1-95,117-412,435-680
tattaaggctccaaaaaaaatccattccacattccagcaaccaataccattaatttcataaatccgaagaaatccctacaaaaatgtcttcttccccgtccgtctctgtgctcgccatcgtcgcaattgtctgtttgatgtgccaatgttgcttttcggcaccgcatccgtgctgtcccggcagtcaaaaagtggtttcacttatgtccaattacgttggcacttttgccaattccatttccaagtcatcgctttgttcggatgcccaaaatgttgcggacgcgttgaaaggccaactgatcggctgctcgaatggcggcgatcgaactcttttggccgacatcgaagcatctcttgccagtcattctgctgatgagtgtgcccacagcctcggcttcgtccgtgccatgttcgccattgccgcctctgcttcttctcatgccagcaacaacagcgaatggcaggcattgagtacacagtttgttcagaaagtcactgaaattgactcgaaatgtgcagagtttggcattagcattggaaaagtgcccatcgatggccccaagggagaccactcccaacgaaatgtgcctagtacggacagtgtgatttccatgcccggattgaccggctcacacaaacattgaactgaatgatgagtgacggaatggataaactaattg

SEQ ID NO: 85999 - DNA, 669 bp, Heterodera glycines
  SCN-specific regions: Sequence locations=22-38,60-90,349-367
ggaagaaatggaagaaatggcggaaaagacaaagagtcagaggaaaggggagaagagtttaaagaggaggaggaaaagcgacgagagatggaagaagaggcggaagagaaggaagaaaaagtggaagataaagaggaaactgacggagaggaaggaagaagaggtggaagagaaagaaaaagaacctgaaaggatggaagaggagaagaaaatgttggaaaggatggaagaagaagcggaagagaaggaagaaaaacgtgaatgggcagcagatgagatggtagaaaaagaggaaaagcgggaatggactgaaaaagatttggaagaaatggaagaaaatgatgaaaacccagtggaagaagatccagaagaggagaacatggaaaagacggaatcgaatgaaaaagagttggacgatacggaagaaaagcaggaagagaaggaggaaaaggaagaaatggcagaagaaatgaaagaggaggaggaagagatggaacaagtggctgaagaggaagaaaaactggaatttaaagcgaatgagatgcaacaaaatatggaagaaaagcaggaagagaaggaggaaaaacgagaattgactgaagaccaaatggaagaaaagcaggaagagaaggagcaaaaaacgaaaagcgacgagagatggaagaagat

SEQ ID NO: 86000 - DNA, 442 bp, Heterodera glycines
  SCN-specific regions: Sequence locations=1-58,80-442
catggctttgctgttccgcttcgtctctttccccaattcttcgtgattttggcctttgccttctctttcatactttgctcttcactacttatctcatctttgcccagattttctgtttttggcatggccaaacgcgtgtcgaatatttgatggatgtccacgcttataatttgtcctttcgagaaaatcttagcgcctgtcttggctcgcgatggcccttcatttttatttctcctttcattccatcgcagttggaaaccgatggaacgtttttcaggacacgcgaaagggaagaaatcggaaaatcgacaaagtatttttaggaagatgaaaattctactgctacttaataatgcgctttaatatctcattgtgtctctccctctgtgtgcgtaaatcacgattaatcaaaaagcagaataatcaacaatattccccaaac

SEQ ID NO: 86001 - DNA, 744 bp, Heterodera glycines
  SCN-specific regions: Sequence locations=1-240,263-591,630-663,687-744
aaaagagtgctcgggttttgcgactttcgcttggacccgacaatttccaagggatttgaattcgatgttgaaggccccaactttccggtcgaagggttccgttttgtcggtttgatttcaatgattgacccgcctcgtgctgctgttccggacgccgttgcgaagtgccgtagtgcaggcatcaaagtggtgatggtcaccggggatcatccgatcacggccaaagcaattgccaaatcggtgggcatcatttcggagggcatggaaactgtcgaagatatcgccgttcggaaagaaatttctgtggaccaagtcgacccgagagaagccaaggcgattgtaatccatgggagtgatttgcgcgagatgaatgaggaccaattggccgaagtcatcaataaccacgatgaaattgtgttcgccaggacttcgccacagcaaaaactgatgatcgtcgagggatttcagcgtcagggacaaattgtggcagtcaccggcgacggagtgaacgattcgccggcactgaaaaaggctgacatcggagtggcaatgggaattgccgggtcggacgtgtcaaaacaagcggcggatatgattcttctggacgacaactttgcttcaattgtgaccggcgtggaggaaggccgtctcattttcgacaatttgaaaaaatccattgcttatacgttaacttctaacattccggagatctcaccgttcctgatgtacattctgttcgggatt

SEQ ID NO: 86002 - DNA, 204 bp, Heterodera glycines
  SCN-specific regions: Sequence locations=1-204
ccgtcgcctgccctgcgcatcctcggcaaatatcccgacaccctggagggccggaagatcggcatactggtcgcggacggctcggacggcgccggcgtatcgtgagtgccgaaggcggttgaaggcgacggcggatctgtcttcatcgtcgcgcccaagatcgggggggccaagctggcggacgggtcgaccctggcgggcgat

SEQ ID NO: 86003 - DNA, 225 bp, Heterodera glycines
  SCN-specific regions: Sequence locations=1-4,26-225
ctggggttgagggaattgaattggtgagaaggaaagtgccagcgaatggaaaggagcaaacggaaaactcaatggacgacgcggccatcaaaagaaaactcgtcgatctgttcgacgacgaagcgtctctgtcgggcgacgacgtcggctccgattcggacggggagacgcaagacgagccggacgaatacgaggcggaggagggcgacttggaccagttgcctt

SEQ ID NO: 86004 - DNA, 696 bp, Heterodera glycines
  SCN-specific regions: Sequence locations=1-696
gtgtccgaattgctggaaaagtcacccgccgtggacatcgccacaaaacctctcgctgtgccaaatgcaatgaatgtccgttgtgcaaaaatgtgctcagcggacgttctcaggcggacgtgtattatttgcagtgtaacagttgccaatggacgagccgaacttcggaaggggccgagcggaacatggccaaagagtcgtggacagagccgaccaatcccatggagggcgaactgggcaaagtgatggctatcatgaagagactgagcaacttcgaacggttcgagcgcgaaatgaacagacggtctggcatgtcaaaactcgacaaatttggcactttcgaacgcgaaacgccaacgaaaagaatgtcgggccgaggaatccttcgaaatgatcgcttttctcttcaaaatgcatacaactcacgcagaaaagcgttacaaaaacaagacgacgtggacgaagtgttggagttgttggctccctctgccgatgttcccgaattggaccccgacattttctctgtgcctccaaaattcgctttgtccattgagcaaacaattgcccatcctttgtgtgtttctgctgctcatttgcaacccacaaaggtcaaaatgatgacacgaagggcattccgatgttcggagtgtgccacgatgctttacaggggccaattgtcgcccaatgatgtgaagc

SEQ ID NO: 86005 - DNA, 493 bp, Heterodera glycines
  SCN-specific regions: Sequence locations=1-167,192-470
gacttgggactcggccgccaccgttatgttgcagggccgtgacttcatcatgcctggagagactgtggagctcgagtttctgtttaatactcctcaatttgttcgtccccaacagcgtttcactctccgccatgacaaaaccacaatcgcctgcggcgtctttttggaggctcttcccgagtcggagggcgaaattcgcgacaaaaagtggaggaaaatgcaaatgcgaggagtgatggaaagggttggtttcaatccgttcggcaaccgatcgtttgagcgagcgtgcaaacctgactataccaattcgccgaaggacaacccggccgaggcattgttcaaagccgaggcaaaagcctagaaagaactttagatgaaggatttgttttttcgttaattaaatcattcatttgcgttgcgcttcatttatttggcgttctgtttttattccatgataaattcctctttacaaaaaaaaaaaaaaaaaaaaaaa

SEQ ID NO: 86006 - DNA, 602 bp, Heterodera glycines
  SCN-specific regions: Sequence locations=1-564,586-602
tggtccaagttgacttcattttggccatttaatgcttttcgtgaacgtcagcgtcatttgcttctcgccgacccgaatttgcgtctcggcgatgtcacgagcgtaaatctgacaaaaatcgagggcggagtgcagaccaatgtgatccctgcccaattcgtggcatattttgacatgcgcgtgacgccgaccgacgactttcagcaaatggaagcaatgatcgccaattggtgcaaagaggcgggcccggacgtcacttttgagttcgtccaaaagggaatgtgcaaatcgctgacccccaccgacgcctcatccccgtggtggcacgcgttttcgtcggcgcttagcgaagagagattttcatcggtggaacggacgcgcgttttctgagagagaagggcatcccggcaattggcttctcaccgatgaataacacgcccattctgttgcacgaccacaacgaatttctcaacgaaggcgtttttctgcgcggagtgaaaatttacaccaaaatgatcccacggctcgccaatttgccgtcattttgagcgaagtgccggcagaacaaagaaaagaaggaatcaaaatgatttctcctctag

SEQ ID NO: 86007 - DNA, 713 bp, Heterodera glycines
  SCN-specific regions: Sequence locations=1-688,711-713
catgtccggactgttaccggtctactgaagctgtgctcgtttgtcccttcgaagtggtcaaagtgcgactccaatcggagctgaacacgcccttctttaactaccgtcgcccgtgaaattgttcattcgaatggttggggcactgagggcctttaccgtggcattggtgctaacctttggaggcacggcgtgtggaactcgtgttacttcggaatttaccataatttgaggcttttcctttgctccatcccttcaaaaaattctcagtcctccgccgatcgtttagaaacggccagcttgaccatgcgtcttacgatcgcctcactctccgcaattgtggccaatttggccaacattccattcgacgtggccaaaagtcgaattcaggggcctcagccaaccaccggccgactttacttcagcacttggcaatccatcggactgctacagcgacagcacgggttctgctccatttacagaatgctgtttcccttcgcgttcatttttggccctggcggtggaatgatgctggtcatttacgagggcatttacgaatggctgatcaggcgatccatggctttagaataaacatttctcccccttcaattcttcgaattctcatgccaattctaaaacgtgcacatttatttactcatccttgtgatacttacatttattgttcccgtcactcccttttcttttttccctcggat

SEQ ID NO: 86008 - DNA, 736 bp, Heterodera glycines
  SCN-specific regions: Sequence locations=1-736
atgtctcgtacgtcggttagcgatctgcttttgattgttcgtgcggcggcgtcttctgctgaacatgtggagctgaagtaccgaatgttgagcaatggcagagacgtggcactgaacgtgaagcatttgctcgcctctcttctcttcttgctaactcgtcccgatgatccaacaacaaaaagcgcagttttaacaacggccaacgaaattgccaagatggtggccgaattggcccagtgcagtgatcagttgcgctcaaacggcgcttccactgcaatgtcagtggaggagtcggtgatggctgtcggcaacgaacttctcgtggccgcaaattccgtggaggccgtttcttacaaattggcacaaatgcgtccaagggaaattcataaacctgatgagaacctaacgtacgatgagcaaattctttcgtccgctaagtcaatcactcaggccgtccaaacactcgtcaaagccgcttcgtctgcgcagcaggaattggtggcccaggggcgagtggccgacccgggcccagcaaatggcagcgaagagcagcaatggactgcaggtttggtctccgccgctaaactcgtcgccgctgcgactaaccaactttgtgaagctgccaacggattggttcagggccattcgacggaggaaaagctaatcgcagcggcgaaacaggttgcttcttccaccgcccatctgttggtagcgtgcaaagtcaaatgcgacttga

SEQ ID NO: 86009 - DNA, 710 bp, Heterodera glycines
  SCN-specific regions: Sequence locations=1-640,670-683,705-710
ccaagtttgagagtttcccaaaaacacttctgcccaatatggtcaccttcttcgccagacattcagcttatttttcagtcagttgaccgcgatcggtccggtcaaatcagtgccgatgagcttaacaggcgctgtccaatggcacatggaagccgttcaacccggagacgtgccgaatgatgatttcaatgttcgactcaaacaacgatggggcatcaattttcaggaattcggcgcactttgggagtacatcaacgattggacgcgcacttttcgcactttcgaccgcgacaacagcggaaacatcgaccgcgacgaattggtcaatgcgttgacacaattcggttatcgtctgtccggcactttttacgatatgttaatgcgcaaatttgaccgaactcaaagcggtcgcataaacttcgacgacttcatccaactttgcgttgtgctccaaacactgactaccgcttttcgagaaaaggacaccgaccgggacggatggattcgaatttattatgaggaattcctcgccatggttttctcgctgaagatgtcaatgatggctaaacaatgagcaaaagaagggggaattattgactgatgaggatttgctaatacagtaacccacttatttttgtatgttttctgttaaacattatttacatatcactttcaattttacgacatttttgtttgaataaaaatttgga

SEQ ID NO: 86010 - DNA, 686 bp, Heterodera glycines
  misc_feature (621)..(621): n is a, c, g, or t
  SCN-specific regions: Sequence locations=1-501,524-686
tataaaatgctccaaacggccttaccattctgcttctgatcagtgttgtgatcggccattccttggccaaccttggcccaaccatcaaacataatcctcattttaaagccgtacaaactgcgcatcatttgcatgatgccattgcgaagaagcacgaggccgaagttacgcaagtcatttgctctattagcaacgaacagcgtcaagcattggctttggagttcaaaaaacaattcggcactgatctgattgccatgctgaaaaaggagttcaaaagcgactttgaagaactgatcatttctttgatgcaaacgcccgccgtttacgatgccaaccaaatgcgtgccgcattgtccggctccaatgaggcggtgctaatcgaaattttggcgacgcgcacaaaccgacaaattacggcgctgaagcaggcgtatgagcagttggacagaaggcatcagcacaatcagctggaggaggacatcaaagcgaagacgaagggacccttccaaaatctgttggtgtctttgctcagctgctctcgcgaagaaagtgcgcccgcaagcattgtattggcacacgacgaggccatgaaactgttcagagagggcgagggccgacggngcgttaacgccgtggtgttcaaccaggtgttggccactcgcagcttcgcccagcttcgggaaact

SEQ ID NO: 86011 - DNA, 747 bp, Heterodera glycines
  SCN-specific regions: Sequence locations=1-357,379-506,528-595,617-747
gggaaacccgaatctaaggatttgtacgtgcgaccgaacatcatcgcaaaacgcatcagtggcacgcttgaggcacatgtcaacggtttccgttcacgtcgttgcgcggcgacaaaattgaggtgatgtacaacaacatcaagcacgccttcttccagccgtgtgacaacgaaatgatcattctgttgcacttccatttgaagaatccagtgctgtggggcaaaaagaaatattcggatgtgcaattcttcactgaagttggcgagatcaccaccgacttgggcaagtaccatcacatgcaagacagggacgacattcagagcgagcagatggaacgcgaaatgcgcaagaagctgaacatggccttccagaacttctgtgacaaagtgtttcggatgaccaatgagcaggtggactttgacacgccgttcaatgacttgtcgttcatcggtgccccccatcggtccaccgtttctctgaaaccgacctcgtcatgtttggtgcacctcacagaatggcctccatttgttgtcacacttgacgaagtggagttggtgcattttgagcgtgtgtccagcaacaccagcacattcgacacggtcatcgtcttcaaagattacaccaagaagccgcacatcattggccaaattccatctaacaacctggacagtatcaaggactggctaaattcttgcgacattcgctacagtgaaggcccaatgtcgctgaactgggccaacatcatga

SEQ ID NO: 86012 - DNA, 637 bp, Heterodera glycines
  SCN-specific regions: Sequence locations=1-170,207-637
ggactttccctaggaacagtttgcttcgttctccagaattcgaccaaatttgctcaatttttccgcgtgtttctcctcaccctctgatggcagtgctccccgattggaaggttcttcaccaccaccgttggcatcttcaattcgcttcccccactttgtttctcgtcagaaatttactctctcttccacatatgaaaagcaagactggttcccaaaacacatgggcgttcaactgaaagtaatggagggaaaacttcgaaccgtcgatttggtcattgaagtgcatgacgcccgggttgccctgaccggaaggaatccttcgttcggtgccaaattatattcagtgcgaccgcacattctcgtctttaacaagatggatttaatcaacatgaaacgctacaaggaacccatcgaagagtactaccggaatgagcagaacattaccaatatttgctggacaaattgcaagaatttgacaaacaaaacgcagtttcaaaatttgatggacaaaatgttggatttgttgcgaaatgaacatcgcttcaacagaacagtgaagacggaataccaagtgatggttgttggtattccgaatacaggcaaatcctcgttgataaacgcattacgcaatgtgaat

SEQ ID NO: 86013 - DNA, 587 bp, Heterodera glycines
  SCN-specific regions: Sequence locations=1-538,560-587
gattttcctcttacaacccaataacagcaccggtctgattgttttttatcagcgactaattagcgcactaattagttaattaataattattacgccttctccccatacgtcggtcccaaaaacagttgtgcgcgttcacattccttccaaattcattgattgtgcacaatttttgcttctttataaaacgccaccgtccgtccgtcaaccgctcgaaggaaaccaatgacagaaaaaaggacatcgctgcttctctccaaacggttcagcttggcactgatctgttttgcgggctgcgcactttgctatgcgctgcgctcaaatttgtcatttgccatcgtttgtatggtcaaggagggatcgcctacggtggacgacaatggcacaacaaaaaagggatgcggtgccgcgcatgcgacaacggagcaacaacgacaactgcccattaatgaaagtgatatggccattagcaggttcaggaggcagactaatcgatcggctcttattggtcatcatgatgctgatgttgaacaatctcttccggtcccacttgggcctggtgaatttgattggtccaagcaagttcg

SEQ ID NO: 86014 - DNA, 408 bp, Heterodera glycines
  SCN-specific regions: Sequence locations=1-35,58-267,291-408
acatttttcgttgcttattactttaaatatcttaggaattttaaaacaaaataaaaagcgaaaataatggccccaccagcggagaaggagcgtgccaagaatgcccgtgtagtgcttaccgcgaggatggcattgcggacgaaaatgaccgatgctggtactgttggtgtggccatctgttgcaagtccacggcgaagccggataaacactttccctgacattttgccaaacagcacatgaacacctgtggagaaaagggccacaaattaatatttatttgttattaattagcatttattttattgggacattccattgattattgaatatttttttgtttcttgaattttattttttgcattttatttaatgaaagcgttggtttttaaataaattatttttcatta

SEQ ID NO: 86015 - DNA, 552 bp, Heterodera glycines
  SCN-specific regions: Sequence locations=1-454,476-496,520-552
ccgtctgctggcacggctccgcgttctcgtattggcgaagactgaacgggcgttggtcggaatgcaggtggattcgttgaatgaggcgcaggcacttccgctgatggccaagttgaactctttgccgacagaacgtcgcattttccaatttatccgcgacgaccaattttatttggttgtcacttttgcgcctgacgaccaaacgggagtccgtataaattttcaccttttctccgccaacgaaaaccgactgactttgctcgatttggatgcggaacatattattcgaaccgcgcccgccccttctctgcgtcctcaaaagtccgaatcgtttcaaaatttctataagcgaaataagaagcaaagggagggatgattgaccactgaacagaatgaaagtgaatgatctcaatagtcgactgatcagatcaaacggcaccgaatgaaaatggcctattttttcaaagagtaaactatgcgtatgacaccacatgatatttattgttacttttaattactgttgtttagccgccacagataaacatttaagcc

SEQ ID NO: 86016 - DNA, 628 bp, Heterodera glycines
  misc_feature (5)..(5): n is a, c, g, or t
  SCN-specific regions: Sequence locations=1-155,177-293,315-517,540 -586,611-628
gggcntctttctgccgcaattgcacttttgggtgccttttgttacatcgaattgggcacaagcattcgtcggtcgggtggcgattttgcctatctgtgccacgtcaaatggcgttccatcgccttctcttttatggcctgcggctgtgttttgacttttcctttaactttggccatccaagcggagacattcgcgcagtattttttgcaaggctttggaattgaatttgtggacgaatggaccgctgttatgggacggaaatgcattggttacgccctcacttggcttctcctctttttgaatttcttctctttgggctctgccgtttcgcgcttccaaattttctgttctgctgccaaattgctttccattggcattgtcattgccaccggcttttatttgctcattttccacggccaaactcacaatttgcgcgatcccttcgccaactccgtttgggagccgggccatctcgtcgaggcctttttcgccggccttttcagttacgacggatgggacattttgaactttggcgcggaggaagtcgccaacccgcgaagcacaatgcgttttgccattttggttggcattctcttcgtcgcttttctttatttcgctgttaatttgt

SEQ ID NO: 86017 - DNA, 478 bp, Heterodera glycines
  SCN-specific regions: Sequence locations=1-281,308-455
gactttctgttaaaaaaatgtcgcttcttgttttctctcgtctccgtactcttcctcgtcttgcgccgcttctgacgaacagtccttgtgcactcagcaccagtgccgttcgcaaagacattgacagtgctgcgaaatacgtcggagccggggctgcaactgtcggagtggccggttccggtgccggcattggcaacgtgttcggctcgttggtcatcggttatgcgcgcaatccgtccttgaagcagcagttgttccagtacgcgattctcggctttgcactgtctgaagccatgggactgttctgcctcaccatgggcttcttgatccttttcgctttctgaacattacgaagacgagcacagaggaatggataggaaatctttttttgttttttctcgcttccaataatagtacgtttttctatttttgtgttgtcagataaagttggactgaaaaaaaaaaaaaaaaaaaaaaa

SEQ ID NO: 86018 - DNA, 634 bp, Heterodera glycines
  SCN-specific regions: Sequence locations=1-552,575-634
caggaggaagcgcacatggtggaagagcataagttggtcgaacgtactctcgaatcctgttcaaaatgtatcaacagcaaactgtttgagaaacacgtattgttgcctatggcctaaagacatatctctccgtggtcaattgggacggtctttcccctgagcattgttacattgcgccaatggcacattgtgcgagtcttgtgcagatggatgaggatgtgtatgaagagatgaaattgtggatgaagggattggtggcgatgtggcgggacgaaaaaggggaggacggcatggactgtgtatttgttgagaccgccataaatattcgagaacaacaacacatgtcaattgagtgtattccgcttccaaaagaacttggcgaattagcccccatttattttaagaaagcaataatggaatcggaaaaagaatggagtaacaatcaaaagcttatagaccttgccaaaacttcaaaagctaatgtcagaggcacaattccaaagggcttcccttatttcacggtcaattttggtctacagcccgggtttgctcatgtggtcgaagatgaaagaaaatttccgttcaatttcgcgcaggaaatcattggaggaatgctcgacttgcctcacagcca

SEQ ID NO: 86019 - DNA, 659 bp, Heterodera glycines
  misc_feature (641)..(641): n is a, c, g, or t
  SCN-specific regions: Sequence locations=1-134,156-615
tcgcagaaatgcctccattgcaacacaacacagctgcgtccgaataacagcttggtggaggctgaactgcttgtccaccatcaaacccagccgcagcaacaccagcaaatgacccccgcttcccttggcaatacgcagccgctattcgctgtgcttaacaccgccgcactgaccactatttcaatgcaaaatggttaggaaacacactttttatcggaatgaattaacaattttataacttcccacagattcgatcactcaactccaacggtctctgtcgttacattcgcttgatattccgtgccaatgtaagtgcaaaaggccggattatgtgttggcactcgaaaatcgagttgctttactgcaggaacagaataagagtttaatggaccgactcagagaaatgaaagggcccaacggggaaaaaagcaaaaagacggatgattaatgttggcctccttcatttgcttataattttgctaatcccaagccatttattcacacgcgaattcttgttctgtacactgatattacagcacaactgttcaccaatatcatttcgcttgctcacttcccgacatattctttctgtatcgaattttgctttatgaacagaaataaaatattaattttttcaaaanaaaaaaaaaaaaaaaaaa

SEQ ID NO: 86020 - DNA, 613 bp, Heterodera glycines
  SCN-specific regions: Sequence locations=1-547,569-578,600-613
tacgacgagaatttgaagcgattccaattaatttgtgcggtgctccatctgttggccctattcaattcggtggtgggatggacctttcgctgatatcaaataaatcatcggacgcgagcacaaacaatgggacgacgacggggggcagccgaagcgaagggaaggcaaaaaaacaaaaaggcagagacagcggcgacaacaaaaaggacagtcgtcgccaaacgcattttgaaacggaaagtgccaaatccatcggcaagaaaactgacggcggatgcgagccgacatttgggaggacaaagcgccaccgcaattcgagtgaagaaacgccggtcgaggagtttggacaccatgttgaggtgcaaatgggacacttcttcgtcttttctggacctcacttcttccaccgatttttcctctttttttgatgagccgaaaaagcctcgtccgttcgaaggacaaaagtgcgccaattcgcccaacaccaaactgaaccaagcaaaattttcctttttctcctcaactgaacgaatgatgtcggaatggatgaaaaataaaaacagtgggacggacggaagaaaatttgaggaggaaaaatattgccaaaacggcg

SEQ ID NO: 86021 - DNA, 612 bp, Heterodera glycines
  SCN-specific regions: Sequence locations=1-24,63-146,169-187,209-612
ttttcccattctgtcatggcccattttatttctctattttttcatttaattattttttattttcggttttcaatgacaattgtgaaaggagcggatggagaggacgacgattcatttctcaaatttgtcgaagggttgccaagcaataaaaaagatttggaaatttttgaaaaaaagctgctcaaagaaaccccctccggccttttttatgttgcccattttggcgttctgtctttgatgagagaaaattgggactgtgccaaagtcagaaaagaattgaaggagcagtgcagaacatatgtgaaatatgtgcacattttgtacgaatattttttccggttattcattaaagcgccgctcgtcgtcccaaagtttcacttcgatgactctgtgctcaatgaacacattttggttaatgtgatcaacagtttgagcatgatctcctcgttttattttgaagaatgcaatggcaccgaatgtctttacgcgcttttttccaaaccgaaattgcaaaatgaggatgatctgccctataaaataatggaggacaaaaccttttgccaaaaggcatcagaaaaactcaaaaaagtcatcaagataaaatctgagaac

SEQ ID NO: 86022 - DNA, 668 bp, Heterodera glycines
  SCN-specific regions: Sequence locations=1-668
tcctgtttgcggacaaacagctgcagaccatgaaacagttgttggaggagtgcggcggatggaccgagccaaatcgttacaagatttatttttcctaccgaaacatcgaacatgaacatatttcgcatgaaaatgttgccgagttggcttcaggctcaaccatcggcaattattttggttccatcgaagacgtagagaacattagtgccaccgttgtacgacccaaatttcacacggtccaaacgcagacggaggacactaacaacaacgaaatgttatcaaacagcagtttttgcgccgagccgggtgcggacaacgacatggacggctccaagacggaggggatgacggcgcaagaattgcgcatgattgactacgagagggacattgaacggctggaaatccaatgctcaaagcagcacgaacaactgatcattctgagcgaacgtgccaagcacgtggaactgttggaggaacaaaaggtcggcctgcaaacgcagacggacattttgcggagacaaaatgcgcaactcattcgtgaccatgaggagctgaagtgtttgtttggcggcggttccatctcacgcaacggtttggagggagttggtgcgcagtgccggccaattgcgcgaaaagacaaagagctggagaccaaactgaaactgttg

SEQ ID NO: 86023 - DNA, 576 bp, Heterodera glycines
  misc_feature (555)..(556): n is a, c, g, or t
  misc_feature (564)..(567): n is a, c, g, or t
  misc_feature (569)..(569): n is a, c, g, or t
  SCN-specific regions: Sequence locations=1-397,419-520,542-576
acggtcgcttggtacttgtcttttgtcgtctcccgtgctatttgccattccacaaattgtcggcacttccttcagtttcgtccctttcattttggtcagtgccggtggcgctgtgttcgtttattgtttgttgcctgaaacacgcggtaagcaagcgacggacattgtgcgcgaaattcgccaacgagtgaagtcaatttcgcacggccaatcgccgtttgcggaagggtcggcggaagcggcgacgacgacggcacaaccaaacggacaaatgagcgaactgacggcactgctgagtttttaggttacagcgtcaaaaaacacttcaaaaacagcagcaaaagaacagttggcacgacggatacatgagtatggataataatgcttaacattgttgacgtggatgagaaagttttgcggaggaaaagcaattgtaaaaaataatcgaaatccgggccatgtacaaatttaatgtttttttattagtttactgtttggattatttttgctttttttatttggtgaatttgaacattgtataaaatgagacctgannaaaacaannnnancaaaaaa

SEQ ID NO: 86024 - DNA, 555 bp, Heterodera glycines
  misc_feature (468)..(468): n is a, c, g, or t
  SCN-specific regions: Sequence locations=1-136,158-162,188-196,220 -468,554-555
aggtgacttacaaaacttgaaattccagtttgggatttgggcggccaaacgtcgatccggccctattggcgctgttactactccaacaccgatgcaatcatttacgtggtggattctgcggacagagaccgagttgggatttcaaaacaagaattggtgtcaatgctggaggaggagctgaagaacgcgatcctcatggtgctggccaacaaacaggacatccacggctgtctgtccctggcggaagttcacaaggcgttgggcttggaggcgatacgaaacaggacattccaaatcttcaaaacctcagcgaccaaaggcgacggactggacgaagcaatggaatttcttgctgcttctcttcaatctgccaaatgatcagaccaatgcataattatttccaattattgtattacagatttttacgttctcaatttatttattttttgcttggtaaatacaatgtcnaaaaaaaaaaaaaaaaaaaaaaaaaaaaaaaaaaaaaaaaaaaaaaaaaaaaaaaagaaaaaaaaaaaaaaaaaaaaaaaaaaaagg

SEQ ID NO: 86025 - DNA, 556 bp, Heterodera glycines
  SCN-specific regions: Sequence locations=1-532
acattccgtcttctccgactgttccattctcaaaagcgtcgtaccataacgtcacacacatcataaccctcatgaccactccagcaaacgcggcgagggcccggagtgccaaggcgaagctgcgcgatgccaagcggaggagggcggcagttggacgcgcaggatacacaagaaaagcgcagcggggcgagcgatgtgccatttgtatgaccaacgtgagcgccatcacgcggacgacgctcggctgcacccatccgttccatcgccgctgcttgtatcgctggatccgctaccacaccaattgccccgtgtgccgctacaacttcgcccgcaccattccgcgcggtgagcgtaaccaaccgctgtaagatgccatgtgttgtgatcgccgtacgatgtcatttgtgtgatcatatttgtaccccattgttcggttatgcgtatgtatttgtacaatggaatgtatgttcttatatgtactctgtatgtacagtatgtataatactcgtcagtaaaatactctccttgttctaaaaaaaaaaaaaaaaaaaaaaaa

SEQ ID NO: 86026 - DNA, 390 bp, Heterodera glycines
  SCN-specific regions: Sequence locations=1-150,200-294
aaaatgcaagaaaatggacgggaaatggcacttgtgaagttcacgaaggacgactttggcatttaattactttgataagctcctccgaaactatagtaggtaatagccggttcattcttttgctgtatgtattacataatttatgtatgctattttatttatacaaattttgtacattttcaatatttattaatttattcattcggtctttgtaaaaaaatgaacaatgaatcatttgttgggatgtgctctattcagtgatgtggtgaaattacacaataaaacattgtcattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 86027 - DNA, 734 bp, Heterodera glycines
  SCN-specific regions: Sequence locations=1-348,371-734
tgagcgcatgatctcattcccaaagttggatgggaaccttgaagtcaataaaaattcttgaacatggtttgaccatcaccgagaagtggaagacggacaaccaactgacgaacgtgctcgaattgaaggacaaggttctgcgaggactcaaactgacggtggagacggcattcaagccgcacgtggaaggaagtcgccatgccattgccaaggcggactgggcaaatgatgcgttccatgtcaacggggatttgactttgtttggtggcccactgttcaccggatcgtttgttgctaaaatgagcaacgattggctggttggggctcagctcaaggccaacctggaacagggcactgttggcccgacagcaatttcgattgggcgtaagacggcggagtactcactgcactcgcataccaccgacgggacggactttggtgcaagtctgtaccatcgggtgcaccaaaatttggagtacggtgtgcagatgggttggaagatgggcgacgccatggcgagttgggcgattgccaccaagtacaacatgagcccagaattgacccttcgtgcaaagatggaccacgactctctcgtgtccgtttctgccgtgcacaatctgaacggcacgctcaagctcaccctttcctcacactttgcaatggcagcgttccctgacgcgcaaaacaaatttggctttgggctcgagtactgtcccggcggcacgtgctgcgcg

SEQ ID NO: 86028 - DNA, 581 bp, Heterodera glycines
  SCN-specific regions: Sequence locations=1-581
caggaaattgagggcaaaggacatgaaattgaggatgaggagtttgacctgaacgatgaggcctgcttcgaggcttgcgttaaccggctgaacatgtgggaccaatgcctggacaacgcggttcgattggagcagcgactgctgccccacgtgatctatgacgacgcggagcacgaagcgcatcataatgacctaattgacgtcatccaacacgttgagcccgtccgaatcaccaacagcggactggagccattgaacggcaaactgaccgaattcatcaacaacccattgaacagctcggacaacgaagccccggtgctgcctcgtgcaatcaccggcattaatcacgtcacgccttccttcgaccaaatcaaacaaatgattgaggcaatcagaacccagggcgactgtccagcggtggacattttggcaccggccgacaatttgactgtttacgacgcctttgtgtgcaaagtgttggcggatgtgctcgacattctgaagcgtcaacgtttctacaccaatttggaactgattgagcgcgacgcgcgtgcccggggggaggcgaaatggcaaaatgc

SEQ ID NO: 86029 - DNA, 650 bp, Heterodera glycines
  SCN-specific regions: Sequence locations=1-21,43-218,240-258,280 -551,579-650
gcaatcggtgaacagtgatctgatcgtatggaatttctgttctcaggaaggacatcaaacagatttgggacctcaaagggtcactaaggaatcggctcgcctccacaaaaaatgacaacaacggcgcctcttccgtgctattggacgagaactacattcagaacatgtggcggaaccaaatttatattacaactcattcgaagacggcactgagtcaggcgatcatcaacgacagccacttcctggccgaccagggcatcatggactacagtctgttggccggaatatgtcggggggaggaggacgaagtgatcgtcggcatcgtggactatatgaggacattcacttttgacaaaaaagtcgaaagtgccatcaaaaatgccattcctctaaccaattcgtccactgtcatttcgcctgagcaatactgccgaagattttacgaagccatcgacgggtatttcgcggttgcgcccgaccaatggaccagcgaatcagtttttacttagaacagaatagaatgaatagaagagtattatagtaacatcactttccttcccattcctttttcccattttcgttaaattccaatggccttttcgaacttatttcccccactccattttagcgcaatcccaatttctctgatt

SEQ ID NO: 86030 - DNA, 286 bp, Heterodera glycines
  SCN-specific regions: Sequence locations=1-5,28-286
agcataaaaaagaaaagtagaaatttcggaagtcattcagaaaactttaatttaaaaaaatgaggaaacttccaattcttgctcttattttctgcttgttgctacttacaacggaaggaagtatatttcgccgaaaaaacagaaagaaaaattcatcgagcagcgaacaaaaaacacaaagaagaaaccgagggtatggccgagttcgactttttcaaagtggcatgggcatgtatggccaatcgaatggattttcaaatggccgatttggcggctccagtgtcta

SEQ ID NO: 86031 - DNA, 580 bp, Heterodera glycines
  SCN-specific regions: Sequence locations=1-244,268-580
cagctgcgttggtcttcgagcagttggctgccgggtgttgcagcaccgccgcttacatggcggtgcacaacatggtgccgtggatgatcgaccgttttgccaacaggagctgaagcaacggtacatccccgaattagccagcttcaccaagttggcctcctattgtttgactgagccgggcagcggctccgactcggccgcactgcgcaccaacgcacggagggaaggcgaccattacattgtaaatggctccaaggcgttcatcagcggcagcggcgtgtccagcgtttatttggtgatgatgcgtcacaaagacgcgccgccgggtcccaagggcattttcgcgttgattatgacgcccgacatgccgggcttccaactgggcaaggacgagaacaagttgggctggtgcacgcagccaacgcggatccttacttttgaggacgtcaaagtgccggtgaccaaccaagtgggcgcggacgacgaaggctttaccatcgccatggagggactgaacggaggccgtgtgaacatcgccgcgtgttccctgggcgctgctcagatgagcatggacttggcc

SEQ ID NO: 86032 - DNA, 583 bp, Heterodera glycines
  SCN-specific regions: Sequence locations=1-236,260-583
caggacgaggctgcccgacgatgtccaactaaaattctaatccgcccgatgatttccaatccacccattcatggtgcgcgaattgcgtccaaaattttgtccgacccgaaattgcgccaacaatggctgggcgatgtgaagggcatggccgaccgaatcatacaatgcgctcccaactccgcgatttgttggccaaggctggctccaagcgcaattgggaccacattgtcaaccaaatcggcatgttctgtttcacgggaatcggtccggaacaagtcgaccgactcgccaaagaattcagtatttatttgacgagggacggacgaatttcagtggccgggatctcatccaaaaacattgactatttggcaaatgcgctgcacgaagtgacgaaataggcgagcagtttatcaaatatgtcccaaatggccctcggaagtgctttaaagttatgcgatcgaatgtagaatagaacactttctacaggtgataagaacaacccgtgactctgtccccctttcatttctctgtttttacgtttcattttgtaatatgacaggtttatagtaaagaatgcatttca

SEQ ID NO: 86033 - DNA, 270 bp, Heterodera glycines
  SCN-specific regions: Sequence locations=1-240
cgataattccggacggcgggtactttatgattgctgatttcagtcatttggatgggcaatttaaattgagaaatgaatccgatgaaatggaaaatgccttggatttcggcttttgtcgttggctttgtcgagaaaagaaattggctgctattcctccctcggctttctattcgcctgaaaatcgaaagggcaacgattatttcattcggctgtgttttttcaagaaagatgaaactctgcaaaaaaaaaaaaaaaaaaaaaaaaaaaaaa

SEQ ID NO: 86034 - DNA, 492 bp, Heterodera glycines
  misc_feature (430)..(430): n is a, c, g, or t
  misc_feature (491)..(491): n is a, c, g, or t
  SCN-specific regions: Sequence locations=1-393,416-430,491-492
gtgatgccctgcagctggaggaccggccctgctatgagatgatcgagctgctgctgcgtggatatcttgcccaaaacaacatcgaggagcatccatatgactgggagatcggaagacgcaactcggatcgagaaaagacgcaaattgagaaaccagcagggaaacagtgaggaggatgagcgaagaatcacccgcgagatgatgaacaaacggagacacatattcgcgagcctagcatctgtctaatcacatttgctcataattgtatattattgtgatcggtatcaagtcgtctttcattgtatacttggcattgacgacacacggaatgtatgatcacatttgctcattattgtacactgtgatcggtattatcattcattatatacttgccatatgtacatatatatgtataaaaaactgggcgctnaaaaaaaaaaaaaaaaaaaaaaaaaaaaaaaaaaaaaaaaaaaaaaaaaaaaaaaaaaaanc

SEQ ID NO: 86035 - DNA, 578 bp, Heterodera glycines
  SCN-specific regions: Sequence locations=1-93,115-494,516-520
agccgcgagttcgactggaatttgaattacggtgccattgctttgatgtggcgcggcggttgcatcatccgttctcgattcttggaccgtattcaaaatgcttttgaaaagaatccgtcgctggtcaatcttttgctggacgactttttcatgaaagccattggagacgctcaggactcgtggcgtgaagtcatttcgaccgctgttcagcttggcatcccaatgccagcgtttagcagtgccttggcatttttcgatggctatcgtactgaagctctcccggccaatctcatccaggcccagcctgattatttcggtgctcacacttacgaactgctcgcccagcccggcgttgctgtgcacacgaattggacgggcagaggagggaaagtgacgtcaaatgcgtactccgcctgatgaattaacagaaagacctttcaattagtgaccgatcaaattgtgattttgccttatgttgtcatattttatcacttaattttgcaaggaaattctcattgtgaaaaaaaaaaaaaaaaaaaaaaaaaaaaaaaaaaaaaaaaaaaaaaaaaaaaaaaaaa

SEQ ID NO: 86036 - DNA, 397 bp, Heterodera glycines
  SCN-specific regions: Sequence locations=1-397
gatttcgatttacttcgttttgggcaggtccctttttggaatgtacagtcaaaaaaacaagccacacaaattgatgatcaacaaattgatcaaataattagtcgcttcgccgcccatttgaaacataattaaactccgttttcactttcatttttccgttctatatttataaagtcagcaaaaaatgtcagctcaaaatgagtttatgcgggcggccgttgaggagggaattcggggcgtacaaagcggcgacggtaaaaccaaaaaaacaaaggaaaaaaaggaaaagcaataattactgactgatcagaggatttgagcgcaaaaaagtgcaaataatttgtgatacgatgagaaataaatgcaaatcccaaaataattagtcaccaaatgtata

SEQ ID NO: 86037 - DNA, 422 bp, Heterodera glycines
  SCN-specific regions: Sequence locations=1-112,157-286,317-329,351-400
accctgcctgaactgatgtgttattcaagataagcctgctgtgtagttaacctgccgacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaa

SEQ ID NO: 86038 - DNA, 582 bp, Heterodera glycines
  SCN-specific regions: Sequence locations=1-192,215-384,406-494,517 -532,554-582
cagaggaagggaaatgtgacaagtccatgaaaaatgtgtaacactcctggttccttcgagtgccaatgcgtcgatgggtttaaacgattggactccggcgaatgttccatcgatgtcgaagctcatcccaatgttccatggcttcaaccgggcgagaaacttcggcttttttcctatttcggcctcttccttataactgtttttgtttttacaatgcatcgctcaacattagcggtttttctggccgtttctgccatttttgccgtccttctggttgaccttttcttcggcgatggctttctccttctgttcaggtaaaactgatgaaattgggagcactgagaaagatgatgatgctgataatggtggtgctgaggcaaaatcttcccaggaaacggagacggacgaaaagctcaaaactgacaaagagaacggtgaacacgatgagttgtgatatttgtttatgggtcgatagagttagggagagaatggcattctgatgtttgtattgttgcacattttttgaacgtttgttgttattatttttgactgggtatttatttgtgtaaatggttattcaca

SEQ ID NO: 86039 - DNA, 593 bp, Heterodera glycines
  SCN-specific regions: Sequence locations=1-593
taaatgactgaaattggaaatgggtcgtctggcttcattccaaagggattcaggccgagtcccatctccgcctttttttctgccgaggccgtccgttacatgaccgaagctgagttccaccgatttcggctcaaatacatcacgccccaaccctttgccgatcgaatgcgcgagagttggcccaccgttgagcagccgatcagcgaatggttggcccagtgctgggacagtgcggccgcctacggcgagcagtgccgtcgcgtgtccaaggcgcgcctcttcaatctcatttgcatgcattgccgcgactgtccggatgccatcgccgaaatgttttgtttggtgctccgctgtaaagatgacgacccgcaggcgtgcaaagagttggtgttggtcgacctgaaaaactctgaattttatgcccgaatgttcgacctcagaggcaatccgatgaaaatggacgcaatttcgaagtgtttggagccccagtgcattttcccggaattgcgcaaacggaatgccaatgagtacgcgccgctgttggcacgggtcgaggcgctgtacaaacggtcgttgaaacatggcaacggcaa

SEQ ID NO: 86040 - DNA, 659 bp, Heterodera glycines
  SCN-specific regions: Sequence locations=1-97,126-659
gtgatcggtacttttttttacaccgaattccccccccccccccttttttcacttaaaacgcgtctttccattgtccgatgattctgcaatttcccttcggggattttaatgttttgttgctgcttacaatcagcactgttcttttggccagatgtttaggcacaattgtacagtttgaagatgaattagaattgatggaaaacaccgggacggcggatgaatccgccgatggtccgttgggtgctttttgggaatggcatcggatggtcgctggggctgacaaattcggctccatctcgcagcgaatgcttcatctgcgtccttctttgaaagtgccttccgtctccaagcgaattgccttcccttcgaccgccttcccaaatccaaatccgaacaatgccatccctccgccgaatgtcgtccgtcgccgtgcccataacattccaagggacaaacccccgtgccttcgaccgatggacagaccattccgagaacatcggacgtacccgcgcagttgggaaatgcccggctttgaggcgaccattccccgccagtgggactggcgaaatgtgtccggaaccaacttttgttcgcccaaccgtaaccagcacatcccggtctactgtggaggctgttgggtgtttggcactttgggctct

SEQ ID NO: 86041 - DNA, 693 bp, Heterodera glycines
  SCN-specific regions: Sequence locations=1-264,287-616,638-693
atgtctctttccgatcaatcagaataccctacatttacagaatttggactttggtatcgacttggaccacgggtggcacttgttggtccgaacggggctggcaaatcgacactcctcaagctgttcagcagagatgttgagccaactgatgggatgatccgacggcatttgcactgcaaaattggcaaatatcatcaacatctcgttgaagaacttccactcgaactctccgcgttggaatacatgcaaagagagtttccggacgtaagagagaaggaggaaatgcgaaaaatcatcggccgatacggtcctacgggtcgtgagcaggtgtgtccgatgaagcaactgtccgatggtcagcgctgtcgtgtggcgttcgcttggttggcatggcagcaaccgcatttgttgctcctcgacgagcccacgaatcatttggacatggagtcaatcgacgcgcttgctgaggccattaataacttcgccggtggaatgattctcgtttctcacgacttccgactggtccagcaagtcacggaagagatttgggtttgcgacaaacaaacaattactaaatgggacggcgatatattttcctacaaagagcatcttcggaaaaagattgaatcgaacgaccggaagggcacgatgacagaacgttgatcccttcttttatcacgttgttgctgagta

SEQ ID NO: 86042 - DNA, 535 bp, Heterodera glycines
  SCN-specific regions: Sequence locations=1-65,87-115,246-274,296 -401,423-484,506-535
agaggaggaggaacacaaacattgatgttcttccacgaaagtcgcaacacattgaaaaaaagcggaaacttttggaagaaattgatttcgcattgccgaaaaaggcgcaaaagtcaaaagcaaaaacagagaaacaaaaagcaaagagagaagaagcaactgaatcaaaagatgaagaagaaaaagcatcaaaaagaaaaattaaacagaaaaagacaaaagttgaaaagaaggcgaagaaaaggggccgagtggaggaggacggaacggttgacatcgccgagttgggcatggataggctgagggcgtacggagtgagcacgaagaagttgaaaagagctcacttcagcaagaaaaaggcagcagcagcggagagaaatcaaggggaaaagcagcagaagaaatcagaaagaacttaccaaaatgggacggattgacctaatttccaacagtctcatgttctgtttggccactgctatcattgaaacagttacaattttgataaaatattttggtgcttaaaaaaaaaaaaacc

SEQ ID NO: 86043 - DNA, 746 bp, Heterodera glycines
  SCN-specific regions: Sequence locations=1-746
gttctaggcggaggaaaaggagcaacggtgatttatgacgaagttaatcagctgtcgaagaacggcaattgcgtgggaattctctccgattgtttttttgcccattggcggtgatctccgcacttttctttggtgtcggatgcaacgccaaccatctctattccgagggtggctctttccccgtcctttcctccgacaattcgccgcccattccaaatgatccgccgacttttggttccccagccgaccttcttgacaatgaattgcagcagcccaaccaacagtaccaaactgagtttgccccttccatggaacaaatggtcgacgaacaaaggcgcaatcggctggccaaaattattgaacaaatgagggataatggacagtttagccagcaggaaattgccgatgggcccggactctttttggaagaaggagaagcgaatgttcccattgaacgaccatcggaaacggagacttattgggacggactaaaagagggtgaactcgagtcttccgaaatgttcggtgaaaacgaagggaagaaaattgctgccgttaaaaagggccaaaacgaatttgtggagtttgtggagccacgtcaacaccaaaacaaccgccacaaagaatggatggacaaacgtgtgccaaccgattcgacgcacgccttttatttcctgaccaactccggcaacattctcttcatggcttatttggccgtttgctgttttggcattgtcgcgggcgct

SEQ ID NO: 86044 - DNA, 610 bp, Heterodera glycines
  misc_feature (529)..(530): n is a, c, g, or t
  SCN-specific regions: Sequence locations=1-404,426-530
aaaaaatgaagcgacgaacgttaagaaaatctggatttgcacgacattttggatggacattctcccctttttgaccgtcttcaaattggactcaatttgggatgtttttgtccgtcaaatttggcccatttttacgacgccgaactctcacaatttgtcgccttcttatgccgatcacttggacaatttgttgcgcctcacaacgccaacaattctctccgatctcaacattaattcaatccattcaagcagttttttgtccgtgcccgcacttctgtcaattacaacatgcagtttcatttgcccgtgtcaacgccaattgtgccatttgaattggagaatgagcggacgaaagaaaagctgacattggagaaagtgccaccttatgatgattgttgaagcgatgtccaattgaggagaagaaagatgaaaattcggcagaaatttgaacatttcttttacttttgaccacctatattttgatcaaattgtgaatatggtaaaataaatcaaataaatgtttatgtcnnaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 86045 - DNA, 285 bp, Heterodera glycines
  SCN-specific regions: Sequence locations=1-126,150-285
ccaagcggaggagaagccaaattgtggatgaaatcgatcgacagctgaagacattgcgaaaatggcgatcacttatgaggacgagtgcccgtacaatttgggctttgcccgtgccatgttcgacttggccgctgctgctgctggccatgcgggcaacggcacagaatggcaaaacatgaaaggacaatttgaacaggaaagccaagcaatcaaagcaattggccaagaattgaacattgaacctactgatgtgcattttggacatccaagcaaaggattttccgc

SEQ ID NO: 86046 - DNA, 650 bp, Heterodera glycines
  SCN-specific regions: Sequence locations=1-136,163-184,215-229,254 -308,335-354,387-462,505-546,624-650
gtaagatgaaagctccggcggtgtaagatgagcatgcgtccctattagctagttggtaggggtaaccggcctaccaaggcaaagatgggtaggggttcttagtggaaggtcccccacactggcactgagatacgggccagactcctacgggaggcagcagtagggaatattggtcaatgggcgtaagcctgaaccagccatgccgcgtgcaggacgaaggctttctgagttgtaaactgcttttgtacaggaacaaaaaagcctctgcggaggttcttgagggtactgtaagaataagcaccggctaattccgtgccagcagccgcggtaagacggaaggtgcaagcgttatccggttttattgggtttaaagggtgcgtaggcggtttattaagtcagttgtgaaatcttagtgcttaacgctaaaactgcaattgatactgatagacttgagttaagaagaggtaagtagaatttatggtgtagtagtgaaatgcttagatatcataaggaataccaatggcgtaggcagcttactggtctttaactgacgctgaggcacgaaagcgtggggagcaaacaggattagataccctggtagtccacgccgtaaacgatgatcactcgatatacgcgatacaatcgtgtgt

SEQ ID NO: 86047 - DNA, 661 bp, Heterodera glycines
  SCN-specific regions: Sequence locations=1-60,82-203,225-239,262-661
ataagaaaaaagttatgagaagtttcaaatttttaccatattctaactcaagtcctaaactgctgttttcttccaaaatgcaaaaactaatcattttttaatgattctaaatgcccaaattgcctttgtgcccttataaccaaaactattagcatttgaattccatcatttttcatgtgttagagacatgaaaatagtacgccaaaaggagagaaaaagaaatatggaaaaaaattgaaattaaattgaattcaattaattctgtggcttcgccggattaacgcattaacgcccaattccaatgtcgtccatcctttggacgttgacgagctgttcctgcagcacaatcggtgtcgaaatgcacagcaaacaagattggctcttccttttcgttgttttcattcgcttcttttgtgttcatggccctcgtgactttggctgaacatcccgaattccttcggaggagaaggattcccttgcgtgcctatcttcaaattgttggcattttcttcgtggtcagtttgctgaacaaccgcgtgctcggcttcggcctgcccttccctctgatcatcgtttttcgatcgagcactcttctcgcaaatgttctgctcagttggctgttgcaaaatcgcaccttttcccccgcccgacttttctccgt

SEQ ID NO: 86048 - DNA, 574 bp, Heterodera glycines
  SCN-specific regions: Sequence locations=1-240,262-574
gaatccgccatcggctccgtaatgctcaacattgtccatcccttcgcgttgtcactttcgatggccccattttcatcgaatttccacctgatgaaagtgccaatgcgtcggatggccaagcggtgaccaaatggctgttcttgcctcgtcctgacaatttaatgaaggagctgacaatctgcattgtgaattcatcggttgaacattggttggcaactgtggaacaaatcgaagcggctttttcctccgcttcttctcctgtcaatttcgtcattactgtttactttccgccgtcctcttcactctctgccgttatgccatttaaactgaccaacgaattcaccgtggagcaattggcactgttcaaagaagatggagaagaagatttaattagagacgacggagtcggcgatggtcttctcgacggttcgcccgggccgagtggtgatcagaaacagcagaaatgaattgattgatttgttaattgatgcgattatgtaacccaaatgttagactttgccatttaaatatagttgtatttgatttttgctcataaattcaaaaacggaaaaaa

SEQ ID NO: 86049 - DNA, 637 bp, Heterodera glycines
  misc_feature (635)..(635): n is a, c, g, or t
  SCN-specific regions: Sequence locations=1-440,462-637
cctcttttgtagtccttaagcaaattattttttgatggcatcgtccgacagaaaaaaagaaaagttttcctccgacaatcgccgactcatttcttctgccgcaattggtgaacatgaacagcagcaaccgatgggttcacatggaaaacggcgaaatgttcgcgtggccaagaaaatgaacaaatcgttagggacgacgaagccaaaacgctgctgctcccttcacaacaatttttggatggacattttccccttttttgaccatgctcaactcggcctcaaattggcaatgctttcgccgcgtttcaatgttttggtggacaaacatttcgatggcaaaagcgaattgacaatttggaagctaatccaaattcgcaatccgagaacggcaccgaaactttctgtgctcgtcaacaatcgcaaattggtgccatttccgttgcctttccatccgttgcccagcaaaattcactttaagaaccttcgaattgattactttgatcactccgtcgtcgcttttctccgctcaaatcaacagattttcgaaagaggaggcctcaatttgtatttggtggttcgagcagcacataagcgtcttttgcagccgactttggatgttttcgtccgtgaaattntg

SEQ ID NO: 86050 - DNA, 616 bp, Heterodera glycines
  SCN-specific regions: Sequence locations=1-501,524-540,565-616
tacgtgctgaagaagttttgggacaatttgttgttcgtctcctccacgctgacgacgaccaaccaattggaagctggaactttgtgctgtgccttcgtccgccacttttgtcttatatagcaacggtgcttcaacacagcaaaaacccttcattagtacagctcggtctccgttcgcttttccatctgttgacaaaatgtaattctgttgacgattgtccgcctctgtcagacacaattggctcagttgctggtcatttgaccagtgcggtgttcgtaatcattcgcagtgagctggtcactggcaatatcaacgttgtggcggacattttacacgcattggccagcaaatatccgaatgtggcgagatcgacagttttggctctgtccgggggtgattctcaacgattgattgcattgttcgcacgtcccaataaatttgattttcgtcaaatatgtgccactatgcatcagactgcacttttgcaaaaagatccagtgatttaatgtattattttataaagtgcaaatttttttttttcattcattcgtttgtttcttttttagtcataatcattatacgatttaatgattcttatatttattaaatatcaagc

SEQ ID NO: 86051 - DNA, 314 bp, Heterodera glycines
  SCN-specific regions: Sequence locations=1-169,193-216,238-288
caattttttgaccagcgaatgccttttccgtcgacgatcactccatccgtccttcgatttgtcctccatcactttccctccctttttctgtcgctttgcctttcctttcgtttcgctgtctcccaaaaaggctgatgaatggcatttttcaactttgagctccgtctcaaaattggattgtttgtctttttgccggtgcttctccccccccccccctttctcccacatttctttctccgaatttcgtgcaaatgttttattccaaaaagaaaaaatgattcttcgatcaaaaaaaaaaaaaaaaaaaaaaaaaa

SEQ ID NO: 86052 - DNA, 697 bp, Heterodera glycines
  SCN-specific regions: Sequence locations=1-182,205-364,387-562,585 -662,684-697
aatttgggagttggaagaaaatccgattgtgatttggcacgatggttcagttcatttaacagtgttcgattggttaaaagtggcttgacccggagcaagagccagaaattcacccaacatgtttcgacacttctcgattgtttctcaccatttaatgtggattatcctcagcaagatgacactgatgattcagcagatgatgaaagtgacaaagagaaatatgactttttgtcatggcaaaaaaaattgcgtcaaccgcaacgatcatttaaattgccatcggagagcaaatacaatccgttccaaagatttgatccatttcaaagattgggtccgtttcaaagattaggagtttacggtagtcgaaaggaaatggaaaattatttggacatttttggcaatgaaccgtcctcttccgtgacggcaccgctaattggttccatcaaaaatgcggagattgatcaacagaacagtgaggacgagaaggggagcagcaccagcacaaagcgtgtaaatccattcctaaagccggatggaagcagctacaacaaagacaaggatgaataaacagaatgccaaacattcgaaggaattgatcaaattcaaaaaaaacgattgtatttatagagccctcacccaacaaatattggcacatgttatgaaatgaattagttaataaaatctgtatgttggtaaa

SEQ ID NO: 86053 - DNA, 777 bp, Heterodera glycines
  SCN-specific regions: Sequence locations=1-455,477-777
gcaattccgcgctgaatcttttacgtgtgattggccgtttccttaaatggccaccgttttgcggtcgtccgctgaactctccgtcgagtcgattgtcgctttgttcaattgttacgtccattcgattttcacatttttttgctcggattttgatgcacaacaacaacagcaaatgttcggcaccaatttcgtcacttttcgcctccgccaatttgtgcaatcaatcgaaaagaaaatgaatggcccggggacgacagagggtgggcaagacagtgtggaaaatgcggagctttcgttgttttgccgtcggtcgtcgctttgccacgcgttggacagaaacgactcggacaaattgtttttgctcgtcgaaagaattgttggcgttgagtcagttgttttcctcgccaaacaaatggaattgcttcggcctttcctcgaggcgcttttgccaaaaagcggcggaggcagcgacagcaatttgtccttggactccttctatcgttcccttgcggcggtgttcgatttgggcgacgcttcgtttggctgtgtggcggccaaaattatactcgttcagtcaattctgaagcaaatttcggcgaccgattggacaaccggggaaatccattcgcaacattcgccttatgtggacacaattgtccaagaatgttcgcaattcaaacaaaagttcgtccgccttttcccctacgttcacatttccgacgaattgtacgccgccatttggtccatgcttttgctgtgcattttccgtattttggt

SEQ ID NO: 86054 - DNA, 618 bp, Heterodera glycines
  SCN-specific regions: Sequence locations=1-368,390-555,578-618
catgtctgttctgcttttggcccactgattgttttcgcgctggtccttggtttggccatcactttgacagttatcacagtgaacaattggaaggaaatcggcgtgcttcttagcaaacaatcggcgttgaagagccgctcggacattgaagcgttttatgaaattgattgcccaatttacagtgacaactccaaacttccggacaaatgggaccaatttgatttggcattctgcaatcgctattgtgatcgcaaccaaatgttcgagtccatgcaccgtcaactcgaccccaaccggaaatcttcagccaagagcaaagacaatcaagagcttatgtgtcccatatacattgaattcaaacaatgtcagatgggggaagggggtcactgtgaggagaagttattcagcgaggaattcaccgaattcgttcaaccgggcggtgctggcacttcgtccaaaggggagaatgagacgattggcacgtgcgttccctgcccttcctaatccgaattaaaggaaaaagctgatgtttatctggccatgttaatctattgtttaaatatatttgttgtatttatgtaattgtttttgaaagttcaataaatatttggatatcca

SEQ ID NO: 86055 - DNA, 502 bp, Heterodera glycines
  SCN-specific regions: Sequence locations=1-178,200-254,276-349
cactgacatgaacactaagaactatacgttgctggaaaccgagtgttggcgaggcgcctgacaaagccctgcataaaacaggcaaaatgattgaggatttggcttctctgcagcacaatcggctcagcaaacctatccaaccgacactctctgaagcaattaagccggatgaaagtgaaatacaattggctgaagaaatagtgcagggattgggccaacatgtcgtgcaattgggtgcaaagcccgcggatttaattcagtctcctcttttacatcaagctctcggtttggatgttgatgattacaatgtgctttctgaattcttagaagtataaatttataataacctaaaaaaaaaaaaaaaaaaaaaaaaaaaaaaaaaaaaaaaaaaaaaaaaaaaaaaaaaaaaaaaaaaaaaaaaaaaaaaacccaaaaaaaaaaaaaaaaaaaaaaaaaccccaaaaaaaacccgggaaaaaaaaaaaaaaaaaaaaaaaaaaaa

SEQ ID NO: 86056 - DNA, 693 bp, Heterodera glycines
  SCN-specific regions: Sequence locations=1-114,140-693
gattttaaaaaatgttccgccattgtcgagattctcgaccacttccccgtggctgttcttgatgtacattgttgtgctgccgttcctgttacactgtgcttgttgaccatttttacagcaacaacgacaacaaaaatgacgaggacaatggcactggcggaagatttgaatatggcggaacatttgttactgcgatcagcgcgggacacaagtgccgatgaagatgatggtggcggtgattttgacggcagcagcaacgagactgagtcggacagcgctcagtttggaagccaattgaaaagggacggcgccgccggagggataagcattggcacttttcttggcaacatttcggcatcggcacgcgctcaactgcacaacattgtaaacaatgcgagcatgaccaagaaagagatgagcgaagcattggacacatgggcacaagcacagggccaactgttcaatactgtttaccttggcctgaaagcggcttatgagtcggcacggcaacaattggaccaacggcacgcggcacagatgcaaaaccaaacacaggcggtgcgcgaggcggacgccaaaattcaaacgattgccaacaaccaattcattacattagcggaggagaagcaacaaatggtggaacaaatggcaaaattcccagcggatgtgcagcaaacactgctccaatttgcg

SEQ ID NO: 86057 - DNA, 620 bp, Heterodera glycines
  SCN-specific regions: Sequence locations=1-81,104-409,431-532,618-620
gcccgatcgttgatattttgaagaagtaatgccggatcggatgaacgtggagaagaaatcggcgccggatctgttgatcatctttttggaacggctttatcagttgatcatcagcactttgaagatcccgattccggatacaaaaacttgaccaatcttgggaacacaaatcatttgaagaggacaacgatgaagagcctaaaaaattgacaattccggatgaatatgaccagagcgattttttaatagaaaacaaaagtgttggagaacaagaaaaggaaattattcgagaagaaatcggatttaatggccaagcagagaacggcgaaaagccatcatttgaggaggaaaagtgtcccccggagggatgccgactttaccgagatgatttggtagagagcgaagaggttttgagaaatgagcatgatttgggaaggaaactgagcaagactgaagacctttcaaagaagatggaagtgaaagggaatgaaattacgaaagaagacgaacattctgcagaaacacacattgtgaaagaggacgaaaattggatggagcacaaagaggaagagaaaagggagaagaaagaagggaagagggaggaggaggaagaaaagagg

SEQ ID NO: 86058 - DNA, 641 bp, Heterodera glycines
  misc_feature (621)..(623): n is a, c, g, or t
  SCN-specific regions: Sequence locations=1-131,153-407,429-432,454 -535,557-564,586-641
ttttggaagtagtgcattttacacagattgctgccgtcctaaatctcctattatctccatgttcggtcgcttcgtttcatcccttttctcctcccggtttcttccgtttttcgccccgaacgattcctgcaaaaattttccccaaatttctgctgtcattcgaactttctccgacaattttcgtttacagcccaaaatcattatgatgacattttaatgcgggacattcgcagaggttctcctccaaagcatgcgcgaaaaccacacgacagaaagccaatcaaaggaaccgcttttaggaaaggcattgttataaaagttgtcgtgaaacacccaaaaaagcctaattctggcaatcgacaatgcgtgttggtgcgtttatccaccggaaggcaatgcatcgcttacattcctggggagggacacaatttacaggagcacagccaaatttacgtgcgcggtggtcgcagaagggatttgatcggagtcagagcaaatgtcatgaggggaaagctcgactgtgcggcggtcaaaaagaaataaatccgaaaacgatcaatgcttttataattcggtaaaatattttgatagagtggtcaaaggacattaaacattggcaannnaaaaaaaaaaaaaaaaaa

SEQ ID NO: 86059 - DNA, 534 bp, Heterodera glycines
  SCN-specific regions: Sequence locations=1-512
cccggacaaagagtggaaatactgaaagagatagcgaagaaaagaccttcttaaacaggagacgcctcttcttgactacgcactcaaagtggagcaaatcacaacttcgaaaaagcccaacttaattttgaacgtcgatggggcaattgcgacaattttcgtggacattcttcgccattcgggaatgttcacaccgcaagaggcgcgggagaccattgagattgggtctctgaatggactgttcgtgctcggccgcagtttgggattcatcggccattatttggaccaacgtcgtctgaagcagccgttgtaccgccacccgtgggatgacatcagttacattatgcctgagcatgaatttgcgggacagcccagtctttgagtgacaatgatcaattactgtttatgtagggcaatgacttcactttttaagaaaatagtaaaattattgaattgtttatttgatcagattctattcttgtattgtagttgtgttaaagtttatacttcgcaaaaaaaaaaaaaaaaaaaaaa

SEQ ID NO: 86060 - DNA, 519 bp, Heterodera glycines
  SCN-specific regions: Sequence locations=1-185,207-519
gcggaaggatttgaagtgattgcagatatctatcgtaacaaagctgttgggacgaactcgaagaagctaagagcaagactgaatttaatgttggcctaatggacgtgtgggatttcggggcattggcacttttccacaaaattggcaccaaaaatgttgtgcttacacacaattttttgatcatgtcacacatgtacaaatacatggaaaaagcaggatggcaaactgagaatagcgaattatttaactaccaaaaacaaatattggacaagggagtgccagaactgttctcagcagtcattaacgacaaaaatgttggaaaagctggtgcatacaaggaaaagcataacgaaagttcggatattttctcaaaagtttatgaaattgctgatcaaaaattcaaggaccttttcaagaacaatgcatttcctactctggaaaaattgttcggagatgcaaaagctttgttcgtcaacacaacgcctttattggattatgacattggcagtttgccaaaac

SEQ ID NO: 86061 - DNA, 404 bp, Heterodera glycines
  SCN-specific regions: Sequence locations=1-44,66-134,173-231,253 -359,382-384
gcgagttggccgcatggcgcagcccgagggcgtttgggactcgctcactgtgcgactgcaggccatcaaaacagccattgagacggccattatgattttgcgcatcgatgacattgtcagtgggacgaagaagcgcgacaaagacgggaacggaggcggaggcggcggcgcaatgccgggtcccggagggtttgaataatagcgaagaaaggcgaaggagaggaaaggaacttcccaattcaacatatttaaagaagtggccattttgttggattgaacaaatttcgaaactccaaaatgctgttgaccgtttcatgctttacttatccattcaatcacaaattgaatttgctttgttttgcctaataaaatttgtttttgtcgaaaaaaaaaaaaaaaaaaaa

SEQ ID NO: 86062 - DNA, 449 bp, Heterodera glycines
  SCN-specific regions: Sequence locations=1-13,35-168,190-284,307-449
aacgatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcacggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgaccctcatcatcattagggccatggatggatctaa

SEQ ID NO: 86063 - DNA, 617 bp, Heterodera glycines
  SCN-specific regions: Sequence locations=1-225,247-585,607-617
ttcccttttcttactaccccccctctcttcctattgtctttctcctccattctccgctaaagaccgtttcaccaaatctcccacctccccggcatttctcatattgccgtttgagtgcgcttgtggagacgaggcgacgaaagtttgacaaaagaccctcaaattgacgccgtttgttgtgttgggatggagcgaagggggcagaacatcgatacacgtggcaggccaagggaagggcctggtcagccacatggtactgctttcgtccggctcccaagtggacatgcggggagacttggcattcaaaggcatgcgaaacacggaccaatggatgcccgcggcaaaggcaccctatttggagcattattccaacgaatttctcaaggaacaatgggccggactttgcgatgttgtagcaaaagtgtacaaggacctcggaggaagttttccatgcgaccgcgttctaaacacactgaagatccccgttttgatcgtcaacggtaacatggaccggttcgtccttgacccgagcttgatgagcaagaaattggaaaatgccaggattgaaatacatgcccagggagggcacgaccttcacatcaaatacccacgttggt

SEQ ID NO: 86064 - DNA, 646 bp, Heterodera glycines
  SCN-specific regions: Sequence locations=1-276,298-600,625-646
aatttggaggaattgccagagaaaagggaggacgaagcaattggcaaagagagggcacagagtgagtgggacggaagagaaggccaaactcaggcgaacagtgccgagccgagccattatagaaacccgggagagttggcacagctccgggcaaagctcctttcgccgacgaagcgaagaagggccgaagacattgaccaatcatcggagaacaaattgcgcagagcggaagaattgcgagcattgctaaagcaggaaaaagcacaaaggcttcacctcctccaccgaagggttggggaagtgaggacggagcgggagcaaatccaacagaagaaaacagcacatttggagatggtgaaggagcgcattcagaaggcggaggagaaccggcagaagagtctcgaagagattgtgcagaaggcgcaagaggacgaaatgaagatcatcgagataaacctgttgaacagcttcgaagcagcgaaccaacggttgggcaagcgattcacccaaatccgagaaaggaatcgacatgcgaaagtggtccgaaaggccgaggaggagcggcaaaagcgcattgaggagaacaagcaacagagagaggaagcggagaagcggcggaaggacgcggaagagcaacgcacaaaac

SEQ ID NO: 86065 - DNA, 713 bp, Heterodera glycines
  misc_feature (596)..(596): n is a, c, g, or t
  misc_feature (675)..(675): n is a, c, g, or t
  SCN-specific regions: Sequence locations=1-713
ggaatgcatgtgcctcaggttcatgtggcaacgttaaattgctggcttttacccacccttggccaatcggaagcaaacacaaacaattccgtttgcaaaaattaatcgacgaactgaaaaattcgcgctttgacgtcattgctttgcaagaagtatggagcgaaaagatttttcttcaaatcgcccatgaactcaatggattttttccccattcacattatttccacagcggatttacgggtagcggcacgtgcgttatcagcaagcatcccatagtttcaactttactccataggtattccctgaatggctttcctcatcacgtccaccggggtgactggtttggcggcaaaattgttggaatggttgaaataatggtggagcagtatcgcgttgcattttatacgacacaccttcatgccgaatacaatcgagagaacgatctcttccttccgcaccgcatctcacagtgttttgagatgtcccaattcatccgccatacctcccgaggttctgacttcgtggtcgtggtcggcgacttcaatttggagcccaacgacctcggccatcatctcatcaaaaacatagcgcagctntacgacgcatgggaaattcgatcgaatttagttgacatttcgcaagataacggaatgacctgtgagagaccccgacatntctacacttgcaaatacgtgcttcaacaatgtccgagt

SEQ ID NO: 86066 - DNA, 402 bp, Heterodera glycines
  SCN-specific regions: Sequence locations=1-378
attgttgacgcgaaactgatcagtgcgcagcgactaaaactggtcgcatttggacagccgaggacgggcaatggcgaatgggcgacagcgatggaccaaaaagtcggccccttcaattaccgcgtcgtgaacaaccgcgacttggtgccgcatatgccgcccctttggttcgaagggtaccgccaccatatgactgaagttttctataacaacgcaaagaacaaaaccgaggaatttgtcatcactcgcggatgaagccgaatcggaggaatgtgcgggaaaatattggttctacaatgttcgggaccatttgaattattttgggaaatcggtgtccgaatggggagagaagggatgtgccaactgacagaaaaggacaaaaaaaaaaaaaaaaaaaaaaaa

SEQ ID NO: 86067 - DNA, 642 bp, Heterodera glycines
  SCN-specific regions: Sequence locations=1-179,201-478,500-642
gcagaagaggcttctgaaatggaggggggacacctccgacacccaacagctggctgagcagaacgcaaaaacagatgctgaagaaactgcgcaaccggggccacgaggaccacgaaatacacgaacaaatccacgaattttacgaagtgtccccggaagaagtgaaagcaactgccagaggaattctccagagaggctgcgaatccatcttcaaacgtatctttggagaatacaatgcggaggaaataatccagatgcgcgacgaaggagcatccaatgttgaaattgaggagaaaatcacagaggcacttaaccaaattcgaagtccgcagaagcgacaggaggccggccgatttgcgatgtcatgtcgccgaatattcgcaatgattgaacgtcgtcgacgatcggcggataacgccgaacattcgctggatcaactgttcaaatcgcatttgatttggctgaatgagcagcaacgggaggagctgaagcaaatgaaagggtccggaaagggacggacggaaatgcagcagagagtgatggaatggtacggacagttggaggggcaagagaagcagaaagcgcgagaacacctgcgggacggatgccgggacatattggcacaagtgttgggcaaagaaa

SEQ ID NO: 86068 - DNA, 396 bp, Heterodera glycines
  SCN-specific regions: Sequence locations=1-10,45-396
gtgattgcttttcctttgctcgttttggcaaagggatctcgaaggctacactttcagttgtttggacgggtgcgaatgtgacactgatgacgaggccatcattgtacaatcgtcccgatcggcactttgtccaattgcccccgtcgcgtctccgcggtttcactgtgctcgcgctcacccgcaataacatcgatgtgctgcccagcgaagaagtactgctcgagaaactgcccgacctgaacgccgttgacgtcgaaggaaatgaacatttccactgttccacgctcgaccattatcggacattgatggtgatgagcgattgcggaaagactcctgaacaattggaggccgaccgggccaaactgccgacggacacacagccaaatgaggattgcg

SEQ ID NO: 86069 - DNA, 444 bp, Heterodera glycines
  SCN-specific regions: Sequence locations=1-21,43-213,235-243,265-444
cctccctctcaaaatgagttcttcgtccattttcctttcctttgcgtctttttctttgataattttggcattgtgccgagcccaaaatgaatcagctgcccaaggcgatgcgcagcccccgccattcttaacagaggccagccaagagaaaatcaacgaattctaccaatacgtcacgagcctggggcatttaaaagaaacggaaatagcggaaaaagtgaaggaatgggtggacaaacaatcggaggaaattcagaagaaatacgtcgagtttgagcaggaaagggaacgggcgaaggccgaggatgaagcggcgcacgaagaagcggcgagaaagttcaccgaagcggcgaaaaaggcggacaaggaactgaccgaaatcgcgaacaaccccaatttgtcggccaatgataaggcggaaatgatcaacagaaaagtgcactc

SEQ ID NO: 86070 - DNA, 465 bp, Heterodera glycines
  SCN-specific regions: Sequence locations=1-156,178-299,321-384,406-465
tcctctcaaatggaccgacaaaatgacttgcgacagcaacaaaacgttccagaatttatttgtcaagaaagactggacacaaattctccaattgccttcaaagaacctttgccaggggcgtggaatttgcacagcgagtatttgtcgacgaaaacaaaagaggaaaaggaacgaaaagcttcacgtttcagaactgagttggatcccgaggatgtgaagctggtcaatgaattgggccatttatcggctgacaaattgatggaatatgttcggacattgcagaatacagcgctttcattgggggaagaggaagcagcacaattttctcgggcaaaattgctgaagattttggagaagtgatttcaataatatttaatattcgtatttattttccattcctttccttcgttatctttgaacttttttatctttttctatgacgtgatttttatcgacaagaaattt

SEQ ID NO: 86071 - DNA, 598 bp, Heterodera glycines
  SCN-specific regions: Sequence locations=1-541,588-598
acgacctgatcgcgagaagcgccagacacccgagctgatgaggagaaccgccaggtagacagtgctgatcgggagaagcgccaagacaaccgagctgatcgcgagaagcgccaagacaaccgagctgatgaggagaaccgccaggtagacagtgctgatcgggagaagcgccaagacaaccgagctgatcgggagaagcgccaagacaaccgggctgatcgggagaagcgccaagacaaccgggctgatcgggagaagcgccaagacaaccgggctgatcgggagaagcgccaagacaaccgagctgatcgcgagaagcgccaagacaaccgagctgatcgcgagaagcgccaagacaaccgagctgatcgcgagaagcgccaagacaaccgagctgatcgcgagaagcgccaagacaaccgagctgatcgcgagaagcgccaagacaaccgagcaataatgtattaagccattacggatgacattagattttccgacaagaaacgtctactatgaaaatgtttcaataatacaccgaaccttattatgtaaaataatcaaataaaattttaagattaaaaaaaaaacaccaaaaaaa

SEQ ID NO: 86072 - DNA, 491 bp, Heterodera glycines
  SCN-specific regions: Sequence locations=1-333,357-453,483-491
caacgtatgaaacgcatttgcccaacagcaaaattgccatatcagacaaacccagaacgaattggccacagtttttggagggggccaaagtcagtggccaaaagtgcgtcattcatcaatttgagagaggtgactgctcgtttccgattggcccccggccaatacgttgttgtcccttcgactttcgaacccgacgaggagggacactttctgttgaggcttttctgcagcggacagttaaaagcgaacgaactcaactgaccaaagtgccaacgcatttgaagggaagaaaaaacaatggcacaaaagggggaaactgatcagaggacggacaataaatcattcattccctttttcaatggcacatttacgttttcccatttcccactgactgagcttctacccaaatgctttatttggccaacttcacttttgtcagtcgtgtcttttgtctattttaattaatttatttatataaatatcgttttcat

SEQ ID NO: 86073 - DNA, 595 bp, Heterodera glycines
  SCN-specific regions: Sequence locations=1-595
tttgaaaattggcgctagttttctctgctcaaacaatcgcgcccacccgaatttaacacattgcgttttgacttcaaaccagcttcaatttcctccgaggcctcggaagcgtacgtcgttcagtcgcagaatcaaaatgagaacaatttccaggtcgttgtgtttggagaggcgcagaaaaagaccattttcaaaggggcgaagaaggaaatcaaaggggacaaggagtgtttgttggtgtacaacagaaagagcaaggagttgtgcttggagagagtgtcggccaacataaatgtgaagaagacgagggacaccgatttggaccaaaaggcaatcagcgaaatcgaacggctgcaaaagcgtaggaggccaaagcaatctccgccatcgccaaaggctcccgtcgaaaatgccacggcagtcgaaccgccggcggagcagcgcaaagagcgcacattttccacttcttcggcaggggacgaaattgacgaggacgacgaagagaatgtgtcggcattggaacagctaatggcgtcaacgaaagtcgaacgatcggaggcggaggaggacatctttcacccagcacaacaacggc

SEQ ID NO: 86074 - DNA, 511 bp, Heterodera glycines
  SCN-specific regions: Sequence locations=1-511
gagggccaaattgtggatgaattgggtgcacagaatgcggcggaattggaccgagtgcagaccgaggcaaacagcgcgcaaatgcggttgacagaaatgctgaaaaaggcggcggaaactcatcggaaattggaggatgagcgcaatcaactgtttgaaaagcacaaattgttggaggacaatttggaggcgtacaagcgacgctttgtggcccaactgcagcgagcgatggacacgcgctgttcacagatgggcaaagggttgcgcaacgcatttgcggacattgtcggacagatggatactgacaccgtcgtcgtcggccgctggcactagtgcaaaacaacaaaatatgaaattccccgcattccgtctgtaaaatgatgtgtctttacgctttctcctgctgattgttttttttttgctgatcatggaccactgccattcttttttttaattaatgaatgttttattcgaattaattggtaaaagcgcagcacacataaaaatgtct

SEQ ID NO: 86075 - DNA, 443 bp, Heterodera glycines
  SCN-specific regions: Sequence locations=1-44,66-68,91-347,369-443
aagtgctgcggtgaatattttccgggagggaatatttgcccgcgatacaataaaaataaatacatatgcttatgcattttacaagacaaaattgtgtacttcctcaagtacattatattgcatatccatttgcatacttataagaaaaaaaaatgtatcattgaaaaacaaaaaaatttgcgtgccaatgccggtccgatgggaatcccagagccgggattccattcccgacaagggctacatatgctatcgccttcatgagagcttctcgccctaaagcctaaaagccggcacagacctacaaaaaacctgacaattgccgggcttttcatgcaaaattgtaaatccaatcctaatattttttgtaataacatgttttctcgaaaaatatcgattccatgaattgtcggaatttcgatttccgaaaaatttttttgggcgtc

SEQ ID NO: 86076 - DNA, 280 bp, Heterodera glycines
  SCN-specific regions: Sequence locations=1-280
gcccaaagaaagcgtgcccaattgcactggggtatcatcggcttggggaaatcgccaatgattttgagcttgctatggcttattgtgaacacccgaacaaagtgaccgtcgtggccactttcaatttcgtggaaagggcgcagaaattcatccaataggttggcctgaacagcgaacaggtcaaggcttatggcaactacgagcagttgctgcaggacgccgacgtggacatcgtatacatggccacgattaacagcacccatttgccccttataattta

SEQ ID NO: 86077 - DNA, 424 bp, Heterodera glycines
  SCN-specific regions: Sequence locations=1-120,147-424
ccatgagtgttttttcctctccgatggttcgccacaacttttcgcgttctctttgacgaacccgtcgaaatctcttcgaacaccacttacgtcgcctccgccaaactcactgggaatgagtcccactacggcaccaaagggctgcgaaagatcaaattggaacggaacggacggccggacataaattggcacttccaatacgcgcccgggaacaacaacggaacttctgtggaggacggacaaatcccggaaataatattctgcgcaaaacatccgtactaagtgaaaagacggcaaaatgggcggaaaactgacggaagattcacgaatataagtgttgtacatatctaactcggaaatcccaagtgtcgattgaagacaattcatttcccactgtcataataaaataaaaaatggcgaacaa

SEQ ID NO: 86078 - DNA, 231 bp, Heterodera glycines
  SCN-specific regions: Sequence locations=22-231
caagctgaacatccatgttggcaaccagtctttggtggaccaattactagtgggacatgagcaacccgaacaacagtcctgaacagtttgcacagaagctatgtgcagagttgggcttgggcggcgaattcgtcggtgccattgcctactcaataagaggtcaactgtcgtgacgaccagcgtacctacgcgttcagcgagtccccgctggacaccgtggcgtgccctttt

SEQ ID NO: 86079 - DNA, 436 bp, Heterodera glycines
  SCN-specific regions: Sequence locations=1-436
aattccgagcatttgcggctatcagacccaaaatactcaaacatttgcacaataaaatcgtgctcttttgctggcgatcagtatttggtcacaggaagtgacgattggaatatttacgtgtggaaagtgccgagcaattgggacgatttcgccaatggcactgtcaatgttcactccgtcttggatggccatcgctctattgtgaaccatgtgaagtacggaccacgcagcaatttgcttttgccttgcggtgtcgagaaaatcattaaatgttggagtgggctgcctttgcgtgactcgtaccaaaatccgaaaaaacgcgagcgcatttcgacgattcttcccgactttctcggtgatcccgaccacgggtcgatggattcggacacggaggaagacctcgacacattgcaacgattcgacttttattatgaga

SEQ ID NO: 86080 - DNA, 442 bp, Heterodera glycines
  SCN-specific regions: Sequence locations=1-204,227-371,395-442
agttggtggcccgtcctgaacaatgtgacgtcatggtaatgcccagtttgtacagcagcattgtggacaatttggcggccgggttggtcggaggtgccggcgtggacaaccgtgagtccgagggctccgactacgtgatctttcaccctgtcgcacgggacacacttcaaagacgtgtttggaaaacaaattgccaacccaaccgcagtgatcctgtgctgcgccaacatgctcaaccatctccatttgaacagttaccgatcggcactgcgacactctgtggaaaaagcgctcaaagagggaaaactgcgcacccgtgacttgggaggctttgccaacaccagcgattgtgcacagtgaggtcattgccaatttccaaatgtgaaacgaatgattgttgcgcgacagaaatgtgaatgatggcacaacatgccgaaaaaca

SEQ ID NO: 86081 - DNA, 341 bp, Heterodera glycines
  SCN-specific regions: Sequence locations=1-161,183-341
tgactaatgcaaggccatagtcagggaactgatgggacggctaagtgaggagagaagcgaacaagtggagaatcggatgggtttctgcgaacacgctttattaccgggaaagatggtacggggaaaggcgacggtatgatgcaggaacagcatggagacgaacaccaccaccaccattataaccacaccaaaagacgggctcacaggcaacgcagagaccaccaccaccaccaccatggtgaacatggacttgaggattatgtcaaaacgcatttggcatggttaacggatgagcaaaaagcggaaataagcacgatgaaggagtcagggaaaagccgaca

SEQ ID NO: 86082 - DNA, 570 bp, Heterodera glycines
  SCN-specific regions: Sequence locations=1-428,450-570
tgaaacaggcttgaccggaaggacgagaagcaattttggatgtatatgaagctgaaaaacaacacgccaatcttacaagtgaacatcaataaaatggtcactgggttgacagtcggattccgtacaacaaaggaaactgtgcatgccttcgttttagaggcgccaaatggcgaaaaagcaattgatttcaccaaatattatgcctttgatttgactgagcagcaaatttttgtgttccccacattttctgctttacaagatgaattggagcgccgaaaaaaatatgccaacgcctgaacaaattttagcaacattacgccaggcattggccgatttggactcaagactgagcgaaaaattgaaaacggaaacagttaaattgttgaaaggaattgactcggtgctgcacgctaaggctgatcaacatgtacagaaaaatgaaaaagttttgtcatttgtggagcatgcacggaatgccatgttggacagggctaaactgatgaccagccaagttggcaagcaggtcaaggacggactgatgctggcatttggccgtgttgtgttcacatt

SEQ ID NO: 86083 - DNA, 514 bp, Heterodera glycines
  SCN-specific regions: Sequence locations=1-160,186-514
aatcccggcttcttcttcttgttcgtcatcatcgatgtgctgctgcaatgcgttggccaaaatgcatgaaagttttgtggccaaatttcgtgtcatccgaccgcaggccaatctgatcactttggacggggacaacaacaacgacatcattctccatgaagaagcagacgaagatgaagcaatagctcagccctgtacttcttccgccggacaacagccgaggccgattggtggtggtactgctgacgaactgcaacaggaggcggaggacaacgaaagtgttttgctgaacggcgccgaatcgccgacccccggcgccggcactttgggctacgaaattttggcggaggactccaaaacgccggccccattctatgaaatgatgagcgaaagtgagctgaatgccgaacttgccaaatatggccatggtccgatgggaaaacgtgcggctatccgacttttgaaccgaatttatgaggcaacacacccagtgatttcaagcgacacgccaatc

SEQ ID NO: 86084 - DNA, 666 bp, Heterodera glycines
  SCN-specific regions: Sequence locations=1-64,86-666
cctacgttggtatgggtgcacagctcgctgagacgctggtcgaaaatgtggacatccccgagagcgccgttgggctcgtgattggacgaggtggtgagcaaattcagctcatacaacagcagagcagctgtcgtgtacaaatgtccagcgaaagcaatgtcagtggatttcgtcagtgcactttacaaggcgcacgacataacatcgataaggcgaaacaacttattcaagaagtactcgaacgcagcaatagaagtgcccctgggccacaaaatggagccaatgcaataacaattgaactgagcattccaggaccaaaatgtggacttatcattgggaagaatggcgaaactatcaagggtttacaggaacaaattggtgtcaaaatgatgttagtgcaagaaagtcatcaaccgaccatgggaacgaagcccttacgagtttctggacctcctgacaaagtcgaaaatgccaaacgcatcattgagcaactgctcgctggcgatggtactcaaccaaatctttctcaaacgcttcgaggaacaaacgttggaggcggtggtggaaatgcctcacgttcaatcggtgaagtgatcgtcccaagaacttcagtcggaataattatcggaaaaggaggagaaacaatcaaacgtttggctgctgaga

SEQ ID NO: 86085 - DNA, 360 bp, Heterodera glycines
  SCN-specific regions: Sequence locations=1-164,187-194,224-283,305-360
tgcgagtgttttggtggcggacgacttggcggcaccgaatgcctattttcaactgatgacagccgaagaggcgtaccaatatcaataatgaaggcaaatcggaaaaagggtcaccgatttgatttgtgtcttcgccatgccttttatgtatttgcttttgagtatttgttgatcatttttgcctttatttgcattttcatgtctctctttctttgcttcgctctgaatgcgttctcaccaatctctctcacaatcttacattttatatggtctcagccctaaattgttttttgttttcaaagtttacgcacaaaaggtttgtattctgaacttatatgataaataacaccgagctgctca

SEQ ID NO: 86086 - DNA, 458 bp, Heterodera glycines
  SCN-specific regions: Sequence locations=1-458
cggttctgtccccgttgctcctcttcatctttcttctgttcactgttgcctttgccagccaaatgtcttttcgcctaatgatttcgcttgcgcgaagaaaaatgccatttttcacgatggactgttcactcttactgaagacaatcgactccgcattgacccgtcgaagcaaaaaacgaatgacactgggacacaactcgacgctcttctcttgaatcccatcaaagaaagactggtcttttcgctcattttcatcaagggaggcgaaaactgcaagcagtttttcatgaaacatgccgaaaggccgagttgttgtctgtttagcgatgaaatggaattgcataagcatccgtacgcaaaaggcgagtgtcaagctcaaaactgtacttatgtcgacatgacgtgcagtgttcttccgatggacccggttgagggccttaaggattcttaccatttca

SEQ ID NO: 86087 - DNA, 519 bp, Heterodera glycines
  SCN-specific regions: Sequence locations=1-424,446-519
tcgctcttccgaaagcctctgacacattaccaaatcactcaaaatgccctcctaaaaatcgcttcttttacgaatttctgctcgcaaatgaccggcaagtggcgcgagaagtcaaagacgaatatgtggacaccaccagcaaaatgttcttttcttatttcaaggcgtacgtttcccggctgtttaaatttcaaatggtcgactctgcgacaaagtccgatttgctcggggccgaggacgtggtcaaacatcccacgacaatctccgcattgccgagtcttttcacttccggcaaaacccaccaaacgcgaagtcgagcgacggttttttcattgggtcatcgccaaaatttgctgctcgatgatttgttggctccgctcattgtgccccacgtggcgcaggaaaataacgaaacgttccaattcgaaagtctttttcggagtgttcagtacgctttggtcgaccattgcagtcatgagtttctgttcatttgtgattttttcatggtcaatggtcagt

SEQ ID NO: 86088 - DNA, 306 bp, Heterodera glycines
  SCN-specific regions: Sequence locations=1-175,197-306
cataattttttaaataacttcctctcaaatggaccgagcaaatgacttgcgacagcaacaaaacgttccagaatttatttgtcaagaaagactggacacatattctccaattgccttcaaagaacctttgccaggggcgtggaatttgcacagcgagtatttgtcgacgaaaacaaaagaggaaaaggaacgaaaagcttcacgtttcaaaactgagttggatcccgaggatgtgaagctggtcaatgaattgggcatttatcggctgacaaattgatggaatatgttcggacattgcacaataca

SEQ ID NO: 86089 - DNA, 507 bp, Heterodera glycines
  SCN-specific regions: Sequence locations=1-25,47-61,83-367,394 -442,464-507
ttttaaaataaacaaatgtacaaatttttatttttccttcatttttgtatcttaattaaggcaatttcggggctccattgttggaattcgaacatgattttgctgagtgaaatgccggaaaagggcagtgtcactgtacgccaatgtccgtccgggcatcaatgcgtgacggcaaattgttggcttggagtcggcaattacattgtccaaaaatgcgtgccggaccagccaggggccagaaactattgcaaagacttcaacaacatttgccaaatgggctttttcggcatgccaattcattgctcatcttgtaagggtgatctgtgcaacgaagcgcgtaattaacaaatgatgagcaaattagtcaaattaataaactaattaattaattaaactggaataaagaaccgattttcaaattttatgtttgataaattattttatggctattgttgtattcaaattcaattcaattagaataaaaaaattgcccgcaaaaaaaaaaaa

SEQ ID NO: 86090 - DNA, 559 bp, Heterodera glycines
  SCN-specific regions: Sequence locations=1-104,128-246,268-559
atgtggcggcgcactttccccttgctgatcaactaattagttactaattgggctaactctgattaacaaattgtctactgttctactttcgccagcaatggctcccaaatgccttccgctcgaacttttgttcgaaattgtgccttttgtccatgccgaagaagccgttccgaacgtgctcttgtcctgtcggctgcttcataaccttttgcttccatgcgttgtcaaatggaaaaagagaatggcggaagggaaaaaagaagaggacttgacaaaacaatttgctgcaatgtccaaacatttcgaggacaaaatgaaagcgatgtttaaagaatttgaggcaaaaattgatgcgaaaattgaagcattgacaaaacgaatggaagcggttgaggaagaattgaaaaaatccaccgaagaaacgaaaaaatcgaccaaacgtattgaagcggctgaggaagaattgaaaaaatcgaccgaagaaacgaaaaaatcgaccaaacgtattgaagcggctgaggaagaattgaaaaaatcgaccgaagaaatgaaaaaatcg

SEQ ID NO: 86091 - DNA, 560 bp, Heterodera glycines
  misc_feature (14)..(14): n is a, c, g, or t
  SCN-specific regions: Sequence locations=1-28,50-296,318-560
cacgctgctccttntactaaattgccattttcattttctgttttcctttttgctttcctctaataatgctgctgttttggcctcttactgacgacgaagacgtggaggacaaggaggacgactgggaattctgttgtggcaccattcactcgttcatcggcacttccctcttcatggtcggcgaccttctcggacttccgtctctgctcgctgcttacgttatcgtgctccattatttggagggcgactttacttacgtccatttttgggtgcccattgtcgtcctcactttgggcataatctcttccttctttggcgcggcttccatcgtccgattgtacctttgtctgtttcgtcatcgctgttcgcccttacacgaccgaattgtcaccgattcaatgtccatttatttgtacagactctccctcctctctctgttctctgtttcgtatgtttcgttcattttttggcaacttttcggtgggccacgcagccccgaggacatttgcgactgggagcgcctgtggggcttcttccactgtctttgggtttgggtccgt

SEQ ID NO: 86092 - DNA, 561 bp, Heterodera glycines
  SCN-specific regions: Sequence locations=1-561
caatgctcatgatttttgttaacaaattccgattttttattggaatatagcgacgagaaagcgctttcagcagtggaaaatggatttttaatgcgatgttccgatttggacgagcattggtttgattgtcagagtgtcaccgaatcggtcaatgccactgacatcaatcaaatggaactgctttgtccttatttcggcatttcgaagggtccacttctttttgccaatataagctgccgagttttgccatgcattgaatgctatgggacaagaaactttgcgaaagaatttccctgtaaaaagtatactggtcattactttctctcggcacttctttattccattttccttggaccttttgcggttgatcgcttctatttgggttattcggcgattgcgttgggcaaattgatgacattgggagggttgggtgtttggtggttagttgatattttcttgccgctttttggtcatttgaagcccgctgacgagtctgagtggcagccattttgataatgaaattcaagtgttcaaaaagatgttttggtttgatctcagatt

SEQ ID NO: 86093 - DNA, 487 bp, Heterodera glycines
  SCN-specific regions: Sequence locations=1-487
tgaaggaattgaacctggaatatgacaattgagccttcgacgctcacttcgcttggtgtcagttgtccgggcagagtttgctgtgcctccgattcagtgattgttggcacaatgggagacgatcggatggagaacaatggcaattttctgctgttggaccgtctcactttcgaaccaatcggattttgggcagagaaagaagggcaaaaaggcacaaaatttggcggaacagatttctgcattcaaaccaaacaaaatgttttgctgagcgtcgggtggggaacgccggccaaattccgcggcggacttcggccgagagacgtgacaaacggtcattacagcaacgaagtgaatgtttgggagtggcgccaacgccgactgatccaaaccatcgctttggagggcgactgcggatggatgccaatggccgtgcgctttttgcacaacgccgacaaatgccatgcttttgtgtgcactcttctcggct

SEQ ID NO: 86094 - DNA, 449 bp, Heterodera glycines
  SCN-specific regions: Sequence locations=1-73,97-238,260-449
cgcgccgaacgccatgagcagggggcttcggcacaaagccatggttcagcaacggctccgcgagagtgcgaagaaggcaaaggataaggaagttgaagaccatgaacttcggatgacactttttgtcaatggaacaggcggcgcgggcgagcttttcctctcgggaggaacgcgaagtgccaatggtcccagccccacggataattacatcgcaaaagcaaacggccgaaccgaccgaagaagacgaagtgaaagcaaagcttagggaacagaaaagaaagctcgccgcattgaaaaaacgttcaaagcaatcgcaattttggtcaccggacgaaggggaaatgggggaaggcgacttgccacttgaagaggaattggccgattgggtgcaggcggagacatcggacggacaattttactattggcacatttatacgggggaaactcct

SEQ ID NO: 86095 - DNA, 384 bp, Heterodera glycines
  SCN-specific regions: Sequence locations=1-15,40-384
gtatggttgttggtaaccaagatggaaatgaagaggaccgaattgctgaggatacagcgttggggtggccgggattctatcgacgcttgagacaattctcggcctattggaggagcacccggacattgtgaagcgagtggagcccgttgtgcgaagttgcatcacaacaatattcgatgcttattgcgaaacttattttgaggaggcgctttctctcacccattccctcgttttggtgcacatttcgcctgagatgtggacggtttttgaccatatttacaaggcttttctggaggaaggcacttcatttttctcagattgtgcaccagtgctccacgctttttttgaccaatgacactgacaattttctgtctgtttttgacc

SEQ ID NO: 86096 - DNA, 319 bp, Heterodera glycines
  SCN-specific regions: Sequence locations=1-319
ttgaacaattctttaacaatactgctcaactggccggatggggaaagattactaaatgtgttgcgaaagaaaaagctatctctgctccttatttgattggtcgggctgtccaattgtctgaatgccgtaaattgtatcgaggtgaccgaatttgctttcgtgggatcgcatctcaatcaggcgatactggcagcgcagtattggccagcaatgggacagactatgtccaaattgccgtttcttcttatgtagaatgtatatcgtcagctcctgaagcctcctacgccatttactctcgaatcgacgctaaatggcttga

SEQ ID NO: 86097 - DNA, 553 bp, Heterodera glycines
  SCN-specific regions: Sequence locations=1-133,155-167,189-528,550-553
attgaaggggagcattacgcaaaatctgcccaaaatgaaatccaatttgtgatcgtccgcttgcttttcactttggttatgtttttcggttttgctattcaaatgtacgtcgtggtggaaatgctgtggcccgaatttgtcaaatttctgcgcaatttatgtccaaattttggggtttataatgaaaatgatcacaaaaatatggtcggcattgaattgctcttccgtgccgcgctcgtcaccgtctccatgctaattggcctcgctgtgcctgaattggagaatatcattccgttggttggactccaccgctggaatgcttttggcactgattttccccgctcttctcgaccttctcgtttttctgcccattcatttacaacgccacagaattcgtcaaactttttggcttctccttgacaattggacacttgtcgccattggagtctttggtttaattgccggactgagggcgaatttgcggaacatttttacaccggcagaagatattgttgcataataaaacggaattaaatatttttaaaataactag

SEQ ID NO: 86098 - DNA, 306 bp, Heterodera glycines
  SCN-specific regions: Sequence locations=1-306
aaggaggaagcgaagctgctgcgcacgcagctgggcgacatgcgcggaaagttggccgatttggagggacgcaactctctgctggagagacaggccgaggaattggcctaccaagtggaggacgaccaaagggcgtacgaatcggcactgaacgacaaggacgcacagattcggaagctgcgcgacgaagcgcaggcactgatgttggagctgcaaatgttgctggacaccaagcagacattggacgccgaaattgccatttaccgaaaaatgctggagggggaggaggacagatcggggctttat

SEQ ID NO: 86099 - DNA, 444 bp, Heterodera glycines
  SCN-specific regions: Sequence locations=1-362,440-444
ttccagcggttctggatgtggacatatgttgatcgactcctgaagaaaaagaagcaatacgacactgaatgtcgaattgattatgaagagtattttaccaaagaagaacgagaacttctaagccctattcccgcattccaaagtatcatggacgttcgctacaatagcgagctccttgaatccaacattcgcgtgtccctcctccactttgggggactacccgccgactgcagatggccaaatggaaaaagtccaccaaaaagggatgaaatcaaaaaagttaaaattttaaaaacaataagtgcaagcacaagaagaacaattatctgttccatagcataaaataaaatttcttttaaaccaaaaaaaaaaaaaaaaaaaaaaaaaaaaaaaaaaaaaaaaaaaaaaaaaaggaaaaaaaaaaaaaaaaaaaaaaaaaggtcc

SEQ ID NO: 86100 - DNA, 386 bp, Heterodera glycines
  SCN-specific regions: Sequence locations=1-128,158-386
gcgctaacggaggtgccgaactacggtggacgaccgtgcctggatgatgtcgttggtgccctcgttgaccgtgctggccgctgctcatttgctgtacccgcgcatttatccactgaccgcactcggcacaccccaacaacagcagcagcaacagttggcggacgatggccacaatcagcagacagcggcaaacggcgggggaatgccaagcggcgcgaggaccagcacgttgtactccttgcttgaggacgaactcgccgccatgggcatcgccgaccgcggtggcacggacgcgcaacaacagttggtggtggaagtgccggcacaagtccgcgcctcctttgagtacttccaaccgcaagaggcctatctgatcgagaatgggc

SEQ ID NO: 86101 - DNA, 563 bp, Heterodera glycines
  SCN-specific regions: Sequence locations=1-185,207-563
acgactcgtttcgatttcctttttttcttcttccttcctatggcctctgccccgtcctccgatcgcttttcctccgatcgcttttcctccgatcactttttctccgatcggtcccttcgcccgcaatgtctgcccaattgcgcttctctctcttttggctttgtagtggacaaattggcccagcattgtcactgctttagccatttgttcgaatgcggccaacgcattttcgaagtcagtgccaccgaattgagtcccaccaacggattcacttcacgagtgtttcgctgtgaattcgaatttggcgcatttgtcggagaaaagcgaatgccaacgccaaagaagcggacaatgagtgcaattgcaaaagtgatttcactggagagaatggacactttgtgggagaatttcgttggcaaaaagcaaatggaaaagatgcgaaatagcagagagcagacagaaatgataaaaagcactcttttgcaattacaccgcaacgaatgcaatttgtacaaatttatcggctcttccgcgccccttccgcttccgaaggttttttacac

SEQ ID NO: 86102 - DNA, 528 bp, Heterodera glycines
  SCN-specific regions: Sequence locations=1-29,51-330,352-528
ttgcgcatggcctgcgggcaagaaagcgcgaattccctgccaaaattttccgacccacgccaattgtgccgacatcgaaataccgacacagtgtggcggacggaatgctgacaagagatttgagggacagtcaagtgtggaaaacggtggtgacggtggacggaattagtggcggacaagcggaacggcgggggcagcggagcaccgcgaaagacgaaaagcggcacggggacacagaggcggttgcactgcgccgccacttttacgccgaaaagccaacaaacgaacaatggcagcagaacggacgagtggcattggacgaggacgggcacaacgccaaccaacaaaagttggaccgagcgccgaatggtggacaaattcgacaattggtgtttagcgtgggacgaactcagttttcaatgggcggtgggcaaagtgccggcccattggtgcagtgccatgcccggggcgaaagtcacgacagtttgggcagcaacagcacggccaacatgcaccgctgcatttcgc

SEQ ID NO: 86103 - DNA, 471 bp, Heterodera glycines
  SCN-specific regions: Sequence locations=1-37,60-375,397-471
aagtgcccgggactatgcaactgctgttcacaagcagcacagctccattcaacccaaatgcagcagcaacaatatccatcaacagcagcaagcgaccattgctcagcctcagcaagctgtttccgccggaatgggcgcagtttcttcttctggcggacctgcgattaatccgcaaactggacaaccggactacagtgcccagtgggccgaatactaccgcaccatgggaatgcatgaacaggccgcactcatcgaagctcagatgaagcaaacccacgccgccgctcaggcacaacgtcctcagcaacaactttacatgcaatgaaggcttgcagaactcgtcgaagaaagacaataatgtggctgaatttctggttatttggattgctttttctaatattatcagtttccgttcgatttcttttatatttaatcatcattacgaaccgttctttgactgatttatttgtc

SEQ ID NO: 86104 - DNA, 286 bp, Heterodera glycines
  SCN-specific regions: Sequence locations=1-240
catcattatggactgtatgaaatgaaaaatgaattctctgtttatattgtgtcaaacataaatctttatgaactacagtacatgtaaataagcattcagttaggctactgaaagtacatatacttcagttaatttatttctcattttacaggggcattttggactccatctatgttttaggatggacttctcataactgatgtaatatctggttcctttgacctatttggtctttagtggatattaatataaatttgatttgatttcaaaaaaaaaaaaaaaaaac

SEQ ID NO: 86105 - DNA, 588 bp, Heterodera glycines
  SCN-specific regions: Sequence locations=1-27,50-84,106-197,219-588
atcttcttgtgagacttctccttatgacacaacattattggcattttcatcatctcttcttgttttttggcatttccttatggcacaacattcttagcattttcgtcgacttttcgtttcttgtggcatttccctatggcacaacattcttggcattttcactcatctcttcttgttttttggcatttccttatggcacaacattcttagcattttcgtcgacttttcgtttcttgtggcatttccctatggcacaacattcttggcattttcatcatctcttcttgtttcttgtggcatttccctatggcacaacactattggcattttcatcatctcttcttgtttattggcatttccttatggcacaacatttcttatcttttcctcgtcttttcttatttcttgtggcatttccctatggcacaacactattggcattttcatcatctcttcttgtttattggcatttccttatggcacaacatttcttaccctatggcacaacattcttggcattttcatcatctcttcttgtttcttgtggcatttccctatggcacaacactattggcattttcatcatct

SEQ ID NO: 86106 - DNA, 569 bp, Heterodera glycines
  SCN-specific regions: Sequence locations=1-569
acatgtgtctcttttccctacattttgccttgcgttctgtcccttttttctcctatggctctccccacaaattgctgcgtgtcatttgtgccagcatcgacccacgccaactctcccgactgatgagtgaaattgtgcgcgagaacattgtgctcttttcccctgatgaaatccttgttctcttgcacgactcactcaaatgggaatccatggagcagttcatgctttggcagttgatccaagtcgaagcagtcgagctcgacaaatttctcgatctcttgcaaaggttgaattatgcacaacaccccgaggcaactgcagcgattctcgtcattatacggaatatggaacccgacccggacccggctgttatgcgttccctgttgaggaacttgtttcttagacagccggacagggatttgttcacagttgatgctcttaaattgatcgttgattacagtgacaatattccaccaatgagcgattgcatcagcaaaatggtcaaacacgccattcacaatgacgaaattattgcgccatttggacaaacgaaattgggcaaggcacgt

SEQ ID NO: 86107 - DNA, 598 bp, Heterodera glycines
  SCN-specific regions: Sequence locations=1-27,49-182,204-298,321 -480,503-518,547-598
gtaataaaatattaaaagatccgaaaaaatgccaaacattttcaaaatccttctgattgtgcttttggccgtcgtctcattccgtctctcggcttctactggtgacaaaaaagctgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgaccctcattatcattagggccatggatggatctaacggaggaagaaagaatggatgcttagttttcagattttattctatcctcttttatttattagtttttcaaaacaaatttcttccacaactttttaaactatttgctgttttgaatctttttagataaatctaaac

SEQ ID NO: 86108 - DNA, 544 bp, Heterodera glycines
  SCN-specific regions: Sequence locations=1-544
ctctctgatttttttttttgtcgtcttgcaattttggtggtacaatgtcaaagggcaacaaaaatgtgaaggccgtggccgttttgggattggatgacacggacacggatgccacgatcgacttggaataccacgaccgacttgtggaggcatcgaaggacttcaaaagcgaatacctcactaagaattgctccgtctccgtttcaaattggtcgccactggcgtgctgaagctggggcgttcgttggacggtctgcaaatcccgcctccaatactcgaaaaaattggcgaactgtttgactgtttggactgggctttgtctgccgacgacgaatgaaacaaattgagggatcaaaggccaagccgaaactttggacggatctttcacccacccgtgtcctcccaaaaaaagccattttttaccccgtaatcgaatttttgtattatttttttgaccgaatgatatcacgcgacattcatttatttttgcccaatttatcatccttccaaatccatttttatcatcttttctctctcattcaat

SEQ ID NO: 86109 - DNA, 582 bp, Heterodera glycines
  SCN-specific regions: Sequence locations=1-282,304-356,378-582
ggtgtcggacggccgttcccgcgggttatgcgtttccccgggtggcagccgtttttggccattctgagagaggctcttctgatgggtggggtcgaaatcaaagaagtcgccgctaattgcctctcgcaactcatccctctgagcagtgaggcgggacttagaccccacgttgtgaacatggccggtccattaatcagaattttgggtgaacggcacccggtccccgtgaaggtcgctgctgtcaacgcgttgctgagattgctggagaatgtctctctcctcctcaaagcgtttctcccccaaatgcaaagtgtcctcctcaaaattctacaagacccgtcttctcaaaatcttcggcagttggcttcccaagcagttgtccatctgatcgatttgcacccgaaacctgaaacgattttgaaagagttaaacaaattgcgtgaggctgataagtcgccagaaggattggatttgcataccgacaaactgatcaacgaactgatcgccaaaatcgacctgaaaaatggaaacacttcaaaataacagtgaatgaaaatggtctgcctatgacgcgaattattg

SEQ ID NO: 86110 - DNA, 383 bp, Heterodera glycines
  SCN-specific regions: Sequence locations=1-383
tcattttaaaatgcgacacttttatagcattttatttgctcttgcacttttatgctcggcattcgtttttctgagcgcggaagaggacgcggccgaaggggaggagaaaccgaaggcggaggaacggacacagcgggaggtcgatcccgaggctgctgatctgattggcccttcttccgatgtgcaaagttcctttttgttcaccaatttgaagtcgggcgcctcgacgacggatttgatcgcaggagaaatcgtcaagtttctggtcgggttcgccaacaaaggcgagaaggacttcattgtcaagcactgcgaaacgtccttccgctatcccctcgacttttcctaccatattcaaaatttctccgccgtacgttatgaac

SEQ ID NO: 86111 - DNA, 465 bp, Heterodera glycines
  SCN-specific regions: Sequence locations=1-60,82-465
attttttttgccgccatttaataatctcccatttttattttttatggccctctctgcccttctgcttcttctccccctgcttctcaatgttcaaaatatcccagatgagtcagtccaatcggatatgaaggctgtttattcggctatttcatcgccggaacaatggaagaactcacaaaattcattggcttcactcgaatcacaactgacagagccccaaagagcactggcaaaaatgcattgggaattggagaccatccaaaaggaaaagccggaggcaccgccacaattcgacttgggacttttctcggaagctttggaagtgatggtcgaaatggacgaagaagcgaaagaagtgaagctgaggaaggacaaactgattgaatgggcaggaggagaggaagcaaaaaaaaattgaaggaaaagatgacggaggaggacacagtgccggaagtgagggtgaac

SEQ ID NO: 86112 - DNA, 645 bp, Heterodera glycines
  SCN-specific regions: Sequence locations=1-207,229-312,335-502,524-645
tggacttacgtgaaaaagctgttcatgcccggtgtttctgctggttcgtgtctttgccgccgcttttcctttgttggccgtcattccctttatgctcggcctttacttccaaatgctcgtcatttctcctcttcgcgtggccattttccaatcgccgcttttcttcccctggaaagaatgggccatgggtgttgtccacttcaaaattgtttgtgcttccgttttgatgggccccgactggtggctgaagacggcttttgaacagatttacgccgatggcatttggaacatccgtttgcgagacctttacacgaacctggtgttcccaattgtgaatacactcacttttctgatcgcgtttccttacgttctcagcaattttctcctcttttttgtcgatgcttcacgcgaggaacaaatcattgtgatacgatttgcttatccgtttctgctcggctccatttgtttctgtgctttaatcacatggcaatggcaaaagctcaaacttttggcccagaaaattcgtaacgacaagtatttaatcggcacacaattggtcaacttttatcgtgaaaacacttccgccattgtgggcaattcgacagtcaaaaaatcagtgacaccaatggaatcgattgtaaatca

SEQ ID NO: 86113 - DNA, 483 bp, Heterodera glycines
  SCN-specific regions: Sequence locations=1-355,377-406
attgatgaccgaacggaccacgaaatgctgacatttgagaaagaatacgatcatgaaaatatggaggacgatgaaaatatggaagacgaagatgcaagtgacgattggctgttgaagcgatgccaaattggagaaacggcgacgattcaatgggtgtgggacccgagcgattggcaaaatgtcagccttacgctcgatagtgtcaggaagaattgcattgggcaattgtctccacccaaggcggaccaaatgaatgcaaaaatcgtctgaaaatgagcgccgggcccagcggaagaaaaagtgaaagaattattgagaaatgacaaatgagtgatcattatgaatggaagttgatctgctaattgcatttgttgcttctttcgtttgaatacatttatttggtttgaaaaaaaaaaaacccaaaaaaaaaaaaaaaaaaaaaaaaacaaacaaaaaaaaaaaaaaaaaaaaaaaaaaaaaaaa

SEQ ID NO: 86114 - DNA, 633 bp, Heterodera glycines
  SCN-specific regions: Sequence locations=1-201,223-306,329-496,518-633
ttcgtgaaaaagctgcccatgcccggtgtttctgctggttcgtgtctttgccgccgcttttcctttgttggccgtcattccctttatgctcggcctttacttccaaatgctcgtcatttctcctcttcgcgtggccattttccaatcgccgcttttcttcccctggaaagaatgggccatgggtgttgtccacttcaaaattgtttgtgcttccgttttgatgggccccgactggtggctgaagacggcttttgaacagatttacgccgatggcatttggaacatccgtttgcgagacctttacacgaacctggtgttcccaattgtgaatacactcacttttctgatcgcgtttccttacgttctcagcaattttctcctcttttttgtcgatgcttcacgcgaggaacaaatcattgtgatacgatttgcttatccgtttctgctcggctccatttgtttctgtgctttaatcacatggcaatggcaaaagctcaaacttttggcccagaaaattcgtaacgacaagtatttaatcggcacacaattggtcaacttttatcgtgaaaacacttccgccattgtgggcaattcgacagtcaaaaaatcagtgacaccaatggaatcgattgt

SEQ ID NO: 86115 - DNA, 688 bp, Heterodera glycines
  SCN-specific regions: Sequence locations=1-357,379-688
aggaagcaaattatgaatttgcgaatattacttttctttgctgtatttattccttcagcgaggtctttctatttgccaggtttagcgcctgtgaacttttgtgagggaaaggataaaaagcccacttgcccgaataaagtgactttgttcgtaaacaagcttgacagtgatcaatccgtcatcccatatgaataccacagcttcgacttttgtattggtagtgagcaagagtcgcctgtcgaaaacttgggtcaggttttgttcggtgaacggattaggccaagtccctatgagataaatttcaaagaaaacaaacagtgttcgtacctttgtgagaaggattacaaaagttcggacaaatcacaccaagaaaaattgcggttgcttcagcgtggaatgaagctcaactaccaacaccattggatcattgacaacatgcctgtcactttctgcttcataaatcaacaaaatatgaatgtatgcaccactggcttcccaatgggttgttatgtgacaaaggaggggaagcccaaagatgcctgcgttttggatggacgttaccgacagcaggacagtttttacctgttcaaccacgtagatattaagattgagtacagagacatgtctgatgatccaaatttcctcgatgagaaaattggtggccgtataattcggatcaaagtgcagc

SEQ ID NO: 86116 - DNA, 706 bp, Heterodera glycines
  SCN-specific regions: Sequence locations=1-706
gtactccagaaagctagcgaccctggagagtgctcgccattgccgaattttcagctcaggacttgccgcaattgcagcagtgtcccatttgcttaattccggacagcatgtcatcgtgtcgggggattgtaacggcggcacgaaaaattatttcgacaaaatttgtgtgccgcatcatggcttggagctgatttttgtggatttgacgcgattggaaaacttggagaatgaatttaagcccaacacaaaaatggttttgtttgaaacaccctcaaatccgcttctaaaaatcgtcgacattgaagcggtgtgccgtatggttcgagcacgctcaaaagattgtgtcgtcgttgttgataatacgttcatgacaccgtactttcaacgcccgttggaacttggcgccgatgttacggtgcaatcgctcaccaaatacatcaacggacacaccgatgtgctgatgggcaccgtagttaccaacaaggagcagcttgatcagcacatatacgcccagcaaatttatgctggcgccgttccgtccgcctttgatgcctttttggtgcttcgtggcatcaaaacgctcccattgcgaatgcgccagcacatggaaaatgcgctggcaattggacgatggcttgagaaggacccgcgtgtggaaaatgtgctttatcccgagctcgagtcgcatccgcaacaccaaatccac

SEQ ID NO: 86117 - DNA, 798 bp, Heterodera glycines
  SCN-specific regions: Sequence locations=1-798
accgtttgagtgagctattggtgctgattgtgagccgacatttttgcgcttggttttttgcgggcgatcacttgccgatggaatgcaaatatcaactctcgaacttggcccaaccacttctctcactctgctgatggatactgcacccaatttggatttatcttcttctattggccatccgtcgattgattggccagttggggcgtgttccactggaaatgactctgccgatgaagagcaatgggtgaaactctcttccgaccaatttgcggagaatgcagtgaatttttctgatgaaagtgcgttcagtgcctttttcgtcttttgcaaaagttgcgtttcgctcgaatgtgccaaattgcgtgcgtattgtcgcacgtgcgaatcgtccgcaataattttcctcaatgagccgcaacaatgggacgacgtcaaggagaacaattccattcgcatttttttgccactactgtgacaaggaaagttgcgtttcgttccgtttcaaatgcgttaaatgtggcgaacccgcttcacccctccaacacatttctcgcaatttctctctgcccccctccgaatgtgtcatttgcggctccaattcgtttcccttgggcgttcgattgcgcgactgcacccatctcagctgcgttcaatgtttcgtcgcatatgctgaagaacttttgtcccggatgagtctaaaatggcacccccaagtcggttacaccgtcggatgccccttttacgggtgcaccgctgtcgtcaccgatgttcacactttgtatttgctgggcaagcctt

SEQ ID NO: 86118 - DNA, 234 bp, Heterodera glycines
  SCN-specific regions: Sequence locations=1-130,158-196
tgaagaatgcgcttgttcgcatgatcaaaggcaacaaataagcatgatcagaaaaaaacaatgatcactttgacactttcgaagagagaaattcctaatagttactgttggaagataattaagccttcgctaattgcttttttaaaaatttaatttgcttatttttttgtaatgttgataaatttggcttgcttttaaaaaaaaaaaaacaaaaaaaaaaaaaaaaaaaaaaaa

SEQ ID NO: 86119 - DNA, 560 bp, Heterodera glycines
  SCN-specific regions: Sequence locations=1-81,181-306,330-428,480-560
ggctctgcgaagcagcaatgcgacgtatagggtctgacgcctgcccggtgcctgaaggttaaagggaggagtgaaagctccgaactgaagcccaggtaaacggcggccgtaacaataacggtcctaaggtagcgaaattccttgtcgggtaagttccgacctgcacgaatggcgtaacgacttccccactgtctccagcacaggctcagtgaaattgaattccccgtgaagatgcggggttcccgcggtcagacggaaagaccctatgaacctttactatagcttcgccttggcgttagcgaccgtatgtgtaggataggtgggagactatgaaaccggggcgccagctctggtggagtcgtccttgaaataccacccttactgtcgttgacgtctaaccgagggccgttatccggtcccgggacatggcgtggtgggtagtttgactggggcggtcgcctcccaaagtgtaacggaggcgcgcgatggtgagctcagagcggtcggaaatcgctcgtcgagtgcaatggcataagctcgcctgactgcgagactgacaa

SEQ ID NO: 86120 - DNA, 494 bp, Heterodera glycines
  SCN-specific regions: Sequence locations=1-494
gaagtgtcgccggacggggactgcctttcagtgcggtggcacaccaagcgaatgtttcgggccttggtaagttttctgccttcgaaatacgtcggatggcggcggattacattcagcaaaatcccgaggatttccttccctttttggctaacgaaaacggagaaatgttcaaagatgagcagtttgacgaatactgctccaaagtggcgcgaatgtgcgcaagcggcggaacttggggtggggagccagaacttcgtgcattgagttgcgttttgcgctgtcctattgaagtgctgcacgcggacggagcaacaatcaaatttggcgaagtgttttctggccatcccctcattgtgacctaccacaaatttgcctacactctcggggaacattataatagcactaaaccgaccggagaatgatttgaattttgtaattgttacttttttgtttgattttttgtttggttttggcgaatacatttccatgaacgt

SEQ ID NO: 86121 - DNA, 176 bp, Heterodera glycines
  misc_feature (32)..(33): n is a, c, g, or t
  SCN-specific regions: Sequence locations=1-176
cattggtcgaaatgcatattcaaccgtccttnntttctaattcttaaaattattttcgtcgtattttaatggggtttaattttgaatttaccgaagaacaaaaacaactccaagcggctgtaaagaaatttactcaagatgaaatcattcctaaagcgtcacattatgataagaca

SEQ ID NO: 86122 - DNA, 621 bp, Heterodera glycines
  misc_feature (445)..(445): n is a, c, g, or t
  SCN-specific regions: Sequence locations=1-453,475-579,603-621
gtcccgcaacgatttcggcgatttggcgcctcctgtggccgtgccccgcaacgatttttgcgatatgccgcctcctgccgccgtgtcccgcaacgatgtggcgcaaacgttgtcctcggtcttcaagaggaacgaagcctattatgaagaggactttcatgcgttggcgtcgcctcggaatggttcaccggaaccacgaccggcgaaggaggagccgcacaatctgcagcaaccacgaccggcgaaggaggagccgcacaatctgcagcaaccacgaccggcgaaggaggagccgcacaatctgcaacaaccacgaccggcgaaggaggagccacacaatctgcagcaaccacgaccggcgaaggaggagccgcacaatctgcaacaaccacgaccggcgaaggaggagccgcacaatctgcagcaaccacaaccggccatggantgtggcggtgccgccaccgccgccagcagactctgtgccgtattcaagtgacgaatattactttgaggacatttctgacgactcagagagcgattgggacttacttgacgaggttttggatcacaatgattggaatgaggaggaggatgacgaggaatgtgacgcgttcttagaca

SEQ ID NO: 86123 - DNA, 698 bp, Heterodera glycines
  misc_feature (632)..(632): n is a, c, g, or t
  misc_feature (668)..(668): n is a, c, g, or t
  SCN-specific regions: Sequence locations=1-698
ggaaccgggccgcgtacgcgtcgtacagctctgcccttcgcgagtcgctggtcgtaatcgaaactgagtttcttcttgcgaacaacgcagtgctgaacacggacactgtttcacttacgcaaaagtcggaagaactcgtcaattatcttttgtgccgaaatgaaattgactgggcggaaagtgaatcaatttctcgatgtttcaatatcgtcgactcaatttcaaaaatacattctgtagatgttgagagggtgtttttggcgctgatcgatcgttgggtcatcgaaggccaagaacagtcggaccaagccgtttcacagatcacttccgaccccgactccaccatcgactttactggcccttcggttctgtccaactcagtcaacaccgatgattccgactttttcgttccggtcctttacgacgacattcaaacaactcggatcattgtccttttgcgacggattagggaaccgacgaagaaaatcttggaattttcacacaagtctgaaattgatgtgtcggtgctccccggcggttatttaaccaaagttcgcattgcctgctgcattttgcgctttctgaccgatgaacagatgaggacaatgttcaacattagcatagaccaattntacggaaatttcgtcactatgctcaaccagcggctntactcattgtgccgcatcgattcgtcgccg

SEQ ID NO: 86124 - DNA, 638 bp, Heterodera glycines
  SCN-specific regions: Sequence locations=1-613,635-638
ttaaattatcctcccaaatgcgtaccattcccttatggccatggtttgcttggtgatggctgtcctaatggaaatggcaaattcaaaagcagtcaaaaaagacaataaaaaaggagcagtggcggcatcaccagcaaaaggaaaagcatcgccaaaaggaggcaaaagcccagcaaaaggaaaagcggcaaaagttagtaaaaaagataacaaattgaaagcaaagaaagaaaccaaaggcattaaagttaaaaatgcaaagccaacaaaaaaaggtaaatcggcaaaaggcgcaccaaaaacagccaagaaagtccaagccgccaaaaaagcaccaggaaaggacaaaaagtcgctagttaagccaatcgtccttaaagcaccggtaccaccccataaaatgcacccgatgattgaatccgaagctgtgccaccgcccgcccatgcgcgttcgcttgcgaccgttccttacagtacaccgggggcagccgaccgtaactcattgccatcgtacacttcggctggcaccaatttggacatggccgatgataatgatgattatcagaattattactacggaacggaagacggcagcagggaatttgatgcatcggcggaggaggaggatgaactatatg

SEQ ID NO: 86125 - DNA, 617 bp, Heterodera glycines
  SCN-specific regions: Sequence locations=1-151,188-617
agtttgcttcgttcttcagaattcgaccaatttgctaatttttccgcgtgtttctcctcaccctctgatggcagtgctccccgattggaaggttcttcaccaccaccgttggcatcttcaattcgcttcccccactttgtttctcgtcagaaatttactctctcttccacatatgaaaagcaagactggttcccaaaacacatgggcgttcaactgaaagtagtggagggaaaacttcgaaccgtcgatttggtcattgaagtgcatgacgcccgggttgccctgaccggaaggaatccttcgttcggtgccaaattatattcagtgcgaccgcacattctcgtctttaacaagatggatttaatcaacatgaaacgctacaaggaacccatcgaagagtactaccggaatgagcagaacattaccaatatttgctggacaaattgcaagaatttgacaaacaaaacgcagtttcaaaatttgatggacaaaatgttggatttgttgcgaaatgaacatcgcttcaacagaacagtgaagacggaataccaagtgatggttgttggtattccgaatacaggcaaatcctcgttgataaacgcattacgcaatgtgaa

SEQ ID NO: 86126 - DNA, 369 bp, Heterodera glycines
  SCN-specific regions: Sequence locations=1-369
tggcggtcgcgctcgttgttactgacgccgtttcccacccgcccggcgtggacagtgtctggcattccccaccattccacagtgtgccgcgttttgctgtctgtcgtgacagagaaatgtgaagttgagaaacagtggagtaaatgtggaggttgatcagtacggaagagagtaaaagtgcggtgcgttatacgtcgttaaatccaagtcgtttgggtggacagagaaaatgaggtggagaaatagttgatgtggccggccggtgccctctgctgctgccacagagagaaaaagagagaaaaaagaaactggggagcagagagaaagagggggcaggaatttgccacactgttgtgttcagtccagttg

SEQ ID NO: 86127 - DNA, 130 bp, Heterodera glycines
  SCN-specific regions: Sequence locations=1-3,25-33,56-84,125-130
gaatttattgacgtgtttatgaattcgttcgccatttagcccccctccccatctctgttccgtaacaaattaattgaaatgcgttgctgctgctgctgctgttgttgatgttgctgctgttgcttgttgg

SEQ ID NO: 86128 - DNA, 459 bp, Heterodera glycines
  misc_feature (438)..(438): n is a, c, g, or t
  SCN-specific regions: Sequence locations=1-381,405-459
cagagatttccttcccttcggcaaagaattgccactccgaaaaaactttaacgcgattttatggcatttggaaaacgttcgccaatgaggccttccaacgcgaatttatggccttcggaaagcgaggggcaccgtctgatcacttccaaagggattttatggcattcgggaaaagagtcccggacggatttcagagggaattcatgacatttggaaaaaggagcagtgacgttggcaggggaggatcattcgacagggaattcatggcatttgggagaagaaagtgaagccgaaagggagagacggcgcgagagaaaaggacggcacgcactgatctaaggatgggattgatctgatcgacagaaaacagcaaaataaacagattcaaatcaaaatattttctgagacgaaaagcggataaaagtgaaaatgtcaacnaaaaaaaggataaaaaagaaa

SEQ ID NO: 86129 - DNA, 313 bp, Heterodera glycines
  SCN-specific regions: Sequence locations=1-313
cgcttccatttgatgacacttattctgctgctattggttgttttgatggtccaactgaacgagtcggcaccggcagatggccaaggaggacacttggcaatggttaatgaagcggaaaacgaagccgaccattctcttaccgttttgcgctttaaacgttcatgtccacccccgtgtcaagaaaaagattgtccttctcctatgtgtgctctatgcagtttctgcggatgagcgttttaaaataggcaggcgaaaggaacatttgcgacgggatgacaaaatgaatgggaagaaaatgtgattttttaactaa

SEQ ID NO: 86130 - DNA, 227 bp, Heterodera glycines
  SCN-specific regions: Sequence locations=1-160,182-227
ttatggaacgcacttttgtctgcataaacccgaatccgtccgaaggggcctggtgggaaagatcattgaacgctttgaagccaacggctttcggctaattgccataaaaatgatcgttgcatctcgcaaacaagcgatggaccattacgtcgcttgtgccggccaaccctttttccccaaagtgatcggttatatgacctcgggtccggtggtggcaatgatctggg

SEQ ID NO: 86131 - DNA, 185 bp, Heterodera glycines
  SCN-specific regions: Sequence locations=1-185
aagagtttccctgacgcatcgcttcattttgccgagactttcgaccgcgccatttttttgcttcgcgcagactgtcgtacttcggagaaacacgtcacttttctgcacattctccgacaattgggcgcgagtgaagagaatggtggactccttggcaatttgaacgggctcattcgaaacctgag

SEQ ID NO: 86132 - DNA, 497 bp, Heterodera glycines
  misc_feature (407)..(407): n is a, c, g, or t
  SCN-specific regions: Sequence locations=1-374,407-470,496-497
ggcaccgcgtcgcagaaatcggccgccggaggaactacgtcacagaaatcggcagcggcacctgctggaggagcgtcggcgctgggcaccgtgtcgcagaaatcggccgccggaggaaccgcgtcgcagaagtcagccgctgggggaaccgtgtcgcagaaatcggcagctggaggagccgcgtcccagaaggcctgagcaaccaccggacggcataagaacaagacgctctacaacccgcttcaatgatatttatcgacagtgatcagtaatgatgtttaaaagaccccgtattgttcccccacatacctatgcctaatgtgctctattgtctgtgatcacgtatatcatttgtaaaaccgttgtgtgatcattatttgtgtatatgtatgtatattgtatgtatngtgtttggctgatcagcggatgtcgataaaaggaactaataggtataaaatagagatagacctaaaaaaaaaaaaaaaaaaaaaaaaact

SEQ ID NO: 86133 - DNA, 745 bp, Heterodera glycines
  SCN-specific regions: Sequence locations=1-213,235-248,270-615,638 -672,695-745
gatcaaagtcgtgaaacccgacaattataaaaggaggtgaaccgagaatgtgacgaagggacagggcaatgtattgaatagcagatatacacgggattctggtaagacatggcatcgaggcattttttatgtcaatgaaacgacattcgattttgagaaaatgctcgagaaaaaaatcggagcagaagcaattctcaaatgtcctgcaaatgcagatgcccccgaggggtgtgtgcctgaccacggtcgtttgtcttggccttacgttgccaccatggccattatgccatttgtggtcggaacactgcaccatcccacacaaatgcagcagcgaacgcagtcggcgctggttattgggatgggcggcggcactttggacatgtttttgcacagaaaaacgcccagtttggacccaatggtcgtacaaatggcacgcaaatggttcggcacagtggaggattcaactcgacgcacatttgtcgaggatggaattgtcggaattgaaaaggcagcggaaaacggcgaacagttcgatttggtggcattggatgcgtgcgaagtgtacatcgatttaatttgtcccgcttcggtattctctgatgaaaagatattgcaaaaaatcaaagcaattttaaaacctacaggagcatttgtggtcaacattttaatgtcggatgagaaagaagaagacaaatatgttgcagaacaaaagcgcaaattgctcaacattttcccgatttgtctc

SEQ ID NO: 86134 - DNA, 665 bp, Heterodera glycines
  misc_feature (657)..(657): n is a, c, g, or t
  SCN-specific regions: Sequence locations=1-299,321-464,487-550,572-665
ttgtaagttcgtacctgattatttttgggttccattggacgcttattagaacatcggtcgttcatttgcatggggaatggaattgtccattgacaaggggttcgctgtgcgtgccgtgcctgtcgtttggagaaatgtttgcaggtcggaatggacccgaatgcgatacaatccgagagagaccgaatcggttacacgaagagaacacggcgagaaaaacttgtgggatttgacgaaggcattggccacgagaggggcgacctttgcgcggagtcttttgcttcgaacgatgccgatttggaggagtccgatgaagatgacgtcatttttcgcgataccgaaccaaccggaggctcaccttctgtaaatattgcgcagcgttcaaaggtgggaacaaaaaattacataaatttacgttaacctaaaacagtgccttataatcaaccatagtcctcaaaaaattgttatattttatgccaaaatttgtcactaatgggcaaataattaatttttctttaagggtgtcattttcattgaacagctactcttggaaaaacaaggggcgaagaacaaaaaaaagtcttctgcctcccccccccccttttccgctttttttaattaaaaggcgtccgtcgggggttgatactgctatgaatntacagaat

SEQ ID NO: 86135 - DNA, 365 bp, Heterodera glycines
  SCN-specific regions: Sequence locations=1-25,56-112,137-217,255 -294,318-365
ccagtttgaggacaatggttgccgccaatctgaagctttccctgatttttgtggccggcttttgcctgctgttcatcgccgactccgatgccgggaagtcgtgcaaaccgggagaaaagggaccgccaggccctccagggaagccgggaaacaaggggaagcccggcgtgtgcaagcccaaatatgaaacaacttccaagtacggtacgactacttccaagtacgacaccaccacttccaagtacggtacaacaacacccgaatacgatacgacagcatccaaatacgatacaacgacttccaaatacgacacaacaacttccgactacggtacgacaacttccaaatacgatacaaccacttcc

SEQ ID NO: 86136 - DNA, 713 bp, Heterodera glycines
  SCN-specific regions: Sequence locations=1-576,598-713
attaagcctttaattttggtgaaaatgtttaaatttgcaaaaccgatgaccaccaccgccgctcggatgattgcgcgcaagtcgcgtttggaggtgatgccgatggccaagaagtacaccgagtcagactaccagcgtgagctcacttaccggcgttccgactattcatttcccgcattctgcgagtccgatgtcacccacttcaagcgtggcgaagtgcaccacaaattgatgcagggcggcgcgtcggagggcggcttcacattgactgcgtatgtgctggttgctttgctggagaaccacgtgcagaacaaagtgacggaattggcacgaagcaatttggtgtcacacctcgccgacttcaaagaggacccgtacgcgttgacgttgtgcacttatgtgctgcatttggcgaacagtccggagaagggtgacgtgctgaagatgttggaaggcctccaaaccacagatggcatggtccattggacgacgaaggtgtcaaacggtgccaaagatggctctggtggagcagcaaagaacatcggcgatgtcgcttgggacaccaaccagtacttctctcagccccagtcggccaacgttgagatgagcgcttatgccttgctcacatacatgctgctggacaacaaagagcatgcgctgcccattgtccgttggctgaccgcgcagcgcaattccttgggcggcttttcatc

SEQ ID NO: 86137 - DNA, 617 bp, Heterodera glycines
  misc_feature (570)..(570): n is a, c, g, or t
  SCN-specific regions: Sequence locations=1-6,28-176,198-362,384-617
aaaggtccccccttttgtttaaaaaggcccacttttagtatagcgccaacttttgattgtttaatattaaatacccaactccgtagtgctatgcagcaagtcaccagtggcacagatcattctcaatctcaaccagttcattctcctgctgtccattgtctggtctgtcaatgtcgcttggaattgcaccattcattgtttgggccgactgaggacggcaccgactgtgcttcttccaccaaatcgtatgctttgcgcagtgacggggcttcctgctcgacaacaacagatgcgaagcccgactttgcttcaaccattgcattgacttgacctccactgttggcacgtctcaatctgcaaatttgttggatttagtggccgaatccaccagtccattggaagtgccgatgtgtaagaaatgtgccaatgcagtgactgcggagctgaacaagcaattgggtcatttggagaaggaatgcatccaatacaaaaagtcgttggaccatttgttgcaacggcgtgcggactgtccatttgacatggaggcatcgcgcatcaaattggacgctntaaaatcagaagagcgcgacctattggaacaactgacgctgttggaa

SEQ ID NO: 86138 - DNA, 572 bp, Heterodera glycines
  SCN-specific regions: Sequence locations=1-254,277-319,346-572
cggacggtgaggcacttaccacgctggtgttgaaccgtttgaaagttggtcttaagtgtgcgctgtgaaggcgcccggctttggcgacaaccgaaagaacacgttgaaggacatggcggtttcaactggtggcactgtgtttggtgaggaagcatcgctgatcaaacttgaggacatccaaattcaggactttggcgaggccgatgaagtcacggtgaccaaggatgacacgctgattttgcgcggcaaaggctctcaggaggacgttgagaaacgcattgcatcaatccaggatgaattggatgcttccacatcggactacgaaaaggaaaagctgaatgaacgtctcgccaagctgtccactggtgttgcactgctcaagattggaggtgccagcgaagtggaagtcaacgagaagaaggaccgtgtgacggacgctctgtgcgcaactcgtgcagcggttgaggagggaattgtgcccggtggtggtgttgcattgcttcgcgccttgaaaaagttggacacactgaaaccggacaatgatgaccaaaagagcggcatcaaaatcgtcc

SEQ ID NO: 86139 - DNA, 608 bp, Heterodera glycines
  SCN-specific regions: Sequence locations=1-608
gaaaagccgcaggaaatggccagaaacaaatcgactttaaagaattcgtactccaatcaaagcgggcttctgctgttgactaacatgcgggaagacaaatgaaatttcatggcgggcgaagcaaatgaccgatttggactaccggagagaaaagccaaccagagactggacaacgaaagtcgcagaaatggacgaacttcggatagaattgctgagtttgctgcgcgttgacgtcgattgtattttccgaagcgtaaagccaaacattgcggtttgttgtgctgcactccaaaggtcgtaccctgacagaatttacgccaccgatgaaacaggcttggactatttgccatgcctgcagatgatccacaaatgtgctttgagctcgcgcgcgagtcgccgccatttgcaccctttcgaaacggtcgacagtgaaattggtgggaaaatagacgagtcgcataagctgcagtattacctcgaggagtacagcccaatcccttcggcctgattgttctcaatgcttgtgaagaaaatcgcagtgatattattgtataagattcgtcgcacaatgaatcagatttccttttgcagtgtatttatcccgctaa

SEQ ID NO: 86140 - DNA, 684 bp, Heterodera glycines
  misc_feature (2)..(2): n is a, c, g, or t
  SCN-specific regions: Sequence locations=1-369,391-507,529-684
angtgaaggaattctacacaggaatagcatttgaagcggaagaaccaccgaattcattggagttgcaatttcaaagcaaaaagatggagaaatgaaagtgatcagagcaaaagccaaaggcacagaaggactttttgaactgaattctgacaacacagcaaatagggtgagagaaatcacaatgaaaaaacgacagaatggagaaatattgtcgaatttgcacgtcaattgaagggggagaatgaacgaaggttgcttactggatgcagaacatttaaattcccaacaaaatgggcacggatcccctcggggagttcatcattttccctaatggcaaagccgagagagatttgcgagctcgccgataattgtttctttgatgtacaagaattgaaaaaaaaaatcaagcatcgggaagctttctccccggtggatattgcacattctgttgatgtcagtggaaagggcgacccgtgcagtttcataaatgaaaattacgaagtgcgatgggcgtacgacagcaacacagccaacgttaattttgtgatgaaacaaaaggccaaaagtggaaaatggtggtcagctgtgggggattggcgacaatatgagcgacatggacattggcgttgtgttcctcgacggcggcgagccaaatgaaatgggcgattattactcaaacagtta

SEQ ID NO: 86141 - DNA, 669 bp, Heterodera glycines
  SCN-specific regions: Sequence locations=1-86,108-168,201-669
catttcgaagtgcacccgctgcaacacttttaaacggcctcgacaaacagcaaattcttcaccaacacaccgatgaatagcggcgtcagcccaactccgttcctttcgctccgctgtgtgtgctcagtgctggtgctgctcatctgtgcgttcgatgtgtcactggcagcaaaagacaaggagaagaatggcaaagaagaaccaggaggccaatttaatacgctcagcatcattttgctgattccgctggtcatcgtcaccggcgcgttcgtctacctgctgtttatgaagccaaagagcgaaggaaccggcgatgacgacggagaaggggacgcggacgtggagaagggaccaaccgaagagacgaaaacggagcctcgaattgaatctccagcaactcttttgggcgtgacagtgccgttggagcaagacgaagaagagcagaaaaaggacgacgagggtggcgaccaaaccgcggagaagaaggaagaggacgcggtgacagcggacgaacaaccgaaagaaggcgccgcggaggcagcggaagcggagaaaagtgcgacaaaggaggagacgaccgaggacacggaggaaacgacggaaggatcgaccacagagacttccgacagcggctccgggtcgtcttcagcatcgggctctggctctgag

SEQ ID NO: 86142 - DNA, 709 bp, Heterodera glycines
  SCN-specific regions: Sequence locations=1-590,612-639,663-709
aattttattttatctacaactcaataaaaaatgtccgcttggatttgtcctgggtttttgctgttttttgtgctcattctgatcactgatcactgtccgatgacccaagctgtcactcaaccgccctatggtcaattggctgtcagtggaaaaaatctagtacaaaaaagtacgaaaaaagccgtggcattgcacggcctgtcaatgtactggagccaatgggtgccgaagttttgggtgaaacagaccgtcaacaaattaaaatgttcatgcaatgccaacgttgtacgcgcagcaatggcatccagctttggcggttacatttcaaacccaactgctgaatataaaaaaatgactgcaatcattgatggggcaattgaccaaggcctttacgtggttgtcgattggcacacgggcgacgatttggccaccaccgaaataaaatatgcgactgaattctttacaaaaattgctaaagcctataataaatacccgcacattttgtacgaaatttggaatgagcccaacaaatttgtggcatgggaagcggtggtcaaaccatacgcaaagacgatgattgacgtgattcgtaaatatgacaaaaacaatgtgatcattgttggcacgccaaactgggaccaagatgttgacattgttgcaaaaagtccgttgaaagacgcaaatattatttacactatgcacttttacg

SEQ ID NO: 86143 - DNA, 701 bp, Heterodera glycines
  SCN-specific regions: Sequence locations=1-650,672-701
gataatgatgtaatttacaataaatttcgaaatatttgaagtcagtcccgttttctgtttttttcccgtcgatctcgaggcattattttgtgccaatgcttccgtcgccgtcattttccattcaattggtgtctcgtcttttttcccagttttttaatcgacccttatgttcgtccgcacatttattgtcaaaggacccttcaaattctcgcaattccggtcgcgatcacaactttttcgaaggcctctattttgagggagagataccacgagatcgcatcaaacagaagtacactttgtccagcggaccgggcggttcgaacgtaaacagtcaccccacaaaggcggaaattcgtttcactgtcgacgaggccgattggattccgcggagagtgcgcgaacggctggtggaacgatacccacgctacatgaacaacaggggcgagttcgcattcacttcgcagaagacgcgctaccagattcaaaacatgaatgactgttttgatcggctccataacatgctgctgaactgctccgaggagttggtcaaggaagagcaccgaacgcatgtttcaccacaacgcatcagcataatggaagaacggaaaaaacgctccgaagaatttcggttagcatcaaaaaaattctcattcgcggaaaaaacaaaaccgacgttcgggcttcagcatttaaacgggccg

SEQ ID NO: 86144 - DNA, 616 bp, Heterodera glycines
  misc_feature (598)..(598): n is a, c, g, or t
  SCN-specific regions: Sequence locations=1-60,87-590
ctgacatgaggcgaaggctactgatactgaggtgaaaaccaccgacaatgaggcaaaagcactgaagaaaaagaagaagaaggccattggagagccatcgaaggactttcgtatcaaggaggagggcctttgttcgatgtttctcattaaggtggaggagggtcgaaaagcctaccgttacgacatcgaagtgatgaacatggtcaaacagaagagcctcacccgtggaactgacgatggccttcgcgcattcaaccgcaaaatctgttacgaactgttgatcattgcctatgagaagacgggacaattcgggatgaaaccggacgaaaagggccgtatgggcgagattgtctacgacagcaaagccactatgtactcatccatgccgttccaccttgagtgtccgaagattgaaattacgcatgaagaaattgttgacgactacgtgcgagatcataccgcgatggacagctttttggtgactattacgccaaaccatcagaagcctgtgttggacatttcggattatcgtcagtattattcgaagaagtctctgttcgacgaagatcgcactgtgcgcacttttctggaaaaaaangaaaaaaaaaaaaaaaaa

SEQ ID NO: 86145 - DNA, 556 bp, Heterodera glycines
  SCN-specific regions: Sequence locations=1-45,67-556
tcccttcgttcggtcgaatacttcgctgagaatgaaattgacatattcgccattctgtttgtggcattgtttattgccatcgctgaagcagatggcaatgtccgggcaaaacgccatgaagaacgattgaagcgccaagacaaccgagctgatgaggagaaccgccaggtagacagtgctgatcgggagaagcgccaagacaaccgagctgatcgggagaagcgccaggaagacagtgctgatcgcgagaagcgccaagacaaccgagctgatcgggagaagcgccaagacaaccgagctgatcgggagaagcgccaagacaaccgagctgatcgggagaagcgccaagacaaccgagctgatcgggagaagcgccaagacaaccgagctgatcgggagaagcgccaagacaaccgagctgatcgggagaagcgccaagacaaccgggctgatcaggagaaccgccaggaagacagtgctgatcgcgagaagcgccaagacaaccgagctgatcgggagaagcgccaagacaaccgagctgatcgggagaagcgcc

SEQ ID NO: 86146 - DNA, 552 bp, Heterodera glycines
  SCN-specific regions: Sequence locations=1-436,479-527,549-552
tgcattgcgaatgcgccagccatggaaaatgcgctggcaattggacgatggcttgagaaggacccgcgtgtggaaaaggtgctttatcccgagctcgagtcgcatccgcaacaccaaatccacaagaaacagagcagcggaatgtccggcatgctctccttttacattcgcacagattttgacggggcactgaaattcctggccattaaaggtgtttttggtcgcccgatcactcggcggtttcgaatcattggcctcactgccggcggccatgtcgcgtgattccgtgccagcgaaggttcgcgctcagaccggcatcagtgataatctgatcagactgtcaattggctgtgaggacaaagctgatctgatcaacgacttggatatggcaatgcgagtggtgacggaatagcaaattccttttttttggtttttcgaaatttaagaaatgttgattgatgatttacaccttttatgatgttactaataatgagatatattcacatttgccttgtcttttattccgattttttataaaatgtttttacctga

SEQ ID NO: 86147 - DNA, 714 bp, Heterodera glycines
  misc_feature (23)..(23): n is a, c, g, or t
  misc_feature (29)..(30): n is a, c, g, or t
  misc_feature (39)..(40): n is a, c, g, or t
  SCN-specific regions: Sequence locations=1-94,116-153,175-479,574-714
acattcgctactaccacttgagncccatnnttctaaagnncgtatcagccgctacaaatattttaaaaggccttcgacaagcaagcaacaaattcttcacccaacacacaccaccaacgatgagaagcgtcaacacaacaccgttccgtcgccgacctcttccgcttcgcattgtgtcgtccgcgctggtgctgctgctctgtacgttcgatgtgtcgctggcagcggagaagaacggcgccagcccgcctatatataatacgctcaccttcattttgctcgttccgctggtcatcgtcatctgcgcgttcatctacctcctgttcatgaagccaaagaatgcggaaggcgacgaagaagacgaagaaggcaaaggaggagctgacggcgatgtcgagaagggagcggacgacgacaaaaaggagactccaccttctgctgctggtgacgtcgtggcggtgccatcggaacgcgtggttgatgagcagcaaaaggaggacgagggtggcgacaaagctgaagaggagaagaaggaggagggcgggtcggcagcggaagagaagaaagaggaggcagccgcggagaccggcggagagaagtcggcgaccacggaagagacgactgaggaaacgacggaaacgaccgacgaaacttctggaacccctgagacttccgaaagcggctccggctcggcatcgtcatctgcctctggct

SEQ ID NO: 86148 - DNA, 372 bp, Heterodera glycines
  SCN-specific regions: Sequence locations=1-346
caatgttaggaagttggaagaatggttaaaggacggagctgcacaattcggacccgattttgatgtcgattccgcgataaagctgttacgatccgctgaactttttcacttggcctcaaaattagcagcaaaatccgatcgaccattcacatttttggacattctttgtcaggacactcgcgaatggggaaaagccgtcaaatttataagtgaaaggccgctgtcagtttcatgcgaattactggaaacttatggcccgattttgcttgaacatgtcgaggaacaaaccctcgcgcttatcggacgattgatttggtcggaaggagtgaaccttaaaaatctgacgaaaaaaaaaaaaaaaaaaaaaaaaaa

SEQ ID NO: 86149 - DNA, 432 bp, Heterodera glycines
  SCN-specific regions: Sequence locations=1-265,287-329,356-405
cctgacgatgggtcgttgagcgcggagcaaaaaatggagcgaattgactcgatcatttgcactctgccggagaatgtcattgaccaaattccggacccgccagaagttgcgcaactcccggctgatgtgcgccagcgcgtcaaacaaattgaacgccagcagggaaagtcattcagcactaaatttgaagagatcatgaaatatgtggacactttgcctgaaggcacaaaatcggctgccaaaaacattttccattgaatttttcatggaaaaggaggagaggaaagaagtggaaaaagcagcatggattaatgaaagcaaggctaaacaatatttattaaatattttattttttggtaaaatatttccaatttttcatttccaataaatatttttgctttgttgaaaaaaaaaaaaaaaaaaaaaaaaaaa

SEQ ID NO: 86150 - DNA, 401 bp, Heterodera glycines
  SCN-specific regions: Sequence locations=1-276,400-401
cagggttctgcgcgactacctcaacacgaatggcatccacgagttcccttacgactgggagaaagaagcgaatcgacgaacaaggagtgcaacctgattgattgattgtcgtgccccgcgtgtttcattcattattccgtgttgttcggacctatattcattattccgtgttgtcagccctatgtatatattatatgtatgtatattctatattgtatattatgtgtacttgttcgacctatactatgtatttgtgtgtaataaacaattcatgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaatt

SEQ ID NO: 86151 - DNA, 574 bp, Heterodera glycines
  SCN-specific regions: Sequence locations=1-574
cggcccgaactcgtcgctaatttacggactttctttcctccactcttctgctttgaatcctttggttgtgagtttctttagccgtgttgtgatctgttatctttttgctgatgcccaaatgttattggcttattggaagacagtgcttttttggagaattgcttgacagcattggacaactgttcgctgttcgaattgctctgtgctattgccaattgtatgcccgacccttgccttcacggagcgaatgaaaacttggtatgtcaaaaaggattttgctcaacaaatgctccaaaaccttcggtccaaccaaccttctaccattcacgaaaatcagctgcatcttagggtggaattcataaaagcattgcgtgacttccaatacaatgtcgagcaatgccacgaccctctcctccactcgctccaatcggaagaggcggttttgaagttgctcgagttgatgtttcctcggacaaatcctgacgaagaaagtgaaaatggggacgttatgaaattcactaatccttcggttgtttcgaacggggttttggtattaaatgcattgatggagaca

SEQ ID NO: 86152 - DNA, 607 bp, Heterodera glycines
  misc_feature (601)..(601): n is a, c, g, or t
  SCN-specific regions: Sequence locations=1-78,100-298,322-414,436-607
ggaacatttacgtgattgtaaagaacgcggctactatattaaagaaacatcgattgataatgatatgctccgttttgcatttattttatcactacaaaatgattctccttcttcttcaagaattgataaagcagctaattgtaagcaccatacagatgaaaatgatgaaaagttggaggaacttttgttgatattgaatgacaacaccataaagcgagatatcccggagttaattgaagaggcgatgaattggttgaaagaacacattggagaagaagaatatgtgaaactcgagaaagtcttagaagaaaaaaggcaagcggaacagaagccgagcattattgagaaaaagcatgacaaagatggagagaatagtgaagaaggcatgggaaagagaattaaggacaaaattagtcaagcaaaagaaaatttaaaaggcataatcaagcagaaattgatgaagaaaactaattgaggataattgaggagaagaggaagaaaatattcagcagtttccatgaaaaaatttgttgaccaattaatgaagaatatcactaatgtagccagcaaaaaaaaaaactttcgaaaaattaagtgaatnttaact

SEQ ID NO: 86153 - DNA, 641 bp, Heterodera glycines
  SCN-specific regions: Sequence locations=1-144,166-641
gacttttgccacaccaccaaccgttcactcgtaatttctgagaaaccgacagttttgctcacgttcaacacagcgccattctcagcaacatcgcacaaaaatggcacgccgacgaagaaagaaggagccgcgaaagcagtcgtacaagctgtacgttcgacgtgtgctgaaggaagttcatccgggcaaggaaatctcaatgcgtgcgttgaacatcatgaactccttcgtcatcgacgccttggaccgcattgcaacggaggcgacgcgaatggcccacaacgaccggcgcaaaaccatcacgcttcgcgacatggagttttctgtccgactgtgcctgcctgacgtcatggccaaagatgcgaaccagaaggctcagaaaacggtgaccaagttctatgctgcaaaagtgcgggatcggatgagaaggacggagatgcgtcgtggcgaatttgcgatgatgcagatggcagcgctgtgagcacactcaacttttggacgaccggcggatgaagccacctgtatattgttgatgattggccccgtatcccccattactgtatgtgtatgtattatacaatgtatctaccattcttgtgtgtgtatgtattattcactatgtgctttatatgtatacctgg

SEQ ID NO: 86154 - DNA, 429 bp, Heterodera glycines
  SCN-specific regions: Sequence locations=1-429
cgctatttctttggccttacagagattgccggaataattactacagtaaagacgatttaacgaaatcgacactcaagcacttggcttttattatttgtggccttacactttggtcccaattgactaaatcttttattatctgtggccttacattttggtcccaattgtctcaatttggctctattcaattgtgtaccaggcgtacaaatttgagcagcaaaatgaggaagacaaaaatggcggatcgtatggacagaatgccaaagtggtcaatcaacaatatgccaaagttatgccaatgccaatttaatcatttggctcaaaacggtttttttttgaaaaataatgacaaatcggagatatttttgatgaaagaacacctggtgagccctgcaaaaacctgttgatgtttgattacattatgcttat

SEQ ID NO: 86155 - DNA, 551 bp, Heterodera glycines
  SCN-specific regions: Sequence locations=1-551
ttacttccttccattttttaccgcgtaaactgccagcaccgcggatggtctacgaggagtactgcttcgatgtgaggctcgacacttcacaggagtctgtttcaggtgagcaacgccgacatcgtacacaacagctgcctctatgtggaacagacgaatccgaactacatgaccttccatggcgtcactacgacattttcgtctgtgagaagacaatcagcgggctcaaagatgaccgaagcgaaaatgtgttcaaccgtagacaaggagcatgtgcaagcggggacgaccgatgcgataacgttttcaaccgtggacaagtggcaagtgcgcgcaatggtgaaggaagagacagcatcctcattcaaggattggcgttcgtcattgtgaaagtggtcaatgcagtgtacgatatgattgtttaattgtgatcaggatatattcatcacgtatatgtaaacaattatttttgtgtgtgtcgtatatgtacgaactgaatttctgaacattcgtcatatgtatgtaaaaataaatgtgtgtgaaataaattt

SEQ ID NO: 86156 - DNA, 694 bp, Heterodera glycines
  SCN-specific regions: Sequence locations=1-694
taagcctttaattttggtgaaaatgtttaaatttgcaaaaccgatgaccaccaccgccgctcggatgattgcgcgcaagtcgcgtttggaggtgatgccgatggccaagaagtacaccgagtcagactaccagcgtgagctcacttaccggcgttccgactattcatttcccgcattctgcgagtccgatgtcacccacttcaagcgtggcgaagtgcaccacaaattgatgcagggcggcgcgtcggagggcggcttcacattgactgcgtatgtgctggttgctttgctggagaaccacgtgcagaacaaagtgacggaattggcacgaagcaatttggtgtcacacctcgccgacttcaaaggggacccgtacgcgttgacgttgtgcacttatgtgctgcatttggcgaacagtccggagaagggtgacgtgctgaagatgttggaaggccttcaaaccacagatggcatggtccattggacgacgaaggtgtcaaacggtgccaaagatggctctggtggagcagcaaagaacatcggcgatgtcgcttgggacaccaaccagtacttctctcagccccagtcggccgacgttgagatgagcgcttatgccttgctcacatacatgctgctggacaacaaagagcatgcgctgcccattgtccgttggctgaccgcgcagcgcaatttc

SEQ ID NO: 86157 - DNA, 726 bp, Heterodera glycines
  SCN-specific regions: Sequence locations=1-508,530-726
aaattgacaaataaatccacccaacgcattaaaatgaattattttattatcaaatttcttcctttaattatttatttctcccttttctcaattgttaactcatttgcggtaagtttaatagagacgaattggccattttactaatttattaaattattgcccgcaggcgttttttaattatattctaagataagaaggcctgaaaaaaaattagcgaaattgttaggatctttcaaaaaaattttaattgagaattaattgcagtttgacgatgaagcatttcttgccttcgtgaaaggacctgccaattttgacaaattttgcgccggaaaaggggtcactaatgaccaaagcaaagaactgttggcacaaatttatggcactcatctaggcattttgttttacatgcgaaagaattggcattgtgccaatgttaggaaagaatttgaagaatttatcggcccagaggaatgtcagctgtttcaaaattatttgtgcattgtttacgaatttttgttcaatgtttatgccgaacaagaggatataatgaaaccaattttcaagcaaccaattggatttcgaatatcaattttgatgtcattaatgtcggcattggaattaatggcaaaattttcgaaattttgtctttatgaattgaaattaattgaaagaaatgattcgacattggccgaaacaattcaacttgaaaatgagcaggaaaccttg

SEQ ID NO: 86158 - DNA, 680 bp, Heterodera glycines
  SCN-specific regions: Sequence locations=1-264,286-462,485-680
gtgaatgatggaaatgacaattctcgggaatcggatatgcattaccgcggacggcgccaaggtgtcgccatttggcagcaaaatggacatgggggactattatgttgaaaataacaagctgagaaaaacacggggattgggctgggtaatggccgcactttttgtggtcgccgacatggcaggcggaggcattgtggcattgccaacggcggtggtccgatgccagttcttttccgggttgctcattctgttgtgcatggcgatcatctccaccttttccgcagttatgctgggccaatgttgggaaatattattgcgccgtttcccggtttaccgtactcactgtcgaaaaccgtacgctgaaattggccttaaggccctcgggccaaaaattagaactatcgtatcgatttgcgtcaacgtcacccagtacggtgccaccaccgttttcctgctgctctgtgccaaaaacattcgtgacttcatccgtgcctttctagacaaggagatcagcttctgctatttgatcgtggtcattgcgcttgtgcttttgcccgtcactttgctcaaatcgcccaacggtttttggccggtcattgtgggcggaatgcttagcacaatcgttgccattgtgttcatttgcattggtgccatgatggactggcgcagctgtgccccct

SEQ ID NO: 86159 - DNA, 627 bp, Heterodera glycines
  SCN-specific regions: Sequence locations=1-14,36-184,206-370,392-627
gcaaaacaaaaggtccccccttttgtttaaaaaggcccacttttagtatagcgccaacttttgattgtttaatattaaatacccaactccgtagtgctatgcagcaagccaccagtggcacagatcattctcaatctcaaccagttcattctcctgctgtccattgtctggtctgtcaatgtcgcttggaattgcaccattcattgtttgggccgactgaggacggcaccgactgtgcttcttccaccaaatcgtatgctttgcgcagtgacggggcttcctgctcgacaacaacagatgcgaagcccgactttgcttcaaccattgcattgacttgacctccactgttggcacgtctcaatctgcaaatttgttggatttagtggccgaatccaccagtccattggaagtgccgatgtgtaagaaatgtgccaatgcagtgactgcggagctgaacaagcaattgggtcatttggagaaggaatgcatccaatacaaaaagtcgttggaccatttgttgcaacggcgtgcggactgtccatttgacatggaggcatcgcgcatcaaattggacgctttaaaatcagaagagcgcgacctattggaacaactgacgctgttggaaga

SEQ ID NO: 86160 - DNA, 671 bp, Heterodera glycines
  misc_feature (622)..(622): n is a, c, g, or t
  misc_feature (643)..(643): n is a, c, g, or t
  SCN-specific regions: Sequence locations=1-671
gatttttgaatcattaaaatatttaaaaatcggaaaaatttgtaaaccaaattccaaaccaaagcaaaaactttattcatcaaattttcttctattacaatattttatccttacaatggcagatttaagaatggaggccagcaatgatgtgatcattcccgtcaatgttgcaattcgcatattcagttttgttagtagagatgatttggaaaattgcaaactcacctgcaaatcatggaaagacgtaattgattacgcagacaaccgaaagaactcggagttgcaactgaggcacattgacgccatttgtctctcaactaattctgaattttctatcaaaatttactacaaccaaactattcgcgagttttactacaaaaaatatttcgctgatatggaaattgatgaaattgaagtgaaaaaagtcaggcatttaacgaatcaatttgacgagaaaaaatacgttttcccatgtggagagcatttgccaattcggcaaagtcattcctttgtttttccagcggttgatatttttcaccaacacaggtgtaaaatggtgaggccaaccgtttaccaggaccatgtcaattacacgcgaaaactcttcacacctccgctcagnttttatgaacgccttcaacanatgctcaaaaaatgtaaaattcgtctgg

SEQ ID NO: 86161 - DNA, 399 bp, Heterodera glycines
  SCN-specific regions: Sequence locations=1-197,219-399
ggatggtaagggacccaaaatcaatgcacctaatacacgattagaagctgatgcgaagatacccgaataggaaaacgcaaatgctcaagctcctaatatggtgaaagaggacccttagaagggactgtgacaagtgaacagaaccactcggctatgggatgcacaaactggacccttttcctatgctttatttagccaatattttatagttctacccagacataaccatgattgacaaaacttctgcccataacaaaaccatcgcatctaagcctatgtgcatgaacgccttaatcttctataaaatgcttcatgtggtatatgagcgttacactgaaataaaagctatccggtaccaaaatccaggcgctttgatcaaccgatttccgtttgaatccg

SEQ ID NO: 86162 - DNA, 619 bp, Heterodera glycines
  SCN-specific regions: Sequence locations=1-109,137-619
tgatttctggagcaggaaattggcaaagaggaggaaaaagacaacggaacatcagaagaaaagggcatggagaggacggaggaacaacagacgaagacaccaacggaagaggaaaaaaggggggaggaggacaaaacggagggacagcgaatggcggactttcagagggaaaacgcaccgagtccggaagaaagggatgaagcaaagcaaagcccaatagaagagaaggcattcgtgtggcaaacagtgcaaacacatccggctgaagaaagagctgaagatacatatgcagaatcagttgatcaccccgcaaaatttgaagaaatcactgcaaaaacggatgaacgtgaaggagaagacagtgcccgatcagttgatcatcattttgaagaagttaatgccacatcggaccatgttggagaagaaggcagtcccagattagctgatcatcattttgaagaagtcaatgccagatcggaagccagtcccggatcagttgatcatcattttgaagaagttaatgccagatcggaagccagtcccggatcagttgatcatcattttgaagaagttaatgccagatctgaagccagtcccagatcagttgatcatcattttg

SEQ ID NO: 86163 - DNA, 671 bp, Heterodera glycines
  misc_feature (629)..(629): n is a, c, g, or t
  SCN-specific regions: Sequence locations=1-439,475-582,604-671
tggatctgggatgctgatactctaagtcggtggaaaaatttgcattcgagcagcccatttccagctttcattggttcgttccgtgcgattgcaactcttcgcttatttccattgccacttcctcgtcaaatgtcgttttgttgggcccgcgattgggtaacactgcacaacaaattcgctgtttgcagcaacgcatttggtcagtccgctgggaccgtttccgtgactatgttttggtgactgggagcgacagtggcgaaatcgctttgtgggacattagaagtggcaaaaacgagttgaaacgcgtgaaaggtccttacgaaaatgacaatgcgaaaagcgaatcggaccgaaaacgaacagcgaacagaatgagaaattctgcaaaattattccattccgatcgcattgtctgtttgcgttgcacgtcggacggccgtttccttctttccctctcccaaaacagaaatgtttgtgtttgggatgccgaaacgatgcgaatgctttgccatctgaaggtgcccgaatctgaaggcgacctcagcacttttcccgtacaatttgagctttgtgacgaggggcgtttaatttggctgttcattcccaattcgaacaatgttactgtggtngggaattgctgatccgaaattgttctcaaatcgtccgattgt

SEQ ID NO: 86164 - DNA, 566 bp, Heterodera glycines
  SCN-specific regions: Sequence locations=1-196,218-270,292-414,436-566
atgctctgacacctcctctgaaaatgttactgattggcccgaatgcctccttccctgttagggaaaccttataagttcaaacaccttccaagggaattgagtgaacgatggactgagcccacttgggtcgaagctgtaaagcaagcgcatgaaaatgacgccggaaaattgaagccatggcagcaacggtatctcgactggatgatcctccaagctcgactctgtggctatttgacggtgaaaaagaacgacaaaaaggcacaactccaacaggaagtgaatttctcgtggaattccgctacaaaccaattctgcttccgatttctggccaatcacatgcaggacaatggcgtcattgtccctatcgaacatcgctatttgctcaaaagtgcccctccgcgtgctctcgcgttactctccaaaggaaatgacccggagaatggtccgtgggaagtgacaagcaaaaaacacgacgctcttttcgctgccttaaattattgcagtgcgcgggagattcggcaagggttgtggcagagttacgtcacaagatccgcattcagttcgca

SEQ ID NO: 86165 - DNA, 682 bp, Heterodera glycines
  SCN-specific regions: Sequence locations=1-83,110-190,215-250,292 -390,412-607,629-682
tctctcttttgggacggctccgtcgctttttgccccgaattgcagccgcaaatgcagctttgtcagacacgatgggtgccggcggtggtgatggtgctgctgttactgtactggacgacgatgaggaagacaactatagaaacggcggtgcccatggaactgacggcggccacgacgacggcaagcagtacaaacaaaaacagcagcagcagaaagaagcgccggcagtgactgtgcatgtgatcgactcggacgacgacgaagacgaggaggaggaagaagaggaagtgattagcgaggatgacgacgacggtgccgagatggtcgttgagaatgggccactaggaggagaaggcggcgatggtggaggagttggtcgtcgggagattaagcccaagcagttcatccaatttgacaccattctctacaaaattgacgacgaacagagtgaccatgacaacgtcggcgtcaagacggagggcaacaacaacaaagtcgacgacagcggcggtggtgatgaaaatatggtggtgtcgcagccgaaagtgaaggtccagcaaatggtggcggagcgcaaaaacaacaacgacagcactgccacaactgctggtgccggcggaggaggggagccgttgctgaagaagaaatatttggttttcgacgccatgacgatggacgcgga

SEQ ID NO: 86166 - DNA, 634 bp, Heterodera glycines
  SCN-specific regions: Sequence locations=1-304,361-569,592-601,623-634
agatggagtccgtcaaatgaaaatgttaacggggacaacgtgccaacgcggcgcagatgcaagcgcaccagcagttccagccaagacgctttggacacctgaagttccagacacgcgagtacggcccgttgcacaaacagtgagggggaaaatgaatagtgccaccgcgacgaatggatgggagagggatgcataggaaaacgatcgacggatgatgagataaaattgggcgagagcaaacgacgacgagatgccgagagttgtttattttgttgttttgattccagtgtctgatggagcactgcttttctctttctttcttttctctgtcatttccacacttttcccttccttttttcttgacatggtccaaaatgttgatgattgttttcgtaacaaaacttcaaattgtacaaatgcaacatttctcatttatagtaaattattttgttttggttttggaccagttcgggcaaattgtctatgttttgatgatgcgagacgccattttggttgatgatgacggtgatccatttttaggattgaatttgcctctatttgtattagtattttttataatacattatttttcgttttgctgaaataaaaatgtaaatattggaaaaaaaaaaat

SEQ ID NO: 86167 - DNA, 637 bp, Heterodera glycines
  SCN-specific regions: Sequence locations=1-637
aagggaatcgctcatcgcgatctgaagctggaaaacgtccttctttgtgaaaacggcgtcatcaaagtcactgactacggattctctaagcagagttctgatttgtcttaacattttgcgggtcgcgttcctattcgtcaccggagattttgcttggcatcgcttatgacatgttcaaatcggacatttggtcattaggcgtcaccgcgttcatcatgatcacaaacacaatgcctttccatgaagactcgcccaaccagcaaatcgttgactcgcagcggaagcgccgttacaaatacccgtcatggcttaacattacgaagcaatgccgcactgccatcgatgccttgctgacttaccaaccggcttttcgtccgaacatctttgaatgtgccaagttggaatggtttgcccaagattccgcctctttgtggtgcggtggtcgtcgtgccggtgttggagtgatgggtcaagtgcgtgggcgatgataggccatgtgatgaccaatggcagaagatacatttgataggattaaatccccctatctttcgtttgtacatagaacctaagcttttcttcgtttgtacacatacctgtctatagtctttgttcgtacacacatacacttgttaatagg

SEQ ID NO: 86168 - DNA, 593 bp, Heterodera glycines
  SCN-specific regions: Sequence locations=1-373,395-593
gtgtgtgaagatgaaacgcactgctgatgtactctcccatatttgaacctaacaaagtgccgtcaaccaccatcaatggagaccggccgcaaaaacttcgacatgcggccttggatgattttcgggctggccgttaccaagtggtcgtcacgactgatgtctgtgctcgtgggatcgatctcaaggaattggaccatgtgatcaacatggacttacccatcgactacacaacttatgtccatcggatcgggcgcactggtcggatcaaagaaggagcatctacatcgttttttgatctcgcggaagatgttgagctggcgaaagaactcgttgaaggactccaaaaacaagaccaagaagtgccggattggcttaagctggtggctgaggggaaaatgccacttgacgagtcggaagcagccagcggtgcaaattcggtgccgatcgctgttcgcgttccgtcggaaactgttcctgacaccaattctttgccagctgctgtaactgttccgactgataatgtggctgcaaccggtgctaattcggtgccgcttggaacccgcgttcaagacgacggaaccccgaatggagaa

SEQ ID NO: 86169 - DNA, 667 bp, Heterodera glycines
  SCN-specific regions: Sequence locations=1-154,182-273,295-667
atctgttcgattgcttacaccgacccaattcgcgcttttccgcctctgatgtcattggttcccaatgggttaagagtcacgggcaaaaggacgaaacggcggaaagtgaggctgaaccgcttctgaacgcggcactgtccgaaatgcgttttggccaaaacgaggaggaggaggacggacatggggatgctgattcgtgcgattttgcggtgtccgagtcgagcgccgagtttttcttctcgagacgcgccagcatggacgagctcagcgagcagggcgggagcagcagcggaccaccgatggatcaacagcagaaaacaaatgcgaacagtgatggaaccaacaaaaagggaggcattgaagcggcaaatgttgtcggaacaagtcgacgagagagcgtccagaagcacattcaaattggcaccacgacaccggcgacattggcattggcactgaatgggacaacgatggacggcgagacagcgacgacgacgggcaaagaaacgccgaaagtgggccgacgggtggtggtgggacagcagcagatgaggaagacatgagcagacagcgactgattatggacggaggaaaagcccagaaagacggaccctaaattatggaccgattgtttgttgccaaagttgctttctgttaatcggtttactat

SEQ ID NO: 86170 - DNA, 614 bp, Heterodera glycines
  SCN-specific regions: Sequence locations=1-614
caaaaagggatgaagttgaactgttcgatgaaagtcgcatgattcgatgtgggaaacatttcgttgacgctttttccgatgagagtcaaatcactgtgctcaccggagggggaactacgcaaattgaattgattcggtctttcgacgaatgcgaacttccggagccaataaagcgtaacatcgaattgaaaaagtacactcaacctactccaatccaaaaggcggtcatcccactgatcgcaaacactaaaagggacataatgggccatgcccaaaccgggacgggaaagacggccgcctttttgctgcccatcgtttgccacgtccagaaattggtggaggcgaggggaagcggagttgtgaacggcactcacccagtcgcgctgattgtggtgcccaccaaagaattggcggaacaattatatgaagaggcacgggcattcgctgcggggacctccgtctccgtctgtcacacttacggccatatgccaatggcgctgagtctgcgcgaaaaaagcgacggctgcgacattttcatcggaacgtgtggccgaattcagcaatttgtggaggagagatatattcaattggacattttgcgctatttggtgttg

SEQ ID NO: 86171 - DNA, 613 bp, Heterodera glycines
  SCN-specific regions: Sequence locations=1-33,55-142,166-613
tgataaaaaattgattcggaatgggattttcgacaaagcacataattattgacggaaaagatcgtttgcttggacgttagggcgctggcacttcgaaaaaacttttgcttggccagaaaatggttattgtgcgatgcgaatccatcaacatttctggaaacttccatcgttccaagctcaaattcctcggatttttgcacagacgctgcaatgtgaatccatctcgcggacccttccactaccgtgcaccatatcagatattgtggcgcacgggtcgtggaatgcttccgcataaaaccgcacgaggtatggaagcactgaaaaagttgaaatgttttgacggatgcccgcagccgtatgacacaaagaagaaattcgtacttcccaattctcttcgccacatagcattgaaaccgcgacgcaaatattgcacagtcggccgtctcgcacacgaagatggttggcagtatcaacgcgttgtggacaaattggagacgaatcgaaaggtcagaggcgctgctttacatgagaagaaaaaggcactgctgaagctgaagaggaaggcggtcgaaaatgcaaagccaaagacggcactgttcgacaaaattctcga

SEQ ID NO: 86172 - DNA, 659 bp, Heterodera glycines
  SCN-specific regions: Sequence locations=1-416,439-542,564-659
aacggacggcgacacttcgggcgcccgtgagtcgccgattcgaatggcttcgacgtgccctccacgcgtcgtccgccggcttggatttgatcggctccgacgccacgctcattctcaaccagcagcagcaaatgatacggcagggcgacaccgtcgagcccatcgcggacgaccttttgcgagccgacttttccatgccaaaactgcgcgagtttttcgaatgccaaaaagcgatgggcgtgccgaactttgccgaggatttcgatgaattttggctgctcgtcgtcaaggcgcgtcttttcaacgtgttcaaataccgcggccccgacgcgtacaatcgagttgtgctcaaaattcgtgacattgcgcaccaattgcgagcacaagtcgaagaaaatgagcacagcgatgggacggagaagccgaaaagagggaaaaagcaaatgaccaattaattaatcaattgaccgaccgatgccaaaggcgaataacggaggcaaaaacagacaaatgaccaaacaataaacaaataattgtaattgttttttaagcattttgtttctcatctctaactttaattgtgattgtgtggcgacccattttcttctcctccttttttttctttttacattacgcttttttaaagaggggttgataaa

SEQ ID NO: 86173 - DNA, 324 bp, Heterodera glycines
  SCN-specific regions: Sequence locations=1-227,249-295
tagcgaagacgacgacggagaatgtgaaagttcgcattgccgtggccacgtggagaaacagcgaaagccgccgccgtcggacgatggaaatggcggcggtgggcccggcccttcgtccatttcaacctgatcaattttgccaatcatttgcctatccatttactattatttatcgatttcctttatttaaacattgatacaatgtattagaaatttaatgtataatttccatccattcttttgtgatttgtgcgttaaaattgggacaatccgtcgaatggattaaaagaaatccaaaaaaaaaaaaaaaaaaaaaaaaaaaaa

SEQ ID NO: 86174 - DNA, 650 bp, Heterodera glycines
  SCN-specific regions: Sequence locations=1-650
tactgagtccgttcacaagaaatgggaagtggagcgcacgctcagttctggcgcctacggcgtggtgtttttgtgcaaggacccgttaatggacatcaaaggcgtcgtgaaggttgcgcgtgcggagtccggaagtgaaacggccgagtgggaggcagctgtcatggacaaagtcacgaaaaatacacacggaaagagcataaacattgtcaaactcctggacaagggcgttctggttgctccggacaacagtcggctgaacttcatggtgctcgaattctgcgaattgactgtcaagaaataccttagctatcgaccggctggacctccacgaagggctcgcatctgtcaagtgttgctgggagcattgaaggccatttacgacatgcacaaccaaggactgttgcaccgtgacttgaagccggaaaacatgggcattttgtcgagggccgacccggtcactgtgctttacgatttgggcatgtcacgcatgtttaccaaccaattgggacaagtgcgcgaaccacgaactgttgtcccgttcaagggcgccgttgagtgggcatcgggccatgcgctcaatgggcgtgagcagactcgttgggacgatttgatcgcttggctgtacattgctgtggaactgtttgacc

SEQ ID NO: 86175 - DNA, 591 bp, Heterodera glycines
  SCN-specific regions: Sequence locations=1-467,489-591
taaaaaaaaattgcaattattctttttattcgccgttttcattgctgccaatgcttttgactctgcccaaagtgtcggcaaaacgtccgctgaggacgaagttcgagcggtaacggaaggggcggcaccgcagcggcaaacgccgacgcggaaatcgttgaaaatgttcggccacggcctacgccatcacacgggcatggatttgctgatgaaactcggccagcagcaggcggaggagcccaagtcattctcctcaatggacattcttcgcctttttgatgggcttgaccaccagttttaccacgatttggagaaagcacaatcgctttttgaagaaaatgccaaagttgtgaaaagtcttgaaaatcgtgttgtcaaacttgagagtgcaatggcaaaggcagcggagcattgcgaacccggcaaagtccaattggtctcggctcattacgacacggccattgttctgttggctttgctgattgttcttctcctgtgcctttcgttgctgttcgccaatttgatgctcgccaacttcaaacgcaaaggcgtcgtgcaaatgccgttggcaatgatgcggggagagagcga

SEQ ID NO: 86176 - DNA, 162 bp, Heterodera glycines
  SCN-specific regions: Sequence locations=1-135,158-162
tggggacatgatcagggcgggacagattgcaatgctcatcaaaatgagcagagcggggatacactgaaacagtgctgacacagagtaatgattgctgttctgttatggactcccccgttctatttgctttattttaaaaaaaaaaaaaaaaaaaaaaggtac

SEQ ID NO: 86177 - DNA, 559 bp, Heterodera glycines
  SCN-specific regions: Sequence locations=60-60,286-303
cacgcttttgttgcccttgccgtaaatggaattgcgggtcggaggtcgttaccgccttgagcgtaaaattggcagcggttccttcggagatatttatttaggcgagaacattatgacacacgaggaagtggcaataaaattggagtgcgtcaaaaccaaacatccacagcttcacattgaggccaaactgtacaaaatgatgtccggcggagtcggcattccacaggtccggtggtgtggttttgagggtgaatacaatgtgatggtgatggaactgcttggcccttcgctcgaggatctgtccaatttttgctcacggaaattcacactgaaaacagtgctgttgctcgccgaccaaatgttggccaggatccaatacattcacagcaaggatttcatccatcgcgacataaagccagacaattttctgatgggtctcggcaagcggggcaatcttgtctacattattgactttggactggccaaacggtatcgtgaccagcggaccaagcagcacattccatacagggaccacaaaaatttgacgggtacagcgcgt

SEQ ID NO: 86178 - DNA, 266 bp, Heterodera glycines
  SCN-specific regions: Sequence locations=1-245
actcttcgaaaatattcgctctttttcggcctgttatcccaaaattttttcagttttgcgagtgtctgaatttgatttatgaacaacaaaattcgtctttgattcactccgtttatgggccatcagtgctcgaaatgggctcttcggagaggctaatgcttgtctcatcacttaaccccgaaggaatggaaaacggcggaaagaaaggaacggacgaattcgagtcgagtcaaacgaatggagccaaaaaaaaaaaaaaaaaaaaa

SEQ ID NO: 86179 - DNA, 638 bp, Heterodera glycines
  misc_feature (24)..(24): n is a, c, g, or t
  SCN-specific regions: Sequence locations=1-24,46-69,91-153,175 -204,228-280,302-638
cattgaaaaacgctgcaaactttntaacacaaaacaaatggaatgccaattcgatggaactgaagccggaaaatgtgctttttgtgtaaagcttccgtgtaaatttggagcagttaattgtgcagaggaagtgagcatctcttgtgtaaatccgcaagaattggaaaaatgctgcaaggcgcgtgacaacgaatgctgcgtgtgtgtgctatgcgagaaaaacaaagttatgaaggttttggtcgaatgttgcggaaagcgcaccgaaacgagtgccgaggccgggaaagcgctttgcatttgtgtgccgaaaattggtggaggcaaatgtggaggacaagtgcaagtgaaacaatgcgatgcgaagctggttgacgagtgctgcgcagctaacacggagagtggcgactgctgttgcgtctgtttgagctgcaatgaccaaaagtgtgtggtcaccgtccgttgtcctactggagaagcaaagtcgactggtccaacttgtactgcttcaaaatgcgaaagtgtgaagtgctgctgaagtcaaaaaactgatcgaagactgaaaggatgcatgcatttaactgactcagttttaaaaatgctttttcaattagcaaataaataattgttgaaaatta

SEQ ID NO: 86180 - DNA, 682 bp, Heterodera glycines
  SCN-specific regions: Sequence locations=1-293,315-682
actcttcttcgccgtacgggtacacaacgtgaacagcttcaatgtcatggctactaccgtaaatggcaatgcatcatcgttggtggcaccgctgtcgccgccaaagaccgggccgtctggcccacaagtggcaattgtcagcgctaaattgatcatcaccagcaatggcattgagaaggagggcgatcaaatgagtaccgccgcctcggttgctcgccgtactccgctgtccatcgtccaaacggcgggtggcgcggtgcatcgccaactgagcgacagcatgtgctacaagagtgggcacagcaatgggagtggtaatgagaacaacgatggcggcgcggacagtgacacgacattggaccgtccggcgtactgcggggacgggttgccaccgcgttcggccaccatgccaccattgcgcagcattctgaagaagccgagggcgccgcagccgccgtcgccggttcctgccaacaatgactcgacgctgctgatgatgacgaagatggcatttgcaaatggtgccgctagtggacaacaacaacagctgcggcaacatcagcagccgaacaggttcaccatggtgccgtcgccgatgccgcgcaaccatttgcgacgcgtgccgaccagattggttttggagcgttcggtgtccgacagtgtgttggacgacgcggcaatt

SEQ ID NO: 86181 - DNA, 564 bp, Heterodera glycines
  misc_feature (544)..(545): n is a, c, g, or t
  misc_feature (547)..(547): n is a, c, g, or t
  SCN-specific regions: Sequence locations=1-564
gagccttcgactaataaacacttaatgtgtccattcaaactcgaaaacttcggtgtgtatcttcctgcatggcataaacccgttactaaccgttacgggaaacgtaaacgtgtggtaagagaggctgggggcatggaggtccccggagacacggagacacaagccactgaaactgacagcaacaatcaaattgatgaagatggatggataactgtgacaagaaagcacaaattttcattccggaataaagtaagtcgatctgacgaaggcaatgccacttttatgggaatggaaggaagtgcggacgagccatacgatcgtccgagaaagaaaaaacggactcgatagatttctgacaaatatacaattcctttaaacaataaatgttatggaaaagagacaagcaaacaacgaactttaaattaaaaatggacctaatttaagtgaattagcggaaaattttcaagccactgtatttatattcgtcctcaaaatgaattactgatattatcgacgagagccattaaattgtcgaagcgcatannanaaaaaaaaaaaaaaaaa

SEQ ID NO: 86182 - DNA, 417 bp, Heterodera glycines
  SCN-specific regions: Sequence locations=1-227,250-417
gcgctgacgaaaaacccgtatcctaacggccgatcaaaaccgtacatcacaccaacctcataaccgactagacaagtaccacagccaccgagcaaggtgaacacatgactatttcggagctgtgatgtatccttcgccgaaaccaaggaaacagcggtggaggcggcggccggacaccgaagaagcgcccaaggaagaacagccgagcgcggagacgaaggaaacaaccggagacgcacctgccgccaccgaagaagcgcccaaagaagaacagggatgaccggccggcgacttatgaccagcgatcgatgattggcttggtttggattgtccataccccttcttgttgtactataatttgtgtccgtcctttattcctatgtatcccaatttcgctgtgatcggtgtgtgatgatt

SEQ ID NO: 86183 - DNA, 190 bp, Heterodera glycines
  SCN-specific regions: Sequence locations=1-55,80-190
cgccttggggccatttggacggctccttctggagctactcttcctccggacgaagaactccatctcgtcaacaccacgggcataccaaggccgaattcacaaacccatgccaaacattgagcaaacagcagcacccaaccaaatgcattggacagtctacacaaaattgtagaggaaaaaaacgaccggt

SEQ ID NO: 86184 - DNA, 587 bp, Heterodera glycines
  SCN-specific regions: Sequence locations=1-234,257-359,381-447,469-587
tcatttttaatattaaatggttgttctgcccattttcgccgccgtcgccggcgccgtcggcgaagataagaaaaggcaacggacgggggaggccgaggagcaattggacggagacggagtgataacatcggcggagcagccgacgacgacggcgaacagcgaatgttcatcaattgtcggcgaagcgaccgacggcggcgggaaaacgccgacggggggagagacagtgacaaacgagtaccagcagcagtgccatcggaacaacatcattaacagcggcggcagctgccctttggcactttcgtcgtccgagcgaatggtcagcgaactgatcgcagcggtcattgagcagagcagacaaaggcaacagctgcagaaacaccagcaacagttgctgatcagtacgaacaaagtagaggagaccaataacagcggaggaagcgaaatgagggcggagggggaggaaagaggggacgaaatggcaccggaggagggcgggagcatttggcaacagagtaagggcgagaacggcacggtaacggcggaagctgtgccgaaccatccgacgacggcaaatgccgggggag

SEQ ID NO: 86185 - DNA, 677 bp, Heterodera glycines
  SCN-specific regions: Sequence locations=1-79,101-638,660-677
aagcggactcttttgctgttggacgggtgcgtgagcggagtgaaaaccgcatgcaaaggcaaagtgaaagtcgagttcaccgagccgggcaccggcttcttctccggaaattgttacgaagaagccaaaactgcgctcgagaacgatttcgaactcagcaaagggaatgacctttctggtttttctgaaaaagacgataatggcactatcaccgaacaagcatacgacagcaccgtgttcacgttgcccgtgctgttgcagcatcgcaagtgcagcggactcggcagtgccaccatggacaacacgttcaaggacatcactctcacaatcagcggcggcgattgcgagtcgcaaagcttcaaactcaaggacgtggacgcaagcaaaggccgtgtgcaggaaatgcgcggactcgagctgataatgatcgacggcactgccaaacaatggactgacgattctgggaattatcaatacacaaagaaggatcagctgatgttcaagccgatggagaacatcgataaaatcgatgaatttgggaagttcgaaagtccatcttactgaacggaaaagaccgaacgatgccgatgaaagggaaggaaaggacgaaccgaagaccgattaattaattaatggaccaattaacagtcaaacaaaacggcaatcaacaaatgcaa

SEQ ID NO: 86186 - DNA, 729 bp, Heterodera glycines
  misc_feature (690)..(690): n is a, c, g, or t
  SCN-specific regions: Sequence locations=1-280,309-450,496-551,573-729
aaatgcgggccgcgaatgaccgattttacccgcaaatgccgcaaatcatgggcccttaaaaaatggactgcaaatgtcggtttttggctgaggttacaaatgtctggaccgcaaaagtcgggccgcaaatattggaaagtggcccttaataaatcatccgcaaatatcggtcgccgcaaatgtcggtttttggctggggccgcctatgttcgggacttgttttgatcaaacagttcaattcttgactttaaaaataagagagagagagcgagacaattagaaaattttaaattcatatttaaaatattgcaagatttcaagaattaagtaattagccattggtaattgatacatatcatgaagatgagcaacagcaacgacatgagtggttatgaaaaattggggaaaattggtgaaggcacatatggaacggtaaaaaaaagtgacaacatataattaattataagttaaattataaagaatttgttaatttaaggttttcaaggcaagaaacaaggacaccgagcaaattgttgctcttaagatagtgcgactggatgatgaagatgaaggagttccgtcttcggcactgcgtgaaatttgtttgttgcgcgaactacggcatgcaaatgttgtgcgattgcagaatgttgtgcatacaaacaagacgctgaacttagtctttgaatnttgtgaccttgatttacgcaaatttatgctattgtcatg

SEQ ID NO: 86187 - DNA, 704 bp, Heterodera glycines
  misc_feature (435)..(435): n is a, c, g, or t
  SCN-specific regions: Sequence locations=1-568,590-704
aggataaagccgacccggggcatggagcagacgatgcagtccatcttcccgcgcattcagtggcactgcgccggtccatgcagaccttccaagactccattgaagctgagttggcacagtggaggtactgctcgaagatgcaatcgagcaaaatggaggcattgatcagattggtcggcgaatcggttgaagttcagattcgcggccctccggaaaaggccactgcgtgcatttacttcctggaggatctgtccacattggtggagctgacgagtgccgaagtggcgcccggtatcagcacagaacggcacttcctttccccggcacatttgagggaacacagaacgacacctgccatttttacgccagaaacaataatggaaatgcaacagaacgagtcgctggtcattgtgaacagtgacggggaggaggagngaggagttcaccgatgtggtttgtttcggctccaaagaagctgccggtctgctcacgctcggcgtcgacatttccgtctcccaattgcaattgtccgcccgctcggaactcgccgctttgctggacgcaccgaacactttgggcatggactggagcatcctggcggtgaagctgaacttgactgaacaaataccggaggtcgactcgtcaggccaatcgttgtcccgcactgatcagctgctcaccgaatgggcacttcactcgcccga

SEQ ID NO: 86188 - DNA, 556 bp, Heterodera glycines
  SCN-specific regions: Sequence locations=1-556
taacggcctaccgatccgataactgatgcgtgggcaccccgtacaaatttgtcggccaaccggacatctgaccaagcaatggccaaccaacggtgccctgacgactcggtcaatgcacgaactcaacaaattcatgcaaataatgcaatgatgccaaccaaccgaagcaatttgtcattgaatcagccaaatgttacgcctgtacatcgtcagaatgggccatcaaatgtcgcacaaatgttggcggaccgtcgagctggagccgttacgccgaatcatcgactggcaacaaattccaccatcagaatcgggggacaatcgtctcaattggggcccttccagcaaatgaaaatgcgaatgaactggagcatgcgaccgccctccgggcttgcagttagcacgccggtccaaccacgtccaattgggcaggcaaacaacagcagtacgtcgatgctgcgtcaattcccaatccgaggtggacgcggacaaccgcagcaacagcaaatgcgtcgcgcgccaccgccagggaattgtgatgtgccatcgccaccgcaga

SEQ ID NO: 86189 - DNA, 683 bp, Heterodera glycines
  SCN-specific regions: Sequence locations=1-574,607-609,632-683
cacgtctttttgccgattcgccgcttttgccgatcagtgcgaccactttggcacatcgattattggccgactatttggaggggatcaaaaaaccaatcttggatttgagcagccaatttccgactacgtgtggaccggcgaagatccaactggacaatctgatccaaaatgggcaccaatttatggcacaggcggaagagttcgaacggcacgcccaaggccaaagtgcgggtgccaatttggcccaattagcgtgggcaaatgaccgactgagaaagttggagcaatgttttgtgaacccggcgatgggactcgcgcgggaagaaccgctcaaaaggcacgtgctgttcgctacaggaaatgacaacagttacgcggccaccacactggcaaatgtttacaacaaaattggtcaatttcgcggtgcgaaaagcgacaacgaacgcacaaaacggggcaatgaattggccttggaattgaccgttgtgcagcaggcaattcgctgtgccgtcagcacacttagcaaaggcatttgataaatcggaaggactccgaagggacaaattttgccgaaatattttgtttatcttttcaaaaggggcatttgttgaattcaaaatgttctcaaaaaagacatttatttttgaaattttaaagttaaaacacaaattcaacttttccat

SEQ ID NO: 86190 - DNA, 320 bp, Heterodera glycines
  SCN-specific regions: Sequence locations=1-251,273-292
gcagtccgtttcctcctaaagaaataccttctggcagcagacttcctctgaaactgctctatcggctcatacactttgtaacgggctcctctaatttctctgttgcgtccaatttgtctcagcaaacaccaatcgctaatgtgaacaatgcattttcgttgaaaatgcgacctcccaaatcactcagtgaaattgttattaattactttagaaatgaacatttcatgtgtcgtgttcctgtcgctaactgtcctcccttttcccttttttatcctcatcgttgtcctgaaccaaaaaaaaaaaaaaaaaaaaaaaaaaaa

SEQ ID NO: 86191 - DNA, 663 bp, Heterodera glycines
  SCN-specific regions: Sequence locations=1-402,425-663
gtcggtgatggaaaagacacaaaattgccaaagaatgctatgaaaaaatgggaaaagatggcatttctgctggtggaagacattggcgtggcatcaaagtgaaaacgaagccgaaaagtggcccaaacggagaacaaatgagaaactttgagcttgaaacatcatttacctctcaaatcatcaatgtcgggttgaatcgacgtcaattttcgatcagatttgatggtaatgaccaaagcgattccttcacaatgttttcgccgtcaaataatgattcgtcttcctttgccgatcagagcgaccttcaaaatgagtttttgaataatctgccaaaaagtgcatttttgggggaatttgccggattttggctgctcgggttggacatgttgccaccaatgaacgccgttccatcatcaagcctgagacacgaaaatgttcagctgtacatccaccgaggcgctcagtgcaccatggaagcatggtttacccaaccatcggattcggtaaatcccattgatcctaaagtggcaactgttgtgccaaagtcatttccaccagtgtcaacatctccaccgatgtcaactgctgatcagcaatttacgaccaatgtcactgatagcgaacaccagagcattaacatttccaccacggcatagagggaca

SEQ ID NO: 86192 - DNA, 233 bp, Heterodera glycines
  SCN-specific regions: Sequence locations=1-233
cctggtcgcttgatactttccgaaaatttcgacgaatacctggaggcgcaagggtacggctggttcatgcgccaagtggtcaagcttgtcggcatcaccaaaacattttcgaagaatgagaacggcacgtatgcatgcaaaattgaaaccaccaaaaagaatgtggattggtccagcttcaaattgggcgaggagttccaagccgagtatttggacgactccgtgcacaagat

SEQ ID NO: 86193 - DNA, 685 bp, Heterodera glycines
  misc_feature (491)..(491): n is a, c, g, or t
  misc_feature (536)..(536): n is a, c, g, or t
  SCN-specific regions: Sequence locations=1-211,233-685
attcgctgatgtgacggaacggtattttagcgagaaaatgtggccggacgaaaaaattgttgagaaagttgttgggacagacaatcgactgttcatcattctctacaaggagctttactaccgcgacttgtacacgcggatgcaacgcgtgaccctaatgcatcgcttccacagttacatgaactaccagagacttttttccgaaattcttaaccaaaaggacccgaacaatccgcaaaattacatcgcggttaacctccaattgcctaacatttggctttgggatatcattgacgaattcgtttaccaattccaagccttttgtctctacaaagcaaacccatcaaaacggtcgcccgaagagattgaggatttgcacgagttggagcagtcacaagatgcatggaatatttatccggtgctgaacattctctactcactgcttacaaagtctcaaataaatgagcaactcaaagccattcggggagggnggggcgagccggacgaaagtcgctgacgagtttggacgaaatgancctctacttcaagctgggctatttctcacttatcggtctgctgaggacgcatgttctgcttggggattatcaccaggcgctgcaaactgttgagtatttggaaatggatgctaagggtttgtacaacactgtgccctcctgtctggtca

SEQ ID NO: 86194 - DNA, 635 bp, Heterodera glycines
  SCN-specific regions: Sequence locations=1-97,124-635
ttaacggatatcgcttggcctgcaaagaagctgtccgctacatgaccgagaacctttccttccctgttgaagagcttgaccgtgccagtcttattcgtgctgctaagacatcgatgtcttcaaagttgattggatcggagtcagacttttttgccgaactttgtgtcgatgcaacagtggcagttaaacggactgacaaggcaggcagagtgagctatccaatcaattcggtaaatgtgttgaaagctcatgggaaatcgagcaaagaaagtcaattgatcagtggatatgcattgaactgcacacgagccagtgacgcgatgccacggaaaattttgaatgcaaaaatcgcgtgtttggacttttcgcttcaaaaagcgaagatgcacttgggcatttctattattgtcgaggacccagaaaagttggaagcaattcgaagggaggaattggacatcacaaaacgccgcgttgaaaaaataattaaatcgggtgccaacgttgttctgactaccggcggcatcgacgacctttgtttgaaagaatttgttgaggctggtgcgatcggagtgcgtcgctgtaaaaaggcggacttgaagcgcatagcgaaagcaaccggagcgacattgaccgcc

SEQ ID NO: 86195 - DNA, 656 bp, Heterodera glycines
  misc_feature (627)..(627): n is a, c, g, or t
  SCN-specific regions: Sequence locations=1-175,202-299,332-632,655-656
gttgaaatcacgcaaaaaaaattaccgacctaacaacgaaatgacgcgactgcgtgccgaaaatgaacaattgcgcaagcgtgtcatggagttggaggaggagacgaagcgattgcaacaaattgagcaacaacaacaggcggagaagcgcatgttggccgagttggaagctgaggaacaacaacaacagcagcaatcgcatgaccaaggagcaggaggagggcacaagaagatgaagctggacggcggtgatgaccacgagggattgccgtcttcggcaacgacgacgatggctgaacaacaaagacagcagcaacaacagcaagaacagtcgcatttgatggacgaagaaatgatggtgatggacgagcatagccttggcggcgtggatgctcatggcgatgtggaggcggaagaagtgttgcaccatccggacgtgccgaacccgccgatgacgccgcctgtgccggaacgaatgtcgccctcggacagctatgggctgaagtttgacagcgatgtgcaggacattgttggtggtgacgatgatgacggagtggagagtgggaaggaccggtgctgacgaagtgttgtacgctcatgaagaagttgaagggaggcgaggagganggcgtggatgaatatgatgaagatgaaga

SEQ ID NO: 86196 - DNA, 553 bp, Heterodera glycines
  SCN-specific regions: Sequence locations=1-553
cgcttgcagccttcacccaaatatgatggcgccaaatcaacctcctatcagcccgatgggcgaaaggtggcaatacagtacggcactggctcaatgaaaggatttgtttccaaagacattgtttgtatggcaaacatttgtgtacaaaaacaggaattcactgaagcgaccagtgagcctggcctcaccttcgtggctgcgaaatttgatggcattcttggcatgggattttcggaaatttctgtccaaaaattgccgaccgtgttcgacaacatggtcacgcaacagaaagtgccggagccggtgttcgcattttggcttaaccgtgacccgacctctgaatttggtggtgagatcaccattgggggcactgatcagcgacgctttgtggccccaatcacttacacaccggtcacacacaaagcctactggcaattcaagatggattcgatcagtggaggtaatggcaaacttgcgtgccaaaatgggtgccaagccattgcggacaccggcacttccctgcttgctgggcccaaaaatgacattgaaaaga

SEQ ID NO: 86197 - DNA, 710 bp, Heterodera glycines
  SCN-specific regions: Sequence locations=1-290,313-710
caaccccgcttggcatgctactatcgcgagatcactgcgagctcatttgccaagatcagcgttgacggatgcgtcattgatccgggatcacacctttgggcatcaaccaggctggctacgtcctgcacagtgccatccatgcggcgcgtcatgacgtgaactgtgtgctgcacttgcacaccgcgtccgcagccgcagtttcggcaatgaaatgcggacttttgcccatcatccaagaagcaatgattttgggtccggtggcataccatgaatatcgtggcattctaacggatgtacaagaacggaaagaaattgtcaaaagtttgggcgacaaaaaagtgctgatgttgcgtaaccatggcttcgccacttgtggcgcaaccatagaggaggcctttcatttggcatacgaaacgattgtcgcatgtgaaacacaggttgccgcaatgcgcacagatttgaataagaatttggtgcttcccagggaatcggcggttgcacatgcctatcaaattgccaagcatggaaccaatggaatgaatcgaacagccgttcccgaagagaatggcaaaatggagcacacttttgaacgcatgggcaacattcagtggggcgttggagaattggagtgggaggcatggatgcgccagttggacggagccggctaccaaactggacacaagtacagattaccgattctgctcgaacca

SEQ ID NO: 86198 - DNA, 419 bp, Heterodera glycines
  SCN-specific regions: Sequence locations=1-419
ctaccgctgactgctgccgcgcgaggacgtagtggagctgctgccgaacgacggggacttcctggtgcgcatgacagaataaatttcgggcacggagcgtgtgtatgcactgtcggtggacgtcggcggcttcctgaaccacgtgatcttccgccgacacaagggaatgttcaccgtggacctcaactccgacaagggcttccgaacaatcgaacgattcgtcgacaattatctgcgcaccggagtttccgtcaccactcaacaatacgtcgctctcatcatggccgtgccccgcgcgcactgggagctgtcgcacacttcaatcatcctgggcaatgaacttggccgcggcacgttcggggtcgtcaagagtggcgtctacgtggatcagcaggggactcgagcggcggtggccatca

SEQ ID NO: 86199 - DNA, 281 bp, Heterodera glycines
  SCN-specific regions: Sequence locations=1-281
attcgcttcgattcggctaatgactttttgcgcattagcaatgcttctttatcccctctcccataatccctcccaattttttttttattgctgatcaggatttattttgcttctgctgctgatgatcctttacggatgaccaatgggatcagtcagatcaacccgtgggattgtttggatttgtgtcaaaataattttccgattttatcgctagagcttggatcaccggccggctttcgctgaaatctgggtcttccatagattttttttttggggggggg

SEQ ID NO: 86200 - DNA, 619 bp, Heterodera glycines
  SCN-specific regions: Sequence locations=1-619
caatttcgaaaaagggatttgaccggcaactcaataagaaaaattttgaaatggctaacccaattgcaaccaaaaaacaaaaagtaaaattgtcttacgaaggccacctttacaccttcgctaaaatgagttctgatgggatgacaaaattttggagatgcgagttaaaaacagcaccgacaaatgcaacggccgaatctggacggacctccacgaccaattcattcgcctcgcaactccgcacacatgtccagcagatgcgtcacgtgttgatgctcaaatggtcacgaccacaatcaaaaggcgcgcaattgccaccttcgaaccgccttctgtcatcagagcagaagcgcttcaaaatgtcccgtctccgtcggcaattttggtgtcaaaacaagcagcaaaagatgtgaaaaactgcaccgattctgtgtttgccgagaacgctcgaatgatcacgtctgttgcgttcgtgcccttgtgtgacattagaatggcggtagcggcacttgatacggagttcggaaatttggcggttttccaaccgctgattgactggtccaatggcacatggtctcaaccaacttttcgccctgaacaatggaacgtctacacacgc

SEQ ID NO: 86201 - DNA, 583 bp, Heterodera glycines
  SCN-specific regions: Sequence locations=1-138,162-168,195-263,285-583
ggctgttagcggcaaactccaacaacattgttccgccgcttttcccagctgctgatcaatcgatttgcaatgtgaaacgaaccgaaacttttgactcttttcgccatttccacgaaaattaaaaagttaaactgatcaatttatttatttattgtgtatttcttttgaatgtttgttttctaacagttatttttgatcgtttttaccactgatctgtgcttttggtcggcgatggacggaataaatcggtcagttgagctgaaccgctccttccgcctcacccggtcgcagtccctctgcggcattcgttccacttcggccggcaattaccccgtcatcccggtccgattggcactcactcattcgccaattttggcattctttcactccgtgccatcccattcagcgcacttattccatctgcgacttcgatgactaccggcgcgaagtgatcgcccatccgatcacttggccccgtgtgcccgtctttcggcccattcgctccgcttatgtgtgccgcccccattggacttaccgctcctattggccatacaacgcgtcccgctttgagagccctccaatt

SEQ ID NO: 86202 - DNA, 605 bp, Heterodera glycines
  SCN-specific regions: Sequence locations=1-142,164-181,203-605
agaaagttccgaagctgttggcatggaacatgaaacagcgctcgctgtgccggcggacccgcaaagtcagcattccgaactgctggagatgaacgacgtgttgcaatgggagatggccactaggtcggaggacgagcaagtcctcgaccctgagggtgaccttgaaggcttcacggtgttgattttccaaaaattggaaaaattcttgcaaaatgtgccaccctcggaggagtacacaaaaattacggaggaattggccaaaatggtcgaaaattggaagcagtcggtgcaaccaattgatgttgatcaagaaactaggcagctcttcgaggtggagaacagcttggaaaatttggacgaacagctgaccgaacagaatttgagcggcattaatgcaactccggcagttttggacattgtgcttgacatcatcaaaaatgatgtacatgaaaaagagaagtcagaattcatgtggaaaatggtcaaccgaaaggcgacacattacgtgaaaaatttgggccaacttttgggcggcattccaattgccatcaaatacttggaccaagtggtctttgtcggcaaatgggctttggataatagtttcc

SEQ ID NO: 86203 - DNA, 572 bp, Heterodera glycines
  SCN-specific regions: Sequence locations=1-15,37-170,192-286,309 -468,491-506,535-572
taaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgttttgaatcttttt

SEQ ID NO: 86204 - DNA, 742 bp, Heterodera glycines
  SCN-specific regions: Sequence locations=1-170,192-742
cattctaacgtaattattctgctctttgagacatcattccaaataagccaaatcgtcaaaaatgaaccgacgctggctgtgcaatgacgtttggatggacattctgccgttttttgaccgtcctcagctcggcctcaaattggcaatgctttcgccccgtttcaatgcgctggtggacatccatttcgatgccaaaacggaattgacgctttggagaccaatcgcaattcgcaacgacggtggcacagcgacgccacacttagcggtgttagtcgacggtgtccattccgtgccgtttgagttgcccgacgcccattcgccgccaatgccaaacaacattcgctttaaggaccttcgaattaattgcattgaccattccgtgatcgcatttcttcgtgccaatcaactcattttccagaagggcaccaatttgcgtctgtcggctccttttggtccattcaacattgatgatgtgcagccaatttgggatgattttgcctgtcgaatttggcccatttttgcgtcaacaattcgccacttttgctttccgaacggccatcatctggacatgttgctccgtctcgtttcgccgacaattctcacggatgatctgatcaacatccattcaatcgattccggtcgtcagtttcccgaagcgattggtgatgatcattttgatgggccaacaattacaaattttgatggatcaattgtgacttctgttgctgctggtcaagcgttg

SEQ ID NO: 86205 - DNA, 671 bp, Heterodera glycines
  SCN-specific regions: Sequence locations=1-671
atttatccgaccgataacacaaatttaatggcagcgctctctccgatcagataaatcaattagagaattggcattcggccaatcagcaaaatggaattcatagtgaaaatgctccattcgattttgaaacagaccgacagaggagcgaaaatcccgaaaacgctggcgaattggccgcttcgttacgccaacgctgcgtaaaagcgccaaattcgaaagggatggccgacaaagagacaattcgcttggatggccagcagcagcaaaatgatcaacagcagcagcaaaagcgctcacaagaacagtcgtggcatcgaattatgatgctgatcattgccataacggcacataatttccccgagggattgtccgtcggcgttggcttcggcggtgccggccggtcggagtccgttagcctggagaaggcgtcaaatttggcgctgagcattggcctccaaaacttccccgagggcatggccgtcgctttgcctctggcggcctttggccactccaaatggaaggcgtttttgtacggccaaatcagcggaatggttgagccaatggccgctctgatcggcgcttcgcttgtgctaagcattgaatttgtgctgccctacgcactttcctttgccgccggcgcaatgattttcgtcgttttcgattcaattatc

SEQ ID NO: 86206 - DNA, 700 bp, Heterodera glycines
  SCN-specific regions: Sequence locations=1-85,107-148,204-310,332 -355,377-596,618-700
gacggtcctttgggctcttccttcgttggcactgccatcccgcaaattgcgtacgaagtgccacaaattgtgcactgaatcgaccacaacaacagcagcgggacaccaaaaggaagcacagccgacggatgagggggaagaatattacgaggaggaatatgaggaggacgagtacgaagagggcgaggagagggaggaggaggccgagaacatcagcggggacgggtcctgctccaattcgttggcctcgtcgctggagggcgaccatctgctgcgcgagcccccaaaagtgttcactacgcctcaccatcctccacctccccccgccgccgttcactcgcatcaccagcagcagcgtcagcctcagtttccttttgatgggaaacggcacttttccaacggtttccatggccatgccaaattgggacacaaaacggtgcaggcgatcggcgacagtcagcagctggcggccgagttggccaagcaggggctgcaagtgatctgtgcacccgactgcgagccgaaggcatttgccattttgattgactttgtgtacagtgacttcgacgtgcgttcgctgtccgtccgtggccaattgactgatgacaatgtgatgaacacgctttacgcagccaaaaaatacgccatcgatgcgctcgtcacggaatgcgtgcgctattgcaccgcgcgactgaccgcg

SEQ ID NO: 86207 - DNA, 685 bp, Heterodera glycines
  SCN-specific regions: Sequence locations=1-403,432-685
ttggcgcaattcggcgtcagtattacgcgatcggagtgggatgacacttgcacggcttgattacaacgtgaagggtccgacctgattaggagttggagcaaggaggatgtgtccaatggggaaatgtctgcgcatcatttcggcaacgggggaccgtccacctctcaccagccgacagcaaatcagcaaagacgcgactcgccgcctaaaagaatgcagaaacaatcgcagcaaaagcagaagcaaatgtcgccagacgagtggttgaagaagttggaggccgaatcgggcggccttcgagacgaagaggaggagcaggcggagaaagacgtgctgaaagggagcgccggggagagcatgcggaagggagcgaaagcacagaaaggcaacggggtgattaggagagatcagcaacagcagcagcaacacgatatgaacggaatgaatctgaagggatcactcggtggacagaatcggaggcggaagaagagctgttgctgcattatttgatcacgccttcgccttctccccaatcgcttgttgcccctttttcgcattttggtcatcctttgattcgtgattaaatatatacgtaaattgtatcgcctctttctctatttctatccccaaatggtcattcgttcattcagctcacaattcctaccaaatctgcacatttaaagag

SEQ ID NO: 86208 - DNA, 596 bp, Heterodera glycines
  SCN-specific regions: Sequence locations=1-534,556-596
gcaggggacggaattggcgacgaattggcccattttttggccggtcttccgcccgtggatgaattagggcaattggtgctgaacaagttcaatactcgtgcgaatttgcccaacttctctacaccggcggaggccatgtggactcggtgttctgcaatattttcagcggatatccgcccactttcttcgaagaattgatcgagtacgccctcacaacgcatcgtccggatgcgttaatccgtcgcatttgcgtttggctggccgcggatgagccttggcccgacatcgccaccctttttccctccgctgtccaacgccgcgtcagcaacgaccgcgtgctgtacgaattccaaaacattggcaaaagttgcggccagcagcagcacaaacggtccgaatttgtgcttcgcattcgtgcgccttcgcggccaatgctttttcgggcgatgagcaatttttctttgtgccgaaaatgagaaaaaaaacagttgcaatcttttggccatttcattttgtattgtattcaatggcatcgtctttcctttctccctttttgaacgccttcactttttttgattgttttttcttgcccattg

SEQ ID NO: 86209 - DNA, 393 bp, Heterodera glycines
  SCN-specific regions: Sequence locations=1-26,48-393
aactgcgctcctctccttcactagattgagtggcaggctgtctggagcaggtgccaatatgggcggagatggcgtgcaacttcgccacctgctgatttcccagggtgttctgtcgtagctagccaggctggctcgactgcgccgatactttgggcatctccctcggctctttcctacctgcggctgctccaactcgtgccgccacaaaaagccacgagtgccattgcaaatggacgccctaacggcaccctgaatgaccacactgctcagatatgaggacaccaccgcccaaactgatgccacttgcgcacttacctatctgactcgatggaaataatgacaacgtttccctcggtatgggctgtctttcggacatggtcactttcatctcgt

SEQ ID NO: 86210 - DNA, 618 bp, Heterodera glycines
  SCN-specific regions: Sequence locations=1-129,151-618
tagttagatttgttttgcttatttgatctgaaaattaatcagaatgaccagcgaaaagaatttgccgttgacaattggcgtgtgtgcttcttccgttgcgctcggctgtattgcgtacaaattgttgcagcgcaaaggctcccagcaagaacttctagacgaaatgactttgaggaaaaagaaagacgaggcacagcttatggactcactgaagttggacccgaacactccgctcaactcacacgagttggcccttgcttcactcatctcattttccgaggatgccgcttcgttcgagaaagtgggcggctgttcttccattttggaacttctgaggcagaaagttgttgtccctcttcaactggcgtccaacaggaccactcttccgtcgttgctgtacagtgcgccgaaaggaattcttctttatggaccaaatggttgtgggaaaactctgattgcgcgtgccattgccaaagaggtggatgcgtacttcatcaattttggaacttcgctcgtcgattttgtcaacggatcatccgttactatgaagtctctgttcactttggcagagaaaattcagccgtgtgtcattttcatcgatgaaattgacttgctgtt

SEQ ID NO: 86211 - DNA, 450 bp, Heterodera glycines
  SCN-specific regions: Sequence locations=1-126,150-336,358-394,416-422
ctgtttccgctgcaaaagacccacttattctaatgacaaagtcggcccccttaaggacggagttttgttcccaagggatgctttaaatgttggatttgtggaagccgtctctccctaaaatcgtatcataacaacagaaacgacaaccaagacttggagttcaggtttactgtgctggccatgtcccaacgcctggaccgcacgacgccattcccttccggtcgaatttgctttggtcgccaaaaacgaagggcgaatacccgcacaatttgatgcagacgtaaaacaattcgaacgacgcgacggaaccaatcaaagcattgctcagcaaacttagaacacattttctaatcagagaacaaatggacggcaccactcaaatgatttttgatttaatttgcacaaatgataaattctacaggaaaaaaaaaaaaaaaaaaaaaaaaaaaa

SEQ ID NO: 86212 - DNA, 183 bp, Heterodera glycines
  SCN-specific regions: Sequence locations=1-10,98-159,182-183
aaaaaatgggaaaaaaaaaaaaaaaaaatgactaaaaaaagagaaaaaattgaaaatatataaaataaaagaaaaaataaagcaaaaaggaagaaaacactcaacaaaagaatggaataaaattgaagaaaaaataacgaaaaaattggggacaaatcgaaaaaaaaaaaaaaaaaaaaaaga

SEQ ID NO: 86213 - DNA, 673 bp, Heterodera glycines
  SCN-specific regions: Sequence locations=1-673
ataattcgtttcccctccaaatgccttttctgtcccttttctcttccgtctccgcttttgcccttctctctctcctttccttttcttcttctgtccatcacttccatcataaccatcactccgattcgtccaaaggacacaacggccatcatcagcagaaggaccatcaaacggcacaagaaattccttccaattcgttcccttgcgcctgcggcggtcattcgtccggcggggaaaatgcgcgatggatgaacggaatgccggcgaatggagttccgttgtttttgtttccggacaatgtcttgcgattggtcggcgtcgttctccgaagtgaaaatgcttttcatagggacaacaacgaattggcgcggcatcttttccatcttttggcccaccagttcccccgaaaatggtttatcgtcggaatcggcacaatgccatcgaatggtgcgaacgaaccgaaaatgtgggcccgcgaaggaatcgacgcactgaacgggactgtacagttgcaaagcccgcccggttacgacagctttccctttttggacggacggcgttttcaacgagaaaacggaagcaaaatttggtatttcgtatatgcggtggggccaatgacggacaaagcaaaggacggattgccagagcaaagcttggcaaagtgtttgtcgga

SEQ ID NO: 86214 - DNA, 651 bp, Heterodera glycines
  SCN-specific regions: Sequence locations=1-276,298-298,320-651
aaatttattaatggagaaattggcaccgcaaaattattgtctagccgattaacagcatcatctttggcaaaagctgcccaaatggaattggacttcatccaaagcgttttgttgggcccacagcgaggaaatttgacggcaattgaatgtttattggcacaaaactttaacaaacagtcatcaatgatgccaaattatggcacggaacgtaaaaatgcaaaagtaccaaaattagaaatggaaaaggctggtggtggtgatgaagccaaattggacaatggaagcgagaccgatcaaagtgatcagaagcaaaagagaaaaggggtgggacgaccgaaaaggcatccgagtgaatgcaaagtgtgcgggaggaagagcttttactgttattacagtgtccgatgttgtgaaagctgtaagcaattctttcgtcgtattgttgcaaagcgaacattgttaaactgttttggagcgaaaaattgtcaaattggaaaagatggcattcgatgccgcggctgtcgcctggacaaatgccttttggccggcatggacccgacaatgatcaatgcaatgcaacatgaaggaatggcccaatatttggacagactggaattgcgaaaaaggagtgctttgttgagaaagaattgcaga

SEQ ID NO: 86215 - DNA, 605 bp, Heterodera glycines
  SCN-specific regions: Sequence locations=1-296,318-605
aagatcctaaaaatgtcttctccgtccgtctctctgctcgccatcgtcgcaattttctgttcactatacaaatgttgcgtttcggcaccgcattcgtgctgtcccggcagccaaaaagtggtttcgctgatggctaattacgttggcactttcgcccattccttttccagtcatactttgttcggatgcccaaagtgttgcgggcgcattgaaaggccaactgatcggttgcccgaaaggcggcgacgcaattcttttggccgacattgaggcatctcttggcactcattttgctgatgagtgtgcccacagccttggcttcgtccgtgccatgttcgccattgccgcatccgcttcttcccatgccagcaacaacaacgaatggcaggcattgagtgcccagtttggtcagcaaatcagtgaaattgactcgaaaagtgccgagtttgacattggcattgccaaagtgccatttgacagcccaaagggagaccactcccaacgtaatgtgcctggcacgaacagtgtgatttccatgcctggatggaccggctcacacaaacactgaaatgaataatgagtgactgaatggaatgaaatgattg

SEQ ID NO: 86216 - DNA, 686 bp, Heterodera glycines
  SCN-specific regions: Sequence locations=1-362,387-422,444-486,524 -589,611-661,683-686
cactgatattttggttttctctctctatctcaaccaacaacaacaactcaatgtctgacaaccgtggtgcctccgttgcttcgaccggtacgaccaacagtcaggagtctcaagtggcgtctccagtgaaagccggaaaagctactacgaagacgacggctagcggaaagggcggcaaagcgaaggcggacggaaaagtgaaggcgggcggaaaaggggcgaagaaggcgggcggaaagggtggaaaagtgaagattgctgcgagcggatcgaagaacacgcgctctgctcgtgctggcgttgcatttcccgtcggacgtatccatcgtttgctgcgccacggtcgccatgctcagcgcattggggccggagcgcctgtctatatggcatcggtgttggaatacctggcggccgaagtgctcgagctggccggcaacgcggcgagggagaacaaaaagttgcgaatcactccgcgccatttgcaattggctgtgcgcaacgacgaggagttgaacaagcttctcgcggaggtcaccatttctcgtggcggtgtgttgcccaacattcacgcggaacttttgtcgaagatgcagcagaagaagcagcagaacgacgacagtcagtgaacggttgggaagaagaaacggacggatgaacggatagaaaaatgaatgatcccaaatatc

SEQ ID NO: 86217 - DNA, 690 bp, Heterodera glycines
  SCN-specific regions: Sequence locations=1-20,42-690
cggcaccggtttaatggtccatattttaaaaaagacagctgtggcactcgccctgcaaagccccttattacgggttcagcaataagattgccatcctcctcaacaagtaaagcaccgccgatgttcaaccaacgtaccaataccaaaaataatgtactcgagaatgcggtcaaaatcccaccgttcaaagagctgcatgcaaatccattgggcaatggcatcgaattggcaaaacatgggcaaatggaaaacgaaatggcggcacactttcacgaccagcgaaaattgtccaccaaatcatcagtggcggaaggaaagtttaacccaaagatgaggacgatcgacccaaagttttatccgcaggcgccacgaggcaatgtcaaggacacttacaaaagtcaaagtggcaaagaagtgaaaaaaatctctgtccccgatccctaccgcggcttggagaacgcaacagctaatgccactaagcaatttgtcgaagaaatcaacaacatttcacagcgttatctcaatgcgaccccagtgcgccagaagctaaaccattcgcttactaaaatgtggaactacgaaatattcttcacgccagaattttgtggcggtttattctattattatcacaacagcggcttacaaaaccaaagagtgctctaccaaactaaatccctgaacagtacggga

SEQ ID NO: 86218 - DNA, 682 bp, Heterodera glycines
  SCN-specific regions: Sequence locations=1-601,623-682
caatcggtggaacggaaatggcgtatcggaacgacaattgcacgacgagtggcggaaacggcggcagaatgccactaattgaacatgtggtgaagaacggggaaagtctgatgcaaatttcgctgcaatattcagtgccggtctccgaaatcaaacgtgtcaacaacatcgtcgcggaccacgaaatccacgggttgcccctgctcagaataccaatgactcgcgcctttctgctgagaaggcaaatgatggaagcggaggaagagataggcggacaaagcgaggccaaaataatcgacattttgggcgacgagggcacatcgacggcaaattgtggcacattcgacgcaatgacggaggaggacaacaacgaagggatgagaacgacacatcgaaatgtgatgaaggaatttggaagtcatcggagccaaacaaatcgacaacaaaacgcacttagaaaaacggatttcggtgctttactcaatggtcgacaaaacgacgcgctgcggagctccgatgaaagtttggcagcctacgcgaaggaagcgattgagggcattttggatgagacggatcggaatgtggcgaccgttcgacagaatttgccctccccttcccttgagggggggcgcttttcatttcgtcgatgccggtgtgcccgacaattcatcgaatgtttggc

SEQ ID NO: 86219 - DNA, 730 bp, Heterodera glycines
  SCN-specific regions: Sequence locations=1-294,316-730
gattttgggtgagtagcacaaatggcagtacaagagcgataaaagcagcagcagatgcacaaagaatttgcgaaaattgagggatggacgaagtgtggactttgacccgcggcagatgtgcaggcgtataaaagggcgaacgaaatgaccgttccatccaacgccaagcaaatcgcaaatccagcgattcattcagtcatttgcctacccaatttgtgaatgaaattcatggcgaagggcacaatgcattcgcaaattaaagcactaatgaccaacggtcattcttcccaaatgttttcccctccctcccattttaaatcaaattgcaaatcacaacaaaattcacagagccaattcaactccaaaagccgaaaatgtctcctgttattgcccctttcgtcctcgccatcattggcatcatcgccttgcccaccatcgaaggcgcagtcgggcgtcagcaagtcaagctgggcgagcagtacaaatacgagaatgtgcccggcaaattgatggtcaagcggcaaactgcggccagcaaggagccccagtatttgttcgccggtcaaacggcatggaccacggacggaaaagaccgctttggccatgccgagttggacttcgccactggcacaatgaccatccccaacttctccgagaacgacttgggctcctacaccttcccgcttgagcagcccaacttcagcgcagtgaatgggcccaacggatgcga

SEQ ID NO: 86220 - DNA, 383 bp, Heterodera glycines
  misc_feature (263)..(263): n is a, c, g, or t
  SCN-specific regions: Sequence locations=1-237,263-383
caccgcccgtcgtttttacttttcgagaaaaagcaatccatcaaagtgacaattggcatttgttgccttcggtacagtctgaatctgttcaccaatgtcagttggtcttgccaataaacaaatattctgtcacttcattttcctcgaacacccaaaaaatcaaccaccaaagaaattctcgtgtctccaaaatggaacatttcgaagggatctctcactgcaaaacatctaccgaaccgaaggaagatgaggagaatgctgancgactgttgaaatattcgaggaattgcctctcacaattgccacaccaaagcggaaggaacgaaatgttttctgcgaaaagcatttcccaacaaatgcgaatgccgttttcgctgtggcct

SEQ ID NO: 86221 - DNA, 606 bp, Heterodera glycines
  SCN-specific regions: Sequence locations=1-548,570-581
tcatgcgccgccttttgtcacttttgcaggaggcccaaaccgattgcactgacacagagtgttccacgagcactggcggcgaccccacgggcactgccgggtccaacgttctgctgattgccatggcctggggactgtttgccatgcttatgtttttcatgcggcctgcttcgatgcgttccggcggaaacgatcgcgaaaatggccaaatcgcgggcaaaccgtcgtcagcagcgaacggacacaacaacgatgatggcaatggcccaccgcccggcgacgttttctgaatacagcgaaaggaacggaggagacgaagacgcaaacatggaattttttgaccagcgaatgccttttccgtcgacgatcactccatccgtccttcgatttgtcctccatcactttccctccctttttctgtcgctttgcctttcctttcgtttcgctgtctcccaaaaaggctgatgaatggcatttttcaactttgagctccgtctcaaaattggattgtttttctttttgccggtgcttctccccccccccccccctttctcccacatttctttctccgaatttcgtgcaaaaaaaaaaaaaaaaaaaaaaaaa

SEQ ID NO: 86222 - DNA, 681 bp, Heterodera glycines
  misc_feature (645)..(645): n is a, c, g, or t
  SCN-specific regions: Sequence locations=1-681
cgtctttggagagaaagtcgctggtaattccacgaaaaccgaggtaaacgaacagggcgaattaagcgctgtggtaaaaactgaggcggagagtcaaaactcaacggaagtgcaaaattatgctttggtggaccttgattgggtgaacaactcgcagaagagccatgtgctcttgcagatgatgaatgcgatgggctacgaacatggcaagggacttggcaaaagggggcagggcattgtggagccgatcaaaaccaacccaaaccaggggaagaaagcatttggggccaaccacgacagccgacgagaagggaggcggaggcgaagaacgagggaaagcggacacatggaaggacaacaaacggacagcggaaaaaacgcaatcgccgaacagcagcaaaaggacgaatggaagagacggccgaatccgtcacggagggcgcaaatgcattacgaagacaatgtgagggacacgctgaggacggcggggctttccgaacaatcggcggaggaaatttggcaggcgcttggcattctcgcgaggcaccaaataatgccacttggcatgggacttggacttgtaaaacggcgagcgggaagaagacgcattgaaatggaggccaaaaacgaagggaaggcagaatnttgaagtgacatggacacattaattattctttgtga

SEQ ID NO: 86223 - DNA, 707 bp, Heterodera glycines
  SCN-specific regions: Sequence locations=1-54,76-707
gattggcaattccttcgttcggtcgaatacttcgctgagaatgaaattgacatattcgccattctgtttgtggcattgtttattgccatcgctgaagcagatggcaatgtccgggcaaaacgccatgaagaacgattgaagcgccaagacaaccgagctgatgaggagaaccgccaggtagacagtgctgatcgggagaagcgccaagacaaccgagctgatcgggagaagcgccaggaagacagtgctgatcgcgagaagcgccaagacaaccgagctgatcgggagaagcgccaagacaaccgagctgatcgggagaagcgccaggaaaacagtgctgatcgcgagaagcgccaagacaaccgagctgatcgggagaagcgccaagacaaccgagctgatcgggagaagcgccaagacaaccgagctgatcgggagaagcgccaggaaaacagtgctgatcgcgagaagcgccaagacaaccgagctgatcgggagaagcgccaagacaaccgagctgatcgggagaagcgccaagacaaccgggctgatcaggagaaccgccaggaagacagtgctgatcgcgagaagcgccaagacaaccgagctgatcgggagaagcgccaagacaaccgggctgatcgcgagaagcgccaagacaaccgagctgatcgggagaagcgccaagacaaccgagctgatcggga

SEQ ID NO: 86224 - DNA, 750 bp, Heterodera glycines
  SCN-specific regions: Sequence locations=1-89,113-207,229-528,550 -614,636-750
gaatatgagtctagcttctatttggaatatatacggcgtgatgttgacattccaaaatcagccccaactgaattactgactgagaagcacaaagaatttttactttcctatggtcaagaagagaagtcgtttgaatatatcatggctgagcatctgaggatgagtggcatttactggtgtttagctgcactcaaagtattgggagaaaatataaacgacgaagaaaaattagctgacctcatcaaagaaaatcaaaatgaagatggtggttttgctgcggctgatggccatgactcacacattttgcatacactaagtgcgattcaagtggctgttatcattggcagactcgatattataaatttggatgcgaccgtcgaattcattaaatcgttacaacaaaatgatgggagttttgccggtgatcacgggggagagattgacacgaggttttctttctgtgctgctgcatctctgtattttcttaatcgtcttggttcaattgacgttcataaagcagttgaatttgttattaactgttacaattttgatggcggctttggaacaaggcctggctctgaaagtcatgctggacaggtttactgttgccttggaacactctctgtttgtggttgcttggagcttattgatgtggaacgaaccgcaacatggctggctgaacgacaatgcccttccggcggactttgcggacggcccgagaaactgcctgatgtgtgttattcttggtgg

SEQ ID NO: 86225 - DNA, 423 bp, Heterodera glycines
  misc_feature (400)..(403): n is a, c, g, or t
  SCN-specific regions: Sequence locations=1-291,320-398
caatccgcaaaatgtcccttttccgtcctcaatcgctgcttcttctggccgctctttgcctgtcctttgcgctgctctttgtcacttcgtcggaagagggagggcgagtgaagcgcggcggatggccttgggattgggccggcaaacaactgtgcaaaacatcggcaaattgcaagtgcaaggatggcaaaaattgggccaaatgtgtaaagtcggaaggctacgcggccagcaattgttgcgacaaaaattacgtgtgggcatgttgcgggaagaagcccaaacattgatgagagaagagaaagggagagaatgagaagcgagttcacataattcattctgttttggatttttagtcttttttttctttttgggtttttttggtaaatattttctccannnnaaaaaaaaaaaaaaaaaaaa

SEQ ID NO: 86226 - DNA, 564 bp, Heterodera glycines
  SCN-specific regions: Sequence locations=1-242,268-490,513-564
gtaccctccgttgctgcacaatgccaaaatgcgcagcactttccatccgccgatgggcgagggcgagcagcacaaacagcagtccaattcgagcgtcgcttcgtccgtccgttcttcgaccactttggacgggggagggccttcgtgttctcagtcgactgctggcgatgagtcggacagtgccgtcgctgggggcacaacgccgcgtccctttggcatcggcagcggcgaatttgtcacggttcagcaccatcagcagcagtacaacaccaacaacaacggcaccaatggcgggacgaaaatgcacagcacattcagcaggtgtccaactgcggaatcaaacgcaatgctggtgatgaacaacggtgaccatctcaacgagtccttctccattctttaaagatcttcaaccgtgaattttgtgatatgaattctttaaagtttaaacattcaaacgggggatgttcatataaatcacaaaattcccctctttaagttaaatatcactattttcacctgctctattatttttttattttcaaaccagataaatattaatttttg

SEQ ID NO: 86227 - DNA, 747 bp, Heterodera glycines
  SCN-specific regions: Sequence locations=1-43,112-319,341-643,665-747
ccgttttcgaccgccagacgtggcacagccgacgctgtccctttctggagtgtccgagtatttcttgaacattaaattagaaaaaactgaacgcgaaggcaattggagtcagcggccgctccgtctcgagcagaaaaaatacgcggcgcaagacgcgcactgtctgaatcggatcttcagaattgtggcatcgaaattgaaaagattgaaggacaatgaactcgccaaggagttgaaacggcactcactgatcgatttcaacgaagaaaaggcaaagccaacgatggcaattccgctgctcagcggacaattggtgcgagtgaaggaaggcgaggaggacttcattttgaacgtgcaaaaagccgccgtggaaattgagcgatcagccaacggagtgttggacggcttcagaaccattggagatgtccgcttcatcgtcgactcgatgcttttcgggttgggcaaacgtttacgcaagtgcggcttcgacacgcgaatgattggcgaccgtgaacaaattgtcgagttttgcaagcagtcgaaggacgaaaaatttgtggtgttaggcgccggcaaaggacataaacagctcgccctccaaatgccagacaacgaagtggtcaatgtgccaattgcgaccgacggcaccaccccaccttccctgttggtcaggaacttgttggacgaactccgcatcattctccgtccttccgacatgtggtcacgctgtgtggagtgcaacaagcg

SEQ ID NO: 86228 - DNA, 343 bp, Heterodera glycines
  SCN-specific regions: Sequence locations=1-343
aacaaccgaaggcgatcattgacccgacataaagagatcagagatcggaaacaataacgtgaacagtgcacggggaagacgaacaactgccgggataagacttatcgcagaaggaaaatccatgaacatcgcgaactacacaaggatggaggaatatgaagagcggagtcagcatgctaaaacaactcggacataaaagacccactgatgagagtgtctaaaaaggacggaggcttgaacgcccgtttggcacaccgataatgacctatcaccatgttggaatatgttgtgagacaaagtttcatgaacctgatgaggtctatgtaaaatgttattgtggtac

SEQ ID NO: 86229 - DNA, 157 bp, Heterodera glycines
  SCN-specific regions: Sequence locations=1-64,99-157
aggtgtcctaaggcgagcctagagaggacggaaacctctcgtagagcaaaaaggcaaatgcttacttgatcctgattttcagtacgaatacggaccgcgaaagcgtggcttatcgatccttttgaatgtgtaaagtttccagcaagaggtgtcagaa

SEQ ID NO: 86230 - DNA, 521 bp, Heterodera glycines
  SCN-specific regions: Sequence locations=1-236,258-501
acgccgcactggacattctgccggattttgcgtttgccgtgcccgtttctctgttcgttgccaatccgccggctgcaattctatgggccggatggttggcggttggagagtattttgccaagaaaagttggagtttggttctgcgagatatcgttctgccaacaaaaagtggtggaaaatttatggagttactgcagcaaacagaagtgccagttgaaagagtatttccaaaggaggttgaggaagatgctgacaaacttggcgaaggaagcaaaggccaaaaagaaacgatgccagtaattgaagcgctggctgccagtcaggtggattccaacctgtaccagtacctgttcatgaacactttacgcgcctattacgtgaccgcgaccagcatttactcacattttatggaaaaaattgaattagccaaagacgaacatgcgatgacagaatttgccaaggacgtgaagaataagatggtcgaaaatgaagttatgaaggaaaaaaaaaaaaaaaaaaaa

SEQ ID NO: 86231 - DNA, 681 bp, Heterodera glycines
  SCN-specific regions: Sequence locations=1-681
caattattctgctctttgagacatcattcgaaataagccaaattgttttttaatcgcccccaaaatgaaccgacgctggctgtgcaatgacatttggatggacattctgccgctttttgaccgtcctcagctcggcctcaaattggcaatgctttcgccccgtttcgatgctcttgtggacatccattttgatggcaaaacggaattgacactttggagaccaatcgcaattcgcaacagtgtcgcagcagtgccagaattacatgtgtttttcgacggtgccaacaaatccgtgccatttccattgcccgacgcccattcgccgccgatgccaaacaacattcgttttaaggaccttcgaattaattgcattgaccattccgtgatcgcatttcttcgtgccaatcaactcattttccagaagggctccaatttgcgtctgtcgcttccttttggtccattcaacattgatgatgtccagtcaatttgggatgattttgcgcgtcaaatttggcccatttttgcaccaaccattcgacactttggcgttcccgatggccatcttttggacactttgcttcgtctcgtttcgccgacaattctcacggatgatctgatcaacatccattcaatcaattccggtcgtcagtttctcgaagcgattggtgatgatcattttga

SEQ ID NO: 86232 - DNA, 574 bp, Heterodera glycines
  SCN-specific regions: Sequence locations=1-574
aaacttgatgtctgctggaattccggcgggcgattcggacatcgaattagttggcattgacgaattttatgcgagtgccacgggagagaaaaatgggacggaagtggcgaagacggacgaacatcagttgcacgtggcaaggctaaagcacgaactaaacgagcggagaagtatgttggcgaatttgcaagaattggaagggcggaagagtgcccttctcagtgacattcgcggcaaagagcagcgactgagtcaaatcgggtcgaaaataagtgcaattaaaaaggccacaattccgctgttcgatgtgctcggactaaaagcacagccctccgaaattggagacaaagcgaaacagtcgtcctgccctttctccgtccaattgcgccctctgtacacaaatgaagaattttgcagagaaatattcggcacacattccatcgaattggggtgtgacgcattggtcctagtgacggaagagagcgccgggccatcgaatggcacaaaagaaaatgccgaaatggacgaaacgagcgacgggaaagagaaagaaccaatggcaagtgcaaattcg

SEQ ID NO: 86233 - DNA, 645 bp, Heterodera glycines
  SCN-specific regions: Sequence locations=1-357,381-645
ggcacaagcgattgcaaacgcaggacgtggccgaaggaggacggattggcattagaaaggggccatttgcctcaaggcaacaaccagagtccgacgcgactccagtcgacgcccaggatttggattcaagaagatgaccggtggcgccaaccgatgactttctcccgaaaagacgtgcgggaaagaagttggctcgagtcggacaccgactcggacttggacagcccaacttcggtgttgcgctcgcggcgaaggagtcgagtgaacattttggacgacgaccaaccgacaagaagaacggcctggggaaggtcgccgacgccatcgccaaatggacgtgctgttgtacaacgaacaacgaccacaacgacgacgacaactgaggaggaggaaggggggcgaagaacggtcagatttggcgaagtggtggtcgttgagccggaagagagaacagtgaacagacggacggaagtacggacacaacagcgggagaccgaagtggagaggacgtcggaatataccctaattctgcgaattgatttcatcgatgcctccgtttttttggacaaatcgttggcttactttggaagtctgaacactgccaggaaagacgaaaggagtgtgcagcgattgtgctacgtactg

SEQ ID NO: 86234 - DNA, 673 bp, Heterodera glycines
  SCN-specific regions: Sequence locations=1-615,644-673
cgatgtccggcacaacaaaatgacgacgatgccgccgccattgtgcaaccgaagcgtaaaggcatcaaaaggccctacgacgaatttatgggtgacgaatcggctgtcggaatggtcaagtcgccatcatttactgaacaaatgcagcacacggcgccccccaatctgaacgatttctgcatggaacactacggctttgacgagcagtacattcgcgctcagccggacagagtctacgacattttattccattcgtccggtcgcgttgagttgcaactgtcgcgcaatttgagtgccaccattttgtccattccatgcccgcccgaggaggagcacaactggggcatggtccgccagtaccgtatgaccacccagaaccgggagggcgacacactgtactttcgctgttcgcgctgcgagtcgctgatgcgttacacaaatgatgaatatcggccaaagttgacgatgaaggacggtgatatccaaggcgattgcttcccggctcatcacccgcaatgctacccggtgaacaaggaatgggtgattctgcaacagttggaccgccaggcacgcctttacatgatgcagtttgacatggcacaatgggaggccatgcgccagcaacaacagcagcagccggcggaggacaacgacggcaccgcagcggcggaat

SEQ ID NO: 86235 - DNA, 384 bp, Heterodera glycines
  SCN-specific regions: Sequence locations=1-2,25-384
caagaaaagaaaaaggaaattcttgccagtttgttccgaccgcaacacggaacattttcctgatcagacacggacaatacgaattggattcaaagacgaaggagcttaccgctctcggacgtgaacaggccgacctcttgggaaagcgattggcggagttcgaagttggcaagggaaagaaaataacaaatgttttgtgtccacaatgaaaagagccgaagaaacagccgatattgccttgaagcatttgccacacgccgcacaaatccaaaaacattcggatttgctgagggaaggggcgccttgcgaaccggaaccgcctttaagttcatggagaccgcagtattacgagttccacgaggacggtgctcggattgaggctgc

SEQ ID NO: 86236 - DNA, 670 bp, Heterodera glycines
  SCN-specific regions: Sequence locations=1-395,426-531,553-591,613-670
acaaattggtggcgcgggtcgacggaacgcggcggcggagcgagcggactttttccggcgagttttgtgaccgaaaacttcgacaacggacaaatttcgaacggaacggaacgaaacggcgagagaacggaggcagtggaaacggcggttgtcccaaaagtgcaaatcgatgaaactgtgctgatgaaatgcatcgaactgctcgagaagtgtgaccccgaggccgacccgtcgtccgaccctgccgaattgccttttctcgagcaaatggcgaaggctcaagcaccactcatcgatcagaaactcgtcaaaattgacaaacagctcagcatgttggccgaggtggacatcgcaattcgcgaggtgctcaccgcgtatgacacggccgtgcagcgggtgcccatgccaatgcctttctctcctcccgcgggctcactcgcctcgtccgcccctccgcccgtctccttcgcctccaccgcttcagttccgtctgttaatacgccttctttcccaacccaatggactatgaatggacagtggcaacagcagcagaaccaaaaccaatgaaattgttggagtggttcggatggaggagagagagtcattctgtggtccatataaatccattataaaaatgaccgatttaaaaactaattttactgcttaagag

SEQ ID NO: 86237 - DNA, 653 bp, Heterodera glycines
  SCN-specific regions: Sequence locations=1-265,287-653
agcgttggttgtcctccgcccgtccgtccgagtgatgagaatgtttttttgttctacccaaacctgctcggttatgtgcgtattttgctcgcttttggcgctctttttgcgatgtcttacgaggaaaagccatggagcgccgcactgctatacttcgctagtgcacttttagatgcttttgacggatatttggcccggaaatttaaccaaagttctcgctttggtgctatgttggaccaactcactgatcgcctcacttttcttggtgttctgatgaccctttgccattactacccaacaaaaatgctcttctttcaatttgttgcttttttagacatcgccgcacattggatgcatctccacgccactgatctaaccggaaaagagacgcacaaagggtcgaagaatcccattttgaacgtttattatacatcgaagacatgtttgttttggaggtgctttggcaacgagttattctacggattgctatttgtcaaccatttttgggctggccctgggcttttaggaattcattttgtgcctctgttggcctgcgttgtctgcccgctcgcccttgctaagtcagcgatcaatgtgcttcatttagtgacggctagtcaaactgtggctgaacacgatcgagaaaaacgcgg

SEQ ID NO: 86238 - DNA, 683 bp, Heterodera glycines
  SCN-specific regions: Sequence locations=1-557,592-683
cggatatatgtgccatgttgtgaaagacgagaactcagaaaaaggagaacgttatgagctaaaacagattgaattaatactggccaacttggcggtgtccatctcgcgcgtcttctcacccaactgcaccgtcggacaatgcaaaaagcgggccttgaagcatccaaagatcagcttctgaacaatgggtcggactttgtcatcgccgaagcgttattcatggcctggactgcgtttggcgacccgaaagcggtcttcctgttcgtggccagcaaaacgagtcgcaatcggtttggccaacgacaaattgagtaccttctcgagaaaatatcaaattacaaaatgaaaatcatccgtatttcgctgccagcttgtgccagacaaatgaagttgggacaattaacattggatccccaggacaacacattgcgttttgtatgggcaaaaagttgccgtcacttatatcgcaacggaggcgccaaaaccgagcgacgatgaatggaaagtccgacttttgttcgaacgttcgacggccattaaaagtccaacaattgggcaggatttggcaaatcagaaaaaagtgcagcagcttctgactaagccgggtatgttggaacgctttttgccggaacctgaacatgccgcaaaggtggaagcgcttcggcgatcctttgccggactgt

SEQ ID NO: 86239 - DNA, 568 bp, Heterodera glycines
  misc_feature (539)..(539): n is a, c, g, or t
  misc_feature (545)..(545): n is a, c, g, or t
  misc_feature (547)..(548): n is a, c, g, or t
  misc_feature (550)..(550): n is a, c, g, or t
  SCN-specific regions: Sequence locations=1-6,56-91,114-543
tacgagaaaaaaatataaaaaacaaatctaataaatatttaaaaaaaattaaattcattccaaaattgagttaattgggtatcaatgaatttctgctcttcctttgcctttctcgtcgttttaatgttgctgatcggtgaagcatcgagcggttgctgcatatcaaagtcaagaatccgagcggagaatgagagacgaaccaaatcagatggtacgatgagatatggacaagcgcttaattacggagttattaaagtaccgcaaaaaaattggaccaatggactccgacgagagctggaggagtgtttgggcttggagttcatccgggccttagaataaacaccaattaattgtcaacagaattccattttttgatgttcatttcgtaaaagggacttcagaatgtgattccttctcggcaaaaaacgccaaagcgaatataatacattttctaagaatatttttgtgatttccgaacaatgcatactgtaaaattatttttatatgtaatattgtaatgtatgtaatattaaacggtnaaccanannanaaaaaaaaaaaaaaaaaa

SEQ ID NO: 86240 - DNA, 229 bp, Heterodera glycines
  misc_feature (156)..(156): n is a, c, g, or t
  SCN-specific regions: Sequence locations=1-206
atcacattgttcgtcaatgagcaccagcaacaaattgcgtcttaaaaacagcagcagcgcaacgccctcctccgcctcactgctgcacatcaatgacgcacggattgcgggactgtacgatctggagcacaccattggcaagggacactttgcggnggtcaaattggctcggcacgtgttcaccggggattttgccatgatccctcaaaaaaaaaaaaaaaaaaaaaaa

SEQ ID NO: 86241 - DNA, 601 bp, Heterodera glycines
  misc_feature (584)..(584): n is a, c, g, or t
  SCN-specific regions: Sequence locations=1-385,419-499,521-601
cagaaatggaggcacagcagtacatggacatgggactgtacatcggactaacgggatttctgtggaaggaccgtgccgtggacggcgtaaaacgcgcgttgcggcaacggaccattcgaatggatcgccttttgttggaaacggacgcgccgtacatgtacccgaatttggaggacaaaaaattgcgcaaagacattgacattcggcaacggatcagcaccgaagcccttgccctgcacaaacactccgacttcaagcgcaacgagcccagctcgttggccgccatttgtgagctggtcgctgccttcatggactgtccggcgcacgaattggccaatgcgacgacggcaaatgcgcagagagtgttcggcttggagttggaggacaaccaccaccagcagcaacaacaaggacaacagcagtgtaacgacaacgaaaacgaaaatgacgagagttcaatggtgaactgatcggagcagaaaggatgaacgagtaatgaatgatggatgattaattatttgaaaaaattgttcaaaaattttaaaggattttgatattgctctattccaaaaaaattttatatntgcttttcgattttttg

SEQ ID NO: 86242 - DNA, 639 bp, Heterodera glycines
  SCN-specific regions: Sequence locations=1-298,320-639
taattcctgcgtattattgcggctgctgttctctgtccgtgccatcatcaaatcaaatcaacgaaagctgagccatcggaagtgtgcacaaatcgactaccaaacgaaactgggcaccacaaatcaacaaaatcatcattatcatcagcagtaaaagtggtgcagaaggaaacgcatggaccaaatcggcggcactttcagcgaccaaatttggctcgacacattggcgtggattggacgtggcgaggtcggatggcacttggcgctggtcaacgcccgcttcgccgccctggtgaacatgcagctgcagcagaggcggtggtgtttggaggagtttcacatcagtgagcggaagccgaaacggactggcgccgaagtgttgagcttggcaaacaacggctcctacttctcgttgccattggccacctcaccgttgccggacagtgtcatcggattcaacggcacattcaacatttggtatttggacgcagaagtgatcaattttctgcaacgatttcggcgcctcttcaacacgtacatctcgctgaagttcaccattccgataacagaatttcgcgcttggcaagccgtggcacctcacatttggcccttgctgaagcacgggctcggcacgttggc

SEQ ID NO: 86243 - DNA, 695 bp, Heterodera glycines
  SCN-specific regions: Sequence locations=1-291,315-355,377-645,667-695
ggaaactgaggcacaattggaaaatggaatgcgcgagaataaaatgcattggccgagaaagtgtcggaaactgaggccaaattggaaaatggaatgcgcgagaatcaaaatgcattggccaagaaagtgtcggaaactgaggccaaattggaaaacggaatgcgcgagaatcaaaatgcattggccgagaaagtgtcggaaactgaggccaaattggaaaatggaatgcgcgagaatcaaaatgcattggccaagaaagtgtcggaaactgaggccaaattggaaaatggaattcaaaacaaccaaaaggcgttgtctctgatgaagaatatggcaacattagcgttctttcacttcccccttccaatttatcatcgatggaatgcctcggattgtgacccagaaattgtgatcaatgaaagcacaaatgccattcagcacaacggaacagaagatattgactggcgttcttgccgagcatggccaattcaaatgtcatctgctgttggtcgcattggcattatttatgcggaatatcggattcttgctataattggaggattgcgcattggactatcaacaaaagaaatgccattggaccgttgggttggaaatggccatgtttcgtacggttacgcatattatggagagattgaaagcacaaataccaatgggaatcgagcagtcatttcgga

SEQ ID NO: 86244 - DNA, 794 bp, Heterodera glycines
  misc_feature (698)..(698): n is a, c, g, or t
  misc_feature (732)..(732): n is a, c, g, or t
  misc_feature (738)..(738): n is a, c, g, or t
  SCN-specific regions: Sequence locations=1-261,283-662,688-794
ggagttggagcggacccaaaatcacgcattgaaaaagacacgttcgacttggcaatcattgcaatggcacaacactatcatcagcaaagtcaaacattgcatgtgaacaatttggtgctgcccgtgtaccaatttcgctgttcggacagaaaggacgaggaatttggcaaagagtttatcagtcggcttcagtacctcagctcattccaattgacttccactgaaaccgcccttttgtccgcctttgtgcttatggaccaatcccaggcgcccggcatggaagcgtttgtgggacagttgaagagctgtttggggggtcagttgcaccagcggatgccggacggggacgaggcattgcgccaactgctcgagttccttccgcgcctgcgggaattggcaaaaacgcatcgcaaatgtttgggacgcttccgattacaaatggtggaccagcaaagcgaacaccaaacggacagaggcgccgcggaggccaatgtgctcgccagcttcccgcccctttacacggaactctttgccggaaatagcgactgacagcgaatgggggaaaaagacggagttggcttcggcgaagggggaatcactacggcgaatgcgcgaacttttaaatgccgtcactttagcgggaaattttcattttgtgcgggaagaaaccttttatttgtttattttctccgaccttnccaggccatcaaacattccaaagcccacaatctntcactntctttttgtctcagatgcaataacccattaattaataactcattcatcattctccg

SEQ ID NO: 86245 - DNA, 494 bp, Heterodera glycines
  SCN-specific regions: Sequence locations=1-412,493-494
catcctttctttaggcttgacgaggcgtttaccgactcttctggctccttccaatgagagggtcgacacgcgaactgacaaacattgaccccgtgctgaagatttatcacgactgtgacgatgggataatgccaggacaacgcaaagtgaaactgcgcatccccagccaatacatcacaaacggagggttggccagacgaacttttgaagtcggagtactcaatttggagacagtctttgctggggaggaaagggacttcatttgaacatggaggggaagaagaactggcgaaatgaaagctgatttattatcacatacagtataaccagccattccatttggtattctttgtataccacattcgtattcagcaaaagaatgtagaaacaataataaactatacaatttgtcaaaaaaaaaaaaaaaaaaaaaaaaaaaaaaaaaaaaaaaaaaaaaaaaccccaaaaaaaaaaaaaaaaaaaaaaaaaaaagg

SEQ ID NO: 86246 - DNA, 712 bp, Heterodera glycines
  SCN-specific regions: Sequence locations=1-139,167-712
gtgattcgttttttgattctctttttgctcttcccccttcttccgcctcgcaaaatggaccaatccgtccacgaatggcactgtctctgccgccacgtcttcgtcggcacgcattctctgcttcgaccatatccgtttttgggttggcaatgccaaacaggcggcccattggtattgcgtcaacttcggcttcatccctttcgcctacaggggcctcgagacgggaagtagaaaaacggtggcatatgcagtgaaacaggacaaaatcgtttttgtgttcgagtcggcactgctgcctaacaacggggaaatgagcgcacatttggccaaacatggcgatggtgtcaaggatgttgcgttcgaagtggacaatttggactgggttttggacactgcgcgtcgtgcgggcgccgttgtggcggaagaaacggccgaggagagagaccaaaacggacacatccgaagggcatccatccgaacgtacggagacaccattcattcactgattgaacggcatcactactcgggcccctttctgcccggcttttgcctcgtcgccgcttcgtccgtgccgcgctttttgctcggccaattgccttctgtcgggcttaacttcattgaccattgcgttggaaatcagcccgaactgcaaatggagtctgtggcccagtggtacgagcgtgtgctgcttttccaccgcttttggtccgtc

SEQ ID NO: 86247 - DNA, 646 bp, Heterodera glycines
  SCN-specific regions: Sequence locations=1-33,55-334,356-646
ccgcaaggcgcatggcctgcgggaagaaagcgcgaattccctgccaaaattttccgacccacgccaattgtgccgacatcgaaataccgacacagtgtggcggacggaatgctgacaagagatttgagggacagtcaagtgtggaaaacggtggtgacggtggacggaattagtggcggacaagcggaacggcgggggcagcggagcaccgcgaaagacgaaaaacggcacggggacacagaggcggttgcactgcgccgccacttttacgccgaaaagccaacaaacgaacaatggcagcagaacggacgagtggcattggacgaggacgggcacaacgccaaccaacaaaagttggaccgagcgccgaatggtggacaaattcgacaattggtgtttagcgtgggacgaactcagttttcaatgggcggtgggcaaagtgccggcccattggtgcagtgccatgcccggggcgaaagtcaggacagtttgggcagcaacagcacggccaacatgcaccgctgcatttcgccaatgttcgccccgacggactacggccgactgatcgaatgcacgacgccattcagtgcccaaggggacaaccaactgagtttggcgatcggggagagagtgttgctggtgaaga

SEQ ID NO: 86248 - DNA, 644 bp, Heterodera glycines
  SCN-specific regions: Sequence locations=1-253,275-348,371-644
ggacaagaaatggttgcctgtgacgattgcgaccgttggtaccattggggatgcgttggtattctgattccgccgcccgaaaaagcgcaatggtactgtacggaatgtcgtcgcgagcgcaaaaaggcggcgcaacgacagcaaacgtcgacgggcgggggaagcgggtcgaacagtcgcaagtcgtcgttcatcggcggaacaccgacaggcggcacagcgccagcgaaaaagcagcgaattgccaaggcgtaaattggggacaaatgcaaaacgtatagacaaattggcctttacaataaagaaatcggttatcatcgaagtgcttttcacgacaaatttgactgtgatacatttcctttctcccctttgtcacgtccgtttcgcctgtcactaaatttttttctgattcggcgtacctttttttctttcttttgacccttgccccgtccattttctcttttcttctctaagacaggctttaccataaaataatattatgctcttcattacattttttttgcgtgtctttgtgtgtattgagaaatgaggccaaaaccttccatttacggcttattatcggttaattgtttatcggatctgaaatttaaacagaatgtctttgacacaataaataaacgatt

SEQ ID NO: 86249 - DNA, 468 bp, Heterodera glycines
  misc_feature (37)..(37): n is a, c, g, or t
  SCN-specific regions: Sequence locations=1-165,193-468
atgaattcgtcgaaataatgaaaatgctcaaacggangcattcttttacaattaacaaagaaagagcggctgaaaaagctgaaggcggaaatgttgagacaaacaaaaacggagttttgttttcgatgactttggccagcgagtctaatttctgcacttcgacgccaatcaaaaaacaacaaaaagtcagcaattcgcccaaaagtcccatcgaaattacgaatgaatttgaaagttgcttctgtaaatggttgcgatattttaccaattttgaggacaaattgggacgtgaaattagcgcctttgagaacgatcaaacgaagaaagaatttcgcatcgaactttcgcgcacaattgcaaatcgaataaacgacggcgccaagaagaatgtgtccagtcatgagatgggttggctcttcaacttcttcgacgatctcctcgcctgccgccccgtcgacagttggcgag

SEQ ID NO: 86250 - DNA, 650 bp, Heterodera glycines
  misc_feature (517)..(517): n is a, c, g, or t
  SCN-specific regions: Sequence locations=1-605,628-650
caactcgaaaaccatagctgctcgaattccggcggatttctgccttcctttacaaaggaaacaaccgctggaaacaatcggttgaactttgcaaaaaggacaagctgtacaacgacgccatggaatacgccgccgagagtcgtcagccggagattgttgaagatctgatgcagtacttcctatcacaaggcttgaaggattgcttctccactctgctgtacaaatgctatgaatttctgcggcccgacgttgtgcttgagctcgcctggcggaacaatcttgttgattacgccatgccgttcatgatacagaccgtacgcgactatggttctcggcttgatcgtctggaaagggctgaggtggaacgcaaggaggaggtcaaagagcagcaacagcgaagcggaagtctgattgaaccccaactgatgctgaccgcgtactccaccgccgcgacgactccaaatgcgacggcgtatcccacgggaggcattggcacgattccgccggcacaaggctntccgtcatatcccttctacaaataatgttgtttcgttgtgatggtgtgacttatgatatgaccatctttgatggattcatttcttacttttaatatgtaatatttttcgacgtaaatgtgttccgcgctgttg

SEQ ID NO: 86251 - DNA, 600 bp, Heterodera glycines
  SCN-specific regions: Sequence locations=1-208,237-442,503-600
ggtttttattaacacatctaaaagccgattttttcgtccattttcgcataaatgccgcccgatactgaccaaggcaatgcacgccgtcagcgccgacgttcatcaagaggacttaatgactctctgtccacgcattgcaatttgtatgagctgttggccctgccaaaaacggccactgacgaagacatcaaaagggcgtatcggcgcatggcactgaaataccatccggacaaaaatcggaatgatcccgaggcgtccaaaaagttccaagacatcaattacaccaatgccgtcctttccaatccgacgaagcgacaaatttacgaccgatacggcgagatgggtctgaagatgatgcagcaattcggcgaggaaaacatgtcattggcactccgtccttggctgaagtggctcatctgtatcatcgccgtgctgacttgtggctgtttttgctgctgctgttgttgcttcggctgcttcaagtgttgctgcaacttttgcttcggcgcctgcaaaccggaggacgcgtccaacgccgactttagcccctttgatgcatttgatgacgtggaaagtcagccagttcgcgctcaaccggca

SEQ ID NO: 86252 - DNA, 697 bp, Heterodera glycines
  SCN-specific regions: Sequence locations=1-236,258-635,673-697
cgaactgaagaaattcccgtcacttacggatgcgtttaagaagaagaggggcaacatactcaatttcgaggaagaggaatttgacgagatcatcagcaatggcaccagcaagcgcgacaacagtccgtacaccgaccacgactacgcaggcacgcgccaattggcgacggcgaagggagcgaccggcaaacaccaacggcagaagggcggcggagggacggcgaaagagccgaaaaagaaaacggcacttgtcaatgggaccgattcggtggtccgttcatcggcacggccgcaccgtccgaccaaacgttttgtagaggaaacaaacgaatcattcattcgtgggacttcgaaagtgcgccgaacatcgccacgcaaacatggcaagaaatcgactgcggagggaggaagcgaaggggaagaatcggaggatgacgggaaggagtacagcgtggaaaaagtgttcaagaagcgtgtgaagggtggaaaaatggaatactttgtcaaatgggctgggtatgacgacggttggaacacttgggaaccgcgtgagagcttgaaacatttggaagtgttcaagcagtacgagaaggcgcaacaaaatgcggcggagaaaaacaaattggaagccgaagagacggaggaggacgaagaagaggaagacgaggacaacgaatacaaagtggagaaagtgttg

SEQ ID NO: 86253 - DNA, 611 bp, Heterodera glycines
  SCN-specific regions: Sequence locations=1-279,302-611
gccccgaatttcccctgatgacgtgccatgcgtcggatggtcaagcaattaccaaatggctgttcttgcctcgtcctgacaatttgatgaaggagctgacaatatgcattgaggattcagcggtggagcagcaatggttggcagccgtggaacaaatcaaagcggcattttccaatgcttcttctcctgtttacttcgacattactgtttactttccgccgccgtcttcgctttctgccgttgtgccatttaaactgaccaacgaaatgactggagagaaattggaaatgtacaaagaagatgtagaagaagatttaagttgtttttccctcattcgttgtccaattgcgcccgatgataagagagagcggatgaagatgattaaggaattggacaaacgatggaatcgaattaacatttttctcatcggcgatggtcttctcgacggtttcccgggggcgagtggcgatcagaaagagcagaagaaatgaatcgatggttgattgattgatgtgattatgattacctatgcgatctaaatgttgggcttagccatttaaatgttgttgtatttgatttttttacaaatccataaaaacgaattaggcttc

SEQ ID NO: 86254 - DNA, 672 bp, Heterodera glycines
  SCN-specific regions: Sequence locations=1-333,355-672
ttcttattattgttagaaattaatgttcccatgagagaatcggacgagggtggcctctgtctgggcaaaggtcagtgctttttcgttatgccaatgtgcccttcttctgagtttgtgcctttggcctgacttcgacgcttcgcggtttctgcctttcccccgctgatcagcagacgaatcttttctcattttgcagtgaaatggcgacgaacgcctcacagaaaaggaaggagatctatcggtacaaagcgtcgttcaatgtttatgcgatgggatggtcaaccaaattggacaatcacctcaaatttcgcttggccatcggcagtttcatcgaggaatacaacaacaaagtgtccattgtgcagctgcacgaggaccaaggcgaatttggccatctcggcactttcgaccatccttacccctcgacaaaggtgctgtggatccccgatccaaagtcggcttttcctgatttattagcgaccaccggcgattatttgcgcatttggcgaatcggcggtcacaacggcgcttcgttggaagttcggctggacaataaccgttcgtctgagtattgcgcgcctctcacttcggccgattggaacgaagtggacgtgtcactgattggaacgtcgagcattgacacgacgtgcaccatttggcagatagagacag

SEQ ID NO: 86255 - DNA, 714 bp, Heterodera glycines
  SCN-specific regions: Sequence locations=1-714
cattctgccgattacaagcaaatgttcgtgccctgttgtacagctttgcgttttattatcgttgagcagcctcggcccgtcgatgattttcttcgtccggttattggcaaatttttggccacagttagagactcggatatgactgtgcgccgtgtggcaatcgttacgctgaattcggtggcacataacaaaccaaaattgatcaaagaatgtctcccaaatttgctaccggccctttatgaagagactaaggtcaagcaggaacttgtgcgggaagttgagatgggaccgtttaaacacattgtcgacgacggactcgacctgcgaaaggcggcctttgaatgtatgtacacattggcagaccaatcgttggatcgtgtgaatatcaacgaatacctgacttatgttgaaaacggacttaaggaccaacacgacataaaactgctcacttatctgatgttggtccgattggttcacaaatgcccaattcaaatggcacaacgtctcgatgctttttgtgaacacataaaaccccaattgcttttgcgcccaaagcaaaacgccgtaaaacgggaaaatgacaagcaggacgaactgaaacggtccgccgtgcgctcagtgatcgctttgcgcaaagtgccgaacagtgacagatcgcagaaaatgaccgacatttggggatgtgatcaatggcaatcctgacctaacacagat

SEQ ID NO: 86256 - DNA, 713 bp, Heterodera glycines
  SCN-specific regions: Sequence locations=1-439,461-467,490-633,655-713
caaaagtgtctgacaacctttgccgataatggaagcaggagacgttgacataattcgacaacaacatatccgctattatgctgacattgatggcaggaaatatccaactgaaggacccgattatgatgttcttctttatgggacggatcttttagtcgacggaaagttatataaaaatgcagtccccactggttatatcaattatatcaatcgaattgaggaacgaattcccgttctcggctcatcaggccgaagcattcaactgaatgcggcgggagatgatcaaggaaataatgcacgtttacatacgaatgttgttggtcaccaaatttcagggagtgtctccttgccagaaattccgattgggggaaactctgattatataaacactggacataacaagcatgatggaaaacccacttttggagacaccaaacgggaagaaaaacagaagaataaacagaaacagcaaaagagaggagagctaatcggtggaaattttacacatataaacaatcaaaacaatgaaaacattggtggtactcaagacatcggacgcatacaaattggaggaatgccaccaggaggagctcttcatttaaatactggtggaaatcgcaacgttggtggtactcagatgattggaggcataaaaataggaaagatgccgacaggagggacatttggtttaaatattggaggcaatcgaaacg

SEQ ID NO: 86257 - DNA, 561 bp, Heterodera glycines
  misc_feature (544)..(544): n is a, c, g, or t
  SCN-specific regions: Sequence locations=1-398,420-561
cagaaccgcatgcctggtatgggcggaggccatcagcagcaaggaatgcgttaccagggacagccgagaggaatgcaacaacaacagcaggctcaacagccacaaattgcctattcgtcgtatccgcagcagcagagccgtggcggcatagcaccgcagatgggtggcggagcgagtggcggtggagccaacgctggccatgtgatcacttcttcaacacaccaggagccgtgaacacacagtgcttaccgaggctacataaccgacaaaacaatgctggagcgtctgtccgatggtgcgcgtgcttcgggatgggatgcaaaaatcgcaatcacggaatgcttctcaatggaaaatgccaattggtgtgtggaacagaaatgtgcgtgccgtggacaacacacaggctttaccagccacggtaaagagcgcatagataaatgaagggatggattggatgaataaattgatgagtaaaaggaaaatcaaaaaaattgatatgttatttggcttctttgtctgagtaaatgcttatctgctaaanaaaaaaaaaaaaaaaaa

SEQ ID NO: 86258 - DNA, 375 bp, Heterodera glycines
  SCN-specific regions: Sequence locations=1-286,325-375
tttttaacttttccaatgctattttaaggattatagtaggattcgtctttatatgaggtttttagactatcttaataaatttatatcaatatatggaagaagattatgagcaactagattatgacgaagatcaattgaaaaatgcgcttagaaaagcacagcaattaaaaaatatttttccaaaagatcaagaacgcaagaagcctttaattcagaatgcattcatcgctaagaaagaggttcgcaatatttcgtccaaatgttacctaaaccctaaatttgcaaaacaaaacatcatcaaaaatggtatattaaataaaacattgagttcaatattctcttcaaatttgttaaatgttaattcgtaattactaa

SEQ ID NO: 86259 - DNA, 472 bp, Heterodera glycines
  misc_feature (450)..(450): n is a, c, g, or t
  SCN-specific regions: Sequence locations=1-201,223-446
gaggaggcccgaaaatgatcgaacgtgctcttggccagtgatttcctactcggaagcgccaatggagtccaaaatgcaattggaacaggtgttcatgacgctgacggacgagaccaagacgcccaaagagaagatggagcggatcaaggacatccagcagaaatggacaccggaaatccgcgcggcgttgaagccatccactgacgacaaggaaattgccgaggcaatccgcttcttcaccgacttgccggctcagattgagcttggcaaaaagtgatcggagctgtggcgcaattgtgccgatctgatcaatggccggacatcgcacaatgtcccaaaaaattcatagaaaaacaaaaacagtaacgatcattcggattttcttttaaatgatcaatgtcaaacaaggattgttttttttgtggttaaataaattttcattttccaaanaaaaaaaaaaaaaaaaaaaaaa

SEQ ID NO: 86260 - DNA, 734 bp, Heterodera glycines
  SCN-specific regions: Sequence locations=1-734
tggaaaaatttgataccgaagaattgcatttttagaaaaaaaagatttttaattatgccatttttgactttgaatgccatgcgttcgttgtgccgtcttccaccatacttttttccaccggcatcatgcaaattcgttttgtgcaccatcacaaggaattggaggaacccggtgggtttgagcgtttcatgggctggcgacgctcgaaccccgcaaaagcgaaccgaaacacccacatcaacgaacgatacatgagaaggttgaggggcgccaaacggctgataattgacctggaagaggattatgccgagcgacgacaattggatcagatgcgaccggatgaagtccgaatgtacttattgtggaagggggagccgaacattttcaaggatgtggcgccaagggattggaatgagcaccagataactctgaacacattcggtcaagcaattgacccgtatattcctcccgaaacttcgctgttttcacgaggggccaaagacattttccccgatttgaaggcatttgctacccgcaaataccaagggatattctacgggttgaggaggattcggaagaaggacggatttcagaacttcaatttgaaggatttcacaaaacttgccgagcaaatctacgcaaatgcgtacaatgcgttggcactgcgagacaaaacgaagctgcacgaactgatcactgaggccgcgttctctaaaatgtggcccgatgttgag

SEQ ID NO: 86261 - DNA, 743 bp, Heterodera glycines
  misc_feature (627)..(627): n is a, c, g, or t
  SCN-specific regions: Sequence locations=1-743
cgtaaaaatggactgcagtcatgaaccgtcacttggcacggaatgcagcggcgaagaaagcgaagcagcaaaaacagcggatgaaactgaaggagaattgaagccgtcacaacgcgacgaagaagaggaaaatgggacaacggggaaaaggcagcaaaagagacgaaagcgacgaattcgactcacagatattggaccgaaggcaaagaaaaaggccgaacgaagggaaaaaccaatggcggagaagaagaatgaagtgcaagatgagaccaatccaaccgaaactcattgtcagtcatccaaaatgtcgcctcctttacttgaaatcgaaaatgaactcggacaaaacccaccaaataaagtgaagccttctcctcactttttcacgccatttcaattactttgtgacaatttgatacggaaattcatggccaaagatcccgagaaatattttgcgcagccagtgacagagttggaagcgcctggatatcattcaatcgttgattatccgatgtcattttcaacaatccatgacaaaatagataataatatgtacttgaatttggatcaattcaaatctgacatttgtctggtttctgacaacgcaatgctttacaataacacggngaagtgtttatttcttggcagcgcaaaaattgaaagttttggcaaaatattatttttccgagaagtatcttttgttcctcgtctattcgttgccctttggaaaagccttaactgag

SEQ ID NO: 86262 - DNA, 196 bp, Heterodera glycines
  SCN-specific regions: Sequence locations=1-147,169-196
cggcgtccactttgcctcactttcgtgtctgtcgaccattactcaatcgacctctgacgaattgggcaaaaagtcgaaaggctctcccacaattgaattgctccgtgccgagtcggactgtcttcctcccgaatggcttttgcccaactcttccgacatcattttgaagccgctgattccaatggccgagcacagc

SEQ ID NO: 86263 - DNA, 722 bp, Heterodera glycines
  SCN-specific regions: Sequence locations=1-567,589-722
ggaaatattgctgtcttacttttggaataaactaattattctccaaatgccgtgctctctcgctacacaatcttctgttctgaagcgcagagcacctgcgtctccccagcatgcaaaaatgcatgacaaaaagagacactttgacgaatcggcaaacaatggacaagcaaaagcggacaaagtgccatccaaaggggacaaagtgtcaccgacaaatgaggaaaagaagaaaaatgttgcctttgccacattggcaatccatgcgggaaatgaacccgagaaatgggacatgaatcatgtggttccaccaatttcactggcaacaacatataagcagcaatttgctggaatgcccaaaggtcatgattacgcacgaggcggcaatcccacccgtgatgtgctacaacaaagcattgccgcgctggaaaatgctcgtcactgtcgcgtgttcagctccggactttcagccacagcagcaatggcaaattggcttcattctggcgaccacattattgcgtcggatgatggctatggtggcactcaacgctattttcggcaaatctctgtccagcatcatggcatggaattgagctttgttgatttaacgaaattgtcaaacttggagaaggaatttaagccgaatacgaagatggtggtggttttgaaacaccctcaaatcctcttctgaaagtgatagacattgaagcagtgtgtcgtgcagt

SEQ ID NO: 86264 - DNA, 663 bp, Heterodera glycines
  misc_feature (14)..(14): n is a, c, g, or t
  SCN-specific regions: Sequence locations=1-103,125-515,539-663
cattcccttgtgtntatgccgtcattcacttctcctcattcatcctgccctaagtcactcgccaaagatttatttttgtttaagcgtacccggttgaaaatttttatttttgaggtttatttatgtatttgatgcctcaataagaggggggtatcaaaatttgtagtcaatttatgatcatttgttatgccaattgcttatttttcattgtcacattgcaatcttacagaatgagttgagcgaccgtagccgtgcctatctgcgccggtgtgagcgcgtgaaggcatttcttacggccaccgaagtggtcgaagttcggaatgcgcaagtaacggagccgggcgatgaccgatcggtgtgccattttttggagctgttgagcacccagcgaatgcacaaacaaaatgagcattttgtgttcggaaatcggatgttcgagaagaacagtgccgtggaattggccggtgacccgcgcatttgcaaggagggcatgcagaagaacgtgcgctttgtcggcgacagtcccctgcagagcaaagccatcattcagttagatgcaaagaaatcggccttcttcccggccattgatcttatcgaatttgtttgccgatttctcaattctcgccctgattacatccaaaatgatttctcacagcccgcgaa

SEQ ID NO: 86265 - DNA, 634 bp, Heterodera glycines
  SCN-specific regions: Sequence locations=1-515,537-613
ttgaaaaggaactttccgaattgcgtgggaacaattcgggcgctgttcgtgttcttgaggttgatgagtctaatttgcttcgctggagccttatgctttatccggaccgtgaaccatacaacaaaggtgcttttcgtgtgaatgttgattttccaactgagtacccattcaaaccgccatccgtgacattcgcaaccaaaatttaccatcctaacatcaacgataagggccaagtcgtgtctcggcatcattctcgcggagaattggaagccggcaacgcgtgcagagcaagtgatgaacgcgctgctgtcgctgattgccgagccggaaattgctcatccgttgcgctccgatcttgccgaggaattccaacgggacaagaagaagttcttcaaaaatgcagaatactacacgaaaaagtatgccgaacgtcgcgactgagtttgtttggacagatggagttatttgtgcatgaaagtcccgctggtatctacgaataatctctcgccactcaaattgtgcaatttataaattattgtgttttgtctgtcgttgattattttgacttttttgtatcgatttaaacttgaagaaaatatattaataaggattcaaaaaaaaaaaaaaaaaaaaa

SEQ ID NO: 86266 - DNA, 575 bp, Heterodera glycines
  misc_feature (553)..(553): n is a, c, g, or t
  misc_feature (561)..(561): n is a, c, g, or t
  SCN-specific regions: Sequence locations=1-548
cgcatcggaaatgctatggcaatggcagtgatgggcgaaagtaaaaggtggccgggaaggagtccatcgcaatggaagcattcgcacgggcacccgccaattgcccacatcatttgcgacaacgccggactggacagtgccgaaataatttcgcatgtgcgagccgaacacagcaaagggaatcgccaatttggcattgatgttgaaaatggtcgtatggcggatgtttacgagttgggcgtgttggagtcgtacaacgttaaattgggcgtgcttcgcagtggcgccgaagcggccgagcagcttcttcgtgtcgattgcatcatcaaatgcgcgccgcgccctcgcacgaaggaccgtcgtccgtgctgagaaaacgcagctagcgaatgcgaattattgaagacgcgcacaggaaaaggaatacttcattgcttgctttaccgtactttgttattgttttttgacatgttaaaaccttaaaaaccgagccatcactgcgtaattaaatctcgtcgatttttctttcataaatcgaatgcttttgcaaaanaaaaaaanaaaaaaaaaaaaaa

SEQ ID NO: 86267 - DNA, 451 bp, Heterodera glycines
  misc_feature (323)..(323): n is a, c, g, or t
  misc_feature (429)..(433): n is a, c, g, or t
  SCN-specific regions: Sequence locations=1-451
ttcccgaattttaaaaaagagccaaagaacaggtgaatggaataatagcccgagaaagcccaacaacggctctccgagaaaggataaaaaagctctacaaaaggaacgtcaagaagaaagaaagcaaaaagaaagagaaagagaaaaccgtttcctgcgaacgaaatcaacagcaggtaatacgactgacgcgactgacgtggaaaccgaaagcgaagtgattccgacatttgttgccgaactcgaagattctacggtggaatatccaacagacattgaatgtcatgttgcaacaaaaactgaccttggacggaaatgatcgnagcaggaagcactgcaagaatgaggaaaaaagaggcacggaaagaatgatttgtgatagattctttcttcagtgcattttcatctgttgcgtaaatgttgagagcnnnnnaaaaaaaaaaaaaaaaaa

SEQ ID NO: 86268 - DNA, 273 bp, Heterodera glycines
  SCN-specific regions: Sequence locations=1-90,112-273
agagaacgcctttcttccgtacagtatgcaaaaccaaggccaccgacacagctgaagcaaaacaagcgaccgtagcaacaatttgttactgagcggggacagcagggcgaattcggtgatggccgttgagaggaaagcgtcctttgaatccgttcgtcgtgaatcgcagcacgcaatttccgccctccgttcaactaccccccgccacttgagtcccttctcgtgttgctcgtgcttccgccggtctcggcaaaagcccactctgcggaagag

SEQ ID NO: 86269 - DNA, 607 bp, Heterodera glycines
  SCN-specific regions: Sequence locations=1-195,224-280,302-368,390-607
ccggaaggtatccaatacgcggaaggcgaaacggcaggaaaagtgcgatatgaggtgaccgttcggagaatgaactgcttgccggacccacctgaggtcgaagtcgaatttgacggagaagtgccaatggaagtgagcaaactgctgggaaatgccaaaaacaaagaagtgacggataaagtgaacagagcagggggaacgcagcagcagcagcagaacggaagccgaaagaaagtgccgatgagacagaaaagccgaaaggacggacaaccaaacgcaaaacagcagcagcaacagactgcttccatgggacaaagaaagcaacttcagtcattgcaacagcagcaacaagtcgaattgcaagaagtaacaggaggagagggagaacggcagccatttggtcgtaataacgaagtggccatacaaccaaacaatggacaaatgccacggaaaaataaccaccggccgcaaaaacaacaacaacaacaaaatgaagccgtgcaaggagatcaacaacaaatattcaatggggggagaagggcaacacgcgattaaattcatcgagcaaaaccaacacaatttgggcacacactttgcggagcagcag

SEQ ID NO: 86270 - DNA, 639 bp, Heterodera glycines
  SCN-specific regions: Sequence locations=1-607,629-639
aaaattattgtgcggagatagaggtggagtcgcggtcgcactccacccctgctgctggtggagatcgaacaatggcagaaattctgaaggccgtggagcggccgccaatggcgagcatgagtcgattgataaataattagaacagcagcatcaactgatggcgggtcgtgcagaggcgagtctttcgcgtttctctgttgtttatgtgaccgttccctccgctgaaattggcaaacgaattgctcatgaattggtccgcagtcggttggccgcttgtgtgaacattgtgccacagattacttcagtctacgaatggaagggaaaggtggaggaggacagcgagtcattgctgatcatcaaaaccggcagagaacggctggaacagctcagagaggcagtgatcaaactgcacccttacgaggtccccgaatttgtggcatttccaattgactacgggtcatagccgtacttgcggtggatttccgatcagatcagtgacaaagatggacaaacggaagacaaataagaggcgaagaacgaggcaaaaaaagaggaagagtaatgggagaattgtcatatgtaattttgaaattattcctttcttttcgttaaattattcttattttttcttaaacatgt

SEQ ID NO: 86271 - DNA, 717 bp, Heterodera glycines
  misc_feature (552)..(552): n is a, c, g, or t
  SCN-specific regions: Sequence locations=1-717
acaatgacgcgtccaattcgaactttttcgtctgctctgtgctatcattgaacagcagcaccaccacgacgacgaacaggagcaggacggactgagggacatccaaattggagcggaaaaaggcacttcggcttcagtgctcgttgccgagctgttcagccacccgcgatttcaacatgcgccactgcacatttttcaccgatttctccgtcaaattttgctttggtgcgaaattcgcgtgctgatggaacgggcaacgcgcgactgcgcccgccacgaattggccgttcaattcgcgcacaacacaatgttggggctgggcaaaaggcccgcctttgccatccaacagtcctccgtcgacaacaaaggttttccggatgaatatgccaaaggtgccgtcgttggcacatcagcagcgctctcaccaacaaaatcctcctccgtcgacatggacgttggcatgcccattggccactgtctgtggcgccgtcgtcgcattgacaagtccttccacctgttcccctgcgggcacacacttcacttggagtgtgntggaggagcagcacaaactgatgcagcaacatgacttgccagggatgccaacaacaacggcaatgacgacgacaacggcacttccggcggcaaaaggacgccagcgcccgcgggcgtttctgtccatgcgatgcccggcagcaaaactgtgccgcggctggcatg

SEQ ID NO: 86272 - DNA, 673 bp, Heterodera glycines
  SCN-specific regions: Sequence locations=1-201,239-265,288-673
cctctgaagatgccacatttatttgtggcggaccggctattgccagttcgttgggtgtgcgcaaggaccggaaccacgcatgggaacgcattcgagcgcaccaatcggcggttagctttgaccttttgttttggcgtttatctgaatgcgagaattggtaagctcgagttattcttgtatatcgcaaacgggagcagttcgcccctcccccggaaaattttttcaaacctaaaaatttattacaagaaaatttaaagagtgtccgtttttctctttcctttcattccttaaatttgtcccccttttgtatccatttcaatgcttttgctcattgtctcaacaggtgatcacggctgtgtttgcccccaaacctcagttggtcctcaaatggcttgcggaccaacagcaaaagttgggctccgcctcgcccccggggctttcttctctgttccatgtgcccggcgcttcttccgctgctgtctctgcccccgcccattgcccccccactcattcctccgccgttgccctttcccagcacaattcgtccgcaagttcggcctgtgcctcgctgatgatgctcttcccgagcatttctttgtcctccgcaacatcccatcaacccgttgctgaagctgctgcggcgaatggaactgcacggagcaagtagggaaac

SEQ ID NO: 86273 - DNA, 724 bp, Heterodera glycines
  SCN-specific regions: Sequence locations=1-724
gaagatgagacacgacacgcatttttggcaagaattttggcagaattgaagcacttacgaactttggatttgtccgaatggttactcaccgatttcactgtcctacagaaattggaaaaccttacgtcattaattctttacgacattcacaatttggaagggtctatcgacacgttgcgcaaattttgcaaactcacgggactcgatctgtcccaaagcgatcgttcctccagcggactgtacgctcagccggtgacagcacttcacaaattggtgtccagtttgccaaagttgaaatatttggacatttctggcacaaatcttacgactttgccttccgaaaatgatcgtccatttcgcggtgccggaacgattgacagtgacatcccgggactgagttatctgaagaaaccgctcaaatatttgggcattttcaactgtgaatcgagctcgcaatacaaaaacatcccggcggaaaagataagtggcgaccatggagaggaccaagtgctgacagcgatggaaatgtacttggaaagacccaaaacaatgcaagcggtgctcaacgaaagttaccatttgtaccgttttggcaccaatttgagtcgacaagttgaagcgcttcacctcgtgctaaagtcgatgtccttgcacctcaacaacagcaacctccaaattgccggcagtgcttcgatgttttacataattcgctctgtcaaaatga

SEQ ID NO: 86274 - DNA, 459 bp, Heterodera glycines
  SCN-specific regions: Sequence locations=1-459
tgggaaaaacgtgtctttgattagtgttccatcatctcggacggcaccacgccggatgaacagtagccctccaacccgacatcgccacatgccgggaactagagcaccctactcagtggcaacgccggctttctgatgccggtacatgaggatcgtccgctaatgatggttgggccgccacacataacctcatctctgttgacctccaaagatcttacatcggcgcaatataaacaaaacagacgcgaacatctgcgatgaacaagttggctcacgagaccaactgatcactagtccccgtagcaccacgacgaaggggacagcgtgcaccctctgtgcacacactggacaacaccatcgttgctcacattaacttacgctggcggaacttattctttctcaggaacaatgaatgaataagacggcgtttatcgccttccacgacgcttgctccgtctg

SEQ ID NO: 86275 - DNA, 598 bp, Heterodera glycines
  SCN-specific regions: Sequence locations=1-2,24-196,218-598
attttttaaataaaatttccttggaccgacaaaaatggcaaaattcgttgccattgctcttctctcgctgaccattgtttcgatggcacttgcaaaaactggcaaaagtcaaacggcagacgaagttgagggatttcgcaatatgaacatcggcgacaacaataaggttgacgccggaaaggagcccgcggctgataaagcaaccaaaaagggaaaagctcagaaagccggaacgaaatcggcggcggccactaatgagcccgcggctgctaaaggaactaaaaatggaaaagccccgaaaaccaaagcgaagcaagaggtggccactaatgagcccgcggctgctaatgaatggaacgaccaattgatgggcatgagcgttgagaaatttaacgaggagcttgctgtgttgttgccaaaagccaacacttttatggaaaatgctttgagcttcatcaatgaacaaatggaaaaaaatggtattgcaactggcgctgccggggactcgtgctcgaccgggatcccggccaactaggagaccaatgccacaggacggcaccggaggagggaagaaaggatgacgagctctttggatgag

SEQ ID NO: 86276 - DNA, 677 bp, Heterodera glycines
  SCN-specific regions: Sequence locations=1-677
taatctctttttacttaaattgttctgaatctgaattcagttctgctcggactataataaatgtcagacgaaggtcagcagttgttggagtccaccttgcgcaatgtgttggaccagcagtcgcttcgatggattttcgttggcggaaagggcggcgtcggaaagaccacgtgcagttgctctttggccgttcagttggccaaatatcgtcgcaatgtgctgatcatttccaccgatccggcccataacatttcggacgcgttcaaccaaaaattcacacggagtcccaccaaagtgaacggcttcgacaatttgttcgcgatggaagtcgacgggtccaatttcggggaccatggtgtgcccaatttgggtgacgaggacgacaagtctgatatcttttccatcggaaagaattttttggccgattttgctgccggacttcccggcgttgacgacgccaccagtttttctcaaatgattaaactgatccgttccatggacttcgaagttgttttgttcgacaccgcacccaccggtcacactctccggttgctccaatttccgacagttatcgagaagggtctgtctaaatttctgaaggcgaagacgcaatttatgccgatagtctctcagatggaccaatgtttgggtttgcccgactcgactttggactccac

SEQ ID NO: 86277 - DNA, 623 bp, Heterodera glycines
  SCN-specific regions: Sequence locations=1-387,409-455,478-554,576-623
tgacgaagtgccttggcaaaatgcgcgaaattcatgcacggattgatcgtgtccattcgaccaacttaaatggcacgccgttatttggatgcaattggtcgcggaacaacaaacgtttcggtggatgagctcgctattggcctgcaatgggtggatgaacacctccaaaaaaccgatgtgcaagtcaggcgagaagtgaaaccagaagaacgtggcacgaataactcgtcgaagaggacgcggttcatctattttgacgagcagatttccaagtacgctgatggagatgggttccgaaaggcacgggctgccattcggcaaaaatcgctgcttgagcgactcactgcgttaagcaaagaggagcgtgaccaacttatattagtcttgtccgaaaaataatttttctttaattcccgcatatataattttccgttccaattttgtacctttgtattagttattactgtttttaaaattttattgcgacttaagaattctaagacattcccttttggtgtaatcctcctaacatatcttgcctttgacttaagcccaatgagtttatattttttgtcccaatggctgctataaatatttctgattgtggtgaataaaagactttg

SEQ ID NO: 86278 - DNA, 653 bp, Heterodera glycines
  SCN-specific regions: Sequence locations=1-411,440-653
gcattctacatgatcatggcttcacggatgaagaacgggaaaaacaaaatagcagtgtacaacaatacagttttggctatggccactttactccatggaatgcaaaggctgaacatcccatttcacaatccacgaattgaaaatgaagcaatgatcgtaatggaggtggtaaatcatgggaaagaatctgagccattaagcgatgaattagcacatgccattaaaacattatgggcagataggaacattagagaaaaggaatcggttgatcggatcgcaaaacaggattatcgtccaactgagcaggacatactgttatcaacgatcaaaacgacgggtctcattgaggttgaattcaaaatgaaaacggctgatttccgcgtctttgacgtcggtggacaacgttctgaacggaagaaatggattcattgctttgaagatgtcaacgcaatcattttcatcacagccatcagcgaatgtgatcaagtgctttttgaggatgaaacaacgaacacaatggtcgagagtatgatattgttctgagtcaatttgcaactcaagatggttcacaaacacgtcaatgatcctttttttgaacaaaatggatctgttcattgaaaaaatcaaacgaatttccataagtgtttgcttca

SEQ ID NO: 86279 - DNA, 705 bp, Heterodera glycines
  misc_feature (697)..(697): n is a, c, g, or t
  SCN-specific regions: Sequence locations=1-108,132-250,273-480,502 -602,624-705
gatggtggggcctcggcagtgcacttttcgtcggtcctttcgctttgtccaaaaagaaaaatatgaaattggcgtttgttcgtttgaatgttcttacggtactttgtctgttctgctcaatgagtcattcctacggtaatccatccgacgaatccgatgacgaaatttgcgaggaagaagaaaatgaagcacaatcagaagcagaagaagcggacgaattttttcataattttaacggcacaattcaaagtgaaagagaggagaaaagaacggttgtcgaaatattttgccgaaatacaaatgacaaatttcaattttccaccgacgacgagggaaatttcaaaattcaaatggaagcgaaaatcaaatggaaatttcacaaatgcaccaccggactgagaatggcattttacaagaaaaaagtgatggaaaacaaagtgccaaaatgtttgcccattattttgcggagtccaaaacggaaattaaaaaatgcaaaaagattggatatttgtgttgtcccaattcgcatcaaatggcttaaatttggcccaaaaataaatgcagaagaagccgaaaccgaagaaaatgacgaaattttgagaaatgaatttgcattggattttgatgtggaaaagaacgcgcaaatgaacggacaaattagaaattgcagtgatttacattctgctgaacacaattntgaaatga

SEQ ID NO: 86280 - DNA, 659 bp, Heterodera glycines
  SCN-specific regions: Sequence locations=1-379,401-659
tacggaattggggaaattggcacgaatttttaaattagggagagggaagtgctcaaagaattgccattttatgccgatttatttgctgccgcaaacattggcacggacgagccgttgttggacgacaacgaggaatgcggggtgctgcagcaaaatgcggaattcgatgcttttgacgacgaccaaaactatgcgccacagcccaaaatgcggaaaacctctaattcaagcagtgcggctgttcatttgccggtcggcaacggttgtgccgtcggcggcggtggctttgtttggccggccaagtcgtcctttacgggtgccgcttttgttgccggtggtgcaaattgtggtcagtcagcggcgatgccaaatttacgagtgattagcaaatgggaggaaaattgtggcgaaacgaatgacgacggaatggacgaagtcgaaaaccaggcttcttcctcctccacccctttgctcgtcggcacaatttgtccaaccgaaggcaacagtttgagtttccaaaacgcttcgctgtccacggggacacgcgttttctcactcgattttggcaatgttgacaacatttccatttacccgggcatgaaaatggctgccaaatgcaccgtcgaagactgtcatgggcagcaactgtgccgtatgca

SEQ ID NO: 86281 - DNA, 527 bp, Heterodera glycines
  SCN-specific regions: Sequence locations=1-527
cattccctgcatttacgtgctgaacaaatcgaccaattagcgtcgaagagttggacattctttacactgtgccgcattgtgtgccaatctcggcacatcacaaatggaactttgacgatttgttggaaaagatttgggcctatttgaatctgatcagagtttatacaaagccaaagggccaattgccggattataacgcaccgatcattttaaacgcagaaaaaaaactttctcgacgatttatgtatgaaaattcacaaaagtctgtcaaaggacttcaaatgtgccctcgtctggggaagcagcgtaaaacacaatccgcaaagtgtgggcaaaacccatttgctgaacgacgaagacgttgtccaagtgatcaaaaagtgagggaaaggcaccaccgaacgcggcaaagagagaagcgccaaaagagtgccctcctaattgatcaattaattaatgtgtgtgttcgttccattgttttttttttgctttttgtacatttattttttacgaaaataaaaagcaac

SEQ ID NO: 86282 - DNA, 605 bp, Heterodera glycines
  SCN-specific regions: Sequence locations=1-31,53-605
tccgcccgttttatacctgcgattggaaattgcatcgccgcccacaccgacataatttgctactgtttcgtgatcattgtgcacgggtacactgccggactgctcactttgccacttcctgcgcttgtctttctttgggggacgttggccagcccgcgcccctccaaattgttttggattgtcatgataatttacaccgaattcgaaatcgtggccaaattcgcttttcaattcggattttggccttggaatggggacacagtcggcaataacaaagtgtacaagacggagtatgtgttcggagttcagcgcattcagggctttgccggcaaggacgtcgccctgctcatcgcactctttttccaccgttatatgttgaggaaatttggactttggagagacgcaagttccgacagattgattaacgaaatgcccaaaaaacggatggacaatgggtcatcttcatcatcatctgctgaaaaaagtccacagaaatcgactcaatcgacggttgttccatcgtcgagtggagaaaactttgaatcggtggccaaggcacaacgggaacagaactccgacgacatcgaaaagggcataaagcgaca

SEQ ID NO: 86283 - DNA, 588 bp, Heterodera glycines
  SCN-specific regions: Sequence locations=1-13,35-168,190-284,307 -466,489-504,533-588
aagactccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaacccct

SEQ ID NO: 86284 - DNA, 628 bp, Heterodera glycines
  SCN-specific regions: Sequence locations=1-628
tgatgtccgcttcgttagcccgtaattggtcgaacttagacgaacccgaccgatggattcgctgtccgtggcctcgttggcgacaatatcttcaaatggcaagtgatcatttttggtccgcccgaatcgccctacgaaggcggcacctttttggcacaactcgactttccgatcagttacccgcaacatccgccgaagatgcgctttatcactaacattttgcatccaaatgggatggctatgtgtgcatcagtattctccacccgccgggcgacggaccgcatggcgtcgagagggcggcagaacgttggcagccagtgcacacggtggagtccatcgtcatctcagtccaatccatgctgtcggagccgaactttttgagccctgcaaatctcgaggcgctcctgatgtttcgcatcaatccccagcggtacaatgagagggtaaaagaatgcgtgaaggagtcgaacgtggcgcttgacagtgattaccgcgacagtccaacaaatggaaggacgccgggcgcagtgaatggtttaagatcgatctaacaccctgaaaactcctctgttgtgatctttttcataagaaactcgtgtgtatattgtaaataatacgattcaccaaa

SEQ ID NO: 86285 - DNA, 690 bp, Heterodera glycines
  SCN-specific regions: Sequence locations=1-329,351-690
atcgtcgacaagttacctatagatcacttcaatattttaaacgtcgccacaaaccttatcgcccatgcatttgaactatcaaaaagtaaccgaggaaattttcagcaattggattgacgatttggtcaaaagggatgtccgattgccgttataccaaccgtacaaagaccgtcgcgaagccctttttcaattgaggataaacaatgatggcaaatggccaaccgatacaccaaaacagcacaaaatcccccgacagccgcccccgacatttgtgcagacatttggcgccgacattctcagctgtatggtcaacccgtggcatttgatccatttgcaactgcttggcccaagggattttgaaaaggtggcgattggactgtacgtgcgttgcaaggttaaggaactctgttctgtcgagcgcatcgaaagggtctcatgggatgcgagtccgccgtacgaaatctatggaaggcaaatgcaagtgctgctccatttctacgggcccagccaaacgccgccttcgcccatttcggccgttcagtttccaagcacagaaattgaccgtcaggtggtcgaacagcagcggaagtgccgcacttttgttcccccgtcgggcaatcacattaagcgcaagagtgaagagttgcaaaacgcgttgtacaaaatccattattaatttgaccgttggtt

SEQ ID NO: 86286 - DNA, 639 bp, Heterodera glycines
  SCN-specific regions: Sequence locations=1-46,68-639
cgttttgttcttaattcgttgcctgaaattaattcgcttctgccccgttttaaagggctttttgtttgaaatgttctcatcggagaaagccaaacgcggcgcatttgctaagaaaagtttgaacggaaatgaattggagtccgaggccaacgagggggacgcggaggacattgggaagagtttggaggagcagtcgcatcagttggcactgccacggcttttcaagacacttctctcttttgagtttgccaattactcccgtctgaacgaatccgaagtcgaccctttgctgctttcatgggatgttctgatgcgtttttttggagatttggacgtcctttcccgggttcgcttttgcgatgccatcgatgccaaaaccctttccaatgcgttggcccatttgtttaattctctctccgaccccccggggcataaagatgccatttgcgttgtttctaatgtcgacgaccttttcactggcccttttcattataaattggtggaccgtcctttcgatcgtgaacattttacgagtaatctcttcttccggactttggccacgatccccgctttgtttcgcgaatggcacggcactctcagcaaaacggaagcgaacacagtcaatgaatacacccaaaa

SEQ ID NO: 86287 - DNA, 672 bp, Heterodera glycines
  SCN-specific regions: Sequence locations=1-378,400-470,492-555,577-672
atgcaaccgcagcaaaggaacaaagcgagcaaatacgacgtgattggcaaaacgaatgagcagctcttccacctgctgaccatctgtttgagtctgcagccgcaacgcatcgacgagtccatccaatcgcaacttcaggacaaatacggggaaagaatgctgcgtatggccaacggcgacatcgacgagttccgaaacgccttccagcagggatgtcccaagttcttgtcccccaccactgttgtctacgaagggagcagtgtggccaaagagcctttgcttcgccaatgcaatgcgtttttggaaggcatcgaaagtcaaattagtctgccaattttgcgtggctatcttaaactctacacaactcttcccgtccaaaagttggccagtttcatggatattcccgactcggagttggactccttcatcggcaagctcctaacctacaaaatgattgtcaccgaattgggcaaggaaaccattgacaaaaccgaaggggccgatgagaccaccgatttggatttctacgttgataaggacatgattctgatcgctgacactaaagtggctcgtcgcgtcagcgaatatttcatcaaacaaatcggaaaacttcgtgagatttctcgaaaaatcaaatcatctgtcactcccgttggtcaaatacacaagaat

SEQ ID NO: 86288 - DNA, 616 bp, Heterodera glycines
  SCN-specific regions: Sequence locations=1-78,100-547,569-616
cggagaccaactttcttctgctggtgcgtcattattggcactgtgttgcccgtgtcatttttcgtgtggctcttctcgaaagcctttggtaaggatggttcagcttcgttgcagttgtttttaattggtgcggcaatcagcaccttcgtggtggtcatggttctatgctgtatttgtccagacaaagacggtcacagttcgctggaagtgctgtacaaatgttcggcgtgtggcaaaaatgtgcacagaacttatgagtgcattattgacgtcacttacaactggtccggcggacgacaccgcgacacctttcgctaccgtaatcaaacgtacagtgtgtggggaaagtacacggcaaatgtcataaaaacggtattgcggacgcggatgaccatgaacaactttgaggcggtggagcgcgtgatgagcgttgttcagacggacaattattacaagacaagcgatgaatggaccgacgatttgataaggcgtcttgaataattgaggcagaaagccaaatggcaacaacaatttttgtgtatttctcgtatatactgtatgtattatatttgtataagggagcaaaatactgtatggtttgaataaatggtatacg

SEQ ID NO: 86289 - DNA, 688 bp, Heterodera glycines
  misc_feature (35)..(35): n is a, c, g, or t
  SCN-specific regions: Sequence locations=1-442,464-688
gattttataaaatttattctcttccataaaatttntacttttccttcaaaaatgtcacttttttctccccttttctgttcttcatttttacttttgtcattctgcttttcaatttgtgcttttttgcctcaaataagcgaagttgaaaatgaaattgccgaatttattcaccgtaaccctttggccattgaccaccgtatcgcactcgtccaactcattttcgaacaccaaaccgaactgattttggccaatgaacaaatctcattcccaaagaacatctctttagacgatctggcatttccctatgaaatgcttgtcagcaaaataacaagtgaaaattttgaagagttggcacagaatttgcggaaaaatgcactcaaattggcaaaagaaagcactggcaaattccattttctcactgaaaatcacttttatggccaatttatcaattatttggcaaaaattgcccaacttaaagtggaagaagcactgaagcaacgacgggagaatgacaatttggacgaattatcggagaaggaaacgaatgacttttcggagggatggaaatcattacaaatgtttgtcgaaatgtattcatttggctcggaactgttcatgcaattagcggccaactacggcgggaaaatttcccaagaaaacgcgaaaaacaatgaagcaattagtggcc

SEQ ID NO: 86290 - DNA, 746 bp, Heterodera glycines
  SCN-specific regions: Sequence locations=1-263,285-746
tttcggactttgccagcgatgatcgatttgggtgtcgtggcactttgccgttacgccttcacataaattcaaacccgaaaatggcctgtctcatccccaaaataagcaaagaggccaattatccggttctcatccattatcttatgccttttcgcgacgactttcgctatttcgattttccgctcatcaaaacgccgttgtcaaaatatcagctggatctgatggacagttacatcgacgccctaatgctttacgacgagggcagccaagtggagcagctgaagaagcgccaagtgcacgacccgcggcttcagtacgaatgccaactgttgcggaaccgcgccgtgcacccggacaaaaaagggatggaactgagtgcggaagaccgtcagagactgctcgaaaccctttcggcaccaaagcaacggatggacgaagcgcaggtcgtactggacgaaatccgtgaggagtttccgcgggagctgaacgaaaacacacggatggccgcatttcgtacaaccaaagctaagacggacacgctcggccaagtcgatgaccgtctccagcccattgtgccgggtgcgcccgttaaggacgaacagagaacggcaaagaaagaagacgcggactgaccggcgaaatttattcattttacactccatccatccattatttggtttgatcccacagcagatccttaccagcgatttacacagttttcaaatttactcaaataaaatcagttc

SEQ ID NO: 86291 - DNA, 681 bp, Heterodera glycines
  SCN-specific regions: Sequence locations=1-119,164-535,559-681
gtgattgatgcggaactctttgcgcattggctgttactatggacgactttcagtttgcactcggtaaaaacagtccgtccgcgttgcgtgaaaccgtcgttgagactccgaatgtcacttgggaagacattggaggccttgaaaatgtgaagagggaatacaggaattggtccagtacccggttgaacacccagagatgttcctcaaattcggaatgcaaccatcccgcggtgtcctcttctacggtccgcctggttgtggaaaaactttgcttgcgaaagcaattgcacgcgagtgccaagcaaacttcataagcatcaagggccccgaactgttgaccatgtggttcggcgagtccgaggccaacgtgagagatgtgttcgacaaggcacgtgcagctgctccatgcgtgctgttttttgatgagctggactcaattgctaaatctcgtggtggaaacgttggcgatgcgggaggggctgccgaccgtgtcattaaccaagtgttgaccgagatggatggaatgggatcgaagaagaatgtgtttatcatcggagcgacaaatcgtcctgacattattgactccgccattctgcgcccgggtcgtctggaccaactcatttacattccgttgccggacgagcccagtcgcctgcaaatctatcgtgcttctctacgcaa

SEQ ID NO: 86292 - DNA, 655 bp, Heterodera glycines
  SCN-specific regions: Sequence locations=1-139,161-655
tcccctgcgattgcttcttatgttagcactgagccgttcgtccatcttttccttatgcagccttgccatttgttttcgccgttttctttttatttcagcgggactttttctcatttattttggattttattgtttgtttcgttgccatcaaaatggagaataacatctgatcattctttttctataatcagtgaaagatttgaatttaattccacagcctcaaaaacggaacaattaagaaatgacaaattgaattggattgatttttcaacagataatgctgaatcgctgttggaaaccgtggcaaattcttccggcggaagcttttgtcctgacaacgatcagaatggtcttttgcttgggcatattggacaagcgactttgctgatcgaagacttgcaagaagaggacgttgagttggcatttcccgaattgagtccgggcggtcactggaaaccgagcaattgtgtggctcttcataaggtgggcatcgtcattccctacagagacagaaaaagtcatttggtccgacttctcgactttctgatccccgtgcttaagcggcaacaactcgacttccgattcattgtcacggaacagaatggcgattcgttgtttgacaaagggcgaattatgaatgccgccttccgttttg

SEQ ID NO: 86293 - DNA, 703 bp, Heterodera glycines
  SCN-specific regions: Sequence locations=1-28,202-303,325-633,656 -675,697-703
gagcaagaggaagaaaaacacgaggaatggaagagaaagaggaggaaaaaccagaggaatggaagagaaagaggaagagaaggaaaaagacaagggaatggaagagaaagaggaagaggaggaaaaagacaagggaatggaagagaaagaggaagaggaggaaaaagacaagggaatggaagagaaagaggaagaggaggaaagcgatagggaaagaatgacatggctcaaaaagaggaaaagccgaaaacggccaattcatttgcatcgccatgttcacgtttgggggagaaacagtgaccacacacggacgagaaacaacagaaataataacagacacagatttggaagcagcgcatcggcaccaaaacgttcaaattcggcacattttcctcccctttcaacgccgttcaaacgaaagctttctttcgtcgattcgtccagggaagaagcccatcagaagggttattcacctcagtcattctcagatcattcctggggttctgccaatcactcgtcggcttctgatcacttttattcgcctcatgatcagtcgcccccaatctctgctgccgagcgatcattgtccatcgatggacataaatattcggacaattgggatcattttgataaaagaaaagagcacacaaagaaagcgcctcgtcataaaatcaacaaaatgacaaagtcaaatcaatcacaa

SEQ ID NO: 86294 - DNA, 677 bp, Heterodera glycines
  SCN-specific regions: Sequence locations=1-174,196-410,432-677
tgaaagccgaaattccattgaatttttgcacgggcgaccgattgctgtcccgaagacgaactttcgttctttcaaaatttcgagggttattccgatgagagacgctcccgacttctcccgacttcagttttgttcttcaattcgttgcctgaaattcaattcgcttctgccaccgttttaaagggctttttgtttgaaatgttctcatcggagaacgccaaacgcggcgcatttgctaagaaaagtttgaacggaaatgaattggagtccgaggccaacgagggggacgcggaggacattgggaagagtttggaggagcagtcgcatcagttggcactgccacggcttttcaaggcacttctctcttttgagtttgccaattactcccgtctgaacgaatccgaagtcgaccctttgctgctttcctgggatgttctgatgcgtttttttggagatttggacgtcctttcccgggttcgcttttgcgatgccatcgatgtcaaaaccctttccaatgcgttggcccatttgtttaattctctctccgaccccccggggcataaagatgccatttgcgttgtttctaatgtcgacgaccttttcactggcccttttcactataaattggtggaccgtcctttcgatcgtgaacattttacgagtaatctcttcttccg

SEQ ID NO: 86295 - DNA, 442 bp, Heterodera glycines
  SCN-specific regions: Sequence locations=1-35,57-129,174-303,334 -346,368-417
atctggttgatcctgcctgaactgatgtgttactttcaaagattaagcatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaatt

SEQ ID NO: 86296 - DNA, 193 bp, Heterodera glycines
  misc_feature (67)..(67): n is a, c, g, or t
  misc_feature (85)..(85): n is a, c, g, or t
  SCN-specific regions: Sequence locations=1-193
gaaaacaattggggcgctggacatggacgaattggaacgggcattgaaggagagcgtgcacgatgtngaaggcgattgtggtgantcaatccgggcaacccaaccgggcaggtgctgagccgagccaacattgaaagcatcatccaatttgcgcacaaacaccgactgtcatcttcgctgacgaagtgtacca

SEQ ID NO: 86297 - DNA, 577 bp, Heterodera glycines
  SCN-specific regions: Sequence locations=1-21,43-310,332-363,385-577
catcttctgtactcctaaagaacctgaactcaacacattaacgccacttaatgacgatgatggacttaacaacattacactcataagtccctaagcaatctgtagctgtaaatcttcacaccgattcgtcattggctgcttccaccgtaaaagaagcgtcaaatacacaatttaaactgttttacacttgccctgactgtcctcgtgatcaatccccggtgcgctctgagtgttcagattatgtggacgacgattggtcatccattgaagatggggacaatccacgaacatctcgtgaagcgcaagaagcggagattgaggacaaataccgaagtgctttgaactttttgcaagagggaaacattgaaagggctgtctccatattttcggcacttcttgtccacccggtgatgtccaaatatcacatcgctgactggtcaacatttgattggcaaaaatcaatgactgccggcgacggcacttcatcgcaacgaattgtgccaaatatggcaaaactgtatttcaacatcaatttggccatgagtggactggccaaggacccgttccaattttatgt

SEQ ID NO: 86298 - DNA, 543 bp, Heterodera glycines
  SCN-specific regions: Sequence locations=1-143,172-250,280-543
caccaccagcagcacgccaacgacgccaaaggggacgacgacggaaaattggagcgaatcattagcggctgctgttggcggaaagacccacttgtgctgatcatcgttggcgcactgattgcaatcattgtcctgctcgtggttgttgtgtgctgctgctgctgcaaaaaacgcaaacgccgccgccgccacacttctgccgacgacgacaaggaggacaacaaaaagcgcaaacgtcgccaccacacttctgatgacgacaaaaaggaggaggaccactaccacattgaccagcacaataagaaggagggggagcagcacggaaaggaggacaacaaatcgccgatacaaagcgaactgaaagtgtcgacgatttccgccgtgccaagcgactacaacacgaacaaacggctgggcgcaacagaattggacgtggaagcggaagaggtgccgaagacgaagccggttcccaaaaagccgaagtcagaaggaggcacaaagcgcaaactgtccaatttcttttggtccaccggcaccaccgag

SEQ ID NO: 86299 - DNA, 692 bp, Heterodera glycines
  SCN-specific regions: Sequence locations=1-279,301-692
tatttggccgtttgctgttttggcattgtcgcgggcgctgtcggcggtgtttactattacaatcatgtccgttcaagtcgaattgacgaccccttcaacgaattcactcgctattcccccgccgggcccacaaaagacaaacttaagaagtcgggttcgcccatattcggtcagagcggcgacgacactttggcttacaaagcgcaactgcaccattaccagcagcagaaacagaaaatactgggcacagcgtcggggccggtggtggacaatgtgagcgacaacgaagaagacacggacgaaatggaccacaattacagcgtttttgagtgtccgggtctcgcaccaaccggtgatctcgaaatacaaaaccccaatttcgtgggcgctgagaagtcggcagccggcgaaacacgccgcacagaatgaagccaaggaattgttacccccttccaccctacatttattattgcgttccttcccaccaattcccttgtaaattaggcctcaaaatccccgtgaccgaccaaaacatccttttccccttccactgctctagtctgaacacttccgcacattccgaagttctgtccgattaaacattcctatttgagctattggatttgaatgtctacgctttggggggcttttcgataaacttgggcgcagtgttgtacagaaattgacgataa

SEQ ID NO: 86300 - DNA, 745 bp, Heterodera glycines
  SCN-specific regions: Sequence locations=1-38,62-359,381-596,618 -680,703-745
ggctgaccgaccatttccacttccatttgctgtttcggcacttccttttcactcctttttgctgcaactcaccagtaatgagcagcagccatcgcgagaccggcagaagtccaagaagtgtgctgatgcgccagtacgaaatgctgctgcaaaactcgaacgacaacagcggattccgtgcctggttcgacaataacaatctcttcaaatggcgcattctaatcgacgggccgccgggaacgccttacgcgggatgcaaactcacggcactgctccatttcccggcttcgtacccaaatgatccaccgacaatgaccttcctcaccgacattcttcatccgaacattgaccagagtggcaaagtctgcatcagcattcttcatgcgccgggcattgatccgcttggccatgagcagccgtccgagcgttggaatcccaaccgttccgtggagtccattttggtgtcgatccaagtgctgctggcagagccgaatttcaacagtcctgccaatgtggatgctgccattttgttccgcaacgatccggcgcaatacaggaaggaagtgcgacggcgcgtggagagggcatcagcatcgacaccgcgagcgaggtcgtcatcaacaccaccgccggtagcgcagccgtcgggagaacagcagcaggggacgccgcaaccaccagcgacaccgccgacgccaccgcaagaagagccgcagcagcaatagcaacaaactttgcgaatggt

SEQ ID NO: 86301 - DNA, 693 bp, Heterodera glycines
  SCN-specific regions: Sequence locations=1-693
acgggcaaaattttgtcggaaggccgtggcgaagtgcaggagtttgttgacatcgccgattacgcaactggtctttcccgtatgttttccgggcgtattatgccatccgagcggaagaagcacctttttcttgagcagtggaaccctctcggagtggtcggtgtcatcagtgcgttcattttccctgccgccgtttacggttggaatgccgcgttggccctcgtctgtggcaattccgtgctttggaagccgtctcccagcactccgttgacgtccattgccatcactcgactcattggcgaagtgttgtccaaaaacggactgtcgcccgccatttgctcattgatttgtggcggaggggacgtcggaatgtgccttgttaaggaccctcgggtcaatttgctctcatttaccgggtcaactgaggttggccgtgtggttggtcagcatgtccaagcgcggtttggcaagttactgctcgaactcggcggtaacaatgccatcattgtgatggatgacgccgatttgagtttggttgtgcccgccgtcactttctcttccgttggcactgctgggcagcgctgtacgagcacacggcgactgattatccatgaaaaagtgtacgacgtggtgttggaacggggtggtcaacgcgtacaaacagctgatggacacgcgcatcggggtcgcgaa

SEQ ID NO: 86302 - DNA, 707 bp, Heterodera glycines
  SCN-specific regions: Sequence locations=1-193,215-372,395-433,519 -602,632-707
ggacaaaaacctggagaacattcgccgaattgaccaattcgcccgcaaagtgatcgaacattgcacccatgcggcactgttcaatttcagcattgagcagaacaaatggctgaagacggaggtggacggcccgctgttcatctacgaacggcttgaccagccgctgtactcgatgattgtcgtcaatcgccagtcgcccaaaaattttgtggaaccaatcacggacgggctgcagttgcgctacgagccgccctacatttttgtgcatcgcgaagatggctgtattcgcggtctttgggtgttcggcgaagacgaatgcaaacgagtttttgacactctgacgaatctgagcatggagctgaagatgaaaagtgccggtgccaccaccagcagccccaaaaacagcatctccgccatcaacaacgacagcggtgccgtcgccgctttcgctgccgcaacgccgccgacgaaaattgtcgctgccgccaaaccgtcaccgccgccaccgtcgcagcagcaacagcaacagtcgatccgcgtcagcagcttcatctcttccaacagcagcccgttcaacaacaccaatcagtacaccaactcgaacaggggaaccaccagcagcaccaacaccggtggtgggtggagccaatgccatgagcactgtcagcaacaacaacacaaccagcaccaccaccgtcggcagggac

SEQ ID NO: 86303 - DNA, 573 bp, Heterodera glycines
  SCN-specific regions: Sequence locations=1-163,188-270,292-573
cacaaggaacgacagacatacggcgaggaagacaaaagcaatgcccaaaatcaaatgccgacgagggatgaacgacggaagatcagaagagagcgaaaagcgatgagtgacaaagcggacgacggcactcgaattcccgaaggtttggtcgagctgaaatttgaagcaccggcagcagcggcggaagaacaattgatcgaaggagagacgtcgacaaagtcggctttcgtttccaaattttccacgcatccgctgggcccatgggttccggtcaaaaaggaggagaaaaggcccgatctcgactcggccgactctgagcttcaacctcatggaaagaagcgagcaaagcattacgacgacttgcccgagcagtcgtacgggcccgggtcagctgactactcgcaaacgccggctgaactgcttgaaattgccgaaatggaccctgacgatttgtcattcaagccaaagcagacgggacagccgcagaaaagtgccaaagggaaagcgattggattcagaaagccgggcacaagccatgcaacgaaatcattcagaaaggcaaacaaaactgaa

SEQ ID NO: 86304 - DNA, 574 bp, Heterodera glycines
  SCN-specific regions: Sequence locations=1-574
ttttcccaggatggccctgccttcttacaattctttctccggcactcaattcgcacatcgctttccctttgcgcctctttcgtcctccgttcgccctatttcgttttgcggcgtaattccgtcgcctcctcctccgcattcccttaattcgttgccgtcttcttcgtcctcactaaactctaacaattgttctcttctgctcccttctgagatcagtgccaaagtgttttgtccgccgagtgcaattgacccgaaattatgccggagggctgcacgtcgaagtcggcacgaactcagccacaaaaggacccatcgctgcaccgttggaggctgtgacaaagtgtacaccaaaagttcgcatttgaaggcccaccaacgactgcacaccggtgagacttgtgcttttggcacttttgtcggtgtcaaatcggtgcttttctgtccattccttcgattggcctttaaagtcaacaattgtcggtttatgtgtggcggcgctcaaaggacattcattcgcgctgactttgttctttctctgctcccctcattaagtgccttcttcaccagcgaacga

SEQ ID NO: 86305 - DNA, 642 bp, Heterodera glycines
  SCN-specific regions: Sequence locations=1-642
tatgacaagtcaagtccgtagcggaacgactcgtaccaagaagcgtaccgctgaccaagttgtaaagacggtgttccgtcgcaaaatctgtctgttctgctttatggcctcactgattgttttcgcgctggtccttggtttggccatcactttgacagttatcacagtgaacaattggaaggaaatcggcgtgcttcttagcaaacaatcggcgttgaagagccgctcggacattgaagcgttttatgaaattgattgcccaatttacagtgacaactccaaacttccggacaaatgggaccaatttgatttggcattctgcaatcgctattgtgatcgcaaccaaatgttcgagttcatgtaccgtcaactcgaccccaaccggaaatcttcagccaagagcaaagacaatcaagagcttatgtgtcccatatacattgaattcaaacaatgtcagatggaggaagggggtcactgtgaggagaagttattcagcgaggaattcaccgaattcgttcaaccgggcggtgctggcacttcgtccaaaggggagaatgagacgattggcacgtgcgttccctgcccttcctaatccgaattaaaggaaaaagctgatgtttatctggccatgttaatctattg

SEQ ID NO: 86306 - DNA, 322 bp, Heterodera glycines
  SCN-specific regions: Sequence locations=1-322
cgtatcgcactcctccaaccctatttgcgatcacacaaacgcggctgctctcggccaatgaacacatctcattaccaaataacatctctttgcacaatctggcatttccctatgaaatgcttgctatcaaaatatctattgaaaattatgaaaacctggcacacaattttccgtataacgcactcaaattggctacagaaaacactggctaatgccatcctctcactgaaaatcacttgtatggacatattatcaatgatttggcaaaaattgccgctcttaaagtggaatacgcactgaagcaacgacgggagaatgacct

SEQ ID NO: 86307 - DNA, 681 bp, Heterodera glycines
  SCN-specific regions: Sequence locations=1-54,76-127,150-560,582-681
gctcggttacgtgttttccgctgctctgtccagcttggtcctttccttcggtgcgtaccgcgccagcttggcctttacgacaacttctccctcgcttttccgttctccgatggcttttttcgaccggactcccctcggccgaattctcaaccgaattggcaatgacatcgaccgaattgacgaaaacattccctgggcggttggctattccttgtcaattcttgccgaggcgttcaattccatcatcgctatttgcattgtcatcccttttcttgtccttgtcgctgttccgttgatggttatcttcctctgtattacgcacttttacaacgtttcttcggtccaatttcgtcgtttgaccagcaaatcgcgttcttcccatctctcttttgtggaggatgcttactccggctccgattccattcgcatttttaaggcgatcaaacaattcagggccaaaggctaccgaatttctgacatttgcaacgaatgctttatcgttgaaatattctctaacagatggctccaaattcggcttgacattgtcgccgatgtttccgtttttatttgtgtggctgttgcaatttggatggcaagtcaaggcgtcatttcgttgggggttcttgcgttggtcatcggctgcggatatacgttcaccggttaccttggcgaagttgcacg

SEQ ID NO: 86308 - DNA, 668 bp, Heterodera glycines
  SCN-specific regions: Sequence locations=1-115,138-611,634-668
cataaaaaaatatgagaattcccattatattaatattattacgcatcgttgcattgctaatacatgatgcatgcgccggcaaaaagacgccgaggaaagcaaacagaaatcgtgccaataaaaatgggaatagtgggaccccgtccagacaagcagcggcaccaggaaaacagaacaaaaatacgccggaagcaagaaccaatgggcaatctccgaaaaagggtggtaagagcattggaaaccaagcaaatccagccgaagtaaaagatgctcctcaacagtccacgccaaaaaaattattacatgctgcaagcgttggtgtacttctactttcgaatcttgcagggcccataccggcaggagcctatgacattaaccaggatcggaattcacatatgaccgaacagtacaaaatgcatggacggaataatatggcggcatatatgaatcaaagaagtaatttatatggagaaactgcagcggcaaacaatatacatgggaagaataataatattcatgcgccaccaaaaaataaagcggttgaagagaaaaccaagccacaaatgacacacaataattttgcacgtcatacacgaacaagatatccgcctccaccacacaaaaagactcttcgatcaccaaacttttcagcattagctgctgaaaga

SEQ ID NO: 86309 - DNA, 698 bp, Heterodera glycines
  SCN-specific regions: Sequence locations=1-576,599-698
tagtctgttccagtgcagccaactcgtggcattctgtgtcagaggtgctcagtgaacagaaacagcgcctttcccttaacggatggttccattacgctccggggacggcgaatgttgcacagacagggccaaattgcgctgtggaagagccgatttgtcgggtggagccatcgatgaatatcacgttggcagaagtcaacgaatggctgagtccaaattacattcgtccgggacaacatcggcaaatcaaacggatttttgcatacaaatccgagctgtccctccaacaatttctcaataatgaacgttataacaaagctttggatgagttggaaaaggcgcaatttgaaagtgttggcccaccgcacaaaagaaatgtatggcgtctcgtcgagtcatccttggaacagaacagcgttctccaaagtctattgcgtttgtttcgctccgaggccatcactcttttgttgacccaatggactggcctccatctgtacgatttgaagacaaaacgtggcacggcacattctccgaatggcgcaaaaagggcggcggaaccgccaaagaaacggaagagagcggacgaagaggaggaagggacgacgagcggaggactgaagcaggggggggaaagccgacagaggcggagaaagcgaagatacaaatgttcgaatcgcttctttcatccatcgtttcga

SEQ ID NO: 86310 - DNA, 542 bp, Heterodera glycines
  misc_feature (430)..(430): n is a, c, g, or t
  SCN-specific regions: Sequence locations=1-323,360-396,420-430
gtacgcggtgaattgtggtgccaggagagccttacgttggcgccaaaatcttcctgatggaggctgacacgcttgatccggatgatttgttgggcgaagaacgatcggcgcccgacgggcgctttgaagtgcgcggaggtgagagcgaaattggcgacgaagaaccgtatttgatggttgggcacacctgtccacagcgaggtgtcccacctgacccggcctgccattttttgactcgcgttgatttgccaaatttcctcactcacattgaagtgccgccaattcatttggacggacaatacgaatttcagcatatttgtggcgaggatgatgtttaaaaaatatgaatgatggatgaataagataataaacagttcatttgcccatctttttggctaaatatgtaaaattaaattaattaatggcattnaaaaaaaaaaaaaaaaaaaaaaaaaaaaaaaaaaaaaaaaaaaaaaaaaaaaaaaaaaaaaaaaaaaaaaaaaaaaaaaaaccccccaaaaaaaaaaaaaaaaaaaaaaaaa

SEQ ID NO: 86311 - DNA, 704 bp, Heterodera glycines
  SCN-specific regions: Sequence locations=1-408,433-559,581-704
cgacccggggcatggagcagacgatgcagtccatcttcccgcgcattcaagtggcactgcgccggtccatgcagaccttccaagactccattgaagctgagttggcacagtggaggtactgctcgaagatgcaatcgagcaaaatggaggcattgatcagattggtcggcgaatcggttgaagttcagattcgcggccctccggaaaaggccactgcgtgcatttacttcctggaggatctgtccacattggtggagctgacgagtgccgaagtggcgcccggtatcagcacagaacggcacttcctttccccggcacatttgagggaacacagaacgacacctgccatttttacgccagaaacaataatggaaatgcaacagaacgagtcgctggtcattgtgaacagtgacggggaggaggaggatggagttcaccgatgtggtttgtttcggctccaaagaagctgccggtctgctcacgctcggcgtcgacatttccgtctcccaattgcaattgtccgcccgctcggaactcgccgctttgctggacgcaccgaacactttgggcatggactggagcatcctggcggtgaagctgaacttgactgaacaaataccggaggtcgactcgtcaggccaatcgttgtcccgcactgatcagctgctcaccgaatgggcacttcactcgcccgacagcgcttc

SEQ ID NO: 86312 - DNA, 708 bp, Heterodera glycines
  SCN-specific regions: Sequence locations=1-123,145-708
ggggcactcggaattggagttgcattgcgactacccatttggacttttggtcggttctgcagcaaccaattagctgatggactgtctgatttcacaaaaaacgccggcgaagacgcgactcaatcgtggtctttccgtggaacacggccatcgacaaacgcatttatgccgccatcgaggcaactcaagaaatagccaagaacccttctgagaagttgactgcccatgcgaattccttccttgacattgcgaattcgctcagcgaaagcattttgggactgccgcgtgctgtggaggaccccgagtgggggctgaaggagcgcgtcacgtttctcgcgtcgcgtatcggtcaccgaatcagctcaaagaccaacgaacgcatcgtggaaccgctgctgcagcagatgtgtgtcctcacagagcagttgtcgaagtgcattgtcctcgtggactgcgccaagcagcgccaggaatggactttcaacaaagtgagccaattgtcgacatcggtcgttgagttgcgcaacaaaatcgaaacggaggcaacgcgaacgcgaaagatcccgggagaagtgctgctgaagatcatccgcttttactcctccaagctgaacgttcagatgagcaaactgcgcgaccgcagttcggagttgctttcttcttcgatgcagaaacaaattctgacattgactgcatacgttcagcaat

SEQ ID NO: 86313 - DNA, 591 bp, Heterodera glycines
  SCN-specific regions: Sequence locations=1-247,418-540,563-591
acatttcttcttcttcttcttacccactccaaccacgaaccgcttcagtgcgcaacgcaacgcaatggccacttacctattcatcgctgctgctgccttcggagcaggaatttactgttggaaggcgtacctcggcccgatgctcgaccaaccgaagagcgacgacgaggagaagcccaagccggaaggaggcgaagaagcgacaaccgccggcgacaaggaggagaagaaggctggcagcaagggcgacaagcacaagaagaaggacaagaagggcgaaggcgcagcagcagcaccagcggcggacaaaaaggaggagaagcgcaaggacaaacaccgatcgaaggaggcggggaagagcgacgacaacaaagcgggcaagaaggacaagcacgggaagaaggacaagaagaaggacaccgccgatgcatccaccgtggacgaagcgctgggagaacagagcacagcggagatgagccaagcagaggaatagccaggccctgctgcgtgcaaatgacagtgttcgacgacgacgtctcgcgacaccaacacacccatcccttgctttcgatcattcccttcccgtccgat

SEQ ID NO: 86314 - DNA, 579 bp, Heterodera glycines
  SCN-specific regions: Sequence locations=1-579
ccttttaaaatttatggttcattcttagcattaattgccgtgtcaaagtgtccaaatgcttcttcctctgcttgtgctgatgcttctctcggcttcatttcccctcagtgccttttccccctcctattcgtcttactccaattggccttatcccaattctcctcgctattctgactacaaccgattgtatccatcatattcgggccaatatggcaattacagtggctacaattacggcaattattacaatccatatgggggcaatagccgaggctactacggtatgtacgacagtccttcttacggtagcggatattcgccctcatattatggtggctattatgggaggaatggtggcctagggtatggtggaatgtacccgggctacggtggctattcgactgcgtcctactacggcggttggccctatacggctgggtacggtgctcagaacggatacacatcgccgtggagataagcagaagaattgcgagggatttgcgaagggaccgatcagaaaggacggaaatggcaaactctctcataacaatggcataaatgataaaaaaatatgaagcc

SEQ ID NO: 86315 - DNA, 301 bp, Heterodera glycines
  SCN-specific regions: Sequence locations=1-45,67-133,161-229
gtaatgctttgtgctgaatttaggacttgttcttcctgctcagcactttcatcttcagaattcccactccgattggctgttcccacgatggcattcgccgctggcaaaatctcattgaaaatttccttttcgcaaacaaaaaaagaaagaaagaaagaaatgttcgtttggctataaaaataaaaatgaattttcagtgatttatgttcaaatttcattaatatttcacaaaaaataaataaaacaaaaaaaaaaaaaaaaaaaaaaaaaattgaaaaaaaaaaaaaaaaaaaaaaaaaaa

SEQ ID NO: 86316 - DNA, 677 bp, Heterodera glycines
  SCN-specific regions: Sequence locations=1-677
cggtttggtgccctccggcgccgttgttaaactttttggaagaatttgtttcagaatgaacttcctaaagtgaccgatcggcccaaaatttcgagctgtttgccgaattggacgaggtcgattcggtgctaaccgaccgcatgtccgcagtgattccgcaacctccgagcccggcacatccaaaattccagaaattgtatttggacaaaaaagacaagtccaccggccaagcgcacaaaccgaagaccaacaaagggccgttgcatcggttgcgtacctttttttccagggtaatattagagaagaaaattgatggcattgtgcaagtgtacgagaagataaaggacagccccggggggtgggctgttctcatccagaaaatgttcaccgaaatggtgctggccaagcagttcggcgagggaagtgccggcgagtcgcgcaaaaactgccaaatcgcactgcaattgatcagcaacggaggggacaaagttggaggagttcatttggacaaggtcaagccgttcgacagcacttggtccctggtgaaaagtgcagcacaatcgctggtagaactgttcaagcgcaatgccggaggtgaaaaggccaggatgaagagaacggagacgattttgcgagtgttcaaaacgtttgccatggatggaaatgcattggaagga

SEQ ID NO: 86317 - DNA, 630 bp, Heterodera glycines
  misc_feature (348)..(348): n is a, c, g, or t
  misc_feature (353)..(353): n is a, c, g, or t
  misc_feature (598)..(598): n is a, c, g, or t
  SCN-specific regions: Sequence locations=1-489,511-630
cagatgtacgtggcacagcagcagatgaaggccggcacgggagggggcaaaaagtgaacgtgtcgaatgcgaactcacttcgattatgctctttcctcgtgtctttggcgctgcttttaaccattgcccagcaaaaggtctcttcaactcgtgtgcacattttcaccattacgctacccgtcgccgaattcctcgcccaaaatcattcgcggatttgtgatggttcaagacacctcaaacaaaaaaaaggaaatatttctttttgttggtcgattgtccgacaaatagcttttcgtctgtcttcacaatgacttttaaataaaaggggggggggaggggctaaaaatngactntgcccttctccccgtcccttaaacattcattcgtacgcctccgctttcgacatgatattccttccatccccttcagttccactcctttttgttttgcttgtgttaatttttgtttgttgtttggccactctttctttccatttccttttttacttttgtcgctgtccaatgagtggcaaataaatgcccttaaattattatttcttcatgggttctcacctctgtgtaccgtgtaccaatcattntgtttgtgtattttattaactcatcatctgtt

SEQ ID NO: 86318 - DNA, 178 bp, Heterodera glycines
  SCN-specific regions: Sequence locations=1-104,125-178
taccgttactcggcgacatttcttccgattacacatttcctttccctccgttctgtcgtccaactgctgccactttcaattgtccttcacggcaatggctgaaactcctcctcctcctcctcctgctgatgctgccgctgttggtggtgatgaagccgttgatttggagcaacgtgtt

SEQ ID NO: 86319 - DNA, 388 bp, Heterodera glycines
  SCN-specific regions: Sequence locations=1-388
tggaaagcatgtgttcatctctgcatcaactctagtaaaaatgtcaacaactgtgtcatggacatgcttactccatattgatgcatgcgaaacttctatggcgaaatcaatccccgtgcattacgccatcatatgccctaacatcaaacatggccgaatgtatcataattcataagtgccaatgaaacttgcctgtgatatggtctgcaaatctggaacgactcgaatagttgcacttgactcataccgcaaggaaattcaatgcttaaatatcattcctgtggataatcttcccgcgtctcctttttttgcttcaatacatgaaatacaatattcccgactacaaaaatgcggtaattgttgctaaaacgcccggagtcatgaacac

SEQ ID NO: 86320 - DNA, 521 bp, Heterodera glycines
  SCN-specific regions: Sequence locations=1-27,50-69,93-212,243 -285,310-521
atgtggaagaggcgaagacaggcgagaaagatgacgaggaagacgacgatgtggtcgtaattggcgaatgggagggagggagagaaagagatactctctccaccgccagcgatcgttccccggccgtccctcataaggcgctttatccatcgcttccgtccgattcgtccgcttcccaaatggaccctcctccgcagtatggtcatcctcaagctcagcaacaacagcagcagcagtccacgtggttctctcctgcttcctttctcggctcttccaccaattcgcctccctccgccgccaatggcaccgatcaatcggtgccgtccgcctcggccagtgcccagcgattgctgaccgaactccgtcagagatatcagccgtggtccgtgttcttcaagtgcgccaagttcggttttcctcccggcgtggcagcgattggaccgcgcgtcaaacgcaatttggcgacatttaccaccaattacctgtgccttttcgcccttctccttctttactgcgtgctc

SEQ ID NO: 86321 - DNA, 114 bp, Heterodera glycines
  SCN-specific regions: Sequence locations=1-114
agttggatatatgatatcaaaattaactatggacaatcatcgcgcaacaaaacgtgccaaaatagaactaagctgaccaaacatgaaacgaactttcacaaacaatttggtcaa

SEQ ID NO: 86322 - DNA, 557 bp, Heterodera glycines
  SCN-specific regions: Sequence locations=1-114,147-441,463-557
tgattgccgacaccttcttgtttaaagagggcgaccgttttctgcaggaggccaatgcttgccgttattggcccaccggacgcggaattttccataacgccaagaaaacctttttggtgtgggtcaacgaggaagatcacctccgtatcatttcgatgcaaaatggcggcaatgttggacaagtgctggagcgtctcataaagggagtcaaggccatcgaatcgaaagttccgttttcgcgtgacgaccgtcttggctggctgactttctgtcctaccaacttgggaacgactgttcgcgcgagtgtgcatatccgacttccgaagatcagcgcaaaacccgacttcaagtccatctgcgacggcctgaaattgcaaatccgcgggattcacggcgaacattccgagagcgctggcggcgtttatgacatcagcaacaaggcccgtcttggtctcacggagttcgaagcggtgaagcagatgtacgacggagtgaaacacctgatcgaattggagaagaaagcataatgggaggaccgatctatgatgatgacttta

SEQ ID NO: 86323 - DNA, 683 bp, Heterodera glycines
  SCN-specific regions: Sequence locations=1-190,213-623,649-683
aggaattggatggcgagcagcgccgtcaccaagaaacagacaaaaactaccgcaaggctgagcggcgtgtcaaagagcttgatttccaggtggaagaagacaaaaagaacacggaacgtctgacggatctgatcgacaaattgcagggcaaattgaaggtgtacaaacgccaagtggatgaggcggaagaggtggcggccaccaatttgggcaagtaccgccagctgcaggcacagttggacgaggcggaagagcgtgccgatatggcggagaactcattgagcaaattgcgagccaagaaccgctcttcggcgtcaattgcgcccgcttcggcctccggcctggccacttccgccagtgccgccgtcctccggtccacttcttttgcgcgtaacagcttcgccgactattgagagaatgtgctaagattgttcctatccgtcctccgtttcctctttgctttgttctccctttccattcgtttgtcaatccctttaaatgtgtccactcattcacataaataatctatgaaattgccctggcggaaaatgtgccgaaattagcccccgaaaccctcacaaaatgttaatgttctttctagcgaatacatagccaaaagaataacccttttccctccccctttttattttcgttcatttgtgctcattttggtgatgatggcg

SEQ ID NO: 86324 - DNA, 682 bp, Heterodera glycines
  SCN-specific regions: Sequence locations=1-601,623-682
ccaagctccttgcttctgaaatgtggcaacgaatcaaagaccgagttcttatttatgatcgaatgggcaggggaacggtgcacggcgagacatcaatcaaatatgagtttaaaacggacgaagattttgggaaatggctgaccggatccgactcggaatggagcgagggcttttccaagtgcaaattgtacagaagcgaccgtggctcggcaatctttgagggcacactcagcacacgactggtcaaagatggtaaaactcaaggagcaggatggtgttcgatgcgttcgctgaacgacaaaaaagccttcgataggaaaaattttttttcggactggtcccactacacccatcttctgatcaagtgccgtggcgatggtcgcacttacaaagtgatgttgcacattccgcagtttatggacatcacttggggcaattcctacacgtatttgctgcacacccacggcggcccccattggcaattcgaaatgattcccttttcacgcttcgttttcacagtcgaagggcgtgcaattgatgttcaatatccgttggaccctcgggcggcgagctcgattggaatcactctcatggacagaattgaggggccatttcgtctggaaatcgactttattggtgccacacatgacataagtcacctcgaaaagcatgcttatgagaa

SEQ ID NO: 86325 - DNA, 682 bp, Heterodera glycines
  misc_feature (25)..(25): n is a, c, g, or t
  SCN-specific regions: Sequence locations=1-260,317-518,547-682
agccttaacagaattatagactcantcgtggccgaaatgaggaggaaatgacactacaaaagaaggtggacgagctgaagcgtgagttgaagggaattggcaatgaattggcagtgttgggcgcaaaattgaaagccggcgaaacaaaattagcatcgctcaaatgtttccgtacgaaatggcttgccaatgcgttgtccaaagaatcgggagcgattgttgagcgtccaccgaagaaaaaacgcttacaattaataactgaagacgaggaagcagcagaagatgacgaagaagaggaggatgaaggagaagaagacggagagggcgacgaattgcacgaacaaatggaatttgaggaggacggaattgaggatggacaacgacaattggaggaagcggaaaacgaagagtctgtggacgacctcgaccagtttctacacgactgtgtggcgattgacgatagcgatgttaattttgatgagacagatgcaagagatgcggaagaccaaatggaaattgacgaagaggacgacgatgaggagggagagagagaaacgaacaaccaattggacaatggccaaagagcgacgaaatcgaccgctaaagtcgttgctaacccggacaatctcaacaaactctttatgccgttgcccaaacttaacgaacagcttttacgtgatga

SEQ ID NO: 86326 - DNA, 586 bp, Heterodera glycines
  SCN-specific regions: Sequence locations=1-114,136-586
catcctctaagaattcaaatcctctcagaaaatggcttcatctttctgctcttcactcatttccatcgtcgcaattgtctgtttgctgtgcaaatgctgcttttcagcaccccatccatgctgtcctggcagccaacatgttgtttcgatgatgaaagatcacaccggcacattctccgcttcgatgccaaagtcttcgctttgtctgagtgccgaaagagtcgccgctgcggtggaaaaccaactgaaaacaatttggtgccctggcaatggtggccaaacactcatcaacgagatcaacgcagctcaatcatcatctgatgagtgtgctcgctctctcggcttcgtccgtgccatgttcgaaattgccgcttccgccgcttcccatgtcggtgccaacgccgaattggccaatttggctgtccagttccgagaacaagttggcacaattgacaccaactgtgctgcgctgggcattcatgttgggcaaatcagcttgggcactcccaaaggagaccatccgcaagtgccttgactctgagagtgtgcttagtaaccctggcaccagcgggtctcacaagcgcca

SEQ ID NO: 86327 - DNA, 334 bp, Heterodera glycines
  SCN-specific regions: Sequence locations=1-253,276-334
cactgcggtggtacttgggcttaaggacgaaactgcgctcgaagggtcagtggacagtgttgacccgaagtcgctgaacacgcagctgagcaacgttgtgttgtacagacgacggcagaaagggctaaaacccgcgcatttgcccagttttttttgtaagggcaaacacattcgcttcgtgcattttgagaattacgcttgtgcgctgcatttgttgaaaaagtcgttgcgcaaattgtaaaagccatgcccaaaagaagcaacaacaaacacccgtaaagctcatctccgtgtcttctgtctaattggaaatattccatagcttttgattttt

SEQ ID NO: 86328 - DNA, 254 bp, Heterodera glycines
  SCN-specific regions: Sequence locations=24-254
attattttttgtattatttttcaatgccgcaattaattttgtcagttcacatcgcattgtcggttattatcagggcatacgtccattgacaaatgatcaagccaagaagtagacccatcttatcctggcattttcaacccctgactctcaaggcaatttgagtccattgagctctgtgcttaaacaagcgctaaaagcgggtaaatccgctaatggtgcgctcaaagtgatgattgccattggaggaggtggct

SEQ ID NO: 86329 - DNA, 531 bp, Heterodera glycines
  SCN-specific regions: Sequence locations=1-158,180-531
ttttcgacatttcgattggtggcgtcaaaaaaggacggattgtgattggtctctttggtgaagtcgtgcccaaaacggccaaaaactttttggaattggccaaaggcacccatggctacggttacaaagactcaaaattccatcgcgtaatccggaacttcatgatccaaggtggtgattttacgcgaggtgacggcactggtgggaagtccatttttgagggcaaatcatttgaggacgagaatttcaaactgcatcactatggcgccggatggcttagtatggccaatgcgggccctgacaccaacggatcccagtttttcattaccacggtccatactccatggttggatggacgccacgttgttttcggtaaagtgctcgagggcatgaacattgttagagaaatcgaagacggcgaaactgctggcggagaccgtcccaaaaaagacgtcgtgatcgttgacagtggagagctaacagtcagtgaaccgttcaaagttgcacgtgaacctgtggtttgataaatta

SEQ ID NO: 86330 - DNA, 712 bp, Heterodera glycines
  SCN-specific regions: Sequence locations=1-712
tcagaatgtgaacactgggtactaagcagctgaagcgcgacaacgtttacgagctaattggcgattttgcaaaagcgctgcttccctcctcatttctttacggctattgcaaagaggcgaattgcgcaccttcgtccattttgctcaattatgctgttgaactgtgcaaattgtcctcttctttaactgccgatgcgaatcgttttgaactttgcattgaaacagcgaaagctgccattttgaaagcggagatggacgaacgtactgtgatggtattgctgtccactgtgaaagacatttgcccatacaattacgaggccatcgaactgttgttccacacaatgcacgaaattgcaactaatggaaaaattgagccggaaaaccctgatttggtgctgatcaggggcgggtacatgcttctcaaattcctgagatgcacaaatcgtggcaaaaacatcagttccggagaaattcgttggtacaaacagttcaccagtcagaaaaattggaactcctctctgtcctacgtcacgaacactgaactcgttttagctgatgaaactgctggcgctccttcgctcgatgagagtgcaatgggcccagtccgacaacaatcgaatttattgccgtcaaatgagtccaattccattctgccgtcttgggcaatgaaacgactgccattccatttgctgttcaacgaagagaatgaatc

SEQ ID NO: 86331 - DNA, 318 bp, Heterodera glycines
  misc_feature (64)..(64): n is a, c, g, or t
  SCN-specific regions: Sequence locations=1-18,43-110,162-201,223-292
tgatttctttttcttgtagtatatataccacactttctttattcttttccatattcctctaatntaggcgaattgataggataggcattaaataattagcggctttttccccttgggtattttcctttaaaattttcttgttcaaaattatgttttattttgctaattggccattttgccactttttgtatgtgtacatgtaaaaattatgtgtatatgtcattgtatttgtactaattttctccaattaaatacatacttatcgcgtttaatctttcttcgcttttgggccaaaaaaaaaaaaaaaaaaaacaaaaa

SEQ ID NO: 86332 - DNA, 663 bp, Heterodera glycines
  SCN-specific regions: Sequence locations=1-517,540-663
atttttagtcggaagagtcaatttttcggataaattcatatataaaaggcacaaaaaattcatttggttgccattattttcatcattcattaattatcggcaattcatcttcatcaatcatcccttctctgtgtacaacgaaaacgacgacaattgagcaatgtcggaccatccaaatgttgcgctggccgacctcagctgcgtggcaaacgacgtttggctggacactctgttttggattgaccgcgtggaggtgggcacgaagtttgcactgatcgacgcacgtttcggcaagctggtggccacgcatttcaacctgcgcaagtggaggctgggcgagctgggcgttcatcgtgcaccaagcggatgggaccggggcggcacggcggctgtcaccgttatggacgacaacgcgttgatcaatcgactgccgctcgccacgtgtcctgcaccgggcggcgtgattggcttcagtgccatctacatttggtcttagcgaacaaaatttttttgcaaatttttaaaaattccctaattttccaggtacgtcgacctggaagtgatcgcatttctgcagtgcctgcaacgtgtcatcaatcgcggcatcgctgtgcagttcaccatccattcgacggacctccgctgctgggcggtgatggcgca

SEQ ID NO: 86333 - DNA, 632 bp, Heterodera glycines
  SCN-specific regions: Sequence locations=1-394,420-632
ttatttacaaattcctccctaacgggcaacaagggctacaaggcagccgattggaaattggacagtcccgactgggtgggaaggctcaggctaatttcaatcggcgacaagctcgagattcgacttgaggacaaaacttcaggtgaactgtttgcgaaagcgccgattggtcagctgaactctgtcgactatggatcggtatccgactcatcccgctattttgttgtccgactgcgcaacgacaacgcccagaccgcatttgttggcatcggcttcgctgaccgagctgactcatttgacttgaatgtggcgatccaagatcatttcaaagcggtgaaaaagtgcgacgattcggcggaggataacgcagaaactgtgcccaagttggacttgagcttcaaagagggacagaccatcacggtcaacattgggaagaaaacgatcacttccaacaacaacagtagcagtgctgtgcccaaccttcggacatcgctcggcggtagcagtgccgtgccgcttttgccaccaccgcctgcctctgggaataaaattcgaaaatgacgtgtcattttttcacagattttgcttttcatttttctattgactgctgtgatttcattcgcataatttat

SEQ ID NO: 86334 - DNA, 666 bp, Heterodera glycines
  SCN-specific regions: Sequence locations=1-158,187-666
acctcgtctttcgtctacctcaacaagttcaacatgtacatgaacagcatgggctctcgtggtgcgtcatccgctgctgttgttgcttctgcagcagcattgtgcctattttcggcaatggcagtggtggtgtacggtgccgaaagcgctgggcctaaagcagaccaggccatggctgccaagcagttcaacccgtccgcatttccggccatgccaccagagcttgagaaaatcctgccagccgatgttgtgcaaaagttgaaagctgtccatgccgatatgtcgttgaacatcatgcagaaacaagacaagattgaccgtatcatgagctccttgccgggagaggttttggaccaaatcccggccccgcccggctttgaacgtctccccgacgatgtgaagaaccgtctgaagcagatcaatcgccaaaccaacaaagcatgggccgacaagcaaaaggaactgcaggagtatgtcaagacattgccgcaggaacaacgtgccattctgatgatgggcccaatgggaggtccgcatccgccaccgcccagctttggccggcgccgatgaagcagtgtttatgtgcatatatgttgtgtcttttgattaatggatcatcaatttctttttcattttcttttgtttttgatgaattcaatgataaaa

SEQ ID NO: 86335 - DNA, 683 bp, Heterodera glycines
  SCN-specific regions: Sequence locations=1-458,480-683
aaactctaaatatggacagacgtgctttcgattcggcaccaaacaaagaatttactccccacgaattggaattgcgtccccatttgtccttcttggaacggtaccgataggacccaaattcgaactcatgcatccgtttggaaaatgttcccaaaatggtttacgcggaacaactcgccgaatttctcggtgtccaattcgatgcgccatatgaaaacattgcgcggatgcaaaacggcgtcctttacattaatttggtaagcatttttttgcaaaatggcattttcaggaaacccttgagctcaactcgccttttgaggcggtcagcaccgtaaatgggcaccaatttatgctgcagtcgtccaaggggcggaatccgtactgtgagacgtgtctgggcacaatttggcggcttgcgcagcactggcgaagatgcaaaagttgtggttatcgaacgcatgagaaatacattgacaaagtgcggcgcgtttgtccgagtttggccctggcgagaacggaattctctctccaattcgatttgtgccccgagaaatcgctgcttgaacaaaattatcagtgcgccgaatgtttttgcccatcggattcgacgacgactctgaaaaactgcctcggatttgcgatttcaccggccttttctgttgtcggcgctgtcattggaacga

SEQ ID NO: 86336 - DNA, 543 bp, Heterodera glycines
  SCN-specific regions: Sequence locations=1-543
attccaatgcatcggcccaggcactgctcagagttccgcccgtttatactcaacagaagggcagtgccgtgccgtccttcgcttcatcttccgtaccgtatgcccaacaacaacaacgacagtacccccaaaacagcgttcagtcttcgccccactcgcactcattgtcagcagcctatgcacatccacaaccccttttcgtgccctcctcctcctcgccaccgttccaacctctccaaattcgaccccagcaaaatgccgccgcaattcccagcgttcggcaatcctccgtcccccgaggggatgactttgaccgggcgaatgcctcgccaaaaaacaaaattccaccggcagtgtgcgcagttttctccgttttggaagtgctttttggcgtcgtctcactgttcgtgggttcgtccgtgcccaaatgctttgagtctctccaaattcgcccgtcccattcgcaggtgcgctcaatgcgaatccgtacaattgcctcatccaacccaacgtgcccatttatttgatcctttccggcatcct

SEQ ID NO: 86337 - DNA, 209 bp, Heterodera glycines
  SCN-specific regions: Sequence locations=1-44,70-182
cgaaaaggggaaggagagcaatgcacagaagacggacggagaaaaggaagtgaagaaggaaaagaaggatgctagagagtctacgaaggtggcagagaagaagagcaacgagagactaaatgaaggggataaagatgaaaagagagttgcacggaatgaaagcaatgggaagaagagtgatcaaaaaaaaaaaaaaaaaaaaaaaaaaa

SEQ ID NO: 86338 - DNA, 109 bp, Heterodera glycines
  SCN-specific regions: Sequence locations=1-109
caaaccgattgttagctgtcgtcccttttcttgtccgtacaaattttaatggcgctcgtgttgtgcatcgggcacttgatcagtctcgtgcattgctgcattgtccgtc

SEQ ID NO: 86339 - DNA, 622 bp, Heterodera glycines
  SCN-specific regions: Sequence locations=1-246,268-407,429-444,500 -586,608-622
actcggtcgttgagttgcgcaacaaaatcgaaacggaggcaacgcgaacgcgaaagaacccgggagaagtgctgctgaagatcatccgcttttactcctccaagctgaacgttcagatgagcaaactgcgcgaccgcagttcggagttgctttcttcttcgatgcagaaacaaattctgacattgactgcatacgttcagcaattggatgacagttttgtgaaggcaaaggacatcgacgaggttaagcaggaggtgctcgaagaagccaagcagaagctgttcgacatcgctcgttggtcggcttcgctgagccttcgcgggccaccgaagacttcgacggctgacgacgtggaacatgaaaacctaagcagtaacatcgaaacggagccgaagcaggaggagaccaaaggggaagaggaggagacgctgcagcagtcgatgaaggaagatgaggaagaaaagggcgaagaggaggaggacgaggaagaagaggaggactaagcaaattaacacagtgacagcggaaaagaacacttcgcctaatttgacatcctgagttaacgtataagacagttttgatgtcgtttttataatttaaattaattgaataaagggaatcg

SEQ ID NO: 86340 - DNA, 648 bp, Heterodera glycines
  SCN-specific regions: Sequence locations=1-331,353-648
gaccttttgactatggctgccgtttcctctgctaaatcttcctccgccctcaaatgggtttcactgattgtgctcattggtcaaacgacagcgctcgtgctgactttgcgttattcgcagacccaaaaatcgcatccctccgacgggcccaaatatttgtcgtcgactgccgttttgatggccgaaatagtcaagtttttcacatgtgtctccgtcttagggtatcagaacaaatggaattttggccgtttgttgcacgattttgacgggagagattcgctgaaagtcggcgtgccagcgttactttatgttgtccaaaacaatttgctgtttttggccctttccaaattggacgccgccacttaccaagtcacttaccaattgaaaattctgaccacggcctttttctccgttacgatgttaaacaaaaagttggacctaatcaaatggatgtctctcattttgcttacttttggcgttgcgcttgtccagctcccaaaaagtgccgaaagtccgtccctcgctgtcgatgaaaaggcatttggggctgacaatccgccgcaaaaatcgaccggcgatggattcgtcggacttttcgccattttggccgcctgctgctcaagcggatttgccggcgtttatttggag

SEQ ID NO: 86341 - DNA, 591 bp, Heterodera glycines
  SCN-specific regions: Sequence locations=1-232,254-354,376-385,408-591
ttcttaaaccataaattgtgtacaatattttaatttctttacaaaaaacaaaataaaatattcgttttgaatggattacgccaatcgtacacatgttgttggggaccgttccgcaccagaattgaaacgggaaccactgtgatggcattgttcggatttgggctcggaattctttctgcaatttccagctatgttggctttcacaacatctatgccggaatggtgtacctggcttcgtctcttttctatctgtcggttattattgccatgaaaaagaaggagccgtcactgttcctgccttatctgattttcgagggcatcggcttgttatgcgcagcggtgatctcattgactatgtttatctttggaatttggtctccacagcaagccttctctactaaggaacaggaaatgaattttcgttccctcatgcttttctttgccgccaccgtgggcattgacgtcgctttgaacgcctggttctactccatcatttaccgcacctacaatttgctcaaaaagacaacaaagttggtggcatcggcttccaccgtcgcttcggcacgcgtgccgccgcccgtgtgatttatg

SEQ ID NO: 86342 - DNA, 574 bp, Heterodera glycines
  SCN-specific regions: Sequence locations=1-486,508-574
cacccaacgcattaaaatgaattattttattatcaaatttcttcctttaattatttatttctcccttttctaattgtaactatttgcggaagttaatagagacgaattggccattttactaatttattaaattattgcccgcaggcgttttttaattatattctaagataagaaggcctgaaaaaaaattagcgaaattgttagaatctttcaaaaaaattttaattgagaattaattgcagtttgacgatgaagcatttcttgccttcgtgaaaggacctgccaattttgacaaattttgcgccggaaaaggggtcactaatgaccaaagcaaagaactgttgacacaaatttatggcactcatctaggcattttgttttacatgcgaaagaattggcattgtgccaatgttaggaaagaatttgaagaatttatcgacccagaggaatgtcaactgtttcaaaattatttgtgcattgtttacgaatttttgttcaatgtttatgccgaacaagaggatataatgaaaccaattctcaagccaccaattggatttcgaatatcaattttgat

SEQ ID NO: 86343 - DNA, 591 bp, Heterodera glycines
  misc_feature (8)..(8): n is a, c, g, or t
  misc_feature (17)..(17): n is a, c, g, or t
  misc_feature (589)..(589): n is a, c, g, or t
  SCN-specific regions: Sequence locations=1-207,229-591
agatgggntctcctttntactggctcgtattaattattttcgtgctttttcttcaactgtttcaagatctttcaagcaggtaaagcataccgtccaggacaatgttacaaccattgaattagtcgatgttcctattgcgtcaactcatagagaattgaaggaatctgctgctactcaatctaaaactccggatgactgttcttgtgttttatgcaaaattccaacaagcatttcctacaaagatgtgcttattctggaacaattcatgcgattggacggcactgttttcccaagacaattaactggtctttgccatgaccagcaacaacgacttgagcggtgtgtgatgcaagcgcattggtcgggacttttcccggatcggactataccggaatttgaccgtgctgggtacaagcgattcaaccgacattgggacgacgatttggcaatgtttcggctgaagtacaaattgcaccctggcagttggttttacatcaaacggtacaatccacgaattcgagagtaccgcccattcaaagccgacgaaattcctgacattgagagagagtgatttattgtgaattctctnta

SEQ ID NO: 86344 - DNA, 638 bp, Heterodera glycines
  SCN-specific regions: Sequence locations=1-215,248-330,352-452,474-638
cattgaaggattgttgcttggtgacgctaaaacagaattggatgcgttaacagcagaaccaccggcagaacggagaatggcactgttaagccatcgctgatttgcgggaaggaggaggaagagacggagcaaatggccgagtcgaagtccgaattgggcgacgaattgtggacgggcatggaagggcctccggtgaaggaaatgaaactcgagacgagggcggaggaggaagaggacgagttcgacgaacagtttctaaacgaacccaaaacaattccaatggacacagaaacactcactgccgcggattctctccgctcgcatttcggctcactgaccaaaggaattccaaaccgaatgcatcgttcgtctcttctcagtgcctgggaaccgccgacttcgtccgcatctattctcaaaaatcccgaacaacagcggccttcccttttgtcggacattacagaagtgttcagtgcacaacaaaatgtactcggtccatcgacttcaattgggaaaattacggaaatgactcacaatgttccgttccaattcaacgccaaagttaccgttaaagagctcatctcccaatcatttggagagacaaaaggcgaagaattggccaaaattgtacaagccaa

SEQ ID NO: 86345 - DNA, 516 bp, Heterodera glycines
  SCN-specific regions: Sequence locations=1-415,437-516
cagtcctccgcgtgcgaacgaatcgacgaattgcatttggagctcaatttcactattttggacatcacttctattgaaagtaaagcattgacaaaatggttgaccggcaaaaaggcgaaaaaaagctcaaaaaagttgctcattcgaccccgaagtcgtgaatttgccactagttggattcgcatattgcaatcggatcgtctcgacaacatttaccaagtgcgcgttcaatgcgagttcagcctcgagcaattctccattagttgtggcgccaatggaaccatgaccatggaaatgcgccaagacgggcagaaggattacttattgaacaaataccccaccggagagaaaatgccgccgaattacgcctttcagctgaatgggcctctcattaaggtgtcctttgttgcacaacagaaatcttgagagtgttgcttctgacgcggttttattcaatttctgaaaatggatgaatttcttgctccggatgaccacattattttttgtcttttccct

SEQ ID NO: 86346 - DNA, 560 bp, Heterodera glycines
  SCN-specific regions: Sequence locations=1-504,526-560
tccgccctttcgactctttggcggcttttctccttttataaagcgtcactgtcgcgcagccaaagcgaatcgaagccgacgaattcttttggcagtctcgctattaaacctccgactttggcaaacactcattgtcagttcaactacaacaacattttggcaacacttggcaatggcattgattatcatcgtcagaacagtggaacaggtgaagggactcagcttccagtgggacctttcggtgtttttgctgggttttcgcctttctccaagccgtcgctgtcgcgcagtcaaagcgaatcaaaaccaacgaattcgacgaattcatttgccaacatcgccgcaaagccaccgactgcggcaaacactcagtacaattacaaccagcaacttcgcatgataatgccacaaccttcggtggtgtccaaaaagaattcaccgacttcacagaatgataaacgaatggataaattggaaaatggtgagacgaacacaccatcattgtgtggggatgaagaggagaaacctgcaaagaattaccttcacaagacccaaatttg

SEQ ID NO: 86347 - DNA, 595 bp, Heterodera glycines
  misc_feature (41)..(41): n is a, c, g, or t
  SCN-specific regions: Sequence locations=1-595
tcaatgaaccgacaaaagcgccaaaatttaaattcaatttntaaaaagaaggcaattgacttggccctcaatcagtcccctctctcggtacgcttatcattgagctgtttccatctctttctcacagcagaaaaaattaatgagcggaacaaagtgaaagtcactcttttgtcaaaacctcagtgtgatgcgaatggttatgagataattgtggactataagctaattgtgggaaattggaccaaattggtacaaaaggacaaatgggacgtggaagaaacgctcttaagcatggagcacgactcgtgttacattgacactttggaagtgctggccaatgtgagggaaactttggccccacaagacatcaaaacttcaacaggatttcgcagttttaatatcttgtgttccgacagaagtttttacgtcaacacgacacatttgaatttgttgggtggccgaatgttcaaggaatggtatgaaagagaatgtcaaggggagaaaaacgctgtcatccaatcgattgacgccaatgaattagaaaagttgctccaaacttgttgtgcttacgggtcaactccaacgataccacagg

SEQ ID NO: 86348 - DNA, 516 bp, Heterodera glycines
  SCN-specific regions: Sequence locations=1-404,426-516
atcgccaaaaaagtgaaccaattggaggacaaaaaggaaaatgacgttgaagaaaaggcggaagaactgaagacacagggggacaccttcaaaaaacagctgaacaatctctttgctcaggttgacgatcgtagacggaagcgcgacctcccggactatttgtgtggcaaaatcagtttcgagctgctcaaagaccctgtaatcactccttccgggatcacttacgaccgacaggacattctcacccatttgcaccgagtcggacatttcgaccccgtcacccgggttcctctcactgccgaccaactaatcccaaatttttccatgaaggaggttgttgaccattttgttcaggaaaacgaatgggctatagatttttgaatttgtttcggtgatttgatgggtttattcctgaaatttaattccgatgggcacgtgccgatgaaagtgttaatatagtattctatttattttgcctgtattactttaaactcaaccaaagtgcctttttaacct

SEQ ID NO: 86349 - DNA, 559 bp, Heterodera glycines
  misc_feature (5)..(5): n is a, c, g, or t
  SCN-specific regions: Sequence locations=1-559
atgcngtcgacggacattcagccgaacgcacggaatcgcaaaaagtggtcgattggatttggaaaaccgagcaaatccacacttcttccgccgtttgtcagcttcctccgttactttggtccttttctaccattcgcttggcacacgttcggtcagtcagaaattgtgctgcaaaatatttttcacacttaacaatgggacttggccgtcggctttatcttatgacgaggaccccaattcgaattgtccctaccaatgcatctacacaacggaacgaacggccgaggcttcggcctcagtgttgctgttccacgttttctggtcgaatccgatcggattttggcctttttggagctggccccagcatcgcagtgaagaacaattatacgcctttttcactcaagagtcgccatattacgcgggaagtgccttcaacaaattgtctaacgattggttcaatttgtccatgacttaccatgctgacagtacaatagccacaaaatacgatgagttgttggagcacagaagcggcgaaatgctggcgggggaagacgaattc

SEQ ID NO: 86350 - DNA, 428 bp, Heterodera glycines
  SCN-specific regions: Sequence locations=1-11,33-428
gcagtgctttcggccgcccctccaccatttttgcccggttaaccgtggcggacgaacacacaaacgatgcgggcattatgcacacaggatttgctgcagcaatggccgacgtgctgacggctgcgaccgttcgaatcaccgccgcccaacaaacgcccgtcgtttcggtggaccttacaactgcaattgttcaacctgcccgaattggtgacattttgttgatggaggccaactgtttgcaggcggaccggtccattgcgttcaccgaggccattttccgtcggaaaagtgacggacaactgattgtgaaggcgagccaacagttggccatcctccattatttgccattgaaaacgaagggaaagggcggtgacggaaatgacgccaaaaaggggccgactgattgtgaacaacagcagcagcagaac

SEQ ID NO: 86351 - DNA, 556 bp, Heterodera glycines
  SCN-specific regions: Sequence locations=1-455,477-556
catcggcgaaacttccggctatttccagcgtctgctcatttcgctgtgttccggcgcgcgtgatgagcaaatgcacaccgacccaattaaggccaatcaggatgcccagcgattgtggcgcgccggtgaggcacgcctcggttccgacgaaatcgccttcaactctattttggcggtgcagaactttgttctttttcgcatggtctttgacgaataccaacgacagcatggccattccattgaacaggcaattagcaacgagtttagcggtgacattcgtgatgccaatttggctttggtgaagagtattcgcaaccgtgcctcatatttcgctgagcttctccacaattcgatgaagggcattggcacccgcgacaccgatttgattcgtctcgtcgtcacccgctccgaagtcgacttggtcgacattcgccaggcatatcaaaatatgtacggcacttcactggaaaatgccatcgctagcgactgctctggcgcttataaggatggtttggtcgctattgtgaagggatattaccactgattgcttggcact

SEQ ID NO: 86352 - DNA, 612 bp, Heterodera glycines
  SCN-specific regions: Sequence locations=1-24,46-124,154-612
caggtgctccttccgctcatccgtcttccccttgctcttcctctttgcttcccccgcccgtctcgtctctctccgtcccattgcatcaccgatccagcatttctggcggcgggtcccgcccaattgtcattcggaaagggccccaaggcttcggattttccatacgatccgtccgcgtttatttgagcgaaatgtccgagtattactccattgaacatattgtggccgctgtgcgcgagggttcgcccgctcgggaagccggtctccggacaaacgatttaatcacgcgcgtgcacacccaatcggtccacaacatgactcaccccgaaatgatgcgccgtctcctctcctgcggcaatgaactcactatccatgtcgttccattgtccagcacctccataaaagagggcgaaccgcgtcgaaacattggcaaacccttgcgcaagaagccgcgacggccgccaaccgcacaacagaaaaacaaacaacagagtcgcaaaggttctgcacttctgcgacgactcagcggcaaacggacagtcggagacaccgttcccggcacttcgtctcagaagcaaatgttcattccccgttccgtgtcctcccaagaaa

SEQ ID NO: 86353 - DNA, 611 bp, Heterodera glycines
  SCN-specific regions: Sequence locations=1-119,141-611
acctcgtaatttctgagaaaccgacagttttgctcacgttcacaacagcgccattctcagcaacatcgcacaaaaatggcacgccgacgaagaaagaaggagccgcgaaagcagtcgtacaagctgtacgttcgacgtgtgctgaaggaagttcatccgggcaaggaaatctcaatgcgtgcgttgaacatcatgaactccttcgtcatcgacgccttggaccgcattgcaacggaggcgacgcgaatggcccacaacgaccggcgcaaaaccatcacgcttcgcgacatggagttttctgtccgactgtgcctgcctgacgtcatggccaaagatgcgaaccagaaggctcagaaaacggtgaccaagttctatgctgcaaaagtgcgggatcggatgagaaggacggagatgcgtcgtggcgaatttgcgatgatgcagatggcagcgctgtgagcacactcaacttttggacgaccggcggatgaagccacctgtatattgttgatgattggccccgtatcccccattactgtatgtgtatgtattatacaatgtatctaccattcttgtgtgtgtatgtattattcactatgtgctttatatgtata

SEQ ID NO: 86354 - DNA, 671 bp, Heterodera glycines
  SCN-specific regions: Sequence locations=1-279,301-497,519-545,579 -623,645-647
catgaaaatggcagtgaacaacacagaaagactccatttcagcagttttgccagtcaaaaatttagcctacaaaatttccaaaactgtaacatcgttgaaaagctgaacattaggaacacgaagcagttcaacattgacattcgcgtcgaggagggcaatgggctgttcactgtgacatttgacacgggcggaaaagcgacaaaatgccaatacagaagcccagatatgccaacatgggcagtccaatacataacagtgagaactgaattagcccaactattttgaaagaaatggaaaaaacatttataaaggaatgaatttcaaaaagtcagaataaaaatgggggattaatcgcaatttaaagctatcgcaattttatccaaagtgctaagtgaatttttacactttctcctaaagattgagtttaaaaatgaccgtccgcgggcactttcgcttcagccggaaatcacatgcgaaccgcccgatcgttgcataggagtgaatgaattgatgaagaaagaaattcatgattagcttttctatgttaaatttaaattatatttatatagataaaattgatttccaacaaaataattttctttttgtaaacaaaaatttctcgaaaaataaatcatttatttttcccaaaaaaaaaaaaaaaaaaaaaaaa

SEQ ID NO: 86355 - DNA, 705 bp, Heterodera glycines
  misc_feature (2)..(2): n is a, c, g, or t
  SCN-specific regions: Sequence locations=1-81,103-216,239-705
cnaattcctcttcgccgctttctgcgccttttgctgctcattttcggaaattcgtctgaccctgcccaaattgtgtctccgtgggcttggcgaatgccgtggctgcaatggctgcttctcttttggtttctcattttcatgcagcgcgtccaatattattacgcgtggacaatgaccgatgccatctgcaatattagcggttttggcttcgatgggttcacaagcgatggaaaacccaagtgggacttgaccaccacagtggacgtgtggaaagtggagacagcgcaaagtttcaaagaaacgctggacggatggaatttgaaaacgatgttttggctgcgttacattgcctacgaaagaatgccgaaaaactacagaacattgtccacctacgcactttccgccgtttggcacggccttttcatgggttattacctttgttttgccaccggtgctctgataacagtcgccgggagaatgtctcgccgttgcattcgccaccatttccaacggaatgcatttcttcaccatttgtacaatttgctgacttttttggccaccaaattcgcactcgcctacacaacatttccatttgtgacaatgcatctgaacccgggcctcctcctttacaggcgactctttttcttcctgcattttctcgcattgttcgccattttggcgctcccccggcttttgcctccggag

SEQ ID NO: 86356 - DNA, 683 bp, Heterodera glycines
  SCN-specific regions: Sequence locations=1-36,63-214,237-430,452-683
tgacggaagttgcagaaacggaagaaaattgggacactttatttttggaaagaaaaacaaatggaactgccctgaaaaggcgaacgacaaacaaagaaaacgtccatcgctacaacgtaatgatgcaactgctgggcaaatgttggaaaattgtaacttactccggtttgctaacaatgcattgcgaaagtattttctctaccttaaagcgaataagaaatttttagaagaagacagagataatcgtggagctgaacaaatcattaaggcgaaagacgatttgttgaaaaaattgtcattgaagccctcatttttgcagttatcggaaaacaatttgtcgacggtaaaaattgttctgctgaaggcatacaaacacttcaatttgcaaactgaaaaccttgaagaaaatgaattcaaattaattacggaaaaatttgtaaattttgaaaattgtgctaaattgatgaagttgagcaaggcatttcaaaaaaagaagtcattagaatttccaattgatgatacgatgaacagataccgtaaagcattaggaaaaatcaaagccaaaatggaagatgacgatgattattgtataaaatgcaaaattcctacagtcgatgaaattataaacggaaaagaagcaaaacttaaggaccgtttcgaagatgcatttcaaaaagctacca

SEQ ID NO: 86357 - DNA, 573 bp, Heterodera glycines
  SCN-specific regions: Sequence locations=1-524,549-573
cgcaaactgactgtccatatgacggacgaaagcagattggaggatgtatacaaactgatttgggcaattggacgtgacccgttgacagctgagctgaacttggccgatgttggggtcaagctaatatttggcgactacatcaaagtggacgattaccaaaacacgaccaaggagggtttttacgcggttggcgacgtctgcacaccgaaattcgaactgacgccagttgcaattgccgctggtcgccgtttggcccatcgtttgttcaacaaggaagcggagaaccgtctcacctacgaaaacattcccactgttgtgtttagtcatccgccgcttgccacaacgggcctcagtgaaaaggaggcagtggagcgcttcgggcgtgaccaggtgaagacgtacaatgccggcttcacgaacatgtactttgccatgactcaacacaaagagaaaacccacatgaaaatcgtgtgccacggaaaggatgagaaggtgattggattgcacattttgggcatgggtgcggacgaaatgttgcagggcttcgctgtctgtgtgaaggcgggtcttacc

SEQ ID NO: 86358 - DNA, 308 bp, Heterodera glycines
  SCN-specific regions: Sequence locations=1-59,81-308
tttaattttttgtctgttttttaataattagttaatttttttgtcggaactttcgttcattgtgtgtctgtcctctctctctaattataatccttcatcttctttgttctttaatctgaatctgctaatttcgtcttgtaaacatgcattttcatcgtcacgctttaaacagtcaattttatgactgactgactatgaattaattggtgttacattttttaccatggaaaatcgtcatcttgggatagacacacccaatcattttttcttgctatattctgtcacaatattgtttgtgttggaaaaat

SEQ ID NO: 86359 - DNA, 632 bp, Heterodera glycines
  SCN-specific regions: Sequence locations=1-416,438-632
gatgtccatgcttcgtccgtccgttctgcccttgggcacttctgctcgtccattggtcctctcctgcgtggccatcgtcgcctccgttggcattgtctgtgcccattcccaatcgaagggtatttccggcgccccactcaatccgagcccttcactgctttttgtgtgtgggctgagtttcgccacgcttttctccgtcattttggccatgttcggcctttcttggctccgtccgatttttcttttgcccattatttgcgcctcgggcgttgtctgcgtctttcacactctctccgtggccaattggctctccgactggtggatcagtgctgatcagtcactcgacttggattggctgatcattttcacctcggcgattaccttccaagcaatttccatgctggtcttttctttaaaagcatttaatgattttcaaattgttaaggccttttaccttcaaattcgctgctatcgccttttttgacagtcaaattcaaaatattccattaattgttgcgttaataatcgcttcgactgctgctgaaagtgagctatttctaaaaggtggcggtaaatcatttttatttccataggccattttcaatattttttaattgaatgaaattccctgg

SEQ ID NO: 86360 - DNA, 423 bp, Heterodera glycines
  SCN-specific regions: Sequence locations=1-423
attgaaaatggcagtgaacccacagaaagactccatttcagcagttttgccagtcaaaaatttagcctacaaaatttccaaaactgtaacatcgttgaaaagctgaacattaggaacacgaagcagttcaacattgacattcgcgtcgaggagggcaatgggctgttcactgtgacatttgacacgggcggaaaagcgacaaaatgccaatacagaagcccagatatgccaacatgggcagtccaatacataacagtgagaactgaattagcccaactatcttgaaagaaatggaaaaaacatttataaaggaatgaatttcaaaaagtcagaataaaaatgggggattaatcgcaatttaaagctatcgtaattctatccccagtgctaagtgaatttttacactttctcctaaagattgag

SEQ ID NO: 86361 - DNA, 320 bp, Heterodera glycines
  SCN-specific regions: Sequence locations=1-167,189-269
gaagaagctgcccattgagaggggtacatggaaacggcgacgatttctcagagagattggccctaatgagagagaggcaaattaaataattattaggacgattttcacttttttttctctttctcctgctgttgttagaattgatgttctgtcatggactgattagtttattattaaattaattcactctgaccaatttcattttaacctttgttttggccggtaagacttttttttttttaaataaatcgataaatatttacattgctaaaaaaaaaaaaaaaaaaaaaaaaaacgtccaaaaaaaaaaaaaaaaaaaa

SEQ ID NO: 86362 - DNA, 664 bp, Heterodera glycines
  SCN-specific regions: Sequence locations=1-10,42-194,219-664
caatttgtttgtggatgatgaggacggcgaaggacagcagcaaaccctgcttatcctgaacaatgttgatgatgatgatgttccactgctgccaatgacgacgacagttgaaatgtcttccggtgctgcaacaactgcttctgccgctgctgttgctggaactgctccgtccgctggccctatgccctcatgcatttgctcgtccacctcacagctgttgacagcggccggcatggacggcattccgccggccaaaacgcccgcaaattcgggcccggacgcaaattttcttgccgattcgttgggcgtctcaccgctataccgccaagaagatactaaacgatggcaaaccgccgccaaagtgtaccagtcaagccgtagtcaaatgcacagtccaacctccggcacttgtgcaccgcagcactttcattttggcgaatcgctgacggcggagggccatttgacgcaaaaaattcgccaatgccgaagcagcggttcccccatttcgttggaggacattgccgcggtgaaccgccaattccatcggcaaatggacagcggacagcgccggcgggtgaacggcccggcgctgaacggctcgctggagttggaggcaattgcggcggtgcatgaactcgcctcacaggtcaaacaaatctctgtc

SEQ ID NO: 86363 - DNA, 730 bp, Heterodera glycines
  SCN-specific regions: Sequence locations=1-514,536-730
ggctgcccaacgccacggttcgcgtaacactaacaacaagacgtacaacaaccacgacgaggacgacaacaacggatacatatacaacccaacgaaaagtgaccttctacgaggatgatgttgatgaggagttcgaatttactggaataatttggccaaagggcatttatggcgtatacgcggacatcaaagacttcgacatgtcggattcggagaaagtgacaacgcgaaatgcgcggccaaaagtgttagacaccagagatgatggcaaatttacggcaaaatttatcgcgcccagaagcagggagcccgactcggtgttcctccacatatttgggagcaaaaaagatcctcatttgtatttggacgtgtccgaagtgcaatggggcaatgtgtacatttttgacttgaacaaaacggaagtgatcgctgttcggccgcgcagagttgcggatgaattgaggaagttggaagaacgggaccgaccaccggtgaagagggagcaaccaaaaccgcaaccgcagccacaagcacaacctcaacctgtgacttttcaaaaaattctgtccggtttggtttggccaaccactgaaaagtacaccctgctggtgtcatcgcgtgattttgatttggatggacgaggatcaccgatcaaacaacgcgccaccaatcccgacccgaccagagccgagacaaactacaagggcacattcgacgtcaaaatggcact

SEQ ID NO: 86364 - DNA, 686 bp, Heterodera glycines
  SCN-specific regions: Sequence locations=1-35,58-169,191-686
ccatttctgttggaggggcggactgaatgtttacgatatttatgaaaattgcacgccgcacccaaacaatttggacataatgagaagaggcattttcaacgcaaagtcaatgcactcaaacgattcagttttgtggcggactgacgacgcttttgaaaacgccaatcagccgaaggaggaaaaagtgaattatttgctccgctgtttgaacggtcaaccattggttgattatttgaacaaggaccaggtacgaaaagcgctgcacattccgccgacagtaccctcttggacccaatgcagccgatgggtggccatgcattaccgtaaccaatacgccgacatgtcccatttcgtgtggaaagcgttgtgggccaatgttcgggtactgctcttttacggagacacggacatggcgtgcaactttctgctgggccaacgcttctccgaaatgctgggcttaaagcgactcggcactaatctttggcattttggtggccaaattgccggcataaaaacggaatatggcagcggacttacatacataaccgtgcgcggtgctggacacatggtacctcaaaaacgtggaagtgaaattgaatatgcgatagggcaatttccgacaaacagaaccatttgagaaaatacagctacaatttgcaggctaatgggttcatccaattactgtt

SEQ ID NO: 86365 - DNA, 685 bp, Heterodera glycines
  SCN-specific regions: Sequence locations=1-228,250-685
taaaagttattgcgcagacattggacatttaattgcaaaccgtacattcgtgtggtcaactttggcctacaccgccgtggtttttgtcaccggaactttgtcatggggtcccaccgccatggaacacgccaaagcgatggacgaacatttgaacgacacctcaaaattgagacctgccgaaaagaatcaaattgcgctaatttttggagtgatcacttgcgttgccggaattttggcgtttcgttgggcagtttaattgcgcagcattggaagacgggcaaattctgttttgcgcaccaccgctcgggaagggccgatccgatcgtttccgcggtcggttcgttcgtcgccgctccgttgatgttcgtcgcgttctctttgatcaccactgatcagcttctgtcatggttcgtcgttttcctcaccattttgtgtctctgtttgaattgggccattaacgtggacatgctaatgagtataatcgtccccgaaaggcgtagcattgccagcgccattcagattctcttttcccatttgttcggcgatgcctccggcccctatttggtcggtgccatctccgacttcgtccgcggctcttctgatttgccaaccgatcgtttccattcactgatcttcgctttttatctgcccaatgctttgctttttctcagcggcgcggcatttc

SEQ ID NO: 86366 - DNA, 691 bp, Heterodera glycines
  SCN-specific regions: Sequence locations=1-691
caatccgatgtatgtgaaggtgatacatccctacggcgaagtgttgcacgtcgactggaccaaacagtacaaagcattgaggggcaaaattggcattgcctttcccgggtacatgatccacgagtccggccaatggtccgacattcacaagaaatggtttttcttgccgagaagagcgtcaaacgacacttattccgaaacggaagatgagcacatgggcaccaatttattgctgatagccgacgaggactttgaacatattcaggtccgtcacattgggccccccggcgatggcttccgcggtttctctgccttccgatttttgccaaacaccgaagatgacatcatcgtcgcgataaagtcggaagagcgaggcggcaagccaatcgcctcctatttgttcgtcttccgtctcagtgatggccatgtgctgttggacgaccaaaagtttgacgggccctacaaattcgaaggggtcgtcgtgtactgacagagcaaattgggcaatattgttgtggagtcagagtttgttatttgtgtatttaaaaaagagcagacaaaacgccgtcggcggaggagaaaaagctgacaataaatattccatgaaattttttaattaaaggcatttggaaccactcgaaacgcaactatttttttttgcttttttaattattttgcccacctcatttgg

SEQ ID NO: 86367 - DNA, 714 bp, Heterodera glycines
  SCN-specific regions: Sequence locations=1-396,420-444,466-714
aagcgaaaatgtcgctgctgagtgttctcccgacgcgtcacttaaggggcagttctgagtaacaacaaacaatttcttctttctcgatatttttccgtctcaaatttggcaatgaaaaaaattcgagtcgccaatccggtggtggatttggatggagacgaaatgacgaggataatttgggctggcatcaaagagaagctgatcctgccctatctcgacatcgacatcaaatattacgacttgagcatcgaaaatcgagacgccactgacgatgaagtgacagtggacgcagcggaagccatcaaaaaatacaatgtgggcataaaatgtgcgacaattacggcggacgaggcgcgcgtgaaagaatttggccttaaaaaaatgtggttgagtccgaacggaacaatccgaaacattctcggggggacagtgttccgtgagccgatcatttgcaagaacattccccgagttgtgcccgggtggaagaaggaaattgtgatcggacgccacgcatttggtgaccaatacaaagcgacggatattgtggtgccgaaggggtccaaatttgaaataaacatcattaaaagtgacggacaagttgagaggcactcggtgttcaactttgccgatacgggcggtattataatgggcatgtataacacggacgactccatccgtggctttgcccattcctgcttccaatacgccctcaaa

SEQ ID NO: 86368 - DNA, 657 bp, Heterodera glycines
  SCN-specific regions: Sequence locations=1-199,222-224,395-607,629-657
ccacgaaccgcttcagtgcgcaacgcaacgcaatggccacttacctattcatcgctgctgctgccttcggagcaggaatttactgttggaaggcgtacctcggcccgatgctcgaccaacctattagcgacgacgaggagaagcccaagccggaaggaggcgaagaatctactaccgccggcgacaaggaggatattaaggctggcagcaagggcgacaagcacaagaagaaggacaagaagggcgaaggcgcagcagcagcaccagcggcggacaaaaaggaggagaagcgcaaggacaaacaccgatcgaaggaggcggggaagagcgacgacagcaaagcgggcaagaaggacaagcacgggaagaaggacaagaagggcaagaagaaggacaccgccgatgcatccaccgtggacgaagcgctgggagaacagagcacagcggagacgagccaagcagaggaatagccaggccctgctgcgtgcaaatgacagtgttcgacgacgacgtctcgcgacaccaacacacccgtcccttgctttcgaccattcccttcccatccgattgctgtgttttgtctgttccaatgcttcctaaatgttccccttgtgaacagtgatccttcctcatatgacctgaatatgtatatattgt

SEQ ID NO: 86369 - DNA, 528 bp, Heterodera glycines
  SCN-specific regions: Sequence locations=1-528
tttattgagaattttacatcgaattgtccgattgtgtcctcactgtgtctatcagacgacggaattattctgcgaacggtttctttaacgtctttccttttatacaaaaacgttctacgcctaagcctactggacctgtccgtcgaacttcccgctgttatcattcgaagtgatgtgcgacaaaagcattctgaaagaacctgctgaaaaggtgatggaacaaatggattctggcaaccatggaatgcttctgatgattacagtgaaattaaaaaacgtcttttgcgtcctccgaatgatttctccgagctcagggaaattatacgcaaagacattgaaagaatggcacagataaaggaggaaaacgtaaaaaagaggaagggaacgaccaatgggaagaagcaaatgacggatgagcagaacgaaacactggaagaagatgggcaggaggaggacgaaactcgcaggaacagaatgatcaagcgaatgttcttcgttttttgcctgacctttcctttctttgtgatc

SEQ ID NO: 86370 - DNA, 454 bp, Heterodera glycines
  misc_feature (379)..(380): n is a, c, g, or t
  SCN-specific regions: Sequence locations=1-322,373-380
gcttccatttgatgacacttattctgctgctattggttgttttgatggtccaactgaacgagtcggcaccggcagatggccaaggaggacacttggcaatggttaatgaagcggaaaacgaagccgaccattctcttaccgttttgcgctttaaacgttcatgtccacccccgtgtcaagaaaaagattgtccttctcctatgtgtgctctatgcagtttctgcggatgagcgttttaaaataggcaggcgaaaggaacatttgcgacgggatgacaaaatgaatgggaagaaaatgtgattttttaactaatttgatggacaatataattaattaaaaataatttttaagttttatgaaaataaatttaatgtcagcnnaaaaaaaaaaaaaaaaaaaaaaaaaaaaaaaaaaaaaaaaaaaaaaaaaaaaaaaaaaaaaaaaaaaaaaaaaa

SEQ ID NO: 86371 - DNA, 430 bp, Heterodera glycines
  SCN-specific regions: Sequence locations=1-263,285-327,354-403
tgacgatgggtcgttgagcgcggagcaaaaaatggagcgaattgactcgatcatttgcactctgccggagaatgtcattgaccaaattccggacccgccagaagttgcgcaactcccggctgatgtgcgccagcgcgtcaaacaaattgaacgccagcagggaaagtcattcagcactaaatttgaagagatcatgaaatatgtggacactttgcctgaaggcacaaaatcggctgccaaaaacattttccattgaatttttcatggaaaaggaggagaggaaagaagtggaaaaagcagcatggattaatgaaagcaaggctaaacaatatttattaaatattttattttttggtaaaatatttccaatttttcatttccaataaatatttttgctttgttgaaaaaaaaaaaaaaaaaaaaaaaaaaa

SEQ ID NO: 86372 - DNA, 320 bp, Heterodera glycines
  SCN-specific regions: Sequence locations=1-251,273-292
tcagtccgtttcctcctaaagcaataccttctggcagcagacttcctctgaaactgctctatcggctcatacactttgtaacgggctcctctaatttctctgttgcgtccaatttgtctcagcaaacaccaatcgctaatgtgaacaatgcattttcgttgaaaatgcgacctcccaaatcactcagtgaaattgttattaattactttagaaatgaacatttcatgtgtcgtgttcctgtcgctaactgtcctcccttttcccttttttatcctcatcgttgtcctgaaccaaaaaaaaaaaaaaaaaaaaaaaaaaaa

SEQ ID NO: 86373 - DNA, 732 bp, Heterodera glycines
  SCN-specific regions: Sequence locations=1-297,319-732
gtgattttgggtgaagtagcacaaatggcagtacaagagcgataaaagcagcagcagatgcacaaagaatttgcgaaaattgagggatggacgaagtgtggactttgacccgcggcagatgtgcaggcgtataaaagggcgaacgaaatgaccgttccatccaacgccaagcaaatcgcaaatccagcgattcattcagtcatttgcctacccaatttgtgaatgaaattcatggcgaagggcacaatgcattcgcaaattaaagcactaatgaccaacggtcattcttcccaaatgttttcccctccctcccattttaaatcaaattgcaaatcacaacaaaattcacagagccaattcaactccaaaagccgaaaatgtctcctgttattgcccctttcgtcctcgccatcattggcatcatcgccttgcccaccatcgaaggcgcagtcgggcgtcagcaagtcaagctgggcgagcagtacaaatacgagaatgtgcccggcaaattgatggtcaagcggcaaactgcggccagcaaggagccccagtatttgttcgccggtcaaacggcatggaccacggacggaaaagaccgctttggccatgccgagttggacttcgccactggcacaatgaccatccccaacttctccgagaacgacttgggctcctacaccttcccgcttgagcagcccaacttcagcgcagtgaatgggcccaacggatgcg

SEQ ID NO: 86374 - DNA, 656 bp, Heterodera glycines
  SCN-specific regions: Sequence locations=1-295,319-359,381-656
gtggggaaactgaggcacaattggaaaatggaatgcgcgagaataaaatgcattggccgagaaagtgtcggaaactgaggccaaattggaaaatggaatgcgcgagaatcaaaatgcattggccaagaaagtgtcggaaactgaggccaaattggaaaacggaatgcgcgagaatcaaaatgcattggccgagaaagtgtcggaaactgaggccaaattggaaaatggaatgcgcgagaatcaaaatgcattggccaagaaagtgtcggaaactgaggccaaattggaaaatggaattcaaaacaaccaaaaggcgttgtctctgatgaagaatatggcaacattagcgttctttcacttcccccttccaatttatcatcgatggaatgcctcggattgtgacccagaaattgtgatcaatgaaagcacaaatgccattcagcacaacggaacagaagatattgactggcgttcttgccgagcatggccaattcaaatgtcatctgctgttggtcgcattggcattatttatgcggaatatcggattcttgctataattggaggattgcgcattggactatcaacaaaagaaatgccattggaccgttgggttggaaatggccatgtttcgtacggttacgcatattatggagaga

SEQ ID NO: 86375 - DNA, 659 bp, Heterodera glycines
  SCN-specific regions: Sequence locations=1-441,465-659
agaagctgtatcacttggaggattttatcggtttacgagttccattcgcccgctttggatgatcccgactttaatgccaaaccgatgattttgttggtcggacagtattcaactgggaaaacgacattcattcgctatctgttggaacagaactttcctggaattagaattggtccagagccgaccaccgatcgtttcatcgtggtgatgtacggcgaagaagaagctgttattcctggcaatgcgcttgtcgtcgactccactaaacaattcagagcactgacaaaatttggaaatgctttcttaaaccgttttcaatgttcgatgctgaagaatgaagtgctaaatggtgtgacaataatcgacacccccggaattttgagtggcgaaaaacagcgaattgatcgtggctatgatttttctggcgtccttgagtggttcgctgaacgagtggatcgtattattttgcttttcgacgcacataaattggatatttccgacgagttcaaacgctgtattgaggcactttcagggaatgaagacaaaattcgaattgtgttaaacaagtcggacatggtcgaccatcagcaactgatgcgtgtttacggcgcactgatgtggtccctcggaaaagtgttcaaaacgcctgaagttgcgcg

SEQ ID NO: 86376 - DNA, 689 bp, Heterodera glycines
  SCN-specific regions: Sequence locations=1-278,300-689
atttggccgtttgctgttttggcattgtcgcgggcgctgtcggcggtgtttactattacaatcatgtccgttcaagtcgaattgacgaccccttcaacgaattcactcgctattcccccgccgggcccacaaaagacaaacttaagaagtcgggttcgcccatattcggtcagagcggcgacgacactttggcttacaaagcgcaactgcaccattaccagcagcagaaacagaaaatactgggcacagcgtcggggccggtggtggacaatgtgagcgacaacgaagaagacacggacgaaatggaccacaattacagcgtttttgagtgtccgggtctcgcaccaaccggtgatctcgaaatacaaaaccccaatttcgtgggcgctgagaagtcggcagccggcgaaacacgccgcacagaatgaagccaaggaattgttacccccttccaccctacatttattattgcgttccttcccaccaattcccttgtaaattaggcctcaaaatccccgtgaccgaccaaaacatccttttccccttccactgctctagtctgaacacttccgcacattccgaagttctgtccgattaaacattcctatttgagctattggatttgaatgtctacgctttggggggcttttcgataaacttgggcgcagtgttgtacagaaattgacgat

SEQ ID NO: 86377 - DNA, 506 bp, Heterodera glycines
  SCN-specific regions: Sequence locations=1-203,232-388,410-417,441-506
tgagccggacgcattgttacgtttggcccggtccgtatgaaggaatggcggcaactttgtgaagaggtggacgtggacgagttggaacgtgccaaacggtctcttctaccaattctcttctgatgttggatggttctacgcctatttgcgatgatgttggaagacaattgctgtgttttgatcggcgcatttcaacagaggaattggaagagaaaataaatgcaataacaccatacaccatacggatcatcggacgtcgctattttgtcaacaaaccttttgcctacgtgatcattggaaagacatccaactggccaaatcccatgaaaattcataagtggctgagctggtgacctgttcaatactttgtcataaatgtatgatgttttgatttgataattataccatttttgttgtgcttttattttgaaatattatttctatggtagaacaagcaacattcactttattgacttcaatacatgaaaatacaatattcccgacta

SEQ ID NO: 86378 - DNA, 658 bp, Heterodera glycines
  SCN-specific regions: Sequence locations=1-481,503-658
ttcggccgaattgcaccaagtcaaactctcaaatatggacagacgtgctttcgattcggcaccaaacaaagaatttactccccacgaattggaattgcgtccccatttgtccttcttggaacggtaccgagaggacccaaattcgaactcatgcatccgtttggaaaatgttcccaaaatggtttacgcggaacaactcgccgaatttctcggtgtccaattcgatgcgccatatgaaaacattgcgcggatgcaaaacggcgtcctttacattaatttggtaagcatttttttgcaaaatggcattttcaggaaacccttgagctcaactcgccttttgaggcggtcagcaccgtaaatgggcaccaatttatgctgcagtcgtccaaggggcggaatccgtactgtgagacgtgtctgggcacaatttggcggcttgcgcagcactggcgaagatgcaaaagttgtggttatcgaacgcatgagaaatacattgacaaagtgcggcgcgtttgtccgagtttggccctggcgagaacggaattctctctccaattcgatttgtgccccgagaaatcgctgcttgaacaaaattatcagtgcgccgaatgtttttgcccatcggattcgacgacgactctgaaaaactgcctcggat

SEQ ID NO: 86379 - DNA, 683 bp, Heterodera glycines
  SCN-specific regions: Sequence locations=1-3,30-559,585-683
atgctgctttcttcctcccttttcctttgctttccctctccatttgcaattccacttgcaatgagcagtttgcccattgttcgttctcaatcaacttcttacatcggatttccgcgcgctcgcgactttgccattggcgatgggcacgtgccatcactcatcatagtcacttcggtgcccaatttgaaccatttgcacgtgtcggatgcctatcggtcgtcaactttgtacaaataccgaagagattgggatttgttggactcggccatctccgaccattctcatcgtggtcccggcttccattgggtggatcgtcgctttcgagcccgtcgctttatgaacaccgacccaattcccgactcgctcgggttggactaccccaacttctggtcccgttacaaatggtactccgactatttggagccgcgtcattggcgtcgtcatcgagacccaaattatgaccgtcccctttggaactcgtggaaaccgtacattttggacgggaagaatcagaagcaagccatcgacatgtaccggcaaggactcgtctcttttgcctatttggacaaggattggataaccccgtgggcgttgggtcggaaggaaaaagactgggccgacatttacccaccggccggatagtacggctcacgccggtacatgtactcatgggcatgaacaaa

SEQ ID NO: 86380 - DNA, 627 bp, Heterodera glycines
  misc_feature (599)..(599): n is a, c, g, or t
  SCN-specific regions: Sequence locations=1-189,211-599
actggctcgtattaattattttcgtgctttttcttcaactgtttcaagatctttcaagcaggtaaagcataccgtccaggacaatgttacaaccattgaattagtcgatgttcctattgcgtcaactcatagagaattgaaggaatctgctgctactcaatctaaaactccggatgactgttcttgtgttttatgcaaaattccaacaagcatttcctacaaagatgtgcttattctggaacaattcatgcgattggacggcactgttttcccaagacaattaactggtctttgccatgaccagcaacaacgacttgagcggtgtgtgatgcaagcgcattggtcgggacttttcccggatcggactataccggaatttgaccgtgctgggtacaagcgattcaaccgacattgggacgacgatttggcaatgtttcggctgaagtacaaattgcaccctggcagttggttttacatcaaacggtacaatccacgaattcgagagtaccgcccattcaaagccgacgaaattcctgacattgagagagagtgatttattgtgaattctctttatttcatttgataaacgtaaacggctnaaaaaaaaaaaaaaaaaaaaaaaaaaaa

SEQ ID NO: 86381 - DNA, 471 bp, Heterodera glycines
  SCN-specific regions: Sequence locations=1-34,56-306,330-471
gaaaaaatgcgtgttctcccccttctcttttctgccctcctcctcctctctgttggcctttgctttgcccagtttgatcagtctccgtccgctgctctgaatcatgtgcgggccaaaagaggctacaagccgtggaagaagcaatccttctcctcttcttcaagcgaaatgtacagaaggagaagacccagtggtaacggtcattacagggattacaacggctacggtagcaatggatactatcgacgaaaacccggcattttagaacgggcgctgggaaaaattacgcggagctattaacggacgagcagaagaagagaagcaaaaagccaaacaatgggcgtaacacttttaattgatcaaacgatattacagtatccaacaccaaaattacagtaaccaaacatccaatggaacgaatgactcatttaattcagcaaatttgctggaattgccgataaagaaacttag

SEQ ID NO: 86382 - DNA, 617 bp, Heterodera glycines
  SCN-specific regions: Sequence locations=1-617
atgttttctgcgttggactttgttctgttcggcttgtttctgctcctttctctgttggtcggtctttggccaatttgccgcgtttcgtccggccgtccctcgccgcttcttcgtccacaaaagtggccccaccggtgacccgtcgaccctcaaacattcttccgccaatgatttcctcgacggtgggcgtcgtctccccgtgctccccgtgtgtctttcgctgctcaccactttcgtctccggcattggccttctttcgacgcccgctgagatttattcgcgtggttcggcctttgctttgttcaatctttgcggctcttttgccttcgctctcatcggcatcttcttccttcccatctttttcaaactgaaatgcctcaatgcgtacgagtacttcgagcttcgcttccagtcccagtctctgcgtcgtctggccactctcgtctttatggccaacactctcttttacatggcggtggtcatttacgccccggcaatttctttgtccggtgtcacttcgttgcgcctttggcccttcgttcttctcgtcggcgtcgtttccacaatttatacggctgccgggggaattcgggcggtaatttggacggacactttgc

SEQ ID NO: 86383 - DNA, 574 bp, Heterodera glycines
  SCN-specific regions: Sequence locations=1-574
aaattatcggtcccaacaatatcaaattggatgacttcaccgaccgtctctgttatcgttacacgcctgtgctacttggacttttcatgttcatcaccggaacagtggacaattttggctcgcccatccgatgtatggtgccacaggaattctcagcttcttggtccaacttcgtccatcagtactgctacgtgacggggacttatgtgaaaatagttgacccatcggatcagacggttgagcgcatttacgtcaattactatcagtgggtgccgtatttgctcattctgcaggcattgattatgcgtttgccgttaagtttctggcgtttcggtcgcagaatttcggatgctgactttgactatgtcaacgaattgggcctgaaggcgcgcacttcgactgctgaaaagcgcacggagtttcttaccgaggcagccaattacatttgtcagatagtcggcagtcgcaaaactcacaacggactcggttctttggtcggctatatgtatttgctctacaaaatgatcaacgtcatcgtggtctttgctcaaatttatatgctgaaaatatttat

SEQ ID NO: 86384 - DNA, 715 bp, Heterodera glycines
  misc_feature (670)..(670): n is a, c, g, or t
  SCN-specific regions: Sequence locations=1-27,49-715
aaaaagaatttcttaactaaaataccaacacatacaataagaaaatgattcttttattctattggtctaacttttgtccaaattggtcaactgagtgctggcatatgcaaatttccaaatccgtcaaaaagtgttacggtccaatcgatgatgactgtttcatcgaataccgactataagaacactttgtttgtcggcggttccggcattttgaacggcgcgtgtgatgtgaacaatggcaaactgaaatatttgatgacattgaagaatggcgtgaccatcaaaaatgccattctcgacacgcccggtttgggcatttactgcgagggcaattgtgtgctggaaaatatttactacaagcgattgtgttaccatgctactgggttcgggtataagagcaccagcacttcatacacttaccaagtgattggcggtgctggccaaggttcaccggacaaatatttcacccaatcgggcaaaggcacaaccatcatcaagaatttctgcgcagaaggcaaatacggcaaattgtggtgttcatgcgggaattgtgctttccaaacggcgcgtaccgtacaaatttcaaacaccgtccttaaggggcccggactttcggttgtctcgcttaattccaactacggtgacaaaatgtcactttcgggactgactntgcatggccaaaaatcatcgagcacaaaaactaattacatttgcc

SEQ ID NO: 86385 - DNA, 388 bp, Heterodera glycines
  SCN-specific regions: Sequence locations=1-303,386-388
ccgctggactgtcgcccattgaaacagtgacggagatgcgcagtcagctctcaatgggaaacaaagagcacggagtgaatgtgcgaatgggtgccattacggacattcgtgaggaaaatgtggtgcagccttttttggtcagttcgttcgccgtcaaacaggcggctgaatgtgtgctccgtcctctcaaaatcgacgactttgttctgtccgtgcgttaaagtgacggaaatgcaattagaaatttgtggacagccatttttgaatgttatgacgttctctcgcataaatcgctttttacttaaaaaaaaaaaaaaaaaaaaaaaaaaaaaaaaaaaaaaaaaaaaaaaaaaaaaggccaaaaaaaaaaaaaaaaaaaaaaaaagtc

SEQ ID NO: 86386 - DNA, 650 bp, Heterodera glycines
  SCN-specific regions: Sequence locations=1-143,165-494,527-650
caccgatacggtgattttcattggaatgtaatgtacgcgttcgaaggacagacaatgattttgcctattgaaaacaaattggcaacccctgaagattttcttgacaattttggtgttctttttcgacgatgtgcctttgcacgttttttatgatagcgattggattctttttgtcaacggtttcgggactattgtcagagagacgatcactgtaaatgtgccgcacacgggtctctattccgccgtcaatggctttctgtgcattcagtccatgcttggccattccattgcgatgtacgtcgtgttcgacatgttctacaagggattccgcagaaagttcactgctcgttttccgaatgtcccttcccttgttgtcgacaaagggtttcgcgtcggttgggtttttctcacttatctgatggccattctcatcccccgtttggctgtgatgattcccttggtcggtgtcacttcgggtactttgtgcgctttagtttatccaccattttttcaaattgtcactttttggagcgattggaaattgaatatgagtcccgttcgacgtgcctttctcattggacgtaattgtttcgtcatcgttctcggcttctttgcaattggtgccggcgttgcagcaaatgttctccaaa

SEQ ID NO: 86387 - DNA, 695 bp, Heterodera glycines
  SCN-specific regions: Sequence locations=1-223,245-437,459-506,528-695
catccgagagtagaatctccgatgagcactccctggttttattcatttcgcttcgttcttgctttcgtcctactagagatgaattgtttcgggcggttgaacgtctcagagaatccattcttcttcgtccactgaaagagcccgattccgacgaacgaacggggcaaaactaccgtcgatcgagcgattgtcatgtttcttcccgccaaattttaatcatgctcattttgctgctgctgcacagccggtcgtcaatgtgactgcggttctcgccaatgccaatcccactgggcagaattaccaacgccttctgaatttgaacgccgatttgacggagaccatcgcccgtttaactgtagaaatttcccaattgggatatatgaatgagcaattgacggaacaacttgaacatctcacggaagtgcctccgaatgcgaattttaatctggatgatgttgtgtttcatccgcccctcgaccaacagcacgaagtgcctccgaatgcgaattttaatctggatgatgttgtgtttcatccgcccctcgaccaacagcacgaagtgcctccgaacccgaattttaatccggctttgcttgagtttgatgatgttgggcttcagccgcccctcgaccagcagaacggtggggcactgaacaacaatggccagcaataattctccctcaaaatcagcaaca

SEQ ID NO: 86388 - DNA, 583 bp, Heterodera glycines
  SCN-specific regions: Sequence locations=1-88,132-583
tccagtggggaattgaacccaggcgaaaaattatgaaaggtggaaagtttaaccactacaccacatgtgcatgttaaaaaaaaaaaaaaaaagtttggaacgcttcacgaatttgcgtgtcatccatgcgccgctgctttgttggacgctggtttagacgatgtattcagacgcagtgaagagatttggtcgagaaaacagtcactgcggccgacggccgtcggaatgggcgcttcgctaaagaccaaccaggacttaagtcagctttcatccacccgtctccccatatcaaaaattgccgaaaagcctccgtcggctgatgcttctgaccgttacgaggatataaacactgatgttttgaatgaacgatttacggatgcagaaacaaacaaatttgtgcaacgtacgattgaacgagctcagattgaggcggagcggaccttcctcaaccagcaaattttggagcgacgctttgcacccggggaaagtttgtttggccccgtgaacaaaagggcaatgggctcggcacaaccggacagaacagtaagtggtggaataaagcgtttcataaatcttccgaatg

SEQ ID NO: 86389 - DNA, 645 bp, Heterodera glycines
  SCN-specific regions: Sequence locations=1-645
ccggctcggcggcagggcgatgtgatttcgcctcatcgtgcggttttgactctctccaaagcatgttcaatgccggatgcttctcattgccttacgcttggatgctcggcggaaaatgggtgtcattggctctcacttttgtcattgccggctttaattggtacggcaaccacattctcgtccgttcgtctcaacatttggctaaaaagtccggtgttgcctctctcgattatggacattttgcgaaaagagtgtgcgactacagcgaattgccatttttgcgacgtcacagcaagcgaataatgtacgtcgtcaacatcaccatcctcttctaccaacttggaatgtgtgccgttgccattcttttcattgctgacaatatggtgcacatgcttggctcctggcttggcaattccaccactcttatggccaccattgccattgttttcattatctttacgaacatgttcaccgaaatgcgcgtgatcggtgtttttgccgccgtttcttccgttttccttttgcttggtgccggagtgattatgcaatttacgctgactcagcccagcaaatgggacgaattgccggcctacacaaatttcaccgatacggtgattttcattggaatgtcaatgtacgcgttcg

SEQ ID NO: 86390 - DNA, 590 bp, Heterodera glycines
  SCN-specific regions: Sequence locations=1-590
gtgtgttgctgacactggaccgaacgcactgctgggcaagcactcaccaaatggttgccacgcctaccgtcgatggacagccgaaggaattgtattgcagtgatcatgtttggggcttcaaattcgactggatcaaaacgttcaaagaggaatttctccgttccaccactccggccagttactacatcttgctgcacttatgctcaatgccagaaaagccgtttgagctggtgaacgatcaaacccaggaaaagctgagcttggccaaaattgagggcaatgtgttgatcagttattggttgctgaagcgatggccaatcgccggcggggagacggcgcagcgcaaagacgaaaatggcaacaaattgaacaacgtccgccttctgattcgtggcattaactgcattgggccattgtccccatcgacggcggaccaaagcaacggaaatgccgtgccaagtggcgccggttccagcgaatgatcggacggaagaaacgaatatctaatttgaggaattgtttagatgagggaaattatattcgttgagatgatgatgcacacattacaaatgctattttcttcatgtgtg

SEQ ID NO: 86391 - DNA, 406 bp, Heterodera glycines
  SCN-specific regions: Sequence locations=1-379
gacgtcgattatacagcagccgtcgttacactgctcggaccgtgattacgatactcgcatccgctctcgctaccgtactcgaacgtacagtgcgtggggacagtacacggcaaatgtcgcaaaaatggcactgctggggcggatgaccatgaacaattttgaggcggtggagcgcaaattcgatgtgatgagcattgttcaggacaattattacaagacaaccgatgattggaccgacactttgataaggcgtcttgaataaataggcatgccaaatggcaacactttattgtataactgtattatatatatgcgtatttctcgtataactgtattacctacgctctagaaataatctctaaataaatgttatacggccaaaaaaaaaaaaaaaaaaaaaaaaaaa

SEQ ID NO: 86392 - DNA, 278 bp, Heterodera glycines
  SCN-specific regions: Sequence locations=1-278
ggctttgccaagcgcttggcttttcgtcgactgcgcaccaccgaatttcttccaaatggccgggagtccccaaactgtccgcgtctttgtcgacgaactttccaggcgctttcgtcccgtgtttttctcccgactcgaaggcgcttggaaaacgtatgccgaagaacaggaagaaagggtgatttccgatttggaagcctttgatctcttttacatttgtcgtaaagaggcagaacataaccaaaatgttgactctcttgagctgatgaaacatttcc

SEQ ID NO: 86393 - DNA, 276 bp, Heterodera glycines
  SCN-specific regions: Sequence locations=1-276
gatcacacactaactattacctctagaattacccttatatcgacaatggggaacacaatacccactaacccctgaacatttgacactgctaaattaaaaaattggagattatgtacaatctgtgacaaccgcgaagacgtaatgataccacaataacttaagtgatcaatggaaagtgtaatgctccggcacactcttttattgtggatccacaaacaaaagctgtagacggtcattctgaaaaatccaccgcctcctgacaacatagagagcgaa

SEQ ID NO: 86394 - DNA, 600 bp, Heterodera glycines
  SCN-specific regions: Sequence locations=1-23,50-69,93-212,243 -285,310-600
atgtggaagaggcgaagacaggcgaggaagatgacgaggaagacgacgatgtggtcgtaattggcgaatgggagggagggagagaaagagatactctctccaccgccagcgatcgttccccggccgtccctcataaggcgctttatccatcgcttccgtccgattcgtccgcttcccaaatggaccctcctccgcagtatggtcatcctcaagctcagcaacaacagcagcagcagtccacgtggttctctcctgcttcctttctcggctcttccaccaattcgcctccctccgccgccaatggcaccgatcaatcggtgccgtccgcctcggccagtgcccagcgattgctgaccgaactccgtcagagatatcagccgtggtccgtgttcttcaagtgcgccaagctcggttttcctcccggcgtggcagcgattggaccgcgcgtcaaacgcaatttggcgacatttaccaccaattacctgtgtcttttcgcccttctccttctttactgcgtgctcacttctctgctgatactgctcagtttgatcgttcttggcgggcttctctacagcgtttaccaattcacgcagaaagggc

SEQ ID NO: 86395 - DNA, 654 bp, Heterodera glycines
  SCN-specific regions: Sequence locations=1-569,591-654
ggcccaattgcccatttcttaaaaatagcaatgaatacgcacaagagatgtcgtcattaatattggtgtcttttgaaagctttggaggacggaatgaaattaagcggaaatgagccgaacacgaataagtttttgcttgatttgatgacagtccttgaaaatgtgaaacagtcgcacaaggaaaatgacgccataatgcaggaaattgtgggccaatcacacatcgaagaccaagcgcaacggttgttccaattcgcttacggattggaccagcagagccaattcggacagaagctcataaaggcattttacactgcaggttattggtgtgacgtgctcacatgttttggacaattggacgacaacattcagtctgcacggaaatatgccaaatggcgagcaattgacgttcacaactgtctgaaaaatggagaacaaccgaagcccgcgaccaatccgacggtccaacatcaaaaagaattgagtgaccaagatgacattgctgcacaaataaacgacaaactttcgggcgaattgaatgatttgaacgcgtatttaaccaaatcgccgcaggcggccgccgtcccacagcaacaatgtttcaatcccatgctcactcatccgtcgcaacagcgtcaaattccttcaaattat

SEQ ID NO: 86396 - DNA, 589 bp, Heterodera glycines
  SCN-specific regions: Sequence locations=1-16,38-287,310-467,490 -505,534-589
ataaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcctcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgaccctcatcatcattagggccatggatggatctaacggaggaagaaaatggatgcttagttttcagattttattctatcctcttttatttattagtttttcaaaacaaatttcttccacaactttttaaactatttgttgttttgaatctttttagataaatctaaacccct

SEQ ID NO: 86397 - DNA, 288 bp, Heterodera glycines
  SCN-specific regions: Sequence locations=1-83,106-288
acagcagacatcagagcacccttagggattaagacactatgacacatgtagcgtaaccgcacacaatagcatgaaacatctaaacacaccccaatgtccatcaaaggccttgagaaactcatttcttaattatggtccattggaccatacggcaactatgctggaccttactcatcaccctgtggatcaatgactgagggatctccgcaacagaagagtactgctgataaaggacccgaggcaccgaacaaagcgccggagccggaacttgactgaaaaggggacctc

SEQ ID NO: 86398 - DNA, 710 bp, Heterodera glycines
  SCN-specific regions: Sequence locations=1-111,134-710
tttattgatctgtttttggatgcggtcacggatgaggagaacattgagtacaagaaccagttttgcgtgttcacaaagctgtacaaagataaccggataacactgttgatgaaattggaatgcaattgcttttgtttcttttggctggctttgacaccaccgccaattcgttgggatttgtcagctattatttggcatgtcaccctgatgtacagttgagggcccaagaagaaattgataccgtatgctcgagcgaaaatccgacatacgaagagctgagccaattgaaatatatggaagcggttataaaagagacacttcgactggttccagtcgctgcaaccgttgtgacgcgtgtttgttcacagacgacgacattgggccaaattttggtggaaaaagggaccggagtgacaattgacttgtacacttttcatcgaaataaggagttatggggtgacgatgctgacgaatttcgaccggaaagatggcttgacatagatcctcctccggcctcagcctattattacgcatttggcggcggtcctcgcatttgcattggcatgcgatttgcacttttggaggagaaaatggcacttgcgcgactgttgcggcgctatccactggccaaaaatgagcaaacggagaaatttctaaaggtcaattcgcaagttgtgcttaatcctggcgcagtgatggtacaattgaat

SEQ ID NO: 86399 - DNA, 646 bp, Heterodera glycines
  SCN-specific regions: Sequence locations=1-39,99-646
ttaactccttttatcgtgcattcctccgccgttctttcgtcctttccctttcccttttttctctctttttactctctcttctgtccctttcccttccccaatcattcatttgcctgccattcttctcacattcattcattgttttttgactgatgaaggtcatcttttcgtcacacagtagaagtgggaaaaaaatttgccacccctcctttgtcggcacatgccattggctgctgcacggcaccgaaacggtgccaaagacggcggagcagcgcacctttacactccgttgtaggcacgtcgtgttggcatgcggacgacaacagcccaaactgttaggggtgcccggcgagtcggccgccgctgctgacggtcgcgtggtgtacagtctcagctcgttgaagcagcgattggaggagacagagggcggcgattcgggcgcgacagatacggcaacgacaatggcaccggcgaccgaagcgacggcgaccacaatggcacgagcgactattgccgccactgcggagacggaataagtgtccggcgactgtcccgtggtggtggtcggcgacggcatttccgccgcggacgcggtgctgcactgtctgagcattgaacagcccgtgctgcacattgtccgtcgtac

SEQ ID NO: 86400 - DNA, 665 bp, Heterodera glycines
  misc_feature (615)..(615): n is a, c, g, or t
  SCN-specific regions: Sequence locations=1-376,398-515,630-665
acaacgcatcgtggaaccgctgctgcagcagatgtgtgtcctacagagcagttgtcgaagtgcattgtcctcgtggactacgccaagcagcgccaggaatggactttcaacaaagtgagccaattgtcgacatcggtcgttgagttgcgcaacaaaatcgaaacggaggcaacgcgaacgcgaaagaacccgggagaagtgctgctgaagatcatccgcttttactcctccaagctgaacgttcagatgagcaaactgcgcgaccgcagttcggagttgctttcttcttcgatgcagaaacaaattctgacattgactgcatacgttcagcaattggatgacagttttgtgaaggcaaaggacatcgacgaggttaagcaggaggtgctcgaagaagccaagcagaagctgttcgacatcgctcgttggtcggcttcgctgagccttcgcgggccaccgaagacttcgacggctgacgacgtggaaaatgaaaacctaagcagtaacatcgaaacggagccgaagcaggaggagaccaaaggggaagaggaggagacgctgcagcagtcgatgaaggaagatgaggaagaaaagggcgaagaggatgatgacgangaataagaggatgactaagcaaattaacacagtgacagcggaaaagaaca

SEQ ID NO: 86401 - DNA, 396 bp, Heterodera glycines
  SCN-specific regions: Sequence locations=1-87,110-158,185-311,333-396
gaggcgcccccggcggaaggcgcgccggcggaggcgtctgatgtgccctcggcttaagcaaaaagggaaaagccgaacgcaccgatggaaagggagaaaaagaagaaaagcggcggagaggagacaaatgctttaccttttccttgctcaattgtgtacaaatccctccccttttccccatttcgctattccccgactctccaatttcttttggctgttagcttttgctttccgagtgatccttccgatgaattcgccgtgccttttcttccgtcaatgactcatccccaaaaggcaattaattcattaatttttcttctcccttaaatatatttgtgccaattgaggagtttaataaatgttgtggtgcaaaaaaaaaaaacaaaacaaaaaaaa

SEQ ID NO: 86402 - DNA, 616 bp, Heterodera glycines
  SCN-specific regions: Sequence locations=1-58,80-459,482-554,576 -590,612-616
tacccggcaaatcaatactttccttccatttgcatcataaaaaataaataatttgggcttcgccttcggcttcggcttcgagtgctaagccgagcttcgcccagccctgatcagggaggggaacggattctggaatttttttaggagaatttcaggggactttattagaagaaatagatatttctatataagagtgttttatgttcattcatttaacgaaaagagttataatttttagtcaatttttgtatgcctcttttatacaattctaatttcaacagattttcaaccaaaaagcaatagaaattgtcgtcaattgtttaatttttgatgactaattccatgccgaaaatcctcttcacaatcatcgctttcgtcaacatctcacaaattttattcgctactgctatgtataagggcaaagaaatttgcggtaaaaccgtggaagagtgtcaagcggcactgattgcttttatgaaggatagcggaagtaatcagaactatcacgcgagcggtaacacttaatatttacggaaataatgggcttaataagcattggattgatttctttatttgtgcgattggttgttttttggggcctttttctttggcttag

SEQ ID NO: 86403 - DNA, 512 bp, Heterodera glycines
  misc_feature (489)..(491): n is a, c, g, or t
  SCN-specific regions: Sequence locations=1-104,129-221,244-345,367 -380,402-443,465-492
agttctgattcgcatttgtttattacacttctaacaatgccgaaagcttcgaaaaacaaggaccccaacatgccaaagcgtgcccaatctgcctacttcatctggatgttggccaacagggagaagatcaaaaagccggggatgagtgtggctgaagtggctaaagccgcaggtgtcgagtggggacgcatgtcagcagcggacaagacactttgggaacagaaggcggcagacgacaagaagcgctacgagcaggaaatgactcagtacagagctcgccagaagtagacgattgggcagtgaatgacgttttatctttgacttccttttccgctgttctctcctatatttaaaagtcaacaaaaatcgaccttccatttgtcgtccttttcgacattctgatttatttctctcagtttaacttttattctgatcatgtacgtatacattgcatctggaaaatgatgatcaaataaatggaaatcaccnnntaaaaaaaaaaaaaaaaaaaa

SEQ ID NO: 86404 - DNA, 548 bp, Heterodera glycines
  misc_feature (518)..(518): n is a, c, g, or t
  SCN-specific regions: Sequence locations=1-30,132-194,303-342,518-527
tcaggaaaagagaacgaaaagcagttggaagaggaggaaaaggaaaagcagcgggaagaggaagagaagaagcaggaagagaaggaaacgcaacagaaagaggaagagaagaagcagaacgaggaagagaaaatgcatgaagagaaggaggttgaagaaataattatgttggacagcaacgacgatgaagccatggaaaaggaaggggaggagaaggaaaagcaattggaagataaggaaaagccggaggaagcgcaaggggagcaggaggaagagaaggagaagcagttgggagagaaggaaatgcaaattgatgaattaattgtgttagacagcgatgatgaagagaaggaaaagcaaggggaagagaaggaggagacgcaaaggaaaaagatgagaagacaaggaaaggcaagaggaagagaaggagacgcaaggagaggagaatgaaaagcaagcggaagataaggagacgcaaggagaggagaaggaaaagcgagaggaagagaaggagaagnctctcttacaaaaaaaatataaaaaataaa

SEQ ID NO: 86405 - DNA, 672 bp, Heterodera glycines
  SCN-specific regions: Sequence locations=1-672
tatccgacgaatggaggtaccggggtggcgatctctatgcactcctctcgcaatgtgttcgcctattttgtctcttccgacacctctcagcctgccattcagcactttcatcgagttgcctcgactttgcgcgacaattgcaccttttggctcggttctggggaatgggttcgctcggtggttggcaatgaaagtgccattttcttccgggaccctcacgttgatgacgatccttcgctacaacggaccattggacaacttggactctgtcaaaaaatggctcactgacaaatgcgtgccattggtgcgcgagatcacttttgataatgcggaggagctcaccgaggagggcattcctttcctcattttatttcgaattccgggcgatttgcaagcggagcgaacattcactgacattgtcacaaccgaattggaaggccaaaaaaatgctgccaattttctgatggctgatggaaaaaaattcgcccatccgttgcatcatttgggcaaatccgagcgcgacttgccactcatagccatcgactgcttccgtcatatgtattagttccctgacatgaaacagttcggcgtcaaacgtcatcttcctcagtttgttcttgacatgcattctggaaaactccatcgtgagttccaccagtggcccgaccccac

SEQ ID NO: 86406 - DNA, 745 bp, Heterodera glycines
  SCN-specific regions: Sequence locations=1-69,92-745
tggattctctcctctttttttttctcctagcatgcttaacaaatacctccgatattcgtcaccctttcatttgttttattcgtttttctgttattcgaattttcttctgaagctgtcacacgaaaaaggaaaattccatgcaaaaagacagcatttaatcggcgaaccacaaattaccaggcgtggaaagagcagattaccgtttgtgaactgctcgaaaattatgacccggccgtgcgtccgcttggtcaagaaccaactctcgagaaaaggggtcccgtggtggtcactacttcgttgttcgtcaattcaattagtgcagttagtgaacggaatatggagtatgtggtgcagttccgcttccaacaagaatggcttgacgatcggttggcctacagcagactcggcgacgagcgcagctttgcccacctttttgtggcacgtgatcagacaatttggatcccggatagcttttttcaaaacgaacgaagtggccattatcatatgcttgaccaggaaaatcgttttgttaaaattcgtgcggatggacgagtcacttacaaccggcggctgacactgaccttggcctgcaacatgaacttgctcagatatccgatggacgtgcagtcgtgtctgatcgatttcgccagctatgcctacacaaccaatgacatcatttacaagtgggaccaagtgggcgtggagatcgctccgaccgctaacggagcattgccaaactttgaaa

SEQ ID NO: 86407 - DNA, 696 bp, Heterodera glycines
  SCN-specific regions: Sequence locations=1-246,431-441,463-486,508 -513,536-558,582-649,672-672
ctggcattccgtctttacctctcttagcctgggtttgtgcagtgccctcgtttggatgaccaaattcgcttacggccttttcttgcccttggcaatggatttcctcggcatttctgctacctttctgctgcttctccttttcactccactttcaactatttttgtgtggctttttctgcctgaaactcgtgacaaaacattggaagagatggagaaacagttcagggaggaagattgggcagcactgaagaggaaagggaggaagagaagcaaagagacacgagagagaattgaagacggagagagcggagagagaagctaagagacatgagagagaactgaagacggagagagcggagagagaagctaagagacttgggagagaactgaagacggaaagagcggagagaagctaaggggagaaaaagaacgaaaaagtgcaaaaaggaagagaagaacaaatattaattattgtaatttgttgctaatttaaattagtttccttatggcattctgccttttaaaaataacgccttaagcaatgaacgaagcaaatggacaaaagcagaaaagaagaggaaggcacaaaaccgaatagatccttttcttcgtataaacaaagtattgccaatcattgagcatatgtttcagcagagaacaaagaaagagagcaaaaaaaaaaaaaaaaaaaaaaaa

SEQ ID NO: 86408 - DNA, 651 bp, Heterodera glycines
  SCN-specific regions: Sequence locations=1-72,103-132,154-481,503-651
gattcgacctcgattttggcgtttcgtccctaaaaacgaatcgagtaataaaacgatttgttcttcgtccgcctatataaaggaaacgatttgaagaaaatgctctcattttttgcgtccgtcagtattttcaccattgttttctatttgccaattgtgtcaaagcatcgttctgctcctccatctatcacagcaaacggaagttgtcaaacgcggcttcagcatggagaagatcgtctacttaaagctgttgcaatttgtgctcactttgaccatcatttggcaactccgttcacttcaccaattctgcggcacttttgccgacccaaaagccttcctccatgacatctcaattggccattgcaaaaattttacgctcattggaaaggactcaaaaagcggcgaattcagcgctttgttcgaccaggacaaatggcacaaccaactgattatgatgagcagcaccaatggacaactaatcgaagaacagcaacaccaattcatggacgaattggccacgaaattgccatccgctggacgcatttgtattccgataacgatttcgccttttgactggattttttatcggattgccaatgacagaattctcatcgacaatgacattttgtacttttcttccgtccaactctg

SEQ ID NO: 86409 - DNA, 404 bp, Heterodera glycines
  SCN-specific regions: Sequence locations=1-130,154-319,341-376,402-404
cattgcttatgagcacgtgtgggcgattggaccggaaaaaccgcccccccgaaaggcgcaggaagtgcacggatggatccgcaaatttttgagcgagaaagtatcgcaagaaattgctgagaaaactcgaattatttatggaggttctgtgacagccgaaaattgcaaagatttggcagctaagcaagacattgatggatttttggttggcggagcatcgcttaagccggattttgtgaacatcattaatgcgaaatcctaaaaaagaaacgaacaattggtgaagggaaagaaaacattgacttaggactactactaattgtaagatgataaaaaggaatcatttatttatacgatatgacagaaaacgatacagtaaattatttttttaaaaaaaaaaagaa

SEQ ID NO: 86410 - DNA, 310 bp, Heterodera glycines
  SCN-specific regions: Sequence locations=1-220,242-310
tttgccgaactcagagggaagatcgaataactgactgcgtaggatgatcgtcgtcgcggcgaggaacgtgaacaaaataacacaattgccgagttggccttgcgtttgggaatggtcgaaagggcattaacaaacatttaaacaccggtcaaaaatgccatgaagagaatcgtgaaaatggcaaaccaaaagcctacaaatgcactggagcggacaatttggatgaagaagaaactgaggaacagaacacaccgaaagaacgacgagttgccaagacgagtgttgggaaaagaatggtgttgaaacaacg

SEQ ID NO: 86411 - DNA, 656 bp, Heterodera glycines
  SCN-specific regions: Sequence locations=1-67,89-656
cattgctgccgtccataatgttgagcagatgctgttggctccgttcctgtcttccaggcctcggaaaatgctctgatcaaggagttggaagcgggagaaaatgccgaagtcgcccagaaattcttcagacggatagggccaaggagggaagcgttcagaaagcgagacatgacggggaacagcatccggaaaatcctcgtccacgccgatcaaatggaggcccttttcgagacggaatggggcaaaacaatttgccaaacgatggcacatttggggaaaatccaaattttcaccaaagcccagctattgtccccaggtgatttggacggactggaacagcagttgagcagttcaaggcatttctcgacgaacaaccaatggtgcgaacccttctttcaaaaacgacaaaggcccatttgctgcttcaccactttgttccatttgcgcgccaacaccgatttttggggcttttgcatgagcagggagatgaggcactgcactccgtgtggcggcgacttgagcaactgtggaagacgatgccggactctgaacaaatgcgacagcagctggagcatcatttcgtctcgaattggctgctggacaccggcagactcgacgaattgaagctgcgggaggaggaacaacgggagcaagcg

SEQ ID NO: 86412 - DNA, 621 bp, Heterodera glycines
  SCN-specific regions: Sequence locations=1-128,150-621
cctatgtccgtggagtgagcgacgcactaaacagttacagaaaaatggcgatgtccgtcctcccatacgcacccactgaatacgcccaagtgattcaccacgtcgtaaagttcgcaaaagcatccgagaaggcacagactggccacttctttctgctggtcattctgacgaacggagtgatcaaagaccaccgggatacggtggacactatcgttgaggcctcttcgctacccattgccattgcatttatcgccgtaagcaacgcgcaccatccatcgcagttggctgcactccgtcaacaatttgccgtccatacgctaaaatcgtcgcgcaatgtgccgcttgcgcgagagacagtgactgccgtgtcatgcgcggacccatccatggcataccattttctgatggccgttcaacgacagctcattttgcatctgctaagggcagcgacggacgcggacgcaatcactgccagcggatgaagacggaaatgacttcaattcttcaaatttcacaatttcaaaccaatccatttattccatataatccatttttgtattttccctctcaaaacactaaaactgtgcctatagcccatcataattatatacttattggtaa

SEQ ID NO: 86413 - DNA, 530 bp, Heterodera glycines
  SCN-specific regions: Sequence locations=1-530
tctcgtctttcgtctacctgaacaagttcaacatgtacatgaacagcatgggctctcgtggtgcgtcatccgctgctgttgttgcttctgcagcagcattgtgcctattttcggcaatggcagtggtggtgtacggtgccgaaagcgctgggcctaaagcagaccagactctggctgccaagcagttcaacccgtccgcatttccggccatgccaccagagcttgagaaaatcctgccagccgatgttgtgcaaaagttgaaagctgtccatgccgatatgtcgttgaacatcatgcagaaacaagacaagattgaccgtatcatgagctccttgccgggagaggttttggaccaaatcccggccccgcccggctttgaacgtctccccgacgatgtgaagaaccgtctgaagcagatcaatcgccaaaccaacaaatcatgggccgacaagcaaaaggaactgcaggagtatgtcaagacattgccgcacgaacaacgtgccattctgatgatgggcccaatgggaggt

SEQ ID NO: 86414 - DNA, 465 bp, Heterodera glycines
  SCN-specific regions: Sequence locations=1-176,199-465
cggaccgacaaaaatggcaaaattcgttgccattgctcttctctcgctgaccgttgttccgatggcacttgcaaaaactggcaaaagtcaaacggcagacgaagttgagggatttcgcaatatgaacatcggcgacaacaataaggttgacgccggaaaggatcccgcgggtgataaagcaaccataaaagggaaaagctcagaaagccggaacgaaatcggacggaggacactaatgagcccgcggctgctaaaggaactaaaaatggaaaatccccgaaaaccaaagcgaagcaagaggtggccactaatgatcccgcggctgctaatgaatggaacgaccaattgatgggcatgatcgttgagaaatttagcgaggagcttgctgtgttgttgccaaaagccaacacttttatggaaaatgctttgagcttcatcaatgaacaaatggaaaaaaatggtatt

SEQ ID NO: 86415 - DNA, 658 bp, Heterodera glycines
  SCN-specific regions: Sequence locations=1-31,53-130,154-624,646-658
gaacattctgctgaagtctgttctattcctctctcttctgtctttgtttggtgattgcatgaaaaactcagatcaaattggagtcaaaagaaaatcagcaggaataagaattgaggaaccatttgttgtaaaaggcaaaggaaaagtcgtcgaaacaagcagaaaaggctcctaaatagtcggcgaaaaaatattcgttatgaacacagctgaacgcattaaaaaaatggacattgcccaagacaaagctaaaatggatatagacgccaatggcaaacccaaacaaaatgaggaaaatgctcctccaaaatatgttttcatttggagcagtaacaatgagaagaagaaccttgaggttgacctcagagtgatccgtcactccaaaaaactcagcgaattattccatgccaaaagtgatcaatccgtcaatgcaaaacacggaaagcaggaagcattaccggttccgaaacaggaagctgaaaaaatactgaaggaagtggaagaatggtacgcacatcacaaaaatgataaacataaaaacgctccagtttttgtgttcaagtgtaaagacaatgtcagtctggtgataaatgttcatcttgatgcagtccggctttccaaggagttgtcaaatatgcttgaagatactgccgacgaa

SEQ ID NO: 86416 - DNA, 649 bp, Heterodera glycines
  SCN-specific regions: Sequence locations=1-318,349-595,617-649
acccgcgcgtcgattggcctggggcaaatggcttaactgtggccagacatgcttggcacccgactacgtaatggtgaccaacgaaatgaagccgagactggtcgaggaactgaaggcggtgcttgtggaatattacgggacgaatccggagacgagcaaagactacagccgagtcatcaacgaagcccactttgaccgtatttgcgcgttgctgaaaaactctgtcggcattgaaatttgcaaaatgggacagcccaaccgggaggatttgttcattccgccgaccattttggaggtgcaaaccgacgacgcactgatgcaatccgaaatttttgggcccattcttccgtttctcatcgtccgttcttttgacgaggccattgacattataaagcggggagagaagccactggccgcttatttattcactcgcgacgagcgcaaagtgaacagatgggtcgccgagacgcattcgggctccgtttgtgtcaacgacgtgatgctccaaattacggtggacactttgccatttggcggagttggcgagagcggaatgggcagttaccgggggaagttcggcttcgacgagttcatccaccaaaaggcggtgctgaagcgctgctttttcggcgatggcattgctgctggt

SEQ ID NO: 86417 - DNA, 411 bp, Heterodera glycines
  SCN-specific regions: Sequence locations=1-411
ccgtcgcatccctcgccattcgccttttggttctctctttgctcttccccacttctttcgcctcgcaaaatggacatctccgtccacgaatggcactgtctctgccgccccgtcttcgtcggcacgcattctctgcttcgaccatatccgtttttgggttggcaatgccaaacatgcggcccattggtattgcgtcaacttcagcttcatccctttcgcctacacgggcctcgagacgggaagtcgaaaaacggcggcatatgcagtgaaacaggacaaagtcgtttttgtgttcgagtcggcactgctgcctaacaacggggaaatgatcgcacatttggccaaacatggcgatggtgtcaaggatgtcgcgcccgaagtggacaattcggactgggttttggacactgc

SEQ ID NO: 86418 - DNA, 683 bp, Heterodera glycines
  misc_feature (642)..(642): n is a, c, g, or t
  SCN-specific regions: Sequence locations=1-683
agggccttgatatgcgtttacccatttctccgtccataagttaaatatagttgggaaaacagtagtacccttctttggctcagttgtccactgtccttcttggagtgtcagatttgtttcgacggtgccgaattggattcatggacaaagggtcgaatccaaaacgaaagaatggattgaactaacaaatccagccacaaatgaagtggtcggccttgtgcccgagtcgacgttggacgaaatgcaattggccgtcgattcgtgcaaaaaggcatttcgaagttggcgcaattcgtcggttgtcactcggcagcagtgcatgtttaaactccaggaattgatcaaaagggacatgaagaaattggctgagaacgtgaccaaagagcagggaaagacgctttccgatgccgagggcgacgttttccgaggcttacaggtgaaaaaggaggacatttttggggcaatcgtttagaaggacactatccatcgaaggtggtcgaattcgcatgcaatgcggcgagtttgctgttgggcgaacatttgccaaacatagccaaagacatggaaacgtacagcttgcgactgccattgggcgtaacggccggcatttgcccgttcaatttccccgcaatgattcctctntggatgttccctttggcactggtttctggcaacacgatgct

SEQ ID NO: 86419 - DNA, 684 bp, Heterodera glycines
  SCN-specific regions: Sequence locations=1-111,137-225,247-494,516 -568,590-684
gatgaacctttgtcggtgttgggtgaattcgaaaaacgcaggacaaaaagtgtacgaagagcggagagagaaaatggaagtttggagtgaacaaaagcggaagcgaaaggctgatgaagaaaacgaagaggaggagcggcaaaataagcgaaatggcgacaatcgagacagacaaaatgagcgaaatgggaacaaatcgaaacggacaaaatgagcgaaatggcgacaatcaaaacggacaaagtgggcggaggaacgatggcattgaccaacggcagacggacgaccacgcgggggaagatcctccgttggacgcgctggtgcacagcgcgcaaatgctgcaaaaagccatctttccctttttggaaatgaaatatttggcccaaaaaaggcgtcgaggcgacacacccgctgatggtgggctgcttaaccgtgtgcaaactgaacgaaaaccccaacaaagttatcgtcgacgaagtttacctcatagatcgacttcaaatcatcttcaaacagtcgccaacaaaaccttatcgccacatgcatttgaactaccaaaaagtgaccgaggaaatcttcagcatttggattgacgatttggtcaaaaggaatgtccgattgccgttataccaaccgtacaaagaccgtcgcgaagcccttttccaattgaagataaacaatgat

SEQ ID NO: 86420 - DNA, 739 bp, Heterodera glycines
  SCN-specific regions: Sequence locations=1-359,381-630,652-739
cgacgctctcttcgtcggacgtcggtggtggcaatcgcagtagtaacagcaagcactcctcagccgacaacactaaccgaggaaagaaagcggcaaaggtggtggtgaacaagaggagggaagtgaaggaatttgtgttggtcggaggaggtggtgacgtgaaggaggcagcagtggccgccggaacggtaacacttccggaaggagcagcaggggtgggaagagtggacgacccgaggcgggaaaacagcaaccgaatggttgccgcctgtgttgcgaccccttccgtcactgttaccgccaccgccgccacttatttcaataatcagacggggtttgccggcactctcggaggtggtggtggttccaaaaaagggatggaggcgaacagtaacccatccaaagcctcgaaaggagtgaccatgaccaccgcagaggtggaccagctcatgcaacagctgcaatcggtggttgaaaatggagatctccctacatggacattggccttccggactggagagtgcacgactttccccaaccggaccgattcttgtttcctgagccaagtgaatggcacaaaaagccttcctgaagagacaagaaaattcatccctgatccctcattcataaatctgtttgcttttcttcttggatgctttatgacacatcggacaccaatcataatcccattattatttgcatccagcaatcagtcagttggccttttaataaccaactg

SEQ ID NO: 86421 - DNA, 595 bp, Heterodera glycines
  SCN-specific regions: Sequence locations=1-595
cctgcttagattgttccaaaccagcctgtctggttgcgcacaatggtctcaactttgacttccgaattctgtgccacgagttgcgcaagagcgacctgttccgtacccatccgatcccagaacaggtttatttcctcgacacgctttcctgcttttacgaactcgagaaggagtacaaccgtgagatagaattaacgatggaaaatgttgattggactctcgttttgtcccaattccaaccgaacagcgaaactgtcgttgcaactgccgagatagaggaaactgtacaacaaaatggcactgcttctgagggaacacaaaattccaatggtcacaaaagcaccaccgttcttcaccgactaacagttttacaagaaacaccaacaaaaaaaccggagcttatttctgtcgcgaagacaactgctaagcgatcactatttgatgaggatgttcacccgatacagttcatgcgcaaaacgcattggtcgccggccaaacgccgctgcattgacgccaaattttttgagagcaacaatcgcggtgaatggaatttcaatggtaaccatgccaggcggttgttgtgcggacgtggcaa

SEQ ID NO: 86422 - DNA, 369 bp, Heterodera glycines
  SCN-specific regions: Sequence locations=1-369
agtccgccctcgtattttaagggggacatgaactatcggaagttggtcggcgacagggcgtggccccaccaaacgcctttttcggaagctctttgcggcttttgcccaaccactcttttggcacttcgaacattaaaagcggaaaccgtcgccggtgttccgctcgaatcgctgcgcaaaatcaaagaaaagttcggagagaaggacctcagttggatgagctctagcgaatatgccgtggcccaattgtgcgaacggcggaacggaccgtaaaggatggggaaaagacgaaataggcacattgactcttatgaatatatgtttagtagaattgattaaatgtatcggatgtttaaaaaaaaaaaaaaa

SEQ ID NO: 86423 - DNA, 538 bp, Heterodera glycines
  SCN-specific regions: Sequence locations=1-538
caaagtgccggggatgaagccgtttggcgcagaattgggccagaagtaaacatcttccgcccaggtcctttctcccgactaccaagaccccttcacgggcacgaaccgatacatgccgggctgtaacaacggagtgacgacggcacaacaaaatacgaaacgtagtccgattgtgcctctgccagacaatttctgcacttttggcctcgacggtgtgtccaaaaaagtgattgaacggctgcgcgagatgaatttgctccagccaaaagcgttgcaactgaacgatgacgaattcgcttcggcagaagtgatactctcccaagctgactttgccatcaatgagtgccaaatcgtcgcattagaaaaaggaattttgtggtcgcccgaaacgattgtgcccgcgttggatttgtttcgaattgctttgctccatccaaaattgaacgaaatcttttgctcattggagtccgttcttggaaacccgccaaaaggtgttccgaccgtacggcgtttggtggaattgctcaacttggcccac

SEQ ID NO: 86424 - DNA, 615 bp, Heterodera glycines
  SCN-specific regions: Sequence locations=1-449,474-615
actggatgattctcataggataatggacgaaagcagcaaaacacttttttgactccaaaattctccattttgctgccgacatacaacgaagctgaaaaccttcccatttgtctctggctgataatcaaatatttaaaggggctgagttatgaagtgattatcatcgacgacaacagtccagacggaacacaggaagtcgcaaaaagtttgcagaaagaatttggagcgggaagaattaaattgttgacgagggagtgcaaactcggattgggaagtgcctatgtttttggggcgaatttgtcattttgatggacgccgatttgtcccaccatccgaggcatattccggagatggtcactcttcaggagaagcatggctatgacattgtcacgggaacgcgttatgcgatgggcggcggagtgtccgggtgggactttagacggaaaatgatcagccgaggagccaactttttggcacaattccttcttcagccgggcgtctccgacttgactggttcgttccgtctctatcgaaagtccgttttgtcaaaactcgtcgtcgaatcagtgtcaaagggatacgtttttcagatggaaatgatgtttcgggcaaaaa

SEQ ID NO: 86425 - DNA, 645 bp, Heterodera glycines
  SCN-specific regions: Sequence locations=1-416,447-484,506-645
tcaattctttgataacgaaattgagagacgagtcgaattgagaaaaagtgccgacggatacagcggagacggcacttttttggacattttggaccaattcattgaccaaatggaagagaaacggaggaaaagcaaagcgaaagcatttctaaagctgaagtatctgtccaccctttgctacgacattttcttggccgggcaggagacgacctcaaatacgctcaactttctaattttgttcatgctgctcgaccaaaaatcacaacaaaagttgcacgccgagttggattcgctggcgaatgacaaaaatgagcaaacggcgccggagggcagaggcaccgtattccgaatggaagacagactcagactaccgtacacccacgcggttgtaaatgtaaagggggcgagggaacagcgacaaattaatgaaacaattaattaattaaccattggaaaggaaagccttcgcttgtccaaccttcttccgctgaacctccacaaagtgcttcaaacggacgtcgaaatcggtggccataagctcaaaaagggcaccgccgttgtcaatcaaatcgcaacagtgcttttcgacgacaaaattttccctgaccatgagaagttcatgccgagccgttttttggaggaaga

SEQ ID NO: 86426 - DNA, 660 bp, Heterodera glycines
  SCN-specific regions: Sequence locations=1-629,651-660
ggcgggaaaggtcgaactccgttgcgagaagacgggctatcgggccgaaattgacttcctggccagccgttcttccgcggcaaagcccaccaaatccatggccaaatctttacaccagtcgaaagactgcgttgatgcagctgaagggagaatggaacggggaaatttacttgaagcgggacggagccaccgactaccaactgttcaccgatgttcggcaaaagccggatgttcgaaaggaatgtgtgccggtcagggaacaggaggacagagaaagtcgcaaattgtggcgtcacgtcactgcagcactgttcatcaacaacatcgaaatcgcatcccaatcaaagcgatgcattgagcaacgccaacgggacgaaaaggtggggcgtgagcggctcggtcaccattggcaaccgcgcttctttgtccgcatcggcgacggttcaccgtccgactcgtggcggtactgtgacgcgttggagcaacggacgacgacggacgggccgtagttatggagcagtacaacaaccaaacagagtgtgtgtggttgatgaaagaacagatcgacaaaaaacaaccaaaaactgcacggattcttctaattattattgtctattcgttcgttgttgtcctctttcatcatcatcagccgatgaaatt

SEQ ID NO: 86427 - DNA, 623 bp, Heterodera glycines
  SCN-specific regions: Sequence locations=1-193,215-564,587-623
ttatcgggaactcggctgctattttaactttgaacacagcagcaaaagatgaaccagaccgtgcccatttctggttccttcggtgttgatgaccaccagaaaactgcaaaaaacatctatccgtctttggaactattggaaaaagaaccacgcggagggacactgatgggctgcgtggatggagaggaggtgtgcaccgccggactgccctacccgggctatcagaagccaaagggtcagaagcacagtcgtcactgcgagtggaagcacaaaaacttggtcatccagagtttggttgaacagttggtcgggatgggcttcgacaactgcaacggttggctgttccgtgtggcggagaaggaaggcgccgagttggaccgcatttttgtcgcgattgacgaggacacgatgtaccgtgcgcggatcagccttcagtgaagaaagaggcaatggaaaacgaaatgaggaaatttatgatgaggtggataaaagaaaacgatgctttttcggctttggtctttaattttaatgagctaattaattaagcaatgctttggaattaaactataaaatcatctaaatatttgtcccttattccttcgctcctcatttactcattcatt

SEQ ID NO: 86428 - DNA, 594 bp, Heterodera glycines
  SCN-specific regions: Sequence locations=1-495,517-531,553-594
catcttgcgtatcggttaatgggagcttcatttcctttcggttggtccgacatttctaatccttcgccttcgtctgaaggaatttgggccgcgccgtcatcatcatcatcgaaaaaccgaatattgtactcatggggatcgatgacaacgttttcttcatcgtccacttcaaaatgggcttcgttttctctcttcgtcccacttggacttggcccttttgggttctgatcatcaaagaccattgtcgtgtcaaggtcctcgtcatttttagaggccctatttgttgctgcgtcgtgaacattgaacaaatgaaagtcgtaacgatccaaatcagcacaacaactggcaaatgtgaggtccgatttttggtaaaaagtgaagtttgcttcctgaaatttgctgtttacagtgaatcattctcttgtggataaaagaaactcaccttcagagaaaaagggtcgcttcgaatttgacgcgacagaccgcaattacacctaaagaaatgaacagagggaagtgggaaatgagcagacaattaattacattgagtaagtttttacacccgaacagtgctccttccgcgggcgcttttca

SEQ ID NO: 86429 - DNA, 633 bp, Heterodera glycines
  SCN-specific regions: Sequence locations=1-5,27-104,133-633
tttactttcctccttttccgggcaacgacgcagcagttcgaaacaaccgacgcagaagtgggcgcaacggcaccagtcaaacggcacagtgacaacaccattatttatcatcagcaacagcaacagcagcgacgcatgggccaaatcaatctctgcgacgacgtttggttggacacattggcatggatcaatcgtggagaagtcggcatgaagttcgcgctggtcaatgctcggttcaacactttggtggacaggcatttcgagcagaggaagtggtgctttggcgagtttcacatctgtgagcggatgacggaagaatcgggcgcagaaatcatgacatcgatcgacggctccgacttcagcacgttgccattgcccaccactccgctgccggacagtgtcgtcggcttccaatcaatctccatttggtacatcaacgaagaggtcatcaattttctgtgcacaattcgccgtctcctcgccgaagacattgcgctggaattttccacttacttcacagaatatcgcagttggaaagtgatggcacgacacatttggccgctgttgcgggatgggatcagcactttgttcctgaagaagtgtgacttggccatgctccgtaaacacgtgtcg

SEQ ID NO: 86430 - DNA, 601 bp, Heterodera glycines
  SCN-specific regions: Sequence locations=1-79,102-601
gaatggtaaaacaatggacagagaagaaacggccagcgtaccacggctcaatgcccaaaacaacaataaccgtgtggagccggaggaggaggaggtggacagtttctggtcggtgaaagaggacgatctcgtgtggggccgatgaaccaacagaagcgatatttgagggaagatattggaatgagcgaagagatgcccgattttgtactcgtcatgtcttttttgttttgtttattcgttttgcctttccaaatgttctgcttttatacaatcgtcgtttttgtcgccatttttggcttttctcagctttttaaagtggccttttcaccttcgattgttttccttgaattgtttgtcggtcttttcaagttctttcatggcttttttctcaggttcgtctgcccattgtttttcccactgctcctttggcttttccttagtcattgctttgttagcggaggatttgtttggactccattccattcattgtacgaatgtcccccccccccaattaaagtgcgtttcctttgatactcatcgtcaattcccccttttgagcctctttctctcatttcgttgtcatttgttccttaattagatt

SEQ ID NO: 86431 - DNA, 725 bp, Heterodera glycines
  SCN-specific regions: Sequence locations=1-187,209-725
tggagtttcgctcattttggacatttcgcggtccggtaccgtactcttctcattcggcaccgtagccaacacgcgcactttgggcgaatcgttgcgacgtacgcttctccacacattcagccaattccccgattatgagttcatttggaaattggacgcagaatcggcagcaaatgagtcggaactgatcaaagccacgccaaatgtgcacactttcgaatgggtgccgcaaaatgccattttaaggcatccaaaattgcgcgcttttgtcactcattgcggccaaaacagtctggcggaggcagcaaaaatcggtgtgccaattgtgggcattccgctgttcggtgaccagctttacaacgccgtgttggcaaagcaccgagggatggccgtccacgttggcattcgccagctaatcgcagacaaaacgggcaaagtgctgagaacagcgctcagtcgggttctccacgacgcctcttttcgtgccaatgccaaactcatccaaaagaaaattgctttgtcgccattcggtgcaaaagagcaattggtgcgttgggtggaattcgcagccgaatttccgcatctgaacgagcttaacatgccaaccgatgccgaattgggatgggtcgcttattattcaatcgatgccattctgttcaccatcagtgcggtatttttggcaattttggcacttttttttgatgctgcggatggcatttcgtcaa

SEQ ID NO: 86432 - DNA, 691 bp, Heterodera glycines
  misc_feature (688)..(688): n is a, c, g, or t
  SCN-specific regions: Sequence locations=1-236,258-691
tctttatactcctccgttatctttttgctgccagttcaatttctgctcgttgtcatcggcgctgtgttcatcatcctcagccaatgctgtggtggcggttcgaagaagaaaaagaaagccggagcagctaaaaagaaagccggagcagcaccgacgccaacgccatcaatatcggcgagcgtaggatcggaagcgccgtcgtcactgaaaacgcaagagaaaagcgcaagcgccagctcaaaaacagcaccaccagcgaagaaaggcgccgttgcacaaaaaaaaggaccgactgaagcaaaggcagggaaagcgaccgatgaaaagacagtgaccacaaaaaagaaagaaaagtcgagcaaatcagcgaaaggaaaaccgacgagcaacccaaagccagagcgaactgagccttcagttaaagaagattctaagccggttgcagcggagaaaggagttgaagtgccgcattccatgatgtcgaaaggagactcagttgtcgatgaggaagacgaggtgggctacaccaccaccactgatgtgtaatcttatcatcttaatggtctgtattgtaaatgtttgttcccaagaattatgtatgatctaatgtcttacccttatccaatgttgttacttgtatacatttattatgtcgtggaagataaagtaaatgccacttttaaaaaanaaa

SEQ ID NO: 86433 - DNA, 658 bp, Heterodera glycines
  SCN-specific regions: Sequence locations=1-658
caggcgcttattctgcacgcggtgggtgacagaggtaatttcggcactggaggtattttctctgcgttacgtcgtttgagcagcgcaattccgaattgctatgaatatgcccatcgcatgagagacttgaacagaggcgacgtccatttggtggaaaacattgctgtgcagtcggtgcccgagcccttcaaacagttggataacattaacaacatcaaaaacgaaaatgagccagaattaaaagcaaagaaagggtcgaacaatgcctcgaggacattgtctgttgcgctgatggtcgtccaaacgcaccgcacaaaaaagacaaacgttggtacgcaattggaagccctggagcagtgtctgttaagaattcgtttgttcgcgcgacgtttcgcctgcagtgttcatttgttgcgtatttggttcgatcttgacgagatcgaagagcgacaagttcgagaattgttggatcagcacttgtgcgcgcatggcatcaacgtgtacatttacaaattgcggaggtctgaggggaaatcggcggctgcggagaaaatggagaattgaggagtaaaaacgatcacaaataaataaacccccgaactaacgtaataatgcatgagaattaactcatacttttgttctgatgacctcacttctc

SEQ ID NO: 86434 - DNA, 633 bp, Heterodera glycines
  misc_feature (2)..(2): n is a, c, g, or t
  SCN-specific regions: Sequence locations=1-217,242-633
cngttggagtgggacgagaagaagctaaagaacgccagctgggccgacatgacgccgatggactacttgagcccgatggagtggggcacgaagaagcgtccggtgtacgtggacaactcgaacggcggcgagtacaacaaagaaaacgaaaactgcgtgttcattggccaatggccacgcgagggcaagcagtacctgaagttggactcggcagtagacaagtacgggctggacgtgctgtggagagacgaggtgtgcgagaagccgggcgaggactgtccgcgcggcgccgtgtgtaagaagagggctacggtgggcgaatgctacggcacgggggcgtatctcctggacgcggccgatgaggaggagatgaagaagctgctcaaattcatcactgtcggatccggcacttttgtctatgctgaaaagaacacatacatggtcctcctgctgaaggacttgtacggcaaacagatgaaggaggaggacaggaagaaggtgtgcgcttactacaaggcggagtacgtcactgtaaaggccgagccgaacaaagtgcaagaatatgtggacaaagtgttgtccaagcagaagcagatgtacgcggatgcgagcgaccacatgctgtgtaagttc

SEQ ID NO: 86435 - DNA, 695 bp, Heterodera glycines
  SCN-specific regions: Sequence locations=1-6,28-289,311-695
tacatgtttgcttggcattttactcctcgacatttgctgtgttgccgaagaatattcaattgaactcagagtgaagccgagccttgggagaaagcaaccccatttttattatgctgaagtcaaatgctcctcagaagaagcatttgtgccaatcaatgcgttcttcgagcattctcctgacgatgggtacgacttggccaattttaatgttggcaataaaaagtgcccggggggcttccaaattggcattgcgatgttcaacggatcataccctgaagattttggctggtacacttggggggcaaaaaagccgcttttgttgaaaggcattaaattcaaggagaactcttttgccatggttcaaaacgttgaatttgcaaaccatttcaaattggacatttcgccaaaattggcggacacttcaaaccttgtctatcgggtgaatgttttgtgtatggacaatgaccagcagttggtgttcgaaacgttcacccaatcagaaacaattgtggtgttcaactccattgatgggccaaaatgtgggacatatgacgtgaaagtttggcccacttttttgaattggttggacaaaagtgaaaaagaaataaattcgtttcttgaaactgagttttcactccacggaattggcgttaagaatggcgagatgcatcacataaatttcccgactttggcat

SEQ ID NO: 86436 - DNA, 609 bp, Heterodera glycines
  SCN-specific regions: Sequence locations=1-609
accttttttacggcaatggaaatggaaaaaacacttctgtcggaaaatcaggcgaatatcgttgtgatgaataactagcgccgacattgagttggacagattggtgtcattggtcgcaagtcaaaacactaccgaaagcagtgattcacagccattcacaagcaaaactcccgaaggaccgaataacaaatcaaacactttgtctaacgaacccgttttcgaacttccaaaattcactccaccggacagtccctcggaaaggccttcaactttaaataatttggccgccggagatgtcaacgaaactaaacactttgatttagcaataacagaacacaaaggaccattgaacagtttggaggaaacattcgaaagatacccttcgactgctgatgaaaatttggtattgattcccaaggatataaaaccagaaatattgatgacaagaagaaaagcgaacaaattgccaatttacaagcagaattccaattcattacagaacaaaaccagtcaatctcggtcggataatggccatcagagtcggaaacggaataacgatgcttattcgtttgaggacgatgaattgttggctgtgtcttcatattcagt

SEQ ID NO: 86437 - DNA, 459 bp, Heterodera glycines
  SCN-specific regions: Sequence locations=1-19,41-171,193-287,310-459
aatttaaaagatccgaaaaaatgccaaacattttcaaaatccttctgattgtgcttttggccgtcgtctcattccgtctctcggcttctactggtgacaaaaaaactgctatgatgggagtggaaacactcatagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaatcgtctgtcaccgactggacccgaccctcatcatcattagggccatggatggatctaacggagga

SEQ ID NO: 86438 - DNA, 457 bp, Heterodera glycines
  SCN-specific regions: Sequence locations=1-322,344-457
ttaattgtgatcggccaagcactgacgaggcaactcagaaaatgctcaaagcgattcgtgcgaagtttcttcccatggcaacacttatttttatcgacaaggatcgccctgatcaatggattttgcggcaaaattcgcatttggcggattatgcgagtgcctacagacccggacagccctcagtgtttatgtgccgtgagatgtcttgtgaaatgccgatcgcaactctcgaggaactgcaaaagcgactggcagaactgtgagggagtctctgccggcgcatttgttaattattcactgccctatgggaattgaagccgctatttattattttcattgtttcgtttcgaaatttcccgatgggaacagtcacaatgtgaccattcgctatgcccgagggcatagtttaattgatgaataaactcatccggcaaaaaaaaaacaatttaaccaattc

SEQ ID NO: 86439 - DNA, 712 bp, Heterodera glycines
  SCN-specific regions: Sequence locations=1-57,79-458,481-553,575 -589,611-712
ctacccggcgaaataaatactttccttcctttgcatataaaaaataataatttgggcttcgccttcggcttcggcttcgagtgctaagccgagcttcgcccagccctgatcagggaggggaacggattctggaatttttttaggagaatttcaggggactttattagaagaaatagatatttctatataagagtgttttatgttcattcatttaacgaaaagagttataatttttagtcaatttttgtatgcctcttttatacaattctaatttcaacagattttcaaccaaaaagcaatagaaattgtcgtcaattgtttaatttttgatgactaattccatgccgaaaatcctcttcacaatcatcgctttcgtcaacatctcacaaattttattcgctactgctacgtataagggcaaagaaatttgcggtaaaaccgtggaagagtgtcaagcggcactgattgcttttatgaaggatagcggaagtaatcagaactatcacgcgagcggtaacacttaatatttacggaaataatgggcttaataagcattggattgatttctttatttgtgcgattggttgttttttggggcctttttctttggcttaggctccacacaaaacatcatatgagaacaaatgcatatgacaataataatacctaatatatgttttcagaaaacggtccaatacagcttgctaatgat

SEQ ID NO: 86440 - DNA, 646 bp, Heterodera glycines
  SCN-specific regions: Sequence locations=1-267,291-646
attccgatgttgagcattgatcgtcccgctgcgagttgtggcagtgcatcttatccaaagaacagggataccataatgccgcaaccgcccgtcactcctagcaaccaaaatgaagaaccattgcccgagggatgggagacgcggatggaccaatacggacgccgttattacgtggaccatactacaaaaagcaccacatgggttcgcccgagctctatgccattgccacccggatgggagtcccgtcgtgacccgcgggggcgtgtttattatgtggaccacaacacgcggaccaccacttggcagagaccaacggcggacatgttggcggcgcatgagcaatgggagtcgaaccgttcacaggccatgcatcagtgggagcagcgttttctttacacgcatcacgatgatcctctgggaccattaccggagggatgggaacggcgtgaagacccaaacaccgggcgtcattactttgtcaaccatcagaataaaactacgcaatgggaggacccgaggactcaagggttaacggatgctccgctgccggaaggctgggaaatgcgtatcacagagcaaggtgtgccattctttatcgaccacaacaacaagacgaccacctacaaccacccgcggactggtcggc

SEQ ID NO: 86441 - DNA, 670 bp, Heterodera glycines
  SCN-specific regions: Sequence locations=1-3,25-547,608-670
cgatgcttcttcttcgctctgtccctcttctgtccgcttgcctttccttctttggcttccttttgccgcctcccattgtcggcctgcaatgcaagcagtaccccgagctggagccggggacaaagttcagcaccgaaccaaaggaagtggactgtgaagggaaaaacgacatctgcacggtcacgaactgcaaggacgggtcgaatgtcgccatcccatggtacacccacggcgactgtgacattgagagtcgttttagctgcgacaaattgggcgcacaatgcacggccaaaggtggcactttttgttgccacacatgcaaagaagacctgtgcaatacggaggacatttgtcctaacaccgctgcgatgcgtgccggacagcaggtgatcgcacttgtggtgccgttgttggtcgctgtgtttgcgatccgtgccgccaaaatcggcttttgagaatagacattggacgacgcttttgctgcgcaagaacaaacagtgccaaaattttgagaaagtaccaaaaaaatgtgaccaatttttaagggtttaataattattacaatttatatatgtatcatttatgttatttattgattattatttttgtaaaaagtgtttattttttgcgtaccttaagaattgtaaattaaaagtttcactcatttgca

SEQ ID NO: 86442 - DNA, 646 bp, Heterodera glycines
  SCN-specific regions: Sequence locations=1-646
cagatgctcggcctgattctgagcgagtacgtccccaacactttcttctggcacattttcaacgctcagctgggccatgtgactgtcagttattcccatcgccatatgccgcactttcttcgttccatcgccaaaatggcgtgtgccgattgtcgtctcgtcatcggtgccaatttgacggcttctccgcgcgctttggtcgatgtgaatggcgtcgttttggctttggagggcgatgtgagtgcggtgttccggcgcaagaacaaagtgcacaatttgttgtccgcccgaggacagcttcgtgtcgcgattaaaccccactttcggcattctcgcttgtacagtgacgtgctgttaacaggcgtggacttcaaggtgtacaagggcggtatggacggcattatggcgggtgccattcgaaaaatggtctcttttctcatcccacgcgctatttggcccaaaatccaacaaaggcttcgtttggtcgtcaattacaaaggtgtccaaatcccgcgtctctgctccgtcgagttcaatcacctccacttggattatattgcccacgcggcaattatcagcggggattttgacgtcgatttgcccctttttatccgttccttcaaggaatttatggacgagaagcaaa

SEQ ID NO: 86443 - DNA, 400 bp, Heterodera glycines
  SCN-specific regions: Sequence locations=1-129,159-261,291-302,398-400
cattgtacggttcccgatctcactttttactgatgcaaacccaacagacagcagaacggcaagcagttcatcccaccactttctgcctcttttcgcattggaattaattcttcttttcatgggaatgtctttaattttaatttaattctattttttttgtgtttatttttatgttccctaattccataataaaattattgttcattcaattttcgttgcatttccaaaaaagtatttgcatttgaaatgatagaagataattctgtttgtttcttttttcttttataaaatccattgaatttaaaaaaaaaaaaaaaaaaaaaaaaaaaaaaaaaaaaaaaaaaaaaaaaaaaaaaaaaaaaaaaagggaaaaaaaaaaaaaaaaaaaaaaaaaaaattc

SEQ ID NO: 86444 - DNA, 525 bp, Heterodera glycines
  SCN-specific regions: Sequence locations=1-39,61-139,169-463,485-525
ccaaatgcctcaagaaaacgccctattagcgggcgttgacatttgtgtggcctcccctggtcgtttaatggactgtatcaatgaccgcgttacgaacttgcacaactgtacttatcttgttcttgacgatttctaccgaatgctggacatgggattcgaaccgcagattcgatcattcttctgcaaatccggccggatcttcttactttgatgttctctgccacttggccagctgaagtgcgttctcttgcagccgatttcctttcttcaccagtcggactgaatgtcggctccctcgatctgtcggctaaccacaacatcaaacaaactgtcgaagtcgtcgaagactttgcaaagaaagaccgattatgggttgtactcaatgacattctgaaacagacagaatacaaaacgctgatgttcgcggaaactaatcgaaaagtggacgaactcaccagacagatgcgctacaaggggatgcccgccctttgcatccacggagacaaaagtcaaaaagaacgcgaa

SEQ ID NO: 86445 - DNA, 430 bp, Heterodera glycines
  SCN-specific regions: Sequence locations=1-169,197-430
ttttttgctcttcccactccttcccctcgcaaaaggtctcttttctctgatcattccgtcccttttggtcaatctttccaaatcgcaggacaatccgtccacgaatggcactgtctctgccgccacgtcttcgtcggcacgcattctctgcttcgaccatatccgtttttgggttggcaatgccaaacaggcggcccattggtattgcgtcaacttcggcttcatccctttcgcctacaggggcctcgacacgggaagcagaaaaacggtggcatatgcagcgaaacaggacaaaatcgtttttgtgttcgagtcggcactgctgcctaacaacggggaaatgagcgcacatttggccaaacatggcgatggtgtcaaggatgttgcgttcgaagtggacaatttggactgggttttggacactgcgcgt

SEQ ID NO: 86446 - DNA, 622 bp, Heterodera glycines
  SCN-specific regions: Sequence locations=1-39,78-131,157-157,214 -231,409-433,611-622
tcgtctactttatttttaaaaatccattcccccgtcctttctaaaagcagaaaataaatattttattttgaaaaatgaatttccactaattttgctgctctcgttggcgttctgtgcgctgatcatcgaagcatacccgaaaaacgatgggccaattgtgcgccgagaggcagacaatgaaaaagcggcaaaagcgcaacccggcaaagaggataagcaagcggtgaaagcggaggagaaagaggaggaaaagccgaaggacaaaaaggaaaaacgcggtgcagaggcagaggagcagaaagaaggaggagaaaagaaaggagaagaaaagcccaagggaaagaaggagaagcgcgctgcagagaaagaggaaaagaagacggaaaacaaagaagcagagaaaaaagagaatgaggagcaaaagcctactggcaagaaggagaagcgcgccgcagagaaggaggaaaagaagtcagaaagcaaggaagcagagaaaaaggagaatgaggagcaaaagcctgctggtaagaaggagaagcgcgccgcagagaaagatgaaaagaagtcagaaagcaatgaagcagagaaaaaggagaatgaggagcaaaagcctgctggcaag

SEQ ID NO: 86447 - DNA, 572 bp, Heterodera glycines
  SCN-specific regions: Sequence locations=1-368,398-572
caagttcggacccaattgtcagactcaacaagatccacgacggactccacgggggcatttatgtgcacgaaaaaggaaagggactcattgaggagaacgaaatctatgggaacactttggcgggcatttgggtgacgacaggttcttctccgattttgcgcaaaaatcgtattcattccggaaaacaagtcggcgtttacttttacgacaacggacacggccttttggaagagaatgacattttcaaccacctttactccggtgtccaaataaggaccggctccaatccgaaaataacgcgcaacaaaatttggggtggccaaaatggcggtgtcctcgtttacaacagcggaaatggcgttttggaggacaatgaaatatttgacaatgcaatggccggggtttggatcaaaacggacagcaacccgacacttcgcaggaacaagatttacgatgggcgggacggcggcgtttgcattttcaacagaggacgcggactgttggaggacaacgatatttaccgaaatgcacaggcgggcgtccttatttcgaccgagtcgagtccgatcctc

SEQ ID NO: 86448 - DNA, 690 bp, Heterodera glycines
  SCN-specific regions: Sequence locations=1-586,608-690
gccctgtttggtgattgcatgaaaaactcagatcaaattggagtcaaaagaaaatcagcaggaataagaattgaggaaccaaatgatgtaaaaggcaaaggaaaagtcgtcgaaacaagcagaaaaggcaaagaaaaagtcggcgaaaaaaataagcgttatgaacacagctgaacgcattgaaaaaatggaccttgcccaagacaaagctaaaatggatatagacaccaatggcaaacccaaacaaaatgaggaaaatgctcctccaaaatatgttttcatttggagcggtaacaatgagaagaagaaccttgaggttgacctcagagtgatccgtcactccaaaaaaactcagcgaattattccatgccaaaagtgatcaatccgtcaatgcaaaacacggaaagcaggaagcattaccggttccgaaacaggaagctgaaaaaatactgaaggaagtggaagaatggtacgcacatcacaaaaatgataaacataaaaacgctccagtttttgtgttcaagtgtaaagacaatgtcagtctggtgataaatgttcatcttgatgcagtccggctttccaaggagttgtcaaatatgcttgaagatactgccgacgaatgatatccgaagccaatcccgagtccagttccgaatctcaaaagtgacatcatgctaaaactgattaaat

SEQ ID NO: 86449 - DNA, 499 bp, Heterodera glycines
  SCN-specific regions: Sequence locations=1-4,26-197,220-308,330 -340,363-467
acacgtgaactgctgctggagttttatccgcctaaccgttgtgctcatgtaaaaaaatgaatacttagggggcggacacctcgacacggccgggcattaatacataactcgaaaattcgtggcagtacccaaaaatactccccaaaaaatgccagttttaatgacccatcctccatttgtttcccaattaaatagctcgatgccatttgccactgccaacattgtcctgtcgcctgtgtatggcatgtggctggagctgctctcccgggacatgccaccaatgcttttcggtaaatttgtgccctatcaaaaaagaaattttaattaactgtaaaaatgccaattctcccccattcaatttttcagtgcgcggcaaccgcacatccgtgatcacacacacttcatgaaactcttaattattgtgtgtattattgttttttttgtctcccagtaattatgtataaacgaaaaagagaaaaaaaaaaaaaaaaaaaaaaaa

SEQ ID NO: 86450 - DNA, 726 bp, Heterodera glycines
  SCN-specific regions: Sequence locations=1-726
ttctctctctctctcggacctcccatcctaaagtcgatcccatcaaaactgtcccctcaccgaaacccggaaaagtatccctaattcctataaaaacaaatggctaatatgaaatacttgccgcctgaacttttggacgaaatggctttttacgtatatcctaaccaacgtttttctaaaattctgacttcttcctggctactcttggaatttttgatgccccgtatcaaaagatggaaagaaatattgaaattaagccgttccgaggtcattaaaaagcacaaattggccaaagacgatctcccttggaccaattttgtcacggtggcaaaaaaaagacagtgtctgcactgattttcttaacacgttcaccgaactgtttaaagaggaagatttttataactcgatcgacggaagtatgttgaatttgttgctttcaaatctccgcgagctttacccccgtgttaaacaaacatgtgcgtggttggatcttttaatccaagccaaactttttccggcgactatgcttctgattgaagaactttgcaagttcatcgaatcgccgggtctttatttcggagctgttcccgagtcgacatcagaggaagatccttatcaaactgtcgcttgcgttggaccaacgaaaaatgcggctggtctccagtcgacttcgtcatctttggctcccattccaccaccgaagcaaaaaccgattgtgccatcgcg

SEQ ID NO: 86451 - DNA, 619 bp, Heterodera glycines
  misc_feature (72)..(72): n is a, c, g, or t
  SCN-specific regions: Sequence locations=1-619
agcggaaaaaccgaacgacgaaacggcggaaatgaccaacgacgggtagatacaccggaggttcttgctttncaaaaggttgagacgagtagaaccgacacctcccaaacacttctttgccaacaacagagggcttttgccaactccgacccctccgaagccgccagagtctggtgtggccgaccaattcgacggagacggcaatacgtcccgcatccttccgagccacactgacccgagtactgcttctgctctgtctactccaacttaactcaaactatgtccacccttcacacatataacaggatggagcgccccaacgtggcgagcaaacgactaccgaagcgccgtttactatcacgcgtacttgtcccgccctaagccgctgtcctgcactcactactcatgcaacaggggtggcactcatgtgctgaagatggacaacgactcttcctccatcagaagtcaacacttgacgacttattccgcgtgcaccacagacacacgaagatcaggatgcacgagagcgataagaagaggaaatgaacgaactgaacgatcggtagggcactaacataaaaaaggtgcgctttctggaggcacaaaaccgaaaattggc

SEQ ID NO: 86452 - DNA, 305 bp, Heterodera glycines
  SCN-specific regions: Sequence locations=1-3,28-76,98-132
gtgggagggaagacgaggaggaagagactgacgatgacgaaataattgtgattgagcgagtagagcacaggggaagagaagacgaaaagcggaagagaagaagcctttcagaagacacaagcaatgcagggggaaaaggaagaaaagcaaatcgatgagaaggaagaagagcaaatggaagatgaagaaaaggaggcagagcaaattggagaggaaatggaagaagggcaaatggaagatgaagaaaaggaggcagagcaaattgaagaggaaatggaagaagggcaaatggaagatgaagaaaa

SEQ ID NO: 86453 - DNA, 619 bp, Heterodera glycines
  SCN-specific regions: Sequence locations=1-453,475-619
ttagtttcgatgctcacaatacgcgcctgttcgatcgtacgatctccgtccgcatggaccgttatccgaaggaagtggaacgccgcgagggaggactgccttttggtctgcgtgctgttggaatgggtttgggggcgaatggcgcgcctctaaccgatgtggccagcgtgatctccagtattagcccttcgcagacacaacccgggatgaatggcacagctggcgcaccgatcactccattccaatcgccgccaaatgttgcccaatttggccctgtagctgctcaacctgtggcagcggggcctccaagcggatttcaacagggcttgcctgatcatggcatcagtggacatttccagtctcctcaacccacctaccaaccacaagctaccagtggcttcttcaacccccctcagccctctccacagaaccgtccatccggcggaatggccttcggcggtggaggcgcaacgccacaatacgcaccgacaaagcaaatgggcgttgtcggaggagggacggcgagcgctgcagtttatggacacccaccacaacaacaaactcagaagtacgagcacaaagtggagccgaagtttgaaatgggcgcgtacccggggta

SEQ ID NO: 86454 - DNA, 665 bp, Heterodera glycines
  SCN-specific regions: Sequence locations=1-465,488-665
acggaaatcgagggatggatagaaaagtgccattccatggagaaacgggataccgattcaaatacactctggcaggaaaaggtggacacacttcaaaaagccatcgtggcattggaacatgagaaggcggacatggtggagaaactgtcgcaagccaaacaggagggagtcaaattggtaaaagaaagcgaggagaaacggcatggcgaaattctaactgaacaattgaagaaaaaggatgaagaatggagtcgtcgcgttaaagaattggaggaacaaatgcaattggcggtggaagaaagtgaccttcaaagaaagacgagtgttactggccacgaaagggaactttcgaatttgagaggacgagttgcagaattggaaaaggaaaatacacaaattttacaacaattttgtggacaaaagggagaattagagcaaatgaagcgaaaagaattgacggaaacggaagagacaccgaaagaaagaggagaaacccaaggaaaggaaatagaagagagggaaaagatggagacaaaactggcagagacggagagggagtcgaacgaattgaaacggacaattgaaacgatggaaaaggaaatttctcgtcttgtccacctttctgattcacaaaaagtccaactatccgaacaatctgaaaagct

SEQ ID NO: 86455 - DNA, 493 bp, Heterodera glycines
  SCN-specific regions: Sequence locations=1-249,271-493
taaattgtcccctcaccgaaacccggaaaattccctaaaactcctacaacaaataatacgaaatacttgccgccggaacttttggacgaaatgactttttacatatatcctaaccaaaattgttcgagaattctgacttcttcctggttactcatggaatttttgaggcctcatatcgaaaggtggaaaaaaatatttaaaatactgcttaacgagttgatcgatctgcacaaactctgtaaggaaggaatcccttggcgcacatttaccgccctggcagaaaaggacaaaaactgcaatgcctttgttgccgcgttactggaactggttaaagaggacgcttatgcatctatcgacggatctggctcgaatgcgttgctcatccgtctccgcgaactttacccaagtgttattgaaactcttgcgtggactggccttcaaacactcaatgccgaactttttccatcaacacagcgtatggtgcaagcacttc

SEQ ID NO: 86456 - DNA, 659 bp, Heterodera glycines
  SCN-specific regions: Sequence locations=1-595,617-659
tatgcaattgaacaaggtggtggactttaacaaaacaatcgcatgcgccttaaggaacgacaaaccatggaaaagatgcaaagtgctgcaagatacatccaaatactgaaagtggaactgcgcaaatcatcggacaacgagcgcatagctttgaaagaacgtaaccaaatgaaagcggagatggaacgatacaaagagcaggcccaaaacttgaagacgaaactggctgaccgtgagaagcaactccatctccatgcgtgcaaattgcagctgcagccaagaaacccgaaccgggcctttgcaagtctaaatgggaacactccgttgttgggcctttcctttgattgtgtcaaaagtacgccgaatctcaacgatacaacgatgttccaagcgaataggaaggatgttggcaataatgtgctggagacgccggttttcaacgagagtgaaatcgccggaccgcttcgaatgcctgacacgcccgcaatgcttcgtaatcgtaattcctttgaaccgccgcgtttcttctgaattgtcgattccatggccatcgtcaatttcgttcattgcttataggatatttaatggaatatgtaaattattgtaacttttttagtatcgttgtgtttccgcttattcaatttgttcctttatgattg

SEQ ID NO: 86457 - DNA, 646 bp, Heterodera glycines
  SCN-specific regions: Sequence locations=1-163,185-349,371-646
tttgtttaaaaaggcccacttttagtatagcgccaacttttgattgtttaatattaaatacccaactccgtagtgctatgcagcaagtcaccagtggcacagatcattctcaatctcaaccagttcattctcctgctgtccattgtctggtctgtcaatgtcgcttggaattgcaccattcattgtttgggcctattgaggacggcaccgactgtgcttcttccaccaaatcgtatgctttgcgcagtgacggggcttcctgctcgacaacaacagatgcgaagcccgactttgcttcaaccattgcattgacttgacctccactgttggcacgtctcaatctgcaaatttgttggatttagtggccgaatccaccagtccattggaagtgccgatgtgtaagaaatgtgccaatgcagtgactgcggagctgaacaagcaattgggtcatttggagaaggaatgcatccaatacaaaaagtcgttggaccatttgttgcaacggcgtgcggactgtccatttgacatggaggcatcgcgcatcaaattggacgctttaaaatcagaagagcgcgacctattggaacaactgacgctgttggaagacgaggaacggacactgcttcatgaattggatacaaaacag

SEQ ID NO: 86458 - DNA, 588 bp, Heterodera glycines
  SCN-specific regions: Sequence locations=1-3,25-250,273-444,466-588
cacaaaaatgaatgacaatgttttgagtttattggcattggcattggtcgtatttttgttccgtcaaaagtcaaattccgtacttgcgtttgatttggaagaacatggccctgcttctgctccgtctgcaatttccccaccgatcccttcgcctcccactgaaatttcccaattttttgcccattcgaaaatcgtcgaattgtcacgcggttccaagctcgcaaattcatcagtttgctgcttcggcatatttctccaacattttccttttataatttaataccgcccgattcggcattgattcaattggccaaagacagcggaggaataattgtggggcctttcttaagagaaatgcattcaataaaaggccaaattggagaagcgctaattgcttttctgacaaaaatgtcagcaagaagcacaaaactattcgcggaaaatgaagggacaaaggaggaaaggaattcggcacgcaatttaatcaaagttggcattattttttcgatggcaaaaataattggtgagaagctgcatgactatgaaatcaattgggcaaaagaaatattagaaactcagcaaaaaagg

SEQ ID NO: 86459 - DNA, 514 bp, Heterodera glycines
  SCN-specific regions: Sequence locations=1-51,74-283,307-514
ttggactgctgtagcctgacacatttggagatgtgccgtgcgctgatcgcccatggtgccaacatccacttggggacggactctggcgagtcgacgctgctctgcgcatgtttcgaaggcaattttgagattgtcactcttctcgtcgagaatggcgccaacgttaatctcgcggacagcgacggaatgacgccactaattgccacttgttactttaccggaaagattgacattgtgcacctgctgcttttacacggtgcaattgttggacagacggatttcacggggatgaaatttgctcttttgggagccgccagggcgggctatttggaagtgtgtcagctgctggtgaacggatgggcagcggatgtcaaccagcaaacaatccacggcaccacagctctgatacgcgcgagcggtcggggacacgtggacgttgtgacttttctcgtcgaatatggcgccgaccttgaccacaccgacattgacggatacaacgcgttgatgtgcgcag

SEQ ID NO: 86460 - DNA, 659 bp, Heterodera glycines
  SCN-specific regions: Sequence locations=1-1,34-659
acattttattattttattttcttttggttactttatggcagcagtgatcaaccaaaacccttctgttactatgaccagcagtttgggtgaaaatgcaagaatggattgttgttactttttacccacagaattggcccagaaaatcgaaggtcagctcacgggacgcatcgccggcattcatttgttggagcgggaggacggactgctcgttgtaaatgaggacagaacgctaagagtgctgctcagacgcgagtcgggaatgttttggccttcaattatccatgacttgccgcacatccccacaaaactcagctgcagtgaacagaaaaacacgatttttgtcggttttgcaaatggacagatccacgaatattcaattgaaaacgatttcaacagcatttcattcaaacggcaatggaattcgcacaccaattccatcagtggactcggcttttcagaacgattagaacaaatggtcagttgctcaaaggacaaaacggtggtttggcattgcacgtcgaccactcgcaaaatcgcaagttactgtacgggttcgccttgtaccacacttcaattcgatggcgatgcttccttcgtttttgtgggcgattattccggaatatttcagtgcttcggctggtggttgggacgcaacagca

SEQ ID NO: 86461 - DNA, 605 bp, Heterodera glycines
  SCN-specific regions: Sequence locations=1-605
gcgttcgattcgaaaccaaaacgcttttattggagaagaaagttgaagagtttccattttcggacaacgaatgctctccccagccaaaacattgtgtgggctccgccccaggaaaattggaatgcgtggaacgcttcaaatattgacaatcaaacattggcatttcgttccttggaatggataagcaacgatttgttaacgcgggaaaagatcaaaaagattcctgcccgtttgactgcttcacgtcaaaccctccccgtttttcagcatcgggatgaaatcatgcacaatgtgcagcaaaattccgtagtattggtcaaaggcgcaactggatgtggaaagcccacccaaatctgtcaatatttgttggaaagccatctcacccagggcaaaggtgcccatttcaattgcgttgtcacccaacccatgcgcatttcggccattactttggccgagagagtggccgaggagcgctgtgagtcggtcggcgagtccgtgggttattctgtgcgctttgaatggatgggtccgcgaccttatggggcaataatgttcatgactgtcggagtgttaatgcgaaaaatggaacatggccttcgcggaat

SEQ ID NO: 86462 - DNA, 614 bp, Heterodera glycines
  SCN-specific regions: Sequence locations=1-263,288-614
aaattggactctctaatggcatttctcctgttgtcacttgcacccctcttcgttgcccttagcgggattgatgcaaataaagtgccactgcaattgtgctgtgctggtggccaaagcttggctggccttatctacgactattctgaccatttcagcgaagttttgcaacagtcgggaactgagatgtgcactagcctgaaaaaggacatgaccaaattgacaactgcaattgaaaaagctgaaggatgcaagtgcaatcttgttgaaaaaattgagaaggaattggatgatgttgaggatgattgcgcctacaatttgtcacttcattcgcgcactgttccacattgtggccatggcctcggaacatttgggcgaaagttggaactccgaagcggccgagttcaacgagcaaattgaagccattgatagcattggacatgatgaacttaagaagcttgagtttgaagcggaatcggaattgaaaacacatcctcgtgttggccgaaaaagaatgaacagatgctaattgggctgggcaaaatttgaagatgtcaatgtgtatttagacgaattaatttgacgatctttcattagtttaatgacacattatggca

SEQ ID NO: 86463 - DNA, 553 bp, Heterodera glycines
  SCN-specific regions: Sequence locations=1-553
aaaatttcttccctccatttcgttcactcgttttaaaatgatgtggatgttcttcccactcaaataaggacacggttctattcaaatggtggaaagtcgaaactatcggaagtcttctgatcacttgtttggtcatgtattttggtgccatttgcttcgaagccatcaaatggcttaggcttatgcttgaacaaaagtcgcgtcagccgaactccgccaattccgccggactcaacatgacagaccaaaacaaaacagtgccaatgactaatcgccggtacgccgaatcgctcctctcccgggtccatcttctccagagtgttctgttcacggttcaactactgctctcctacctgctgatgctctgcttcatgactttctctgtttggattggaatggccatttgtgccggtgctgccaccggtttttggctttttgggaggagagtgccaatgttggcatttgcatcgagcggagcagcggggagcggacagggatatgcgagcaccggccgaacggaactccattaaaagccatgcattcattttcccca

SEQ ID NO: 86464 - DNA, 469 bp, Heterodera glycines
  misc_feature (441)..(442): n is a, c, g, or t
  SCN-specific regions: Sequence locations=1-246,269-442
taagttttttatgcgatatgaattcgctcgccaatcgctgctctttttctaatcgtcgtccttttctcgttcggttcacattttggcgacggtgaaagagtttcaaaagttctatccgatgaaaatgccatccaactttaaaagtgtcgttggaggtcatcagctatgcaattccaaccgatttttttcacaagagccatcaaatttgagcccaggggaggcatttttgcagcgctcacgcgaagctaacaaagaacaacttaaaaaactggttgaggaacatgaaagggtcaaaagagaatgtgctgagaaaagaaaaaggctcattcgactcaggcgatactattatctttgtgtatatggctttgccttttttcatttcttcctttagtgcctgtttttggtacttcggcgcaccatcccaaaaatgaatttctctcnnaaaaaaaaaaaaaaaaaaaaaaacaaa

SEQ ID NO: 86465 - DNA, 462 bp, Heterodera glycines
  SCN-specific regions: Sequence locations=1-356,379-462
ccgaaagtctcgactatcggacgtgtcgtcaaaatgtctttcagtgggcattgtttgtgttattcaacggactccggagcattttatgtgcaaaatctgcaggcaaagagtggcggagcactcaaactgttcgatggggcgaccgacggacacgcaatttgtacctttggaatggaagaattcgctcttagcggtgtccatgatttggttgtgttcgtcaatatgcacggcgtttcctcccggccgcccatttccgtgagtggtcggagtcgaattgtcgggctttctctgaaggatccgtttctgcatgtgttaatcgaagatggcaccgtgtctattttcagtaccgtcgatgcccatttggtccaatcgctcgcttttccaaccgacgaagttcaagatgtgcggcaaaacatttgcggtcgatcacctgcgccgatcacttgccaattggagaacatt

SEQ ID NO: 86466 - DNA, 590 bp, Heterodera glycines
  SCN-specific regions: Sequence locations=1-1,23-252,275-412,435 -443,483-590
ctctgttaaagcccttttttaatcggaaatgaatccaacggttttttctttgttttagcggtgctctttcttgtcaaagtcgactttttacagtgcaaatacaatgaaccaatggcacgacaggtgctgcaaaagcacgcttcacaatttcagcagcattgtaaaaatgcccgcagaggaagtgccgtggccaaatgttgcagtgccatcagaagcataatgggccgattcacaagccaaaaaaaggcaatgaaccaaatgctggccaagtgtaaagcgggcacaacgccaagcgaagcacagcaaatgcgaagaaaattggaaggatcgaataaactgaaggattgtggccagtttaaaagccaaattcagcacaagttcagcgagttgaagcagtactgcaacaatggggcagaaaatgaggaggaaaacgacgaatgatcagagagggagagagaagaggagagagtagagagagagaggaacagcaaaattctaatcactagtgatcactgataattgccgattgattgaccggtacgactcatttggctgattgaagttttttttatggcataaagagttgcgtc

SEQ ID NO: 86467 - DNA, 671 bp, Heterodera glycines
  SCN-specific regions: Sequence locations=1-430,452-513,554-671
attgatacctcttcttgacccgtatttggctgtggggatgtgcatgtcattgtgtttacagttctaccaatttttatgcaaaatttgtcatttttgctgctttgcgatgtgccaaagtgtgatcgagaaggtgcactcaaaagcgaaattgagcaaacgtttcccagcctcaaatgccagcacattcactgctacaaaaaatggcctggccacaagttcgacacgttcatgcacgtcactgtagccggacagcaaaagcaacaacattccccaaaactatgtgctgcttctgagcatggaacaaacaaatcccactgcttttgtccaccattgacggatttggattcactgcacaaaatgttgcgggtgaaaggcgcacgccgagtaaccgtacagccttggctagcagtaaacggagaacaacacgaacaacagcaacaacagagtatcaggaacaattgcagctgttgcgtgagcgaaacatgccgagaaaagcaatgctgcgaagcagtggaagacgaggaggagaagaaatatgaaatttaacatacaattttccttttttaaattgtaataattgggaaacagtatgtctttttttatacagtatacctatggttatcgctctgttttttttcattttaaacgcaaattcattttgtttgattaat

SEQ ID NO: 86468 - DNA, 672 bp, Heterodera glycines
  SCN-specific regions: Sequence locations=1-46,68-286,308-672
ccgcaaatctttccattcgaagccacatcttgaacaattggacggagtgaaggaaggggaccaaaaagagcaggagcttagtgaatttatgcgttccatttgcaactttcttagcactctgactaacgaaatgaccattatgcaacggataagtacggatactttgcgctcattcattgactcacttctttcgttggtcagcgatcagcgtcttaaaatacttaacaaacaggtattccgttctctcaacattattgtgattcgactgtgcgaattcacaaatccgaatgtgtgttttgtggcgctgatgaaattggtcatgaaataccaggcctctgatcctggcggtcaattgtcatcgttggtccgcaaatgtctcaccaaattcactgacgcaattgttgagccgaccaggattgaaaaagttgacattctgactgtgctgcacccaatccacgagtattattcgcgtttttatgttgccgatggacaaaccaaccaaatttccgacacagtgaaggacacgtccaaattgttgtgcatttttttgcagcgtttggtcatcaaccaaaaatatgcgatgctcaactatctgtatccgtttcccgaaagttcccaattggtgagttatgtgcggcgatgtatccgaacggtgggccgaaaagcgatgga

SEQ ID NO: 86469 - DNA, 590 bp, Heterodera glycines
  SCN-specific regions: Sequence locations=1-15,37-170,192-286,309 -468,491-506,535-590
taaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcgatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgctttgaatctttttagataaatctaaacccct

SEQ ID NO: 86470 - DNA, 499 bp, Heterodera glycines
  misc_feature (469)..(469): n is a, c, g, or t
  misc_feature (472)..(472): n is a, c, g, or t
  SCN-specific regions: Sequence locations=1-30,52-302,326-470
ttatgcgtgttctcccccttctcttttctgccctcctcctcctctctgttggcctttgctttgcccagtttgatcagtctccgtccgctgctctgaatcatgtgcgggccaaaagaggctacaagccgtggaagaagcaatccttctcctcttcttcaagcgaaatgtacagaaggagaagacccagtggtaacggtcattacagggattacaacggctacggtagcaatggatactatcgacgaaaacccggcattttagaacgggcgctgggaaaaattacgcggagctattaacggacgagcagaagaagagaagcaaaaagccaaacaatgggcgtaacacttttaattgatcaaacgatattacagtatccaacaccaaaattacagtaaccaaacatccaatggaacgaatgactcatttaattcagcaaatttgctggaattgccgataaagaaacttagcnganaaaaaaaaaaaaaaaaaaaaaaaaaaa

SEQ ID NO: 86471 - DNA, 624 bp, Heterodera glycines
  SCN-specific regions: Sequence locations=1-115,138-624
cactttctcctcccttttcccattgcttttgcatttgccgaatctctccgcccccttttttgacttatggcctcgtcctttttgggtaaaagtccgaattcattcacaaacatcgctcatcatcatcagcttcttcagtcatcgcatcatcaaaatggcggcaccgaaattgaaaaacggtccccctcctcctcctccacggcacttaactccggcgatttgctgtcagacaacaacgaagcggcaatggcactttcctcactgatcgaattgggtaaaaatcggcaacaaactcagcgagacgaggctgaaaatggcattgacaatgacgattgccgtttcgatgggtccgtcgccgtttcgtcgccttcggtcatttcgtcgacttttgcggcaacaccagcgaactgttctgccgaaacattccaatcgcacgccaacggcacacacaatgtgacgacaatcaaaacggaggacaacgaatcgggcgacgaattgccaccgcaagatgattccgcgtcggatgcgcccgttcacgaaattcgctgtggtctgttgaacgcgcggctgcacatgcaacgctttacctgcccgggcattcatcggaagtgcgttgagttcgaa

SEQ ID NO: 86472 - DNA, 569 bp, Heterodera glycines
  SCN-specific regions: Sequence locations=1-181,203-529,551-569
tagctgagtcgacaggaaaactgttggtgttgagctcaattgaaggaatggacagacataacgccagcacggaatcggggagtttttttgccttgataaaacgaacagtggtcgaagcccgtgtggacgctgaaattgagcagcactttcagtttggctggatggacgggacccaaattgccagtggcgttgtgatggactctcttcctctgccgaatttggtcgtgctcaattactccagctacgaattttacctcagcaaagatcacccagcgcaaatgacggccaagtcgttgcttttgttccttcacagtgttcggctgggggaagtgacagtccacgggggccgtgcgtggatcacacggctgcgaaggatggcctacgaaatcaccagcaatgtgtacgacatgttccaacaccaacccattctcaccgtttgcctttttggagtgccattggcattcttctccatcatcacttactcaatctgttcggctgatttttccgtggaaagggacgagttctacccggatgatgacgaagaggaaagtttacccttggaggaattg

SEQ ID NO: 86473 - DNA, 677 bp, Heterodera glycines
  SCN-specific regions: Sequence locations=1-540,562-677
atacaaggaaaacgaaaacgacgaatgtgatgatgaacggagcatgccgagaagggcgtcggagagaacgctggacagatttgaggacgtgagaacgattgcctccagtgacattgaagttattcgccaaatggacgattggtcggtcacgagcagttatccgaacagctcccaccagcagagcaacacacagaaaattggacaaattcggtcaataggagaacttcagcaaagccaaacaccgccagagttaactaccaaattggacacttcagaacaatctcagcgagaaatggacgagaaaattgccgtattaatggccaaattggcgcatagggaccaaaagatagaagagttgggcagggccaacgaaaacctgcggacaacgaatgcaactttagtggcgaaaagcaaacaaaaaaatgcggcggaagcaaaacttcaaagtcaatttgctgagaaagaaaaacaactaaccgatttgctagacgaaggacggaaattatccgaatacagcggtcgtcaagcgaaagaagttcgaaagttgaagcaacagttggaacaattggacatcgtcacggctgcgagggacagcgcagttgaggaactgcaagaagcacgccaacagctgcaagagcaagagaacgcaatggaacagttgagggacgaactcgata

SEQ ID NO: 86474 - DNA, 599 bp, Heterodera glycines
  SCN-specific regions: Sequence locations=1-15,37-170,192-286,309 -468,491-506,535-599
taaaagatccgaaaaaatgccaaacattttcaaaatccttctgattgtgcttttggccgtcgtctcattccgtctctcggcttctattggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaacccctaaaaaaaaa

SEQ ID NO: 86475 - DNA, 362 bp, Heterodera glycines
  SCN-specific regions: Sequence locations=1-235,257-328
cagcgagaccgtgaatcgtcatcgccagttaaaatggagccatcattatggaaggcattttggacagtttggaccggctttctggaaacaaaagttgatctgacggaacaggccaagtcggcctggatgtcattgggtgaggattttgccaggaagcgcttgcacatttgaaacgccttggcatcccgcattgattcaacaaattaatgaactccgaataatgtcccaccaattattaaacaatttaaaaaattgacatggctttttgactgtaatggattattatttggtgaataaaacaccacaaaaattaatactatcaaaaatcaaaaaacaaaaaaaaaaaaaaaaaaaaaaaaaaa

SEQ ID NO: 86476 - DNA, 654 bp, Heterodera glycines
  SCN-specific regions: Sequence locations=1-4,55-103,127-471,493-654
ggcgaaaatattttattaaaaatgcatttaaaaatatttttattaattttatttgtgacaatttgctcggtttggtcactttcacccaaaatccaccacaactaccaccaacagcagcaacagcacaacattaagaataaattgccaccaaaaaatattgggacaaaacatttgaaaacggaaattaatgggcacaacaaacacaagcacaacccggcgagcagacacgggcatgctttgcttcaaaaagtgaaagaccaattgaataatgatggatgggccagtgaagatgcaaacaaaacatcggtattgctctcttcactgttggccatcgaatgccatatgaaaaaattggacaagaaaaggaccaacgactcggccgagatcaaacatttgacggagcaaatctgtgccgccgagaacaaagaacaaattggcattcataaactgataaatgaagttgcgaaaacatttgaaaaagatggaaagaaaatggtagaacaaatgaaaagggacgagcatacggtaaaggtgcatcttgacgggcactacggtacgttggccgagattttgccaagcgccaaaaagcacgcgaaggcaacaaggcttcgaacgtatcatgcagtgctccatttgttgcatttgatcactccg

SEQ ID NO: 86477 - DNA, 725 bp, Heterodera glycines
  SCN-specific regions: Sequence locations=1-306,328-584,607-660,682-725
tccggaaggaatctgagagacgttgatgccatgtcgtcggcgatgtttccgagagaattcgacgaatttgaacaattcagacaaaagtatggaccggtggacaaactcaattccaaagtgttcttcgccggaatggatattgtggaggaaatccaagtggagattgagcgtggcaaagtgctgaacattcaaatgttggccgagggaaaattgaactcgaggggcgagcgagaagttttctttgagctgaatggacagggacggtcaatgtttatcccggacaatgaggcgtccaaaagtattgttgtaaggccaaaggcacttcccgggatgaaagggtcaattggagcaccgatgcctggagagattttggaagtcaaagtgaaagtcggtgatattgtgcaacccaaacaaacgctgttcattctttcggcaatgaaaatggaaatgaatgtcggctcgccaattgcgggcactgttaaggctattcacttgaacaagggcgagaaagtctcacccaacgatttggttgtcgaagtcgaacagtgagattaatattatacaaataggttgtgatattgatcatccattcccttcactttgttcccctatttatttgtgttttgtttggttagaccccatccctcccttaaattaggttttatctgtattgtgtcatcacttatgcgatattttccgtgatattcaccaaatggaattgattt

SEQ ID NO: 86478 - DNA, 523 bp, Heterodera glycines
  misc_feature (498)..(498): n is a, c, g, or t
  SCN-specific regions: Sequence locations=1-461,483-499
cgttttccgtcgacccttccaagcaatgcccgactatgacacgttgaccaccgtctacgcgggcgacaaacacctgattgagctgaaagtgaaggcgaacacgcgcattggttggcaatacctcaccgaggaggaggacatcggttttgcggtgtacttcgacccctcgggcaatgccaacaatctgacggagatggactgcgtttttccttacattcgattggaatgttcccaagtgcccatttcgggttccctcctttgtgagcagtcgggccgatacataatcgaattcgacaactattactcgtggttctctgctaaacaattgcggtataacatcgaaatcgatgacaggggaatcggacaatgaaaaagcggacgaataagcgacagaagttgacagtgagaagcatagtaacacaaagaacaccataataataacaaggacgacgattatcaaattccagccaaatatttcattcgaataaattttatttngaaaaaaaaaaaaaaaaaaaaaaaa

SEQ ID NO: 86479 - DNA, 335 bp, Heterodera glycines
  SCN-specific regions: Sequence locations=1-335
ttttttcgtgctgtccagcttcgtcatcgccgctgcctattgctccatcgactgcggtgggaatgcctccccctcctccgccgatggcaaatgcattgcgacgcccacccccgtgccctgagactcaattaattcttttttttttgaatttcacattttttgcgttgctttacttatttatttttgttctttttggtgctcattcattccttttttgattttctttcgatttcaacaaaacaccataaatatctcttgaatctcctctcttcgctttgatcttcttccaaattttacgacgatcattcacttttttctgcagaatattcatcatt

SEQ ID NO: 86480 - DNA, 668 bp, Heterodera glycines
  SCN-specific regions: Sequence locations=23-25,169-529,551-637,659-668
acgcgcactccttgggccggttactacttacgtcatcgggtacgtgcaacaggacgacttgttcatgggcacgccaacggtgaaggagcatctgatggcgccggcacagctttggatggtcggacacacccaacggacgatgcgtagacgcgtcaatgagttggaagaagccatttcggatggtgaggcgcgtcgtttgccgttcgccttcgaaccgcggcacaacccgcaaatcatttttgccctccaaccgactaaggacctcgcctcgtcagtggtggacagcgcggtctcgcacattctgcgtaccctgaatttgttcggccggcgaatcgtcgtcacaattcaccgtccgtcagaaggaatgtgccagaaatttgagcgggaccgtcttttgaagttactcgaacggacgcaaaaggatgtccagcgcctgacgaccgccaaccaacagctcaccaccgccaaccaacagctcaccaccgccaaccaacagctcaccaccgccaaccaacagctcacgacaacaaaccaacaacagcagaacacaatcaaccaccagcagcaaaacatccaacaactccaaaacttattggccggtcagcaaccgcttgttccagcgtttgcccccggggtttttggtgaacaacagcagcatcatcatgcgc

SEQ ID NO: 86481 - DNA, 219 bp, Heterodera glycines
  SCN-specific regions: Sequence locations=1-127,149-194,216-219
aattgccgcccttctcttcctcttcggctgctgtcgtgcggatggaaatgttgtgcatctgtcgagcctcaattgtgccacgaaggacggaggaatcgatggcttaaagctgtggacgacggtctgatcttggattcctcatctgtcaccgctgatacgtctgacctgcccctcatcggtttccagaagaacggaaaggaggacttgatcttcaaactc

SEQ ID NO: 86482 - DNA, 566 bp, Heterodera glycines
  SCN-specific regions: Sequence locations=1-457,479-566
cggtggacaattgtcgatgaaatcaggcgatgtcgctgtgttcgcatccaaatgtcgtcaattactacacttcctttgtcgtcggggaggaactttgggtggtgatgcgtttgttgaactgtggttcgatgttggacatattgaagagaaaaataaaggcagttggcaaagaccaggcggcctacggagtgctcgacgaagtgataattgcgacagttcttaaggaagtcctccggggcctcgaatacttccataattctggccaaatacacagggacatcaaagcgggcaacattttgttggccaacgatgggaccgtgcaaatcgctgacttcggagtgtccggttggctggcggccagtgggggagacctttcccgacagaaagttcggcacactttcgtcggcactccctgttggatggcccccgaagtgatggagcaggtgtccggttacgatttcaaagcggacatttggagctttggcattctgtgcattgagctcgccacaggcaccgtcccttaccatcgctaccccccaatgaaagtgctgatgctgacccttcag

SEQ ID NO: 86483 - DNA, 711 bp, Heterodera glycines
  SCN-specific regions: Sequence locations=1-152,174-555,577-711
gtaaatgttgaattgttttctggacaatgactaccatttaaattttgatcatttctccagttcatgagccccaattgttggcttctggtttgcccgaactgttctggaaatccttatacaaaaagatatccaatcagattttcgatgcaggaaaatattttgaggttatcatcgaagaaagcgaaccgaatgaaacaatttcatcgcaagtcaaagctatgagcgaattgaaaatggacgacccggaaaatgtttttctcattgaccatgcgtggactttccgtccgaatacagcacgttttgcacttcaacaagttgacggactgaggaagagattattggacatgttcaatatcaaagcttggtatgccaacaaagaatgtttaaaggacccttttgctgatgatagcgcagaccaacagcaaaagtgtgctgatgcagtggccactcattccgctgattgtgaggactcggaagtcgcatcgccatgcggccaaaatgtcgaagaaatatgggaaaagcattgcgaaatggacgacctaataattgacgaaatgtggaaatatgcaatgacatattcaattcgaatgctcaatttggaaatggacgaacaccaaattcctgtttggtatgtcatggacgaattcggtgttcgaattggccattctcttcaccaaacgtcaaaatggttccgtttctcgacttttctga

SEQ ID NO: 86484 - DNA, 640 bp, Heterodera glycines
  SCN-specific regions: Sequence locations=1-67,89-254,281-640
ttgaatcgtcgaatccttcgtaaattctctctctctctccattggaattattcattgagatgggtttttaaaaactatcgctttcctttcgcttttggcacttttttgcgcaacaattgctgaagaaaatggggcgacagaaggcacagaagcggaggcgacgacagtgccaacactcaccgcagcggcggagggaggcaaagggggcgaagaggaagtgaccacggcgaagccgacggagacgagcgaaacggcacgggaggagggggaggagaagcacaaggcgaacgaggggaaagcgactgagggaagtggaaccagatcgttgtggcaaaaagtcacctgtatgttgttcggctttttcccatttcgcgccggctgtccgggcaaaaacgatataaaagcggggtcatcatcacatgtgagcagcacaattatgataattgaggaaaaagaggacagcgaatcggacgaacaaatggacggcgccggaggggacgaggagaaacggggaggagagaacggcagcgaagcgcagggcggcaaaggcgccgcaagggacaacgaaatggaagacgaagaattgaaagtgaaagccgtggtggaagagacgacgacaaatgaacagggcaaaactgag

SEQ ID NO: 86485 - DNA, 525 bp, Heterodera glycines
  SCN-specific regions: Sequence locations=1-253,276-525
cactgcgtcggatggtacagcaatatccaatggctgttcttgcctcgtcctgacaatttgatgaaggagctgacaatatgcattgaggattcagcggtggagcagcaatggttggcagccgtggaacaaatcaaagcggcattttccaatgcttcttctcctgtttacttcgacattactgtttactttccgccgccgtcttcgctttctgccgttgtgccatttaaactgaccaacgaaatgactggagagaaattggaaatgtacaaagaagatgtagaagaagatttaagttgtttttccctcattcgttgtccaattgcgcccgatgataagagagagcggatgaagatgattaaggaattggacaaacgatggaatcgaattaacatttttctcatcggcgatggtcttctcgacggtttcccgggggcgagtggcgatcagaaagagcagaagaaatgaatcgatggttgattgattgatgtgattatgattacctatgcgatctaaatgttgggctta

SEQ ID NO: 86486 - DNA, 527 bp, Heterodera glycines
  misc_feature (51)..(51): n is a, c, g, or t
  SCN-specific regions: Sequence locations=30-176,199-349,371-527
aaaaaaaaaaaaaaaaataaaaaaaaaaagggctgcgtttctaaaagcccnctttttttttcctgttgacgaccattctctggttggccccgatggcgattcgcctctgttcacccaccgaatcggcaaatcggcgccggagggccaaccgggcgaaaatggcgcggcagtgacactgacgggggaggaggcggctgaagggcgacgccaaatgagctactggttcatgaacgtcaaggcaagcgacaaattgtctctggaccgcgcattgccggacgtgcggccgaacgcctgtcgctcgctttcctacgatttggccaatctcccttccgcctcggtggtcattgtgttcactgatgagcccacttccgtccttttgcgcaccgtccattcggttttcaatcgttcgccaatgtctctgctgcgcgaagttgtcctcgtggacgacttcagtcatagagaggagctcaaagctccgcttgtcgcccatttgcgtcgcttcggttcgcgcgttcggctctttcgag

SEQ ID NO: 86487 - DNA, 414 bp, Heterodera glycines
  SCN-specific regions: Sequence locations=1-249,276-299,321-332,413-414
tgtggaaaattgtgcaggctctcgacctcgacgactttgccaaacagaagattgacatcactaagaaggaattgttggccgagcgcgacgaagcactcgcagcatgcaagtaatggaaaaggagagacaaacgtagaggaaatgacaaagacgacagaaataaacattcagtgccgacctcaatttggtgggagtcggtaatgcgaattcacatttatgacttttaataaatcataataggcgagcaattaaattaaatagcaaaataaagtgaccttaaaacttggaatgtttgtccattttttcactttttgcaaataaattttgcttacaaaaaaaaaaaaaaaaaaaaaaaaaaaaaaaaaaaaaaaaaaaaaaaaaaaaaaaaaaaaaaaaaaaaaaaaaaaaaaaata

SEQ ID NO: 86488 - DNA, 631 bp, Heterodera glycines
  SCN-specific regions: Sequence locations=1-517,540-631
atttttagtcggaagagtaaatttttcggataaattcatatataaaaggcacaaaaaattcatttggttgccattattttcatcattcattaattatcggcaattcatcttcatcaatcatcccttctctgtgtacaacgaaaacgacgacaattgagcaatgtcggaccatccaaatgttgcgctggccgacctcagctgcgtggcaaacgacgtttggctggacactctgttttggattgaccgcgtggaggtgggcacgaagtttgcactgatcgacgcacgtttcggcaagctggtggccacgcatttcaacctgcgcaagtggaggctgggcgagctgggcgttcatcgtgcaccaagcggatgggaccggggcggcacggcggctgtcaccgttatggacgacaacgcgttgatcaatcgactgccgctcgccacgtgtcctgcaccgggcggcgtgattggcttcagtgccatctacatttggtcttagcgaacaaaatttttttgcaaatttttaaaaattccctaattttccaggtacgtcgacctggaagtgatcgcatttctgcagtgcctgcaacgtgtcatcaatcgcggcatcgctgtgcagttcaccatccattcg

SEQ ID NO: 86489 - DNA, 527 bp, Heterodera glycines
  SCN-specific regions: Sequence locations=1-266,289-527
ccattggttctgtcgtgaggagcaccttgtacatccctgctgagcttaagattccgatatggtggaggaacaacagccaataatttcgccggcacattgtggtagtggtgccgaagaattttcgccagacgcgcagtgcgcacagcaatggaaaaagcccaatgagtcgctgtttgtggtccaacaattggcccgccaagggcttggcccgcgtcaaattttggcaacgctttatcctcgctattgttccaccatttcggacgacatccccgatgagtggataatgcagttactccgtgaactgtgcgagcaccggacacgccaaaaattgtccaattacaacacatttgaggacgcagtggagttattcatgaagagcaagcgcattttggtgatcaccggtgccggtgtgtccgtcagctgtggcattcccgactttcgctccgagaatggggtttatgcacggctcaaaaaggactttcccgagttgccaacccccacggcgatgttcgacattgacttctttc

SEQ ID NO: 86490 - DNA, 508 bp, Heterodera glycines
  SCN-specific regions: Sequence locations=1-164,186-280,303-462,485-508
aagatccaaaaaatgccaacattttaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagt

SEQ ID NO: 86491 - DNA, 591 bp, Heterodera glycines
  SCN-specific regions: Sequence locations=1-168,190-284,307-467,490 -504,533-591
taaaagatccgaaaaaatgccaacattttaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgtttagttttcagattttattctatcctcttttatttattagtttttcaaaacaaatttcttccacaactttttaaactatttgttgttttgaatctttttagataaatctaaaccccgtaa

SEQ ID NO: 86492 - DNA, 663 bp, Heterodera glycines
  SCN-specific regions: Sequence locations=1-663
cccaattggaaaagcggcggcggactgaccaaggcaattcgatgagtgccagtccatcagtttctgctgctctgtacgatttcccgcctgctgacacagaaactatggtgaaattgacaaatactactattccatcaccgaccgccactatcgaaccgtcatccgtgccattgtacgaattgccacccgacaatggtaaaatgccaccatcgaaagcgtcagttgctgacagtgtggtgttgtctgtgggtgtagcgttatatcagtggaaagcgcgcaatgaacaggaaatgacatttggacgaggcgatgtaatcgaagtgttggagcagagcgaaatgaggtggagaggacgacttcagaaaaacagacaaatcaccggatggttccctaaaagttacattaaaatttctgctccttcggagcagcaaaaggatgaaagcgcaacaacggacctttatcagacgggtcaaagtgcagcaaaaaatggaggcaaagcacgcgtgggtgaaagtggagaatggtttattgctctttaccaatttgatgctgtcgagtcaaccgatctctcattgaaacccggcgatcgaatttgggtgaccgaccaacgtgatcaatggtggcgagggacttgcgacgggaaaagtgggatttttccggcag

SEQ ID NO: 86493 - DNA, 425 bp, Heterodera glycines
  SCN-specific regions: Sequence locations=1-321,424-425
cgcggcaccttttactgttcttttttatccgggcatttttgttggcattttggcggtcatcagtgtcatgtctcatcgctggtacacttatcatggcactggccgtgaacttcgccccgtgtcgaacgccttcgtccgctttgtcgccgctttcttcggttgttacagctattttccctacaacactgaccccgaccctgaaccaatcgctgtcgttgaaaaggaatgagtggtgaagaggaaatacgatttaggcaagcaaccacaacactttggtctttttattgttatttccctggcacataaacacagaccaaatgcaaaaaaaaaaaacaaaaaaaaaaaaaaaaaaaaaaaaaaaaaaaaaaaaaaaaaaaaaaaaaaaaaaaaaaaaaacccaaaaaaaaaaaaaaaaaaaaaaaagg

SEQ ID NO: 86494 - DNA, 691 bp, Heterodera glycines
  SCN-specific regions: Sequence locations=1-20,43-691
gattttccatcgaaatacaatcttctctgtttctctctacatatcccaaaattgttccccaatgctgcaagctcatcagtaccaacttcggcaaggtcatcgtcgcgtttctgctcgcagcattttggcccatttcggtttcgaattctcgaacgactaccgacttggctgcggacattacagtaaagtgtacaaaggctatttcaaggaagcgcaacgcacttttgccatcaaagtcaccgacttggaaagcgtttccgagaagttcaagcaaaagtttctgccacgtgagctggaagtttggcgggaattggaccacccgaacctcgtctacttgtacaacgatttccagtggagcgactatcagttcgtagtgatggaattggctgttggtggtgacttgctttcgttcctccaaaaatgtggccccgtcagcgaaacgacctgtcacaattggatgctccaaattgttgctgctttggattatctccaccgtaagggaatcgctcatcgcgatctgaagctggaaaacgtccttctttgtgaaaacggcgtcatcaaagtcactgactacggattctctaagcagagttctgatttgtcttcaacattttgtgggtcgcgttcctattcgtcaccggagattttgcttggcatcgcttatgacatgttcaaatcggacatttggtca

SEQ ID NO: 86495 - DNA, 665 bp, Heterodera glycines
  SCN-specific regions: Sequence locations=1-641,663-665
cagctgcgagtactggcatttgttttcattttattcctatcttcaattcccaaaaacaattgtaatgcaaatttttgaggcaccttggataacgcatgaaggtggcagcattttctctctcgacttccaccctagcggatgtaaactcgcaacagcaggacaggacccttctggtgctggtcttctgattgtgtgggatcttggctttctaaactgcccacccgattcgaaggagttcaattgcagtcaattaccattgacacgaattccccacacaagtaccataaactgcgttcgatggtcaaaacattctgctaccatcagtcgattggtctgtgctggggatgactcgatgatttgcgtttacgaatgcgtcggtgtctattcaagcgaaggatccttcagcaacagtttggaaatgcctacgtgtcaaaagcgaaatatcgaaagctatcgctgcactacacaaattgtatggccattccatcgatgtgttgcacattgactggtcttcggatggacgctttcttgcctcgtgctctttggacagcacaatcattgtttggaatgcactaaaattaccagaaaaggtaattgtcttaaaacaaacaaacgacggacatgtgcgtggagtaaaaggcctcgcctgggacccaattggtcgt

SEQ ID NO: 86496 - DNA, 480 bp, Heterodera glycines
  SCN-specific regions: Sequence locations=1-124,153-153,206-453
ggtttcgactgtttagcaaacaacagggtctctgcgaagcagcaatgcgacgtatagggtctgacgcctgcccggtgcctgaaggttaaagggaggagtgaaagctccgaactgaagcccatgaaacggcggccgtaacaatacggtcctaatgtagcgaaattccttgtcgggtaagttccgacctgcacgaatggcgtaacgacttccccactgtctccatcacatgctcagtgaaattgaattccccgtgaagatgcggggttcccgcggtcagacggaaagaccctatgaacctttactatagcttcgccttggcgttagcgaccgtatgtgtacgataggtgggagactatgaaaccggggcgccagctctggtggagtcgtccttgaaataccacccttactgttgctgacgtctaaccgagggccgttatccggtcccgggacatggcgtggtgggtagtttgactggggcgt

SEQ ID NO: 86497 - DNA, 385 bp, Heterodera glycines
  misc_feature (51)..(51): n is a, c, g, or t
  SCN-specific regions: Sequence locations=1-351,374-385
gccgatgggaaaagaaagtcttggggaggagcagcgaaaggttcttttggngcctttgctgaaggagggatgggaaacggcgcaggagagagatgcctcaaaaagagcttacttaaaattctttttcaagcgttcggttctatgacgcgaatcgcactaaaggcggtccctccgtactaccacccattttgtctctacgtctataacaaagtggacatcacactgagcagtcacgacgtgcaaggcatttccgagagggacgtcaaattggcatcgttcattgagaacgtgttcaaaacagtgaagtgaagatggcgttcgttgtgaatcaaacggatacaaattgtcattttgcaccctttttaaataaaatgataaaaaagtc

SEQ ID NO: 86498 - DNA, 580 bp, Heterodera glycines
  misc_feature (527)..(527): n is a, c, g, or t
  SCN-specific regions: Sequence locations=1-168,190-284,307-466,489 -504,526-580
taaaagatccgaaaaaatgccaacattttaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatntcttccacaactttttaaactatttgttgttttgaatctttttagataaatct

SEQ ID NO: 86499 - DNA, 324 bp, Heterodera glycines
  SCN-specific regions: Sequence locations=1-324
ggagaaaaaggaagaaactgaagttaacagtccgattgagcccaatctggaagtgattgtactgcacacttagttgagcggactactagtggaagcgaaaatccaagcgagaaatttatcaagtcgagcagcagcaactgaatcaatatggcgaaaaacaatatcaacattaaccgtggcgttcaagaccctttttatcgttacaaaatgcctcgcattttggcaaaagttgaaggcaagggcaacggaataaagactgttattgcgaacatgcccgaaattgcaaaggcactgtcccgtccaccgacctatccgacaaaatat

SEQ ID NO: 86500 - DNA, 181 bp, Heterodera glycines
  SCN-specific regions: Sequence locations=1-181
aacagcaacaaaaacaggctcaacaagtacaacaacaaccgccgaaaaatgccaaattgcaaattgtcacaatcggcggatggcacggctggcccacgctgacgacgaatcggccgaccaattggctgcccgggaggactgggcccattttgaaatggttgaccgtcagctggacgaactg

SEQ ID NO: 86501 - DNA, 282 bp, Heterodera glycines
  SCN-specific regions: Sequence locations=1-282
tcatttgaggagggcttaagggacatgagtggcagcagaaggggcatcattcgcaatcagaagcactaaaccgagcaaaagtcagtattggtgcaaaacgccctctgacgggtgcttcgtcttcgtcggaggacgactctggggtgctcgtcacacgagagcatgtgccgcgtaagggccgtacgcttttccgtgccgtcgatgctatgcgttgcgacagtgttggttcggcagtctcggcacaacagcaccggagtcgttcacacaagccaaaacccggtg

SEQ ID NO: 86502 - DNA, 645 bp, Heterodera glycines
  SCN-specific regions: Sequence locations=1-65,87-345,367-645
tcgtgcactgctttatttgagtggcattcgagcgctgtcggattgggcaggacaaacctccaccggtggaaaaacatcaaaagggcaaatctgttttggcacagaacgcacatcttcctcccctcggcttcttccgtgaacaacgttaccatttggagaagaagatgttgaaccaaaatggtgttctcaatgaaaataacttttttgcgattcgtcctgcaaatgagcctgaatttgttccgaaattgaaggatgtgatcggaaaagcgcttgataaaattggtacttatggcgatatggacaattctgatcaggtggtcgccgttattgatgatgacttatgcattaattgtggaaaatgctatatgacatgcaatgattcgggctaccaggcaatttcatttgacaaacagacacatttggccaaagttaatgaagagaattgtacgggttgcacgttgtgccacagcgtttgtccaatccctgattgcattaaaatggtgcctaaaacgataccgcacaaaataaatcgcggaattgcaccgcgtcaacaacaaaacggagacgacgcacaacaaacggcacagaatgccaatcgacggattatattggaaattaattagaaaattgatgatggagcgcgct

SEQ ID NO: 86503 - DNA, 654 bp, Heterodera glycines
  SCN-specific regions: Sequence locations=1-238,260-654
tttcgccgcggggggacgggcgacctaagattttgctgtgccaggaaatttggtcattcgctgacaaaattcgggaactaaaaacggcattttgcgacgcctctgcccccgttagtttcatcattcgtttgtatttgagcagttttgctggtgaacagtttgaattgcgcaatgatcggaccggggaaatgttgagcatggaaatggtcgcgacagaggacgacgaagacggagaaggacaacaactacagcagatggaggaggaggacaacgacaatgccgacattctgacccactacatcaagccggagcgcaatttgtggttgttgaagcgtcgtccgaccgttgggggaggaaaatggcaaaaacagtgggcccaatgggaggcggaggcaatcggatggaattggaccaatgcatggaatgtgatcgaagttgcaaatgaagaggacgtggacgtgatcgaagatggcaatgaacacttggacatggacgaagtgacttatgagggagaggcgatggacgaggtagatgagatggatgacacggacggatgaacgctttaaacagacattggacgacatttaaatgatgtgcaaaatgacaaaatttctacaatttattcatttttttaaaataaagcatttgactaac

SEQ ID NO: 86504 - DNA, 653 bp, Heterodera glycines
  SCN-specific regions: Sequence locations=1-65,87-252,279-506,528-653
caatcgtcgaatacttcgaaaattctctctctctctccattggaattattcattgagatgggtttttaaaaactatcgctttcctttcgcttttggcacttttttgcgcaacaattgctgaagaaaatggggcgacagaaggcacagaagcggaggcgacgacagtgccaacactcaccgcagcggcggagggaggcaaagggggcgaagaggaagtgaccacggcgaagccgacggagacgatcgaaacggcacgggaggagggggaggagaagcacaaggcgaacgaggggaaagcgattgagggaagtggaaccagatcgttgtggcaaaaagtcacctgtatgttgttcggctttttcccatttcgcgccggctgtccgggcaaaaacgatataaaagcggggtcatcatcacatgtgagcagcacaattatgataattgaggaaaaagaggacagcgaatcggacgaacaaatggacggcgccggaggggacgaggagaaacggggaggagaggacggcagcgaagcgcatggcggcaaaggcgccgcaagggacaacgaaatggaagacgaagaattgaaagtgaaagccgtggtggaagagacgacgacaaatgaacagggcaaaactgagacaaacgtcgaacag

SEQ ID NO: 86505 - DNA, 661 bp, Heterodera glycines
  SCN-specific regions: Sequence locations=1-531,567-661
cgttggtttgctgatcctgagaatgaggaatcattcggcacaaagccaaactgatggcggagaagtgccaaaaagtggtggggaagaaaatggcaaaacggagcaaacgggaaaagctgccagagaggagggacgggaaagcattgatcaagttttggaagacaaaacgggtgccttagcagatgttccggaagaggagatggtgatcagtcaatgtcagatcagtggggaaaatcagagcgactcgaaaaaggaaggactgatcagtcagggagagccgagaaatctgtcaaatgctgggccgatcagtcaggaagggcagatcgattcggaaaagaacgacgaactgatcaatcagcaagaacagcaacaagtcactctgatcagtgaagaagggctgatcagtgagaaaaagcagcaaacggtcaccgaagcgacgacagacgaagaagcgttattgatcagtattcagctcaatgagttgacgatcagcccagcaaaagaattggatgccgatgatggaaaagatgctgttgtacagctccaaaagcttgtggccaatggcattgcttcaggggaagttggccaaattgttgcggatgttgtgcaaaatgttgttcaaactgacgctgctgcaacacctgccgtacaacatggacaa

SEQ ID NO: 86506 - DNA, 149 bp, Heterodera glycines
  misc_feature (75)..(75): n is a, c, g, or t
  misc_feature (78)..(78): n is a, c, g, or t
  misc_feature (80)..(80): n is a, c, g, or t
  SCN-specific regions: Sequence locations=1-149
taaaagatccgaaaaatgccaacattttaaaatccttctgattgtgcttttggccgtcgtctattcccgtctctncgngnctttctacctggtgacaaaagaactgctaatgatgggagtggaaacaactcatcagctgggattggtac

SEQ ID NO: 86507 - DNA, 776 bp, Heterodera glycines
  SCN-specific regions: Sequence locations=1-243,266-427,449-776
tacgtgaaactctcgaggcgatctttctctcaagccattgagcgtattacctgggaccataattttagcgattatactttgtttgtgtgagcgttcccgaggcccaatctcgacgactttatacggcggtcaaaaactcgttagaactacacactatttcaatccgagagtctttgctccgtttgtccggtgaccaattgctcagtgcgtacaacagcgaatgggaaaaatttcacaaaggcgccatttatttgcataatctttacggttatctgaacaaacaattggtcaaggaaaaaatggacgcggagtcgcagcatccttttgtggtggataatgacagcgatggtttataccctcatttgggagttggcgaccttgccttttcaatttggcgaaatgagttgctcatgccgttggctgctcagcttgtggcccatatcattgggctgctcggtcggattcgaaatggtatctctgcttcatttggcattcgaatttcggacctccggggcgccgtcctctcctttgtcgatgtcaatgaatccatccatcgggagcaaaaagcacagcttttgtgcatgtccattggtattccgacaacagagttctacgaagaaatattcgagaaacacttcttggaagcatctgaaaattactaccgaacacttacaagtgaaacatttgttcacctcgactgttgtccttacatggatgcggtaattcaaaaaataaacgacgaaagaagcatcgttcagcgcttcttacattacagc

SEQ ID NO: 86508 - DNA, 676 bp, Heterodera glycines
  misc_feature (639)..(639): n is a, c, g, or t
  SCN-specific regions: Sequence locations=1-128,150-165,220-339,362-676
ccttgtttgaatggacgacgaaaacactcatcaagcgaatatggaacgagtgagagaggacgaagatgaaaaaattggtctgatggacattaaacgggaaataaaagccgaactcaatgaagcgattggtcgccaaacggaagatggcgaaacggagccaaaggcggagagagagcgcgagaggaaaagcgacagagagagggagcgcaagaagaagagcaagcggacttcgcgagaccgaagccggtcgaagtcgcgggaacgcaaacgatcacgcgaacgccgacgaagtcgctcgcggtcgaaggaacgccaccgcgagagagagcgaagccgggaaaaggaaaggggcgaaaagaggtcgaaagtgaagagcaacaaatattgggatgtgccacccgctggctacgaacacatgagcccgaaggagtacaaagaactccaagtagtggtcgtccattagaattgcgcaagggtgctgaatcgatggattttttagcatttagctaccggcgccatccctcgggccaccctccaatcgtctgttccggtggtgggcccttcggtcacttgtcaggcgcgacggctttacgtcgggaacattccattcggttcaaatgaagacgcaatgctggactnttttaaccaacagatgcatttgtgtggtttggcacag

SEQ ID NO: 86509 - DNA, 537 bp, Heterodera glycines
  SCN-specific regions: Sequence locations=1-537
ttaagccttcgatgcttcgctcattcgtctttttgtgtcgtacttttccgtctttgagttttggtgcgcagttaacaaaaatctgttcgccgcttcacaaaaaaatgctgctctaacgaaacatttgcacgtctctcctttccgttacgccgattcttcggacgatggcaaagaaaaaaaagaaaacacaattaaaattgacgaaacaatccaaaaggataaagttgacgaaacactccaaaaggaagaaaaggcggcccaattgacgtcattagagccgcaaaggttgaggatgaagccggacaaccggcgagtgctcgtccgaatggccatcaaagcacacaaaataaatgcggccagcgaggagggcggcggaatgtccggcgcaaaaagccttctctccatgaacaccactgaaatcgaccgactgtccgcgtgatcattaagaaaatccgaagggtgtgacgccattgtgaattgtttttgcgctttttcttctgttctctcctcaacggatgaataaattgatgaatgcca

SEQ ID NO: 86510 - DNA, 579 bp, Heterodera glycines
  SCN-specific regions: Sequence locations=1-6,139-273,313-579
aagcgaaaaaggaagaagcgacgaaggaggagccgaaaaaggaagaaacaaagaaaggagagggcaaaacggaagaagctaagaaagatgaagccaaaaaggaggagccgaaaacggaagaggccaaaaaggaagaagcaaagcccagtgccccggccgtcttaactgaagctgccgataatgtgaacaaagcggtcgatgacttaagcgttaaacaggcaaaagcattgaaaaacgcggccgaagcaacggcagagaaaacgccggaagagcaggaaaaagcattgaaagaagtggcagaaaaaggaggaaacgaacagctgaagacggctgtcaacaaaattttggaggcaaaagcgaaaaacgacgcggaattggaaagcgaagtgaaaacgaaaacggcaacactttctgaggacagcaaaaaggccagcgcagagttgactttgataattgaagacaaaaagacgactttggacgagaaggtgaagcggacggaggagctgacagccaaaatgtcggacaacacgaagaaggagctgaatctgaacaacagtgccgacgtcgtcgccttcgtca

SEQ ID NO: 86511 - DNA, 657 bp, Heterodera glycines
  SCN-specific regions: Sequence locations=46-52
ccatcgagaatgtgaaggcgaagatccggacaaggagggcatccaccggaccacagcgtctcatcttcgctggaaagcagctggaggatggccgaaccctcgcggactacaacatccagaaggagtctactctccatcttgtcctgcgtcttcgtggaggaatgcagatctttgtgaagactctcaccggcaagacgatcaccctcgaagttgaggcgagcgacaccatcgagaatgtgaaggcgaagatccaggacaaggagggcatcccaccggaccaacagcgtctcatcttcgctggaaagcagctggaggatggccgaaccctcgcggactacaacatccagaaggagtctactctccatcttgtcctgcgtcttcgtggaggaatgcagatctttgtgaagactctcaccggcaagacgatcaccctcgaagttgaggcgagcgacaccatcgagaatgtgaaggcgaagatccaggacaaggagggcatcccaccggaccaacagcgtctcatcttcgctggaaagcagctggaggacggtcgaaccctcgcggactacaacatccagaaggagtctactctccatcttgtcctgcgtcttcgtggaggaaagaactgtattgatgaatgacacgatggacatatattgt

SEQ ID NO: 86512 - DNA, 431 bp, Heterodera glycines
  SCN-specific regions: Sequence locations=1-409
cattctcctcgctattctgactacaccgattgtatccatcatattcgggccaatatggcaattacggtggctacaattacggcaattattacaatccatatgggggcaatagccgaggctactacggtatgtacgacagtccttcttacggtagcggatattcgccctcatattatggtggctattatgggaggaatggtggcctagggtatggtggaatgtacccgggctacggtggctattcgactgcgtcctactacggcggttggccctatacggctgggtacggtgctcagaacggatacacatcgccgtggagataagcagaagaattgcgaggaatttgcgaagggaccgatcagaaaggacggaaatggcaaactctctcataacaatggcataaatgatcaaaaaaaaaaaaaaaaaaaaaa

SEQ ID NO: 86513 - DNA, 586 bp, Heterodera glycines
  SCN-specific regions: Sequence locations=1-411,433-586
acgcttagccgcgatgctcatgcagaaccctgctggcctcatggggacaatgtatgcgcctgccagcggtggatttttcctgcccaggccatccagaaccaacgtgctgcgccgttcatgcaaacaccgaatctgtccggggcacaaatgcgtggcgctgtccctcgctggaacaatatgggcggtttcaaccatccaatgcaaggctacatgatgggtccagctgttggcggtcagttcggcggtgctaatcaaattgctcgtggaggacctcgctccggtggtatgggtggtggcggtggaatgcgtcagtacgggggacaaccccgtcagcaacagaaccgcatgccgggcatgggcggaggtcatcagcagcaagggatgcgctaccagggacagccgaaaggaatgcagcaacaacaacaccagcaggctcagcaaccacaaattgcctattcgtcgtatccgcagcagcagactccgtggcatggcaccgcaaatgggcggcggatgcggtggaggagtcaaagctggccatgcgatcactgcaacacaccaggaaccgttgaatacacagatgcttacc

SEQ ID NO: 86514 - DNA, 653 bp, Heterodera glycines
  SCN-specific regions: Sequence locations=1-507,529-653
cacatggaagaatcggtggaaagcaaacgaacgagcgaacaaaatcaaacacaacaggaagttgaacagctaaaacagctcgaaaatcgggaggagggagccaaaaatgggcaacagacgaacgaaactgttgccattgaggaggaatggacaccgacaagtgaatgggtggaatcgtggaagaagaagttgccactgcagacgatcatgcgagtcttgcagattttggtgccgcaagtggagaaaatttgcattgacaaagggctcaccgatgaaagtgaaattctgaaattcctccaacatggaacacttgtcggacttcttcccgtccctcatccaatactcatccgaaaatacattgcgaattctgcaactaacaattggttcagaacatacctttggggagtcgtttattgccgtaacatcgacccaccaatttggtttgacagcaacgtcactcttttcgaaattcagcgattgtgaaggaatgaaaatgaatggtttaggcactgaggaaaatgcatattaagaaaaaaaacctattgctgatcgagcagcttaatctttgtttttcttttttctaatgccatggtcaaccgacaaaatattaaacctttctttggctatttattggtacaattccttttcttgtg

SEQ ID NO: 86515 - DNA, 665 bp, Heterodera glycines
  misc_feature (2)..(2): n is a, c, g, or t
  misc_feature (651)..(651): n is a, c, g, or t
  SCN-specific regions: Sequence locations=1-207,229-665
cngccgctcttttgacctttacctgcgttttcccgaattgaagccggtggaacgggcgcattttcgataccctcagacaattgatgacgccaaaaggcttggccgtgtgcttatccgttacaaagaccttcttttttacaccgttctttcgggcgtcgccgccatctataagatacgctcccccttcgcaatccctgttttcatctttttgaccattttgtccggttaccttttctcctttccgttggcgttggccctcgtctgtctctgttcggctgccggtgccaccgtttgttatttcctttcgcaaatgttcgggcggagtttggtgatgtattattttcccgagaagttgtcaaagtggcaaattgaggtccaaaaacaggcagacaatctgttcaattacattgtctttttgcgtgtcacccccattttgcccaattggttcattaacttggccagtcccattgtcgatgtccccattttgcccttcttcttcggcactttagccggagttgctccgccgagttttctgtttatccaggccggcaccacccttcaaatgatgtccaatgccaacgtcgtttggtcctggggctccatcgctcttctcgcctttttcgctgccctttctctggcgccaattctctntaaatatctaaaaa

SEQ ID NO: 86516 - DNA, 342 bp, Heterodera glycines
  SCN-specific regions: Sequence locations=1-342
tcttcgtgttctgccgtcccatcggacccgcagcaaaaaagcttttatgaatgttcggccaaagacatggacggcaatgagacctgctttggcaaataccgtggcgaagtgctgggggtggtcaacgtagcgttgaactgcggcttcaccgacttcaactacagtcagctgaagcatgtgctggacaaatacaagtggaatggactcgaaatcgtggccttgccgcgcaaccaacttaacaaccaggaattgggctgtgccattgacataaaagactttgtgaccaaaaagtacaacttcgaacctgatctatacaacaaaattgacgtgaacgggcccaat

SEQ ID NO: 86517 - DNA, 533 bp, Heterodera glycines
  SCN-specific regions: Sequence locations=1-2,41-112,180-533
tacgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggaacaatcacacactgcgcatttgctgctcaaattgaacatcgcaccagtaattaacaaattcaatgttgacgacgtgcgtctgctcaaaacgataagccaagtcgtctcgaggccggaaacgatggcacgtgccaagaaagtcttggcgctgttcatggaccgcccggtgcccgcgattgaggaaggcgcttttgcggtggagcgactcgtccgccttcccccggggggccatgccaaatttatgcgccgcaagggaatggcatttgggtggacggaatttgc

SEQ ID NO: 86518 - DNA, 491 bp, Heterodera glycines
  SCN-specific regions: Sequence locations=1-67,89-426,448-491
catcgatgtgttcgagatcacgaagcatttgctggccaagtattggccaatttgaaggcactcgattctgattggttctgtcagaattatatgaaacgcaaagcaaaatttgggcttttgccattggaaaaagtgaatatgtggggtggctctctctcattgggccatcccttcggcgctaccggcgtccgattgttggcacacgcggcgaaccgactgcagtccgaaggggggcgtttcgcagtgatcgcggcgtgtgctgcacgcggacatggcatgggaatgttggtggaaaattacgagtcgaaacagaagtaaaagagggagacggagggacggacggaattcactcgtcgccatttgtataattgatttacaaatagaaatatcggaatagtgaaaacactaattcaatgggaatgaatgagaaattgtaattataaaaattgtactgcttaaattcttattaaagattacgtgccggaaaaaaa

SEQ ID NO: 86519 - DNA, 582 bp, Heterodera glycines
  SCN-specific regions: Sequence locations=1-281,304-463,486-501,530-582
catccgaaaaaatgccaaacatcttcaaaatccttctgattgtgcttttggccgtcgtctcattccgtctctcggcttctactggtgacaaaaaaactgctaatgatgggagtggaaacaactcatcatctgggattggtacgaagatcaaaagaattgtcaccgctggactgctctttacttccctggcgacgggtggggcggaggcgattgggcgaagcaatgctcagggaggaagtgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaacc

SEQ ID NO: 86520 - DNA, 621 bp, Heterodera glycines
  SCN-specific regions: Sequence locations=1-80,102-512,535-621
ggctttatcgactcaatttgggagcattggaggcaaaacaaacagagtcggctccaacgcgagacggactttccgcgcaatgacgccgcgtgtgcgccgcggtggcacttctcagaagagttcatgccgatgctgcagccgttgtggaacatcgacgtgctctccaacaactacacggacaacatgtacgagtttatgccgaggccgagctgtgcgcgaaccggcaagtcggaggaatgcgggagcagcgattatttgtggtgcgactcgcgaacaaatggtggtcacgcggtttgtacgtcaaagataaagcccggggggaattgtgccggcttcgaatggagtgccgaagtgtgctacgggggcagtcaatgtgtcgaagggcggtgcacaaaggcaaaaacgatggacaaagagaatgacgagggaaaagcgaagaaaatggacgacgacggcacggcatttatgaggggcggcgccgaaaggggcgacggatggcattcgacgatcagttttatgaaaaaacgataaacaaattggccgagacaaaagccattctatctgatgctagtgtgtttaattgtgatggagaaattgatgaaatcccaatttttggcactc

SEQ ID NO: 86521 - DNA, 672 bp, Heterodera glycines
  SCN-specific regions: Sequence locations=1-115,141-285,307-672
ctattgcggctgctgttctctgtccgtgccatcatcaaatcaaatcaacgaaagctgagccatcggaagtgtgcacaaatcgactaccaaacgaaactgggcaccacaaatcaacaaaatcatcattatcatcatcagtaaaagtggtgcagaaggaaacgcatggaccaaatcggctgttctttcagcgaccaaatttggctcgacacattggcgtggattggacgtggcgaggtcggatggcacttggcgctggtcaacgcccgcttcgccgccctggtgaacatgcagctgcagcagaggcggtggtgtttggaggagtttcacatcagtgagcggaagccgaaacggactggcgccgaagtgttgagcttggcaaacaacggctcctacttctcgttgccattggccacctcaccgttgccggacagtgtcatcggattcaacggcacattcaacatttggtatttggacgcagaagtgatcaattttctgcaacgatttcggcgcctcttcaacacgtacatctcgctgaagttcaccattccgataacagaatttcgcgcttggcaagccgtggcacctcacatttggcccttgctgaagaacgggctcggcacgttggtcaacgtgaagcggaagcaactggccttgatgcgcaaacacatttcg

SEQ ID NO: 86522 - DNA, 670 bp, Heterodera glycines
  SCN-specific regions: Sequence locations=1-263,287-670
gatggtgaaaaccgtccttggtgggcgatgtgaattttgaggaggccaagcggtggccggctttctgacgcctgtgcccggcggcgttggcccaatgaccgtggcaatgctcgtccgcaacaccttcctccaggcggtgtgccaaaaactgaacggccgtgttgagcccgatgggaccgtgaaaagccgcgcagtgaacgcatggaagctttacccgttgaagctcgatctgtcttcgcccgtgcccactgacattgacatttcccgggcacaacagcccaaggcgatcggtcgtctggcggccgaagttggcattgcccagtccgagttggagctgtacgggcacagcaaagccaaagtgtcgttggcagtgctcaaccgtctcaaggagcgcccgaatggaatgtatgtcgtcgtggccggcatcaatccgactccgttgggcgaaggcaaatccaccaccaccgttggacttgcgcaaagcttgtgcgcccatttgggtcgcaacactttcgcgtgcatgcgccaaccgtcgcatgggccaacctttggcatcaaaggtggcgccgcgggcggcggctactcacaggtgatcccgatggaggagttcaatttgcacttgactggcgacatccatgccatttcggccgcgcataatttgatggccgct

SEQ ID NO: 86523 - DNA, 591 bp, Heterodera glycines
  SCN-specific regions: Sequence locations=1-591
ggtagatgagccttcagcaccatcaatgcatagccatcgaaaaacagcaaaggagcgaacattttatgtccagtgtttttgaggagtgcgacgccctaaaacaggaatacgacaagtgctttttgaatttcttcaaaacttttgtaaaggaagacgaacgacacgaaaggacagtcaatccgtgccaacaattgcaaaacatttatcacaagtgtttggaaaagaatttaaagacacataagccatacgacatcgatttggacgagttgaagaaggaagtgtccatcagcatcgaggagaacatcgactggaaacaacgcgggaattgatggaggaaattgtgcaaagtgcggcgaacggcggcataagttcgacagcgccggaccaatccagcgaaagtcgtttcaaccaattggaacggaatttggagctgttccaggaaaatgcgcgtcatatgggagtgatcgccagtgacttcacttccaaaagtcaggagccgttgaatcagaaaattcacactctcatctcgggccttcaggttcttgaccaactcaaaagccaattcaccgatgttcgtgttcccattgaatt

SEQ ID NO: 86524 - DNA, 462 bp, Heterodera glycines
  SCN-specific regions: Sequence locations=1-46,68-322,344-462
ggccgaaccgctctcgcgcggcagtcccccggagggtttcggtcccccaccgcccgtccccacccatcagcagtcatttggagaaagtgaggccgtgaaagagttggagcaaatgccgggagtaaggcgaatggatttgatcaaagtggagtcggacggaatacacaagggattgggcttcagcatcgccggaggaaccggaaaccagcactatccgggcgatgacggaatttttgtgacgcgaataatcaaaggaacgccagcttattacgacggccgactccaaaaaggggaccaaattttggcagtggacaataccatctttaaaaatgtttctcatcagtttgccgtggacactctgacgaacactggggaccgagtgaagattctgttcttgaaaaaccctcacccggacattgaatcgttcggcggaatggagggcaatacgttcgatctgaccgg

SEQ ID NO: 86525 - DNA, 551 bp, Heterodera glycines
  SCN-specific regions: Sequence locations=1-238,263-375,397-465,487-529
attgtggaatgctttctgccgaagatgaaaaaacggagattgtaaacatttgggggacaaaaaagtcattttcttgcgtaaccacggctttgccgcctgcggcgcctccgtggaagaggcgctccacttggcctatcacacgctgatcgcctgtgagactcaagtgtccgcgatggcggcgggcgaaaaaatttgatatacccaaatgaaattgcgaagaagcgcgcttatgacatcgcacagcacggagccaacggaatgaatcgtacggcatcgggccaaaacggtacaatggcacacacttatgagaaaatgggagacatcgaatggggagtgggcgaattggagtgggaggcgtgggtgcgccaattggacggggcgggctaccaaaccggacacaaatatcagatgccatctctgctggaggctgtgatgaagggaaaataggacgaagccgatgattaatttcagaaaatggtttgattaatttcggaattaaattccaaaattctataaatctttttatttcaaaaaaaaaaaaaaaaaaaaaa

SEQ ID NO: 86526 - DNA, 563 bp, Heterodera glycines
  SCN-specific regions: Sequence locations=1-131,153-563
cggcaccgtagccacacgcgcactttgggcgaatcgttgcgacgtacgcttctcccacatccagccaattccccgattatgtgttcatttggaaattggacgcagaatcggcagcaaatgagtcggaactgatcaaagccacgccaaatgtgcacactttcgaatgggtgccgcaaaatgccattttaaggcatccaaaattgcgcgcttttgtcactcattgcggccaaaacagtctggcggaggcagcaaaaatcggagtgccaattgtgggcattccgctgttcggtgatcagctttacaacgccgtgttggcaaagcaccgagggatggccgtccacgttggcattcgccagctaatcgcagacaaaacgggcaaagtgctgagaacagcgctcagtcgggttctccacgacgcctcttttcgtgccaatgccaaactcatccaaaagaaaattgctttgtcgccattcggtgcaaaagagcaattggtgcgttgggtggaattcgcagccgaatttccgcatctgaacgagcttaacatgccaaccgattattattca

SEQ ID NO: 86527 - DNA, 660 bp, Heterodera glycines
  SCN-specific regions: Sequence locations=1-472,496-627,650-660
ttcgctggacgcggatgagctgagctttggctgcgatgaaccaccggatgtccacatgctcggcccgctctcgtgaacgcaattttgaatcggcacatagaaacggctattttcttgttggagaagggtgctgatccgcatcagaccatgattggccaactgaacggcttgaacatgaatgtgacaccgctttgggccgctgtcgtttttgtcaatttggagctgtgccgtgcgctgatcgcccatggtgccaacattgaaatgggcacggactctggccactcgccactgctgtgcgcatgtttcaatggcaatttggagatcgccacttttctcgtcgagaatggcgccaacgctaatctcgcggacactgacggaatgacgccattaattgtcacttccttttcgggacagatcgacattgtacgcttgctgctttcacatggtgccattgttgaacagacggatttcacggggatgaaatttgctcttttgggtgccgccattggtgcccgtttggaagtgtgccgtctgctggtggacgaatgggcagcggatgtcaaccaggaaacaatcgacggcaccactcctctgttaggcgctagcggtgagggacacgtggacgttggtgaggaaaaaatgaattttctcattgaacgt

SEQ ID NO: 86528 - DNA, 479 bp, Heterodera glycines
  SCN-specific regions: Sequence locations=1-335,357-454
atcgatttgctagcgaaatgagttttgttgagcactttaacttggtgaacggacggaccaacgaaaggctgacattggaaaaggaaggaaattattgtctgttgaagcgatgtccaaatggcccaaatgttggggaaacggcggcggcggttcaatgggaaaacggcggaaattcggatgccaatttgaacaatgtcatcattattttggatggtgtcgaacgcatttggccattgtctgcgctagaagaagaagaagcgggtcaaagcagcgaaaaagggacgtcttctgacaaatgagtgacggacaaaagaacaacacaaacagtgatcagcagaagaaatgaatgaatgaatagggaaatgatcgatcataataaagcggtgataataatgcattttatgaagaaatcgcaattatatgtgggtatatttaaataaatttggtgtaacccaaaaaaaaaaaaaaaaaaaaaaaaa

SEQ ID NO: 86529 - DNA, 408 bp, Heterodera glycines
  SCN-specific regions: Sequence locations=1-32,73-84,106-207,229 -296,324-348,376-379,403-408
taattaaccctccgatgccttcccccatccgccttttctttcttttcctgtttctgcttcttctcctcccatttttgtccttcgccgctttgtccccccgagagaagcgccaattcagcttcaccgatggcttctcaagcggcacaattttgcagccgggcggcggcggacttttgagttggtggcggagatgagccaacggcggaagtgaagcaaaacaatgggaaagattttgggttgtgatttgatttatgacgaatgaatgacccaccgatcaaccgacttaccagaccataattcattcattcattcattcattcattatgccgtgccaatatccccccaacccatccttttattgtaaataaaaaatttaagcaaaaaaaaaaaaaaaaaaaaaaatcaaag

SEQ ID NO: 86530 - DNA, 590 bp, Heterodera glycines
  SCN-specific regions: Sequence locations=1-20,43-590
ttaattaaggacctttcaagaacatgcatttcctactctggaaaaattgttcggagatgcaaaagctttgttcgtaacacaacgcctttattggattatgacattggcagtttgccaaaacgcgtcaaattcattggtggcattgatctgatgcagcccgatcacaaggatgctttaccgcaagtttttgggcaaccaaaaccggtgatcgtgttcagcatgagttctttactagaaccatccaaaatgccattggacaaatttgagacggttattcgaggacttggagtgtgtgaaaaggaagtgatttggaaatatgcgaaacaggaggatcatggtcggatgtcactcttgcaaaagcatgctcctaatgtgcatcttgtggagcattacgatcaagccacagttattggcaataaaaagacggaattggtgatcagcgaatgcgatattcgtatcgtaatggatgcgttaagcagtggaaaagcattgctttgtctgccgatgtttgccgaacagttttatgtgtcggaaaagctgcgacgcatgggcgctgcggttgtgcttgatccgcgcagtggcagtttcac

SEQ ID NO: 86531 - DNA, 779 bp, Heterodera glycines
  SCN-specific regions: Sequence locations=1-779
attgagagggaagcgtccgaactttccaattacttgactccctatgcaatccgaacgcatttaagaggcgtcctgatgcactctttgctcccaaacgcattggaggaatggatgtcgcggctgtcagctttttggattcgttgaatctaaccgaggaaaacatttcgaaggaggccatctcgcgattcagcaaagaggtttacaaaatgtccgctattcaactttctcagctgttgaaagcgactagcaaccgcaaaattgagcaccccgtgttgatcaaccacatttgcaccgcactgaaagaccgtcctttgcctccgtctctccgccacatttgtcaaattgctttttacttgtccaaacattcgttcctcgataagccgcttctcaacagaatcaaagaggattttttggtttatgtccgaaatgaaatcatctcgaaaacatctttttcacacattgtgatcgccttcgctttttttcgtctgactgatcgacatttttggcaacaaataatccaaatcatcgaaacactggcgaatcgccctgaatattcaactgctctgattgaatgcgttaattcgttggctgtggtaaatgttcatccgaaattggtgtcttccgttgttgaaaagactaaaagtctggaaaaggacggactttttttgggaaaatggctgcaattggtccattctttggctatccttaactctttggattcgcaaatggccgaaagtgtactcaaccggaactttttttgaacgtttgtctgaaatgca

SEQ ID NO: 86532 - DNA, 733 bp, Heterodera glycines
  SCN-specific regions: Sequence locations=1-352,388-733
cactctaagagattattatgaaaatttaagttacaaaaaatgcagacattggccggcttttcccgcggccgcggtaatcacgctaccgccgggctattatatacattcgcatttttattttttatctttttttaatgcaatttttttacaaatacgtaaataaggagaagcaactttgattaatccaatggaaaagagattgaatccatctgcacttcctacgcttatgttatcgaatttcggtggttattcggtggagacactttgcacgcttgggaaggagttcgtattggaacttatgactcggatgattagcattgtgagcactttaaaaatggatattaaaggagacaataaaaaagtaaattttaattttgatttaaaattcatttgcctttcaaggatctagacattgttcgaattcaacttgattattctcgtctcatttttctctgtcttactgaggttttctcattttgtacactgatatttctacattgaaaatcgtttttattaggtccgtcttcgcatcgatttaaaacttgctgagggaattggagagaatcagaatttgaaagatgttcgtccttctgatgaacggctgttggagctcctttcagagccgaatcaaccggaagataatgcgaaaaaggcaaatttggcagagagattcgaacaaaacagataggagttaattcgattgaattgtcatttaaaaaaattggattggttg

SEQ ID NO: 86533 - DNA, 655 bp, Heterodera glycines
  misc_feature (649)..(649): n is a, c, g, or t
  SCN-specific regions: Sequence locations=1-431,458-630
tgtccaacttgtggaattattttcctaatgtgttctggaataccggaaggcacttatgaattgaaaattggcgctagttttctctgctaaacaaatcgcgcccacccgaattaacacattgcgttttgacttcaaaccagcttcaatttcctccgaggcctcggaagcgtacgtcgttcagtcgcagaatcaaaatgagaacaatttccaggtcgttgtgtttggagaggcgcagaaaaagaccattttcaaaggggcgaagaaggaaatcaaaggggacaaaatcaaatggaggaaagtgccaacggaacgacggaaagggaggagaaacaatcgccacaacagaaacatccgatggcggtgaagaagacgtcgtcattcgtacggaaaagcattttggcggaagatttgcagctgagcgagagcagttcggaggatgaggaggaaggagggagggacagcgaagacacggactgatcggaggagagaatgatcactgactgaccggagccttttaaatgtccataaaactgcactcacgggatgctcttaaacactttcataattgatgctgctgttataagccaaaatggatgcttaaattatatacggtataaatgatgaagatgcaaaaaaaaaaaaaaaaaanaaaaaa

SEQ ID NO: 86534 - DNA, 236 bp, Heterodera glycines
  SCN-specific regions: Sequence locations=1-189
agtgtggcggactgcaatcgtgccggggtgaataatttagaactccagataaatttccgcttcctcaccgtgtgaattccaagcgacgcaatatgactcctttacgacacagcgttcgagaactcattttgtgtagagaaagaaatgatacgacttgtctttccgatttgttgataaaggtgttgtgttaaaaaaaaaaaaaaataaaaaaaaaaaaaaaaaaaaaaaagaaaaaa

SEQ ID NO: 86535 - DNA, 565 bp, Heterodera glycines
  SCN-specific regions: Sequence locations=1-268,293-565
agcaaaattggcactctctaatggcatttctcctgttgtcacttgcacccctcttcgttgcccttagcgggattgatgcaaataaagtgccactgcaattgtgctgtgctggtggccaaagcttggctggccttatctacgactattctgaccatttcagcgaagttttgcaacagtcgggaactgagatgtgcactagcctgaaaaaggacatgaccaaattgacaactgcaattgaaaaagctgaaggatgcaagtgcaatcttgttgaaaaaattgagaaggaattggatgatgttgaggatgattgcgcctacaatttgtcattcattcgcgcactgttccacattgtggccatggcctcggaacatttgggcgaaagttggaactccgaagcggccgagttcaacgagcaaattgaagccattgatagcattggacatgaggaacttaagaagcttgagtttgaagcggaatcggaattgaaaacacatcctcgtgttggccgaaaaagaatgaacagaggctaattgggctgggcaaaatttgaagatgtcaatgtgta

SEQ ID NO: 86536 - DNA, 513 bp, Heterodera glycines
  SCN-specific regions: Sequence locations=1-341,404-465,487-513
aagacgaagacttgaaaagtcagtttaaagaattccaagagcttcggattgacaagccccgttcgtacttcgccttcgacccttcgttggcgcccgaccattggtttgaaccgtcggtggtgtgggaagtgaaggcggccgacatgtccatttcgccacgtcatttggctgcgcggggattggtcgacgctgagaagggcatttcacttcgctttccgcgtttcattcgaaaccgagcggacaaaaaacccgaaaatgcaacatcatcagaacaaattgcagagatgtaccgaaatcaggaccacattaagaaccaaaaggacggaaaagtggattttgatgaagaggaagagggggaggagaaaaaggaagaagcggacgatgagaaggaggaagaggaggacgaacagtgaaaaaggaaacgacccggaaaaaggggctgcccacccattccctgactggccatcaaatttatttgattgtttttgagtaatttattcacacttccttaat

SEQ ID NO: 86537 - DNA, 626 bp, Heterodera glycines
  SCN-specific regions: Sequence locations=1-626
tgatggcatggaatcgagctttgttgattaacggaattggcaaatttggagaaagaatttaagccgaatcaacgatggtgtggtttgaaacaccctcaaatcctcttctgaaagtgatcgacattgaagcagtgtgtcgtgcagttcggtcacgatcaaaagaatgcattattgtagtcgacaatacgttcatgacaccgtattttcaacgcccgttggaacttggcgctgatgttgtgatgcattcgttgaccaagtacatcaacgggcacaccgatgtgctgatgggtgccatggtgaccaacaatgaccaacttgatcagcatcttaaatcacagcaaattactgctggtgccgtcccgtcaccgtttgacgtctatttggtgatccgtggcatcaaaacgctccatttgcgaatgcgacagcacatggaaaatgcattggcagttgcacgatggcttgaaaaggacccacgagtggaaaaagtgctttatcccgagctcgagtcgcacccgcagcacaaaatccacaagaaacagagcagcggaatgtccggcatggtctctttttacatgcgcgccgatgccgacggggcacgcaaattcctcgccaatttgaagctgttc

SEQ ID NO: 86538 - DNA, 685 bp, Heterodera glycines
  SCN-specific regions: Sequence locations=40-138,160-200,222-364,388 -685
taaataaattattttttgcctgtcttctctgctgctctcatcttccaattgtgtttttggtctgttgcaatgcaatgccaaatttcccgtgctgcccgggcagtcagcaagtggttgctgtgatgtccaaatacattgacactttctcttctgctgctgacgagtctacagtatgctcaaccgctaaaagtactgtggatggaataaaaaatgaactgtcctatcgcgtgggatgcccaagcggaggagaagcacaaattgtgaatgaaattgatcgacagctgaagaacattgcgaaaatggaaatcaattatgaggacgagtgcccgtacaatttgggctttgcccgtgccatgttcgacttggccgctgctgctgctggccatgcggggaacggcacagaatggcaatacatgaaagtacaatttgagcaggaaagccaagcaatcaaagcaattggacaagaaaagaactttgaagttacggatgtgcattttggagtcccaagcaaaggggtttctgcacatcaaaatgtgccgagtccgagccatgtgattgccaaccctggccaacacagttcggttggccaaggaaagaaagaagaaccgttgtcatcggacttcgatttttgaggacaaacaaatcaggaggaaatagaatagaaaaccattttgtcgacatgtcg

SEQ ID NO: 86539 - DNA, 647 bp, Heterodera glycines
  SCN-specific regions: Sequence locations=1-1,26-647
gtttttatattttattaaatataatggattttgctgttctcgttgtgagtgattcgtctgacaaggaccacaaaatggacaaaagtggtcctttgttggtcgaacttctgcagaattcgcttttaatcagaagagggcaaaaagtgaccgttgcaaattacacaatagtgccggacgagaaaagcaaaatcgttgaatatctacgtgaatattccaccaaagttgactgcattttgaccagcggtggaacagggttctcaaaaagggatgtgacgcccgaagcgaccaaagaagtcattgagagggaatgcccaggaatcgctgtggcacttctgaagaaagggcttgacattacgccattcgctgctctcacccgtctcaccgcgggaattgctgccaattgtctgattatcaatttgccgggaagcccaaaagcagtgagagagggatttgaagtgattgagccgattctgagccatgcgattgccattgtgaagggggatgagagcgaaacttcagttttgcacaagagaacggctttataagacagaagagactgtctgtcgataagcatttgatatcctatgtatgtgagaggcaattttaaactttacttcattactatgtaccattttgaaaaataaatt

SEQ ID NO: 86540 - DNA, 697 bp, Heterodera glycines
  SCN-specific regions: Sequence locations=1-138,160-697
acacgacccctacaagaagaaatcgagagagccaccagcaacaaacaagaaagatgttaaaaaagataccacgaaaaatttggagcaagcgcagaaaacgaccaatgaaatgacaattaccccgaattacaaaaacgggaaggcggaggagaaggcggcggtttgcacaaatttggaggaagtgcaggaaaagacgaatgaattaagcctcaaggataaaagggagacgacacaagacataccaaagcagacagtgccaacagtttcggcggttgggccgagcaaaatgaattttgttggatgtttggcttccgtttatccgacaaactcatccgacatttaccaaggcaaaattatgtccgtcgatgtcaaagggcactcagtccgtctggaaaagccatttctaaacgggcgtcctatgtccgttccttttattgacatgtccggcaaaatgatgaaggatattagagttgtcaggggtccttcgcctgtgcgttttcattgtgtagaaaacagtccgattaatggtcgtcattcgactggatcagtgccatccattcgtcgtccttcaccagctgattctgtccgatctgagcacaccaaacgcaaacgcctttctccgcttattgttagtagcacatattctccaattgctgccacaccttctacccgctgtgcaccactgaatcaccaaact

SEQ ID NO: 86541 - DNA, 698 bp, Heterodera glycines
  SCN-specific regions: Sequence locations=1-123,145-698
cgatcgcttccctccccaacagcttcgcgtcgatggcactcattttttgctcggcaatttggtcgctggagaaaactttgagttccaattcggaccgcgttggatgccgaacgcatttcgtcggcagctgccattgtggaaattgccattccatcagatagcgatttggtggaggtgggcaaactgatcgtgacttcgcgctttcgtccggacggaaacggagtggtgaacctcacttgggaagtgccgcagcatttgctgggaaagattcaatcctatgaaatgcgttatttggaagcggctcgggcgcaatcagtggcgatgccattttgggaaaggcttttctttcccggcacagcgccaaccgccgaaatttacaacatgaaaccggacactgagtacgttctgcgaattcggacgacgatggagtcgcgggtccaagtggaaagtgccgaatttcgcttcagaacgccaaaatcggccggtgccaatccgatcgcccgtttggacgtcctttactccagcgaaacccccgcagtgcgtctccaatggattctcgccccgcacataaacgccgtgttggtcggaggtttcgatgtgtttttcactgatcgctacgacctcgccgaaagcgaatggacccaccgacgaatccacgggaatgacccccaattgtcgttggactcgctcagcccttc

SEQ ID NO: 86542 - DNA, 741 bp, Heterodera glycines
  misc_feature (711)..(711): n is a, c, g, or t
  misc_feature (737)..(737): n is a, c, g, or t
  SCN-specific regions: Sequence locations=1-81,104-294,318-551,573 -711,733-741
cactttgaaatgccatggaagaagtcgaattaataaagaaataaaagaatggcacagcctttaaaagaatacaccaagttgctgctcatcttcatttagtattgataaactcatttttgtgccaattaatccgaatggaaacgaaaaacttgtgaaactaattgattttgaccgggcacaaattattcgcatttgcaacaacagcgaaccatgcaatgaaattgaagaagaaccagcaatcatggctgatacaacaaccataatacacagtacattggacatcgggaaatacagtagtcctgaaatatttgttggcaataaacaattgtctgtgaaagtggatatttggtcattcgggatttctgtttatgaggcaattctggtggcaaaggataaatacggcaaaaaagaggaaattccaaatgttttaaattccattgcaacgcttcaccgtggctttgcaattgaccaaaatggcctcaaatcggaagaaattaattttaacaataatgattggttacaattcagcagtggatttaaattggcagttaaagccattttgaaaatttggaaggaccaaccaaaaattgcgcttttaattatggtattttcagtttttcatttttaaatggaatttttgagggtttaaaactaatttttgccattttgagctttttcgtccatgtttcgggcttttttagtccatatatntatttataatcctattaaattaaatntcta

SEQ ID NO: 86543 - DNA, 743 bp, Heterodera glycines
  SCN-specific regions: Sequence locations=1-227,249-743
tgtcgtttgtacgagtctgaaaaaagacgatgaacacgccgaaactgtgcttttcgaaatgcccgaactgaagcgagtgatttttgtccaaattggaggcacttccgatgatgctcctccaatgtgtttggaagtgctcaactgttgtttcggtagtgagtcgacctccaaattggctgcaatgtccgcggccaaaatcaaccaaatattttgggaattttttgtttcattcccagtagcatttctctcggccaatagtcgttggacggtgttcagttctttcgacgcacatttttacgtgctcagtactcaaactggacggcttcaatttgaactttgccttgacgaacctctttcagtccttgaactcgagcaaaatctctgtttgtcagttggaattgcgggttcatttgcactgtgggaccttttgaatggcaaagttcttgcgcgtcactctctgaaggaattacttggggatcaaaacaaacatcttctcgcctccgcgttttctcttcgcaaaaatgagaaggaaaccaattcgacttcgatatttttggaattgctctttagcgattttaattcatttgcgttttcctcaaaactcggcggatggaacaaagcgcaaacggtgttcgattttgtgaatgaagaaaaaatgtcgcccaatatttcttctatgcttcttcagatgcctaattcttctgattgactgatctcacaaatcaatgcatttttaaaaacaa

SEQ ID NO: 86544 - DNA, 591 bp, Heterodera glycines
  SCN-specific regions: Sequence locations=1-591
acgaagaggggtccggagatgggcactccgcggaggggtcgggcagtgcgccgacggacgaatttggacgacagacgccaaacgaatcggtggccatcactgatacgcggtcccctgcccaatttggtgacagcgacagaagaccacagtacgccaacacaacaactaccgtaatccacctgcacaatttgagccccgtttctgtcctctccacaacgcgtgccactcctccaatatttgccaccacaacaacgacaattatgctggccaccacattgaggcctccgtcgatgaagccagcggcaacgacggcacggacaacgacgacactcccgagttcagtttcctcaagggcttcatcgccaaaaacggccacgaccaccgtgccgagaatgatcaagccgaaagacaaggacaaatggccgcaaccgctgccgaaaagcaccatgccgcctttcgctcccacgcgcaccacaaaaagacccttttcatttcggacccttccggcactttggaacaacttcggcccggcattttcgccttcattgtcggcggagttgtggttggactgcttctgctaattctgatcat

SEQ ID NO: 86545 - DNA, 613 bp, Heterodera glycines
  misc_feature (585)..(585): n is a, c, g, or t
  SCN-specific regions: Sequence locations=1-613
ggtgcaaacgaatcgaatgccaaataaaatccgaatgtgaaaaaaagcgggaaaatgccttgaagatgcccttctccactttccctttgtactcgcccaattgctcgaccgtctccaagtccaacccgactcggccgtcgatttcaactcatatttgggctcaactgccatttatcgcgaaacagtcggttcccggctattggcgcacatttacgtccaccacactgccgaggaattatggcgtcccaatttggcatggttggagcgcgcgacgcatttggcgttgcctcggctgatgaagcgacaaaaagagatggacgaatgggcactaaaccgtaagcgttgtttcgtcggtttgccacccaatttgttgcgccattgcgttttgcatggaattcgtccgtccgatgtccaattgagacaacttttggacgaacagtccggaccgaacaccgtcgtcgatccgtgtccgccaaaagataatcgacgtcaaaggtacgaaccggcgaatttggatgatttgctgcaattgcacgggttaaatgtcgaggacagtccggcgatggatggcgcgctgcatggatntgtcggcactttcttgcgcactttgctt

SEQ ID NO: 86546 - DNA, 655 bp, Heterodera glycines
  SCN-specific regions: Sequence locations=1-307,329-655
atcgcttcccgaagatgccgacggtccgatgcgctctaacttttggctctccttacggcgcttcgcttcccctgaacacagtttcccacgcgttcgcttacggttcgggtgcaatccctcaacgagaagaggacccaaatacgaaaatggtggattttctcattgtgtgcaacgattcattgctttttcaccagcaaaatttgcttcagtatgtgagcattgcattgttgggattgtcctcacttcaccaattcaatttgcaaagaaacccaagccattactctcttcccttccgatggttcgatgcgaattgggtaaaccaaatgcagcgactctccggcgcacggctttactacaacacacgaatatctacccaaggacgtttaatcaaatatggtattatccaagaggacgacttggagacggacttgctcgactggacatggctgtacgcggccggtcgactgcaaaaacccgtgttggaggtgtacaatgggaggggtgaaacttccgatgttcaaagaacgggacgaaacattggtagggcgctctttgacaattaccgagcggctgctcacgccgcactgctccaactcgacgggtggtttacgatggatcaatttctcaacaaagttgtgtcaatttcatatggtgg

SEQ ID NO: 86547 - DNA, 720 bp, Heterodera glycines
  misc_feature (671)..(671): n is a, c, g, or t
  misc_feature (676)..(676): n is a, c, g, or t
  SCN-specific regions: Sequence locations=1-378,400-499,521-637,659-720
atgcttgtacgcgatgcggcggtaatacctggaactcggactgccgtttccaagggaagtgatttgcaataaatgcggcagaaaagggcatattgcgaaaatttgccgtaatcagaacaacactccccaacattcaggctttaaatattcccgcacaggctcaaataagcaaaatgccaacatcatcgactgcctgcacatcatgccatccgattggaagacggaaaatgaaccgtacattgagcggcatgttcggctcaatggaaaagtgcacaaaatggtagtcgactccggctcaaaattgacaatcgtgagaaagctcatttgggtcaaattgggccaaccgtttctcacagaaacaaagctcaagggtcgttcattcacagggaacattttcacatttatggggaagttcaaggtccaagcagcattggacgatggaatgcccctcgatttggaatgttttgttatcgattcgagggacacactcgatttgatgggacttccatggataagagcatttgaacgcgcctacaaccaagtggtggcgacaactttgtcaatcgaaaatgttgccgacagtcgttggtgcaaccgatcaaacagcacgtcgacgcaatttgagatggatttacagaacacatttccaaaaatttttgaggaaacattgngactntgcaccaaaatcagggcccatctcaaaattaaagaaaattcatc

SEQ ID NO: 86548 - DNA, 658 bp, Heterodera glycines
  SCN-specific regions: Sequence locations=1-34,56-658
catcttctgtagtccttaagatttttttgtgtgagtaaatggcagaaaaaagcacaacgaaagcggcggtgaagcagcggcggcaattcgtgtgctcgtgacgggtggcaccggactggtcgggtcggcaattcgacaggtggtgacggaggaggagcagcaacggaagccccagcggttgcaggagcagtggtttttcgtgggcagcagcgagtgcgacctgaccgacttggagcagacgcgggtgcttttccgccgcgttcggccgacgcacgtggtcaatttggcggcaatggtcggcggactgttccacaacttgcgccacaacctccaattctttgtcaagaatttggcgatctgtcaaaatgttctccaatgctgccatgagactgacgtggaacggtgcgtttcgtgcctttccacgtgcattttccccgacaaaacgccgtacccaattgacgagacaatggtacataacggaccgccgcatgacagcaattttggctattcgtacgccaaacgaatgaccgatgtactcaaccgcggatatgctcaggatcacaatcgaaagtacacttcggcagtgccgtgcaatgtgtttggaccgcatgacaatttcaatttggagaacgcccacgtggtcccggcactgatccac

SEQ ID NO: 86549 - DNA, 281 bp, Heterodera glycines
  SCN-specific regions: Sequence locations=1-42,64-196,280-281
gtagtgtggcggactgaagcgtgccggggtgaagcaatttcagaactccaagatcaaatttccgcttcctcaccgtgtgaattccaagcgacgcaatatgactcctttcacgacacagcgtccgagaactcattttgtgtagagaaagaaatgagacgacttgtatttccgatttgttgattaaagttgttgtgttaaaaaaaaaaaaaaaaaaaaaaaaaaaaaaaaaaaaaaaaaaaaaaaaaaaaaaagtaaaaaaaaaaaaaaaaaaaaaaaaaagg

SEQ ID NO: 86550 - DNA, 627 bp, Heterodera glycines
  SCN-specific regions: Sequence locations=1-515,544-627
tggggggcaaaacgcagactgcggaagggacagacgcggcgagtggccaccacaaaagctcactctcagccgtcgtttccccgcgccttggccccgctccaatcgatcgccggcaatttgacgtttgaatcagcaagcgaacgaagcacaaggaatttcactcgtcatattttgacacacattgttttgtccatccatcttagcattccaacagcagaaaaacagcaatggcatatgcaacaaaatattacgactatcagattgccgttgtttttgccattttactcggcggtcttttactcctcgcgttggtagtcacagccatttattacatttgtgtggtcaatatgcggggcaaaaagggcggcattacgcgcgttccttccggcagaagtacagtaaggacgaggatgaatccgcaacagtactcgccgtctgctcaaccgcaaatattccatcaacagtacccacggtattcgccgtacggtgggatggaagggatgagcagccaacaaacgcagcagcagcaacaacaacaacacccattccaagcgcaaaattatgagcaggcgggggtcagagtgagggaaatgcaaccggagtatttccaacagcagggtccaatca

SEQ ID NO: 86551 - DNA, 657 bp, Heterodera glycines
  SCN-specific regions: Sequence locations=1-657
tacggcacccttcacttttatgataaagcattaatggacaaactgagcgtcaaaaaccccctgcatttggagaaattcccgcgtctttttattcgctgaccaccactgaagacccggtgttcagaaagctgtcctgcaacaatgtcggcaatgtattcgccacagatatcattttgaccacaattatggcggctaatcgttcagtgaatagttgggatatcatcgcatatcgaattggcgataaacttttcttcgacaaacgttcaacttcaggagtttctccaattgatgctttttgggttagtgaaacagcgcccgatccgccgagtggcgacgcgcaagggataaacaatgccaatgacttggcttccgaggctctgtacgtcaatcaaaattttcggcgtcaagtgctaaagagagacgggaaagttttcaaattcgaagaggagcgaattcccttcgaagacgaacagttaggccggacagattgtgcgtataaataccgcacttggaacttggggacaatggcaaacggaactgcgataacattggtggcacgaacggaacacgacgcggtgatgctggcggggaccagcacgaaagaagtacaaaaactgaccgtgaaggcattcaatgaatgggacagttcgctaagcg

SEQ ID NO: 86552 - DNA, 483 bp, Heterodera glycines
  SCN-specific regions: Sequence locations=1-366,454-483
ggacataacagagaaaaaagacggaggaggaaaatggggatgaaatgacaagaagtgtgtgcattggccaaattaacggaaatgatcaattgcttctcatctctgccgctgggcattgttccgtcgcggagtatttaaacgcgtcgtccgccgccgcttcgctctctccgcccgcccttcccccgaaaccgccgcgcttccgctcgtttgccaatttctccgattggccttccccctccgcgcccagcgccagcccaacggacactttgagccaaccgaaatttggacagcatattcaatcaccaattaaccttcccgatcaaacgcatcctcctgaaccgattcatcacaactcaaaaccaactgaagaagaaaggaaacggaaaaagtcaaaggaaacagaggaggacagagggaggaaaagcgacgaagaagcagagaaaagaggaaagagcccattacattaaaaaaaacaaaaacaaa

SEQ ID NO: 86553 - DNA, 680 bp, Heterodera glycines
  misc_feature (640)..(640): n is a, c, g, or t
  SCN-specific regions: Sequence locations=1-610,632-680
caccaaattggcacattgttctagatgcaaaatatcttggaaaatggtgagaatgatgtccgacgaatgaccatccagtgatcggtcgtcagcggtgtcggctcgttcgttggccgcttcaacggcaccaaattcacagtgaggaccattcagtggtcatttgcgaccaaatcgacgtggtcgtcctcgatgaaaaggttcttccacagtcgcttttcccattgaacgaatgctgctcatttggcagactgaaagctgatcagaggttcaaattaaacgctgcgctcagtgcccacagtgaattttcgctgaaacaatgttcaacggacaaaactgtacaaatgctcgtcctttggctccttttttggttcaaacaacgtcagattgaactgattcttcagcaaggccttacgccattcagtttttgggtggctgcgaacattccgatgagtttggagatgaaattggcccttctcgacgaagactccaccgaccgacgactgcgcaccgcgtggagaattgtgtctcagatggactcaattgtctgttcaaactgtgcccaatccctttgcaatgtgtcggacattgtcaatttgtccactggcagcaattccaccctttttacaaactcacatggctntgttcatgaccttttcaccatcaaaaaagtgagcggaatt

SEQ ID NO: 86554 - DNA, 668 bp, Heterodera glycines
  SCN-specific regions: Sequence locations=1-293,316-515,537-668
cgtacgctatgcgtggggtgaaaatgaattacggccgatcgccaaaatcggtcattctggctcagtctttggacgtgcaccagtgggggcgactattatcgatgcacttgacacgctgtatattatgggtatgaacaaggaattcgaccaggcacgcgattgggtggcacaaaatttcaatttgaaagagtctcttagtgatttgtccgttttcgaaacaaatattcgcttcgttggtggtctgccgagtgcttatgctctcactaaagatcagatgtttttgaataaagctcgcgatgttgctgacctgctcatgccgtcatttaatgccggccctttcgggattccgatgtctttaatcaatttgaggaccggtcgaacagggaattacggttgggcaagcggtggttgctcaattctgtccgagtttggctctttggaattggagttcaactatctgtccagactgaccggcaatctgacgtacatgtcaaaatgtgctcgagttcgggagtatgtcattgaactccaaaaaccggatggactttatccgaattatctcaaccctcaaactgggaaatggtgtcaaaaacatgtttcggtcggagcgcttggcgactctttctatgaatatttgctcaaaatttggattttcaatgggaaaagag

SEQ ID NO: 86555 - DNA, 599 bp, Heterodera glycines
  SCN-specific regions: Sequence locations=1-239,261-599
aagaggtggaacaaccgccttgtccacagtcaccccgccacagtacaaaaaaacaacatactctctgataaactggcggcggcacaaacaatcatcggtggacttcaacctggacagtcggacggtgcacctcaatgggccaactccctccttggcttctgtgctgagatggtgggaatctgccgcgagcttctctccatggtcaaagagcagcagaatgacaacatggacacacgagagactttggaggaagaacgccgactccactctgtcgtggtcgagaacctgccggaaagtgaagaaactgtgccctctgctcgtgtcaactccgattttgtggatgctcaatcaatgctcgacacctgtgagatcgaatgccggccatgtcagaaaaagaccgaagcgccgccgctttctccacccaaatcgacgcaaggaaaagctgacgagcctccgtcagatgttttttcttcagacaacaacatggactatggaacattgaaggattttgaccccaaccgattttgatcaccggcactgaaaacgcagcaaaacattgaaaagaatgcaccgccgctcaaagtgccagagaaacgtgc

SEQ ID NO: 86556 - DNA, 734 bp, Heterodera glycines
  SCN-specific regions: Sequence locations=1-73,96-734
ttcttccttggcgcacacttgtcgggaaatgaacgaattgttgtcgcaggaggagcgaaagtaatcgaaataatgtgttgcgccaattggtggaggaaattgcgcacaaaaaggtgacaatcggtccgctcgagttggacgcctctttcccgccggcgctgcgacgggcgttgccgcccattttacgccaaaatgtcgcaccaccgcaatacaaaacgttggcggagaaaactctggccagcaaattgaccatggccaacatgttcggtgccaaattggcccgctgccttctctgcggtctgacagtgtacgacaaacatttgcctacccatcgggcgattcaccgcggcgatcggccggtggacgggcacagcgttggcggcgcgttcttctgcgatctgtgcgggttggcattccgcactcggaccaatctgatcagacattggcggactggctgcagcaccatccacgcaaatttgccaccaaattccgactttgcattggatgacgctggccttaaacaaatggtcgttaacttgctgaaaaagttgacggcagaacgcaaagactccgagtcgtttagtgaaagtttggacgatgaaattggacagccgagcacatctcacaagcaccaaatcttccacactgaagcacgggaccgaactcaaattggtgtcccggcaaaagctgcgtccaaacgatgccatgacgatcaacaacagtaccagcagact

SEQ ID NO: 86557 - DNA, 375 bp, Heterodera glycines
  SCN-specific regions: Sequence locations=1-351
ctacaaaactgctgtaacaaagtgtacaagagtccgcgtgccaatgtcggataagggatggcgtgccatgactacaaggcgatgtgccggttgacattggagcgccaaagaaacgtgccgacggctgtttagaggcatccgtgcaagaggggtacaaatgtgttgcttatgataagaatgacaagaagggattctgctggaaagagccgcgcaaaaaggaggcattagcggcgctaattgcggtggccggtctctttattatatttttgtgatcattgaaagcgaatcggataaatttgatgtttcatttcgggatttttgggatttccacaaattgtccgataaacgcacaaaaaaaaaaaaaaaaaaaaaaaa

SEQ ID NO: 86558 - DNA, 619 bp, Heterodera glycines
  SCN-specific regions: Sequence locations=1-619
actggaagagcgggcaataaggatgggcctacacctttattttgcccgttgggcaggagaaaattgctggcgaagtttgtcgagcattcgaaacggcagacgcaacaccgccggaagatttgaaaaaattgtgggacgattacaaagcacgaatggcagccgaaggagtcgaagtgtactcgggaggaggtggctattccggctcaggctatcgttacgacgacatggaggacgaaatcgagttgaacaatgcggaaaatgaccaaattggtctatggattggaaagcggcatggaagacgatgttgcgaacatcgactcgcaattggaaagtgtgatgaaaagcagcaagcgcattgtccattgtcgtgccggtgcaacattccgtgggggcagagccgacccatcgacggaaaagaaagtggaggcggcgcgggcgatggccgaacggatcgcctacgaaaaacttgcacaaccgaccaatcaaatggaaaaagacgcgacgcatttgacagccgacgcgataatgatacgcacagaggcgactacgctcactctttccggaatctctctcgcaaaacaaaaagccaccgaactgaacgaaaaactcaattatttgc

SEQ ID NO: 86559 - DNA, 682 bp, Heterodera glycines
  SCN-specific regions: Sequence locations=1-116,138-279,309-419,443-682
gtgatccgctaattattattttgaattgagatttattaaaacctaattaattttttttctactcgaatttcttttatggcatttgccatttcaagtttaagcgctttaatttcgctcgctttattggcagcaccacaaaactcgtaccaacagaaacctaacgatgaaccgaaggtctttaatgatatccaaaacgggtgtgatttgataaattgtaccgatggtcgaacctgcggcattcgagttgggctcgcaaaattcggcaacagaaattttgagaaatttgcttttccaaaatgtataacaaatgaaacggaactaaacatgaacacggacaacgatggaaatgcgcacattgttcctaatggaccagggtgccaaatgatacaatgttctgttggctaccaatgtcaagttcgaatttcaatttccaagcttggcaatttgccatatgctcagtcaattggaaccttcccgcaatgcgtggggcctaatgtaagcttcaactcatcaagttcaactatcgagaatggcccagggtgtgaccaacttccgacgaaatgtgacgaaggcacaaaatgcgtaactgccgtcggaattgcgaaatatggcaatttgccatggtcgcaatttttctggcccttttgtacatgaaacgatgaaaagcgctgcaactgtttta

SEQ ID NO: 86560 - DNA, 466 bp, Heterodera glycines
  SCN-specific regions: Sequence locations=1-254,276-466
gtgaggcaatccgtaactgaaaacggtggacgagttcccttagtggcgggcgccaaacagcgaaaggcaatgccaagtgaaataggccaacagcaaaagagtcaaacgaacggaaaacaaaaaggacaccattttgaaacggctcccttagtacggtcaaattcgcaagaatgcgtagtcatgcataagtcggagtctttggaagtgatggactctgatcagttagctgaatgtttctgtttcacaaccagccatttcttcttttgcttttgagaattgtcggccaattgtcgcaatgtctactccggccacttgaagcagctcgagcagtgcctctgtccttaactcgcttactccgtccttctcttctgctgtgccgtccctctccccatcaaatgacttggacattgtacttctctctccgtcttcctccgttgccaaaccttcgctgctgctgagccattcg

SEQ ID NO: 86561 - DNA, 718 bp, Heterodera glycines
  misc_feature (639)..(639): n is a, c, g, or t
  SCN-specific regions: Sequence locations=1-46,68-143,165-399,422-718
actcggttctgctgcatttattttactcgtcttcacacacagtgctcaggctttctaacaacaaacgactgtaatcgttccttcgacttctcataatatcctcctaaaacattgttctcagaacattattccaaaaaaacaaccacggacaaatcacagcaacttgatcatcgtccgcaacacgaaacgcggaagttttcaactttgggtcgaagcagcgctgcaaacgcttcaactacgcctctggctggacttagttcaccgagtaacacaatggctaatgctagagggccgagttcatcgacctcaacctcaactaatgcatcggttggcgttcttatggtcgggccaaatttcaaggttggcaaaaaaattggttgtggtaattttggcgagctccgacttggcaaaaatctttacaacaacgaacatgtggccataaaattggagcctatgaaaagcaaggcgccacagcttcatctggaatatcgtttctacaaattgcttggccaaacagaggggctaccgcaagtgcattattttggtccctgcggcaagtacaatgcgcttgtgatggaattgcttggccattcgttggaggatcttttcgatctttgtgacagaaaatttacgctgaanaccgtttgtatgaccgcaatgcaattgttgagaagaatagaatacgtccactcaaaacacttgatttatcgtgatgtga

SEQ ID NO: 86562 - DNA, 660 bp, Heterodera glycines
  SCN-specific regions: Sequence locations=1-71,94-280,304-660
ttggacgatgctgcggattacgagggcgaagagcaggaccgaaatgaggcagggatcgacgaaatggaaagggatgaggacaacgaggaggagacgacagcgccggagggggcggaagagacgacggaattggacgaaactgaagaggcgccgacggagggacggggcagtgaagtcaacgccgatcggataaaatctgtgctggaaagtcacgcaatcatcggagggtacgagtacgacgtgcacaatgagcagtggtgcaccttcaaaatccatatgcctttcctcaacaaaactcgcatcgatgtgttggccattgtcgagagggaaattgagtcttttgtgcttacgcaagtgcgtggcattgagaagtgcaacgtgagggaggagcagcgaaacgggcgaatggtgcgcgtgctgcagacgcagggcataaatttgggggcattctatgcacatgccgactttttggacatcaacaccatttattccaacgacattgattttatgttgcggaatttcggaattgagggggccgctcgcacaatctctcgagaaatgaacaacgtttttggggtgtatggaattgaagtcaatcctcggcatttgtcgttgaccgctgattacatgacttttacgggcgaagttcagccgtttagc

SEQ ID NO: 86563 - DNA, 647 bp, Heterodera glycines
  SCN-specific regions: Sequence locations=1-207,229-647
agagcttgggctgacaataaagcgcaacaatgtcttctgacgaatcgacgacttcttctgccagtgttgtgagcgttcagctgcgtgaagtgcccatcaaagacttcaaggacgtgcttccggtgctgcagaaaacgctcaacgaattggaacatccgttcatcaagaaggccgaagaaataagcggaatggaacgtgagaagctcttctacatcacttcctctcttgtgctgctcgtgttgatgctctgccctggcaatatgcttctctctactcttatcactgtggcctacccaatgtacgcgagcttgttgaccctcaacactcaaaacacatcggaatacacccagtggctcgtttattggtgcgtgttcgccgagttttgccagttcgactatctctttggctctatcaatggccttctgctgctgtacgtgcctctgaagaccgtctttctgctctacttggcccttccgcaaacttatggcgctcacaacttgtacgtgaagcatatccgcaaagtgcttgccgtgacgaacgtattggacaagatgaagaagatgttctgatcgagcagataatgtatcactgtgtaatgtctaggatgattctttgttgtgattcctatattatgtgttatgtattgt

SEQ ID NO: 86564 - DNA, 405 bp, Heterodera glycines
  SCN-specific regions: Sequence locations=1-129,152-405
ttttgggacaacggcgaaagcgaatcatttgggaagtgcggggggaaacggcgcggagagagagtcactgacaaacggaggagccaatcaaattggcgacgctctcattcacccgacgcccctttccatgggtaaaaacggcggccccggcactgctccgttgtccttcggccgttcttcgattccgcaacagtcggcccattctttcgccgttggtgcgcacgaacagtcggccatctgggtctgattcgactgaccgtccgaccttccaatgccctgaccattgccaactcggcctttctccaatttgccacattcgtcttttttctgtctccataatgagcttttcctcctttctctcttttgtttttgtctgtttttctgcctgatttagtttatacatac

SEQ ID NO: 86565 - DNA, 737 bp, Heterodera glycines
  SCN-specific regions: Sequence locations=1-80,105-601,623-737
cagtccttaagatacgtattttagggcaagcaatgaattaccaacaatcagtccagcagcaattaggaggtggtatgagcgcacaacagcagcagcaacaagcagtgagacacatgcagcgaccacaaaatcctgcatcagctgcagtgccacaaaatatgtcgccgaatgtggcgccctctccacaacaacaacaacaacaaatgtaccagatgcctatgtacaaccacacgaacgcaggcggaactccattcagtccccacaacgtttacaaccagcagatgatgacgccacaaatggcctcgcagcagcaattccctccaaacgcacctgcaacaccagcgacaccccaaatgtcgcagtcaattgggacgccattgtccgtgcacaacattcaacaacccggttctgttcaacctcaacagcccggttctgttggtatggttgccacccctgcggctccgtattctgttggtgcgtcgactaccggtggtccggcctcaaatcaaccgattgccggcccacattccaaccctccggcggcacaacaagcgacacagacgcagccaatcggcggagcttccacccaaacggaattcgacccaattgggacggccaaattgttaattctgaaggaccttcgcagagcaattgtgaatctcaatcaatttgctgagaaagccctcgacagttgctctaatccgactcattgtctgcagtcgctacaatcggtcgct

SEQ ID NO: 86566 - DNA, 525 bp, Heterodera glycines
  SCN-specific regions: Sequence locations=1-238,260-325,347-446,468-525
gagacgcgggcccaaaatgatggaagcttttgttacgcgtcggaaagaattggaggatgagtttcagaagagaaaggatcaatacagcaaggaaatgcaacaacgtgtgagcaaaaaggaagcggaattaaagcatcacgaagagattttgaacatccgtcacaccgagattgacaatacataccagaatgagcttaagctggtcgaggcacagatcaacggactgattgaggaaaaagccaaattggaaataaagctgaagaagcaacaacgctcgaaataaatgaagccgaggcgaatttttcaatcgaagccattaaaaaaacattccattttttgtaagcatctcttattgactaatctttgcacagccttcgcttattttgattcaatgctaattaggtgtctaaccgaatttcagacaccaatgattaagaaagattgtcctaaatagatgaaaaactattttcgcattccgtgttattgtttgttatttatcgaatataaagtatgcgactaatcaaa

SEQ ID NO: 86567 - DNA, 640 bp, Heterodera glycines
  SCN-specific regions: Sequence locations=1-85,110-296,319-640
gtggatgcgcatattcattagacactgcccgccttggggcacatttggccgactccttcgggagtcactctcccttcggacgaagaactccatctcgtcaacaccacgggcatcccaaggccgaattcacaaagccatgccaaacattgagcaaacagcagtacccaaccaaatgcattggacagcctacacaaaattgtagtggaaaaaaacgaccggcggaagcctacaaattgtgctcaaatccattctgtgtgcgatggcaccgctgcttcgaattgggctgtttgcagttgatatttttgccatcatcggatctcatttttatgcccatctttcgtctgactcaagcctatctgttatcaccaagtccccagactttaacgacgccgctgaatttgtcgcaacattcaaatccatgacggatgcaagtgccgacgttcttgataagatttccaacattggaaacggcgcctttactctcctcaagtttgcgggcccaataggccaaatggtacacattggtctatccatcggattgaagcagcaagactcgcccgagctccgtgcaatacaggccttacagagacaaatcaccgaacagttcgaagcactctcccgtaaaatcgatgactctatt

SEQ ID NO: 86568 - DNA, 625 bp, Heterodera glycines
  SCN-specific regions: Sequence locations=1-2,25-625
attcttctctgtttctctctacatatcccaaaattgttccccaatgctgcaagctcatcagtaccaacttcggcaaggtcatcgtcgcgtttctgctcgcagcattttggcccatttcggtttcgaattctcgaacgactaccgacttggctgcggacattacagtaaagtgtacagaggctatttcaaggaagcgcaacgcacttttgccatcaaagtcaccgacttggaaagcgtttccgagaagttcaagcaaaagtttctgccacgtgagctggaagtttggcgggaattggaccacccgaacctcgtctacttgtacaacgatttccagtggagcgactatcagttcgtagtgatggaattggctgttggtggtgacttgctttcgttcctccaaaaatgtggccccgtcagcgaaacgacctgtcacaattggatgctccaaattgttgctgctttggattatctccaccgtaagggaatcgctcatcgcgatctgaagctggaaaacgtccttctttgtgaaaacggcgtcatcaaagtcactgactacggattctctaagcagagttctgatttgtcttcaacattttgcgggtcgcgttcctattcgtcaccggag

SEQ ID NO: 86569 - DNA, 697 bp, Heterodera glycines
  SCN-specific regions: Sequence locations=1-576,599-697
tagtctgttcccgtgcagacaactcgtggcattctgtgtcagaggtgctcagtgaacagaaacagcgcctttcccttaacggatggttccattacgctccggggacggcgaatgttgcacagacagggccaaattgcgctgtggaagagccgatttgtcgggtggagccatcgatgaatatcacgttggcagaagtcaacgaatggctgagtccaaattacattcgtccgggacaacatcggcaaatcaaacggatttttgcatacaaatccgagctgtccctccaacaatttctcaataatgaacgttataacaaagctttggatgagttggaaaaggcgcaatttgaaagtgttggcccaccgcacaaaagaaatgtatggcgtctcgtcgagtcatccttggaacagaacagcgttctccaaagtctattgcgtttgtttcgctccgaggccatcacccttttgttgacccaatggactggcctccatctgtacgatttgaagacaaaacgtggcacggcacattctccgaatggcgcaaaaagggcggcggaaccgccaaagaaacggaagagagcggacgaagaggaggaagggacgacgagcggaggactgaagcagggggggaaagccgacagatgcggagaaagcgaagatacaaatgttcgaatcgcttctttcatccatcgtttcga

SEQ ID NO: 86570 - DNA, 432 bp, Heterodera glycines
  SCN-specific regions: Sequence locations=1-34,56-410
tttttccatggccgacctttcccttcgcttacaactttctgttttgctttgttttggggccatccttcgcaatttgtgtctttaacttttgctctctccgcccgtccgttttccccatttgttcccattgtttaacgtactgttcagcttcggcatattcacagtcttttggctacatttaaattttgtgatagttcgccaaaatttggccgtgttcaccgagcagagaaatcgagaggcagtgaaaaggaacagtgcaaagcgcaaacaacaataaatgtgttgcgatggactcgcgtttttggatttctaaataacaacaacagtcgctccttttccgctttcattttggtctcaattttcatctgttatttcatttcttttcacctctataaatttctgttgggacgaaaaaaaaaaaaaaaaaaaaaa

SEQ ID NO: 86571 - DNA, 335 bp, Heterodera glycines
  SCN-specific regions: Sequence locations=48-186,216-335
tctgtgatgcccttagacgtccggggctgcacgcgcgctacactggcaaaatcagcgcgcttgtccttccccgaaaggggttggtaaaccggtgaaaatttgccgtgattgggatcggacattgcaattattgtccgcgaacgatgaattccttgtaggggcgagtcatcaactcgctctgaatacgtccctgccctttgcacacaccgcccgtcgctgcccgggactgagccatttcgagaaattccgggacggttagtgcctccggcttcggtcggtatgcagactggaaccgatttaatcgcagtggcttgaaccgggcaaaagtcgtaaca

SEQ ID NO: 86572 - DNA, 349 bp, Heterodera glycines
  SCN-specific regions: Sequence locations=1-349
gaatagttccgttccttcgaatgactgctcatctgctggggacgttacaatcagttgatgctatttaatttcttcagtctccgtaatgggacgacgcaatcgacgacaaatcacaggacacaaaacggaggatggacaacggacgcggtggtggaggacggggggaaaagcatcaaacggaaataaaacggcagagaatcgaccaatgacaatcagtgggacacgacagacggaacatgatacaccagcttaacaacaacgatggggatgatgaaaagcaaggagagaatccggatggactaacggctcaacccgtctataacagcatcaacaacaatgttcaagcatt

SEQ ID NO: 86573 - DNA, 604 bp, Heterodera glycines
  misc_feature (424)..(424): n is a, c, g, or t
  misc_feature (548)..(548): n is a, c, g, or t
  SCN-specific regions: Sequence locations=1-479,501-604
cacgacagtgctggatgatatgcaatatttggtcaatttgcgaccatcaggaacaccagtcattgaaagcatgagcatggacttcgaaacatggctggtcagcttcatctctgacgatcaaccgtttgaatattttctctacaaaagaagcaaaaaacgtgctgattacctgttcaccactcgtcctgagttggctggacgacctctaagcaaaatgattgggtttgattattcggcacgggatggcttacgcattcaagcatatttaagcttaccaccacagaccccgttgttgtcgccggcacaagtgcgtggggacaagctggagttggcacgccagggcatgttgccacgacggccccaaaaattgattgtgctcgtccacgggggcccaaaatcgcgcgatttcttggcttcccgcctnatcaacgcgtggctgaccagccgaggatacgctgtgctccagatcaacttccgtggctctgtgggctttggcaaaaatcttacaaacgctggcacatgatggggcggcagaacaaaacaccaanaatttgttggacggtgttgacttcttggtgagcaacaacattgcggaccgacgcca

SEQ ID NO: 86574 - DNA, 527 bp, Heterodera glycines
  SCN-specific regions: Sequence locations=22-304,478-527
aataaaaaatttttctctaaagtagcatgtctcctatgaggagcgtgtataagttatttaataattaacaattaaacatattaaggattatgcaacattcagatttaaaaaaggtattcagatttaaaaaaggtatagcgcttttattattgctttctacaacaatgctcgcacgtaatgcttctaaagaacgctgccgaccagaaaaacagcaaggatatatgcagaaaaataaaataaaaatacaaaaaacaagtaaagcagcacaagaaagaaaagaagcagcaaaagcaaaagcagcggaaagaagaaaagaagaagtaaaaagaaaaaaagaagaaaaagaaataataaaagaagcagaaagaagaaaagaagcagtagcaatagcagaagtagaaagaaaagaagcagaaataaaagaagaagtagaaagaaaagaagcagtagcaatagcagaagtagaaagaaaagaagcagtagcaatagcagaagtagaaagaaaagaagcagtagcaatagcagaa

SEQ ID NO: 86575 - DNA, 183 bp, Heterodera glycines
  SCN-specific regions: Sequence locations=1-183
cactttccctgacgcatcgcttcattttgccgagactttcgaccgcgccatttctttgcttcgcgcagactgtcgtacttcggagaaacacgtcacttttctgcacattctccgacaattgggcgcgagtgaagagaatggtggactccttggcaatttgaacgggctcattcgaaacctgag

SEQ ID NO: 86576 - DNA, 582 bp, Heterodera glycines
  SCN-specific regions: Sequence locations=1-78,103-582
caaaatgcgcaccattctcttatagccatggtttgcttggtgatggctgtcctaatggaaatggcaaattcaaaggctgtcaaaaaatacaacaaaaaaggagcagtggcggcatcaccagcaaaaggaaaagcatcgccaaaaggaggcaaaagcccagcaaaaggaaaagcggcaaaaaaattgaaacctaaaaaggatgctaaaggcattaaagctaaaaaagcaaagccagcaaagaaaagcaaagcggcaaaagcagtaaagggagcgcctaagacagtcaaaaaactcgcatttgccaaaacagcagcgcaagtgaaagaaataaagtcaccagccaagccaatggttctaaaagcagtgccgccccaccaaatgcatttaatgaatgagaaagttcaaactgctgtgtctccacccgcccatgctcgttcgcttgcgaccgttccttacagtacaccggtggcagccgaccgtaactcactgccatcgtacacttcggatggcaccaatttggacatggcccatgagaatgatgattatcagaattattactacggaacggaagacagcagcaga

SEQ ID NO: 86577 - DNA, 601 bp, Heterodera glycines
  SCN-specific regions: Sequence locations=1-249,271-416,450-601
gtattggtttttgcccttgctgtagcaggctcgtttcatactgaaacattcactcatttgcggcccggcctttacttcaccggcctttggggtgacctgaaacagagcaaacgcattgaacgctttaacaagttcaacgctgtcgatggtggtgcggcgatggtgtgcacggacgtggccagccgcggcttggacttccgggggatggattgggtgctgcagatggactgtccttccacggtcgacgattacattcacagagttgggagaacggcacggatgaaccgaaaaggagaagcgatgcttatgcttacgccgtcccaagaaccttttgttgctttgctcaggcaaaggaatgtccccgtcacaaaagtgacagtcgactccaacaaagtgtttgatgttcgtaataaaatcaccaatttgatggttcctttcccatcagtgaagcaatttgctcagcagagtttaatcgcttatgcaaaagctctctatttttcggaattgaaggaagtgtttgatgtgcaaagcattgatttcgatgcactttccaggtcttatgggttggtagttacgcctcggatcagatttctcagaaaaa

SEQ ID NO: 86578 - DNA, 665 bp, Heterodera glycines
  SCN-specific regions: Sequence locations=1-402,424-665
cagaatgaaatgtatttgaaagaccgcttgactgggcttatttcgacgggatggcaaaggtattcccacactacgcctttgtgtgaacttctccccgccggcattccatcgttggcacggcaagcgatttttgtttcgcaatggatgaacaaaagagaagaacggaccgaccaattcatgcaggagtttctgaactgttccgtacgtcactcgacttcggccaccaaatttgtccgcaaaggattcacttttccattcgtttttgaattcaaattctgcgattgtcaattccccggtgttgaactttacagtgagattgaagaactgaatttgttgcgatggaaagcggcgattgagcgatatataagcagtaatgaaaccgaaaaagagacacaaaatgaactggaaaaaatggaggaagaattcagaaaactccgaaagacgatcgcttctcttctcggccatttcttttacgaggacacagtcgacgaatggttggctcagcacgaccatttgaatcgctttaatgatgatgacctcggtttgcctcctccaaaccgactgtgagatcgtaagtccatttgaagcgccttttttgatcatgtgaatttttatatttgaaaatctccctttttattgtatttaacttttgtccattttaatgc

SEQ ID NO: 86579 - DNA, 689 bp, Heterodera glycines
  SCN-specific regions: Sequence locations=1-4,34-67,95-588,610-689
aataattttgctttattttcccaatgcttttctcctcgtccactgttctgctattgcttctgatcgtcctccctttctctctttctttcattttaatccctcaaaatgtccgccaaatttcccccgccctttcgtcgcgtcccttccgccgatttggccatttttctgtcattgccaaacgaaacccaattgttctcatccccggcgacgggggaagtcggctaaaggcgaatttgacgggcaaaccgtcggtggtccattacttttgccagcgacagaccaacgatttcttcgcgctttggctcgatttgcaacaatttggcccttttgtcatcgattgttgggccgacaatatgcgcctcaacttcaacagaacgagcggaagggcgcaggatttggagggagtgaaagtgcgagtgcccggctttggacacacgcgaaccgtggaatggattgactcctccaaacggtcgccgagccgttacttcgcgcccatcgtcgcctccctcgccaaattgggctaccaacgcggcatcgatgtcatcggtgcaccgtacgactggcgaagagcgcccgaggaactccttcattattttgttaaattgcgttcactgattgagcaactttaccacgcaaatggcaaccgcaaagtgatcgttttggcgcatagtatgggaaatccaatggcc

SEQ ID NO: 86580 - DNA, 485 bp, Heterodera glycines
  SCN-specific regions: Sequence locations=1-284,308-316,340-409,432-459
cagtgtgaagaaggctgttgaccagtgttcgtcgccaggaccgggcggacatcgctttggagacgtacttgaggagccacgctgacaccttctccaggaggcgcgaaaggccaacgaccagatgctgttcgtgatgaaggacaagaagctcaactcggaggacaaagtgcgcaaattggaggagtgggccaacactttgccggagaatgtgcgcggagagctgcgcgtgcgcgacttgcgcgagctgaagcagctggtgcacctgtacaacggactgacgcccgtcctgcaccagggcatccaaggcggcatctgaacggaggaagagaaagggaggaaggggggcgatcggactgatcggacggaccgaaagtgatcggtgatctgtgtcattgtgaacgaaaatgccgcattccattcctaatttatttaagtgggtattaaacacattaaaatgcgaaaaaaaaaaaaaaaaaataaaaaaa

SEQ ID NO: 86581 - DNA, 648 bp, Heterodera glycines
  SCN-specific regions: Sequence locations=1-648
gcacctccgcttccgtcgtccgcagcagtcgtcctcttccgccccgttcggcgcgcccttccacagtcgtcgatggcatccgccggttggcttcccccgggcgccaccgttggctgtggtggaccaccacagcagcagcagcagcagacgatatcaatgatgatgatgcatcaacaacaacagaacggcatcatggtcaacgggaacggcactgtggtcggcattggccacctgcaacagcaacagcagtaccaccaattcatcgccgccaacccggggatggttggcgccacttcgttgccccaggacctggagaatgtgaacgcgatgccgtttgaccagagcctgttggacctgaacgactacgaaattgcgccggacggacagttcgatttcccgtgaacgcgggccacgacgacggcggcggcgaacgcgcgcggattttggatggacgggagagataatgaattaattattaattacccactgatatgtgtgtctcttctgttctccccgttttttgttttgttttgtttcatttttgtggagaaacacggcgcagcacaacaacaaatggccattcgacaggaaaccgcagaaaactatctacctacctaccgtatattcatttgtgttcgccccctctct

SEQ ID NO: 86582 - DNA, 561 bp, Heterodera glycines
  SCN-specific regions: Sequence locations=1-561
tgtccaaaattgccgaccgtgttcgacacatggtcacgcaacagaaagtgccggagccggtgttcgcattttggcttaaccgtgacccgacctctgaatttggtggtgagatcaccattggcggcactgatcagcgacgatttgtggccccaatcacttacacaccggtcacacacaaagcccactggcaattcaagatggattcgatcagtggaggtaatggcaaacttgcgtgccaaaatgggtgccaagccattgcggacaccggcacttccctgcttgctgggcccaaaaatgacattgaaaagattcagaaatacattggggcaattccgctcttccatggcgagtatatgatatcatgtgaacgtattcccacactgcccgatgtgacgatcaacatcggtggcaaggcgtacacgttgaagggcaaggactatgtgctgaaaatgaccagcatgggcaaaagcatatgcctttccggttttaggggcattgatttgccggaacgtgtcggagaactttggattcttggcgatgtgtttattggtcgttactaca

SEQ ID NO: 86583 - DNA, 501 bp, Heterodera glycines
  SCN-specific regions: Sequence locations=1-501
atccgcagcatcgttctgcttcatcggtaatcgtcacgcaccatgaggaagttcgcctacttcaaactgtgccaagccgtgctcacttctgtttttctgtggcaaattctctcaacgcaccaattctgtggcgagtttgacgagcctacggccttcttcaactctgcagtctcctccagccattgcgaacagttcacgctcatcggaatggactccaccactggcgaatacggggccatgcccgacaagcagaagtggcacatgcaactcatggcgagcagcggcagtggccaaccaattgatgaacagcaacagaatcacatggacgagttttcgtcaaaattgccgactgttggccgtcactgtattccgattgcgttttctctcgtcaagccctgggttcgcgacaacaaaagtcatctgcataaggtcgctgatttgtttgccattcaattgctctgcggattgctgtctctgtttgtcattgccatgcacgttttg

SEQ ID NO: 86584 - DNA, 529 bp, Heterodera glycines
  SCN-specific regions: Sequence locations=1-207,229-529
taaattgcgatggttcgaacttacaattactaatccgtccacccaatcgtccctctccacttcgcttcccgcgttgccctccgccgctgtctttgcccattccgcgtcccttcggcgtcgtgctgctgccgttcctcctccccaaaatcggcaccattttttgcctccgcccgaccctccgccgttactcaatggcaatgcctcaaaggtcttttcctcttcttcgtccgatacttttttgccggcggccgatgtttctggcggagaccgtcgccaagtgatgttcgaggaggagccaaccactttcatcagcatccgttccgttctcataaatggccaacgcttcttccaaccgctcagtgtccccgccgctctctgtccgtccgcgtcggcgccgccggtcgacccaatgggccctttgttggcactttcggctgccgacaatgaccaaagccatccgaagcagcaaaaggatgctccgctcgctcctcgcgtccctttcatttaccagcaatctctcgccgccgcc

SEQ ID NO: 86585 - DNA, 599 bp, Heterodera glycines
  SCN-specific regions: Sequence locations=1-61,122-599
ccccagttaattacacatataattaactccttttatcgcgcattcctccgccgttctttcgtcctttccctttcccttttttctctctttttcactctctcttctgtccctttcccttccccaatcattcaattgcctgccattcttctcacattcattcattgttttttgactgatgaaggtcatcttttcgtcacacagtagaagtgggaaaaaaatttgccacccctcctttgtcggcacatgccattggctgctgcacggcaccgaaacggtgccaaagacggcggagcagcgcacctttacactccgttgtaggcacgtcgtgttggcatgcggacgacaacagcccaaactgttaggggtgcccggcgagtcggccgccgctgctgacggtcgcgtggtgtacagtctcagctcgttgaagcagcgattggaggagacagatggcggcgattcgggcgcgacagagacggcaacgacaatggcaccggcgaccgaagcgacggcgaccacaatggcacgagcgactattgccgccactgcggagacggaagaagtgtccggcgactgtcccgtggtggtggtcggcgacggca

SEQ ID NO: 86586 - DNA, 554 bp, Heterodera glycines
  SCN-specific regions: Sequence locations=1-554
tggatgaaacgtgttcaggagaagaagaagaacgcgtccaaattgaaagggacggctccgtttttgacttgtccaaaattgacgagcccaaattcggaaagatcgatccgaataatgtgccacatgtcggcggaaacacttgggcgggtggcaccggggggtacaacaccgccggacttggaggagtcggtggtccgtttcgtttggatgccggccatgcggttcatcaattgccggatagtgccaaggagcaagtgccagaacacattcgaaaaagggcgagggaaatcgccagagaggaatatgcgaagcgactaaaagaaattgacatgggcgaatacgacgcggcggcatacgaagaattggccactcgcgtgggccgacaagtgcgggtgctgcgcattgtgatcgactcgttagagcatcggaagcacggaagacagtgggccaagcaccagacgagcggagacttggacgatgccaaactgatcgaatggatggccggcgaaagaaacatttaccggaagcgaattgagcaaccgcccgatccctca

SEQ ID NO: 86587 - DNA, 718 bp, Heterodera glycines
  SCN-specific regions: Sequence locations=1-718
gcggtaaccgggagttgcaccagcggtcaaccgggagttgcaccaagcggtcaaccgggagttgcaaccggtgaaccgatacccgaaccgaccggtgaaccgataaaagagctgccgattccggataaatttgacctgacactgccagaggtggacccgtcgaattcatcggccaacgcaacgagatatgttacacaaatcgaagggcgaaaaaatgtctccgatgccaaatttgacggaaagacagcagcgtgtactccagcaggggtcgaagttttctctgagaagatgacgggcacattaaaagcgaaaaatgcgattgccgatgccaacataacatgcggactgaattcaaacttctactttggatggtccagctgcatgaaaattgcattctacggggatgacggctataaaaagcatgcccaaaaatacggtctcgacaaaacagaagggccggaggaaaacttcaagaacatgaccgagttcgacaaatacggcttcatgcacgacatggtgttgctgctttttgagggttgcgtcgtttgcaaaaacgctaaaatgactgcatcgctgtcacttcgccaatacatgccacagggactgttgaacgagacgtgtgcagcatttgttaaacggccgaccaaagcactggtgggagtgacggctgacagctttgcttacggtattacgctgatggaacgtctctgtgctgaga

SEQ ID NO: 86588 - DNA, 411 bp, Heterodera glycines
  SCN-specific regions: Sequence locations=1-31,61-411
gatggagcagaaaacgtttaaacaaaacggcgaaagaaagagaaagacacagaaaatggaggaacaaagtcgggaaaagccaaaggacagtgaaaaggaaaatttggatggacgcatttcgaagagaaacaaaatgcaatcggaggaggcgacggtggacgccgaatgtgccgaattgcgggggaatgccaaagtgttcgtcgatgggaagggccgttgctacgacgtaatgctcagccaaacgaacattcagcagaacaacaacaaattctatctgatccaattgctgtgcaaccaaacggcggccaacaaattttgggtttggtttcggtggggccgcgtcggattcaaaggacagacgaatttggtgccttttgggacggactttgacggagcgttggaattatttca

SEQ ID NO: 86589 - DNA, 518 bp, Heterodera glycines
  SCN-specific regions: Sequence locations=23-518
atttccttcttttcttttcttaattatcattcctgttgctaatggtgtgatcactcgatcactaacacctcgacgtggtgctgctggtgaaatggcccgagaatttgttgaactctcaaccaattcgcgtgagtccacttcgagaagaccaagtcgtgtcaacattctggatgatgactatgttgagcctagtcttggtgttaggcgatattcagcggggtcgtcatcacggactcgtacagtcaaagttatgactgaattcaaattacttggacaaatttggcccgaagacgtctacatcatttatttggatacatcaaaatttgacaaggacgatcaaaaacggataattggccatgatgaaccagatgtgttaaaaacagcgagtgacggaagtttttcatggaaatttttggtaaagcacaacgagtcggacgaagacattgcggtggacgtacatatgcacatttttgggactgttccgaatgaaaatcttcaccgcaacattgtgatagcag

SEQ ID NO: 86590 - DNA, 556 bp, Heterodera glycines
  SCN-specific regions: Sequence locations=1-98,120-556
tgttgctatgtttgttgctagatcttttaattgccttacttcaattatcacttccattcaccttatccgagccgtctgtcgagaaacaaataaatggcgaaaaccaaatcaatttgatgagtcggctcaatgctcatgatttttgttcaacaaattccgattttttattggaatatagcgacgagaaagcgctttcagcagtggaaaatggattttttatgcgatgttccgatttggacgagcattggtttgattgtcagagtgtcaccgaatcggtcaatgccactgacatcaatcaaatggaactgctttgtccttatttcggcatttcgaagggtccacttctttttgccaatataagctgccgagttttgccatgcattgaatgctatgggacaagaaactttgcgaaagaatttccctgtaaaaagtatactggtcattactttctctcggcacttctttattccattttccttggaccttttgcggttgatcgcttctatttgggttattcggcgattgcggtgggcaaattgatgacattggaggattg

SEQ ID NO: 86591 - DNA, 601 bp, Heterodera glycines
  SCN-specific regions: Sequence locations=1-327,349-436,458-601
gtaatgcacggcgacgggggcagtccaattgcagcgcaacaacgccactctccgacgacgctttcccgtcgttcgtccagtgctcgccctacaccgtcgttgtcgcccgtttacatttgtccggtccgcgaggcgatcactgccgagcacgcagaccaacagtcggcatcgctaccacatgggagcgccgctggcggtggcacgctgctgtacccgttgcgcaagggtgagcgcgtgcgagtgttggccatccgtggcgagtacacgcgttgcagtcgcttgcctgctgctgaacatcgccagcaacaactacgacaacagcggttggcgttgcagaacggcctggtgccgaccaggacgctccagtttggcgccaataatggcactacggcattaaacgacgagcggatgacggaactgtgactgatgattgacttgctgatcagtgtggtggatcggagtttgctgtgtgccatgaacggacaaagaaaagtgaacgaaacgatggaaacacgtacaaaaaaggacaattaaataaagagacacgaaacaacaacacttttcatatgattaattattaaattgatatgaatctctagcc

SEQ ID NO: 86592 - DNA, 626 bp, Heterodera glycines
  misc_feature (625)..(625): n is a, c, g, or t
  SCN-specific regions: Sequence locations=1-321,343-384,409-530,553-626
acaaacctggtcgactgttcgtccaagtacggtaacgagggctgtgacggtggactgatggacagcgcatttgaatatgtgcgagacaacaacgggttggacacggaggagtcgtacccgtacgaggccgtaacgggcaaatgccaattcaaaaatgagaccgtgggcggcactgtcgttagcttcaaagacttgaaggaaggcgacgaagagcagctgaagattgccgtcgccacaattgggcccatttccgttgcgctcgatgccagcaatttgtccttccaattttacaaaaccggcgtttattacgagcggtggtgcagcaaccgatacttggaccacggcgttctcctcgtcggctacggtaccgacgaaacgcacggtgactattggctggtgaagaacagttggggcccgcattggggagagaacggttacattcgaattgcgcgcaacaaacaaaaccattgtggcattgcgacgatggcatcgtaccccgtggtctgagaaagtgtgggaatgaatgggacaagaagggatcagaagaagaagcaggcataccaaatagaagcaattcacaatcattatcattgttatgctttttggtaataaataaaattgcttng

SEQ ID NO: 86593 - DNA, 603 bp, Heterodera glycines
  SCN-specific regions: Sequence locations=1-86,108-400,422-555,578-603
ggtttttgatctcgcggatatcgtgagctggcgaaagaactcgttgaaggactccaaaaacaagaccaagaagtgccggattggcttaagctggtggctgaggggaaaatgccacttgacgagtcggaagcagccagcggtgcaaattcggtgccgatcgctgttcgcgttccgtcggaaactgttcctgacaccaattctttgccaactgctgtaactgttccgactgataatgtggctgcaaccggtgctaattcggtgccgcttggaacccgcgttcaagacgacggaaccccgaatggagaagcaaaggacccagccatccagaacaattctgctccattgccttctgaagacgccaacgatgagtggtgatttgagtagggtttattcggctccggactttcattgttttgttgttcagccttatttattgacgatctctttcatcattcttaaatcacaacgtacttagacattcgtatagctgccccatttgattacttacggatatctagcaacaaatttttgatcagtgtcttatctatttttgagagttgtttctggttttgttttattactttgataaaactttttattgca

SEQ ID NO: 86594 - DNA, 568 bp, Heterodera glycines
  misc_feature (544)..(548): n is a, c, g, or t
  SCN-specific regions: Sequence locations=1-41,63-348,371-491,513-548
aacttgctgttggttcaaaaagtggtgggtttgacgaatattttggaaccattgggaagaagtttctgaaaaaaatatagagaagcaaacaagttacaaagctgtcagacaacaacgtcgatcatgaattcagacaaccatttgattcaaacaatgaatcgtggcgatgaaaggtccgctgacatatatttgcaagagcaaacgctgatgatcacctcaagccaccaacccgtgcaattgttatatgatggagccaatggacaatactttatacctgttcagaatgggaatgacggttctgtttgtcatattgctctgaccccaacacagtcaaaagtggctggctactacagtatcatcataattttttgtaacattggtactttctcatttaaatttccgaacaacaaagcggattatttatccattggcgaattacaaaaagatgtacatgaaacttttttaaattatgtactaaaacgttagatttattgtttcaaagaatttccccagtaaccgcattattagtataaacaatttactnnnnnaaaaaaaaaaaaaaaaaaaa

SEQ ID NO: 86595 - DNA, 703 bp, Heterodera glycines
  misc_feature (2)..(2): n is a, c, g, or t
  SCN-specific regions: Sequence locations=1-81,112-703
gntttcctgatttcttacaaaaaaagggaacacacagattggtgggtggacgactttgtgcgtttcctcaatgaagtacaatttgatggaatttggattgatatgaacgaaccctccgtctttggcacaaatgagaaacatccatggtactttgacacgcaacctgcatttgccggcaagccaccaattgcgccgctgatgtgcccagagccgaacaacaaattggactacccaccgtatcgcacatggaatgcatacaaatgggactcgattttttctaagagaacgctgaacgaaaaaacattatgcatgattggaaaaagtgggcgccgcaactggacaatgtacgatacgcactctctctacggctggtcagaaatggtcgccacacaaaaagcgttgcgcgtctcaactggcaaacgcggcccgctcacttctcgttcaacatttccatcatctggccattacggtggccattggcttggtgacaaccaatcccgatggcctgatctccggctgtcaataatcggggtcatggagttcaacatgtttggcatcccacaagttggcgccgatgtttgcgggctcatcggagactcaaatgaagaactttgtcttcgatggcaacagcttggagctttccattcttattaccgcaatcacaatgatgttaattcaaaagttagccaagatccggcacagt

SEQ ID NO: 86596 - DNA, 627 bp, Heterodera glycines
  SCN-specific regions: Sequence locations=1-15,37-181,203-627
attgaacattttgttgttaatgagaaatatagagaggcagttacaatgtcgttatatgcgattgagccctcgtataaaaacattactgatccactcaaacaacgttatcaatacaaagaagaattcattgccatgtgtagaaatgcttctgcatcaccgtttgatgttttgcttagaatggagcaaagtctaaaggacgattgccaattgccatcacaagaacaggcggaaaattatgccgcaattcttgaactttttcagaaaattgaacagcgtcatcatatgctaaatctaaatgatgccattcctatggataaatacaaatctataaaaagctcaattttggccaaatcagcaagggaagctctacaagaaaaactgaatacaatcctaaacagtgcaaacagtgctgaggaggtcttgcaagccttgaacaaattgaactcggatctgcattattacccatgttggttgcaagcaatggctgatggcaacgaatggaaacgagaaccgctttttcatttcgctcaaattgtgcgtttggatttgatgaaagcttctctcatcgcattacactgtgcctatatttccaacgaggatgacgaatttgctattgatatcaacttt

SEQ ID NO: 86597 - DNA, 529 bp, Heterodera glycines
  SCN-specific regions: Sequence locations=1-120,146-209,233-248,305 -398,458-529
tgggtgcggagttgattcctgaagagcgcaacctgttgtcggttgcatacaaaaatgtggtcggtgcgcgtcgttcctcgtggcgcgttatctcgtccattgaacagaagactgagggctcggagaagaagcagcagatggccaaggagtatcgggagaaggtggagcaggagttgcgagagatctgtcacgacgtgctggatttgctcgacaaatatctgatcccgaaggctggcaacccggaatcaaaggtgttctacctgaagatgaagggtgactactaccgctacctggctgaggttgccaccggtgacgaccgaaacgctgttgtcgagaagtcgcagcagccgtaccaggaagcgtttgacattgccaaggacaaaatgcagcccacccatcccattcgtcttggtctggcgctgaacttctctgtgttctactatgaaattctgaactcaccggacaaggcgtgccaactcgccaaacaggcgttcgatgatgcgattgctgagctggacacgctcaacga

SEQ ID NO: 86598 - DNA, 719 bp, Heterodera glycines
  SCN-specific regions: Sequence locations=1-143,165-674,698-719
gatgccgtggctaatgcgatcgtttgccctgtttgttttgcaaaatttgagccttttcccaatctgcatgcccatgtcttacggcacttggacaaaaaatgcatggccgagtttttcagctgtaaattgtgcaaagattcgaattgcgtccttttcctttctgtcacggcaattcgtgagcacattcgaactgcccacggcgttgccactgattcgtaccttctgaccaacatttaccctggaaataatatacacaaagggaccacgcgaattatggtccaggaagtattgaagcgtttcgcgcggattcgttttgaacaatggagaaatgttagacaaatcaaaacgaagttggggtcgatgaaacggaactgttcctttcctcctgttgacgaccactcgtggaaacgaaaaaaagtgggaaacgaaggcggaaaggtggcggaggaggacgttatcgacagaattttgttttctccgtcacaaattcctcaaaaccttagcgagcgtttgcaccgtctgaaaaagatggaccgcatttcgcggcatcaaatgatcgtgccaatttgcgggatgtcgtcgttcgtcggtttgtccaatgtgcgcattgccaaaatggccaagagttgcagcacccacaaatgatgctttttattcggatattttacacattaaatcttttgcctttcttttcttacaattaatttgattaaattaac

SEQ ID NO: 86599 - DNA, 714 bp, Heterodera glycines
  SCN-specific regions: Sequence locations=1-714
cgacgctcttcttcaaaaaaggatatattccagccgcttttcgactacatgacgacgaattgctgtgcaaatgcaatcattttgcgacctgcggtaaggaaggtgtggcgagttatgttggtgaacagtacatggacgtgtgccggcctggtcgaggcggatactgtagtcgggtagtgtttttgaacgcggatggcacaattcgggaagtcatcacatcctgtttgaaacgggaacaactcgtgcccagggaattgccattcgtctgccaaaattcgaccactccgcaatggaacaaattggtgaactgttgcaagtctgaatcattttgcaacgacatccaatttcccattgaacttggtcttcgcaatggctttttgcccgaatccttcgatggtttgccatccgtttttctgacccttctcatttcgcttgtccttgtgctgttgtttgcattgagcatttgtgttgccatttcctgttgctgttttcctcgaaaaagggctgttgttgaccgatgcattggttggttggtgcagtgccgttccccaacattgaacagttctaaggctgattgtgaaatggacagtgaaagtttatgtggcgcaccgatgggccaattggcggaggcggcaacattctcaaccggatcgggctccggcgttccaatgttggcaccgcgcacaatctcttaccaaatttcgctgcaaacag

SEQ ID NO: 86600 - DNA, 663 bp, Heterodera glycines
  misc_feature (62)..(62): n is a, c, g, or t
  SCN-specific regions: Sequence locations=1-663
cagtgaccacatcattctcgaaattgttttcgaaatattcgaaaacattaaggaagacgtcnaatgggaattggttttcgtgggcactgatggccgagaagaacacgaccaagtgctcgactcagttctcatcggaccgattcaggagggacgacacaaatttttgtttgaggcgccacctccacaaattcacaaccttcgacccgaagattttatggatgtctctcttttgctgctcaagtgcaaatatcgtgaacagcttttcatgaaaatcggttggttcgtcacccacacttacactgacccggaactcgtcgaaaaccctccttctcagcctgtcatcgaaaagctcaagcgaacgattgtcagcgaggatgtgcgcgtgacgagttacccgatcaaatgggacgaggagacggaacagccgatggatgacgatgaagagccaaacgccgggaatgaggtttcctacggagtggcggccattgaattgacatcgaacggcaacagtcaacaaatgaatatgtcacaacaggaacagacgccgatggcggctgttaactaagcggatgaaagttgcgagcgttaaaaaggacagaacggactcgatgttttatgggtacaaaaaacggatttgatcttcaaatttgcatttatcacttt

SEQ ID NO: 86601 - DNA, 386 bp, Heterodera glycines
  SCN-specific regions: Sequence locations=1-359
gaactgtgcttttttcacggcctaccaacgctttgcccaattggccaatcattcggacaaccaagcgacgctcactcttcggcctggcactgtgcttttcatcgacaatttccgagtgatgcacggacgaaaagcatttcaaggtgaacgagtgatgtgcggttgtttatttgaatagagacgtgtttctggcaaaggcaaggccaaaactgtcgccagaattctaccgaaatgtgtgaagaattgggcggtgtgtgtttaatttaacttatatttactggcattgtaatatttttgttcaatttacataatttgtattgctcatgatcgaaacggttaacaatagacgaaatgtaatgaaaaaaaaaaaaaaaaaaaaaaaaaaa

SEQ ID NO: 86602 - DNA, 399 bp, Heterodera glycines
  SCN-specific regions: Sequence locations=1-184,206-399
aaacggccattatgaatgggttggaggcctcccctcgtaatcattcgccggtaaagtctctgatcggcggaggatgggtagagcgttgatgagaggccaagagaggtgtcccccactttcttacaatcaaatcattctccataataactttcgctcttcggtcgtaccaaatggccatccctgaatggaatttctttcatttactgtcgccgcctccgctcatctttgaattcgtcatcttttccttttcccgcctttttccttttcacaaatttttctttcctatcggttttccttcttttcaattcgttttctctttttccgaagttaatacatattacatagttgattaattaggtaggtaatctttagccaaaaaaatttccctgaaaaaaagaa

SEQ ID NO: 86603 - DNA, 564 bp, Heterodera glycines
  SCN-specific regions: Sequence locations=1-109,138-482,504-564
tgggctctcgtggtgcgtcatccgctgctgttgttgcttctgcagcagcattgtgcctattttcggcaatggcagtggtggtgtacggtgccgaaagcgctgggcctaaagcagaccaggccatggctgccaagcagttcaacccgtccgcatttccggccatgccaccagagcttgagaaaatcctgccagccgatgttgtgcaaaagttgaaagctgtccatgccgatatgtcgttgaacatcatgcagaaacaagacaagattgaccgtatcatgagctccttgccgggagaggttttggaccaaatcccggccccgcccggctttgaacgtctccccgacgatgtgaagaaccgtctgaagcagatcaatcgccaaaccaacaaagcatgggccgacaagcaaaaggaactgcaggagtatgtcaagacattgccgcaggaacaacgtgccattctgatgatgggcccaatgggaggtccgccgccgccaccgcccagctttggccggcgccgatgaagcagtgtttatgtgcatatatgttgtgtcttttgattaatgg

SEQ ID NO: 86604 - DNA, 641 bp, Heterodera glycines
  SCN-specific regions: Sequence locations=1-442,474-601,631-641
agaggcagaagagaaaaggaaacgaaggctgtgacccgggggagaaggagcgcaaggaacgtgagagtttgatcgaggaagcgtacgctttgtcacaagaggccaacatcagcttagagcaaatcatcaaacggtacaccaaatgccgtaatcagttccttgaacgtgtcgccgaccaaatcagcgaccaactacaacaggatcattctgacagcactgacgacatcagcaccaacaaacatgagcggaagaagcgtccgattgtgttcatttcgccacagttgcgcaaacgggtcaaaatacaacaacaattggcggaagcggactcggccaacgacggcgacgacgacagtgaacaaaagcaacaaaaagaaaaaagtccatttaccattcccggcggtgctgaagacgacgaaatgacagatgtccattctcaactggagcagaaacaacaacagcagaagcagcagcaggaaacagaagcaaaaaaaagtgatgggacaacaaaaacggaggacattccaagcggcccatttgtcaacaaatccaacgtggaggaagtgaccagcagcactttgaacggcaatgtgccagaagagaccaacaaatgcaacagcagcagtgaaattggacagctcaat

SEQ ID NO: 86605 - DNA, 689 bp, Heterodera glycines
  SCN-specific regions: Sequence locations=1-91,113-165,187-347,369-689
aatggactgggcccacttagtcccgaagctgtgaagcaagcgcatgaaaatgacgccggaaaattgaagccatggcagcaacggtatctcgactggatgatcctccaagctcgactctgtggctatttgacggtgaaaaagaacgacaaaaaggcacaactccaacaggaagtgaatttctcgtggaattccgctacaaaccaattctgcttccgatttctgtaatttgcccattcgttccgttttacctctttttcagggccaatcacatgcaggacaatggcgtcattgtccctatcgaacatcgctatttgctcaaaagtgcccctccgcgtgctctcgcgttactctccaaaggaaatgacccggagaatggtccgtgggaagtgacaagcaaaaaacacgacgctcttttcgctgccttaaattattgcagtgcgcgggagattcggcaagggttgtggcagagttacgtcacaagatccgcattcagttcgcaaatgttgaacaactcacaaaacatcgaggaattgcggcataacactgagggctttgccaaagcgcttggcttttcgtcgactgcgcaccaccgaatttcttccaaaatggccgggagtccccaaactgtccgcgtctttgtcgacgaactttccaggcgctttcgtcccgtgtttttctcccgactcgaa

SEQ ID NO: 86606 - DNA, 496 bp, Heterodera glycines
  SCN-specific regions: Sequence locations=1-447,469-474
aagaaaatcgttgaatatctacgtgaatattccaccaaagttgactgcattttgaccagcggtggaacagggttctcaaaaagggatgtgacgcccgaagcgaccaaagaagtcattgagagggaatgcccaggaatcgctgtggcacttctgaagaaagggcttgacattacgccattcgctgctctcacccgtctcaccgcgggaattgctgccaattgtctgattatcaatttgccgggaagcccaaaagcagtgagagagggatttgaagtgattgagccgattctgagccatgcgattgccattgtgaagggggatgagagcgaaacttcagttttgcacaagagaacggcttaataagacagaagagactgtctgtcgataagcatttgatatcctatgtatgtgagaggcaattttaaactttacttcattactatgtaccattttgaaaaataaatttttaaggtgaaaaaaaaaaaaaaaaaaaaaa

SEQ ID NO: 86607 - DNA, 652 bp, Heterodera glycines
  SCN-specific regions: Sequence locations=1-1,341-389,424-431,466 -507,532-652
gattcaaagtgccagtgcgacggtttcgttcaatgctaatcagctaatttgctcactaattaccccaaataacaaaactgccccctgcatctcccaacaatggccaccaaatgccttccgctcgaacttctgtacgaaattgtgcctctcatccctgccgaaaatgccacaccgaatgcgctctcgtcctgtcggctgctgcacaaacttttgctgccacgtgtcatcaaatggaaagagataatgagtgaaaataccggcttccaaaagcaacttcttgaaatggtaaaggccctccatgaaaaagtcgccgtcattgaaaaaagcgtcgccatcattgaaaaaaacgtcgccgtcattgaaaaaaaagccaccgtcattgaaaaaaatgtcaccgtcattgaaaaagaagtcaccgtcattgaaaaaaatgtcaccgtcattgaaaaagaagtcaccgtcattaaaaaaacaatcggcataaagggagaaacgacgggcgttgtggaacaacaatttcacatccgggagacggtgccgacgaagacaaggaagcgggaaacggaggaaacgggcgcaagagatcgctcagcgaaagctgcagcgggactttgaaggatctcgaacagacgctgcatatggccaaaactca

SEQ ID NO: 86608 - DNA, 628 bp, Heterodera glycines
  SCN-specific regions: Sequence locations=1-184,208-628
tattctcgactcaatgcctcatacaaacattcaatggttttccattatgaactcactcgtcattgtcattttcctttccgggatggttggaatgattctcctcaggactctccatcgtgatattgctcgctacaaccgtcttgacgaagaggaggatgcgcaagaagaatttggatggaagcttgttcatggcgatgtgttccgcccgcctcgccatgcgttgcttctttcagtgttcgttggtacgggcagtcaagtgttgctttgtgcttttatcactcttgcatttgcttgtctgggatttctttcgccagctaaccgtggctctttgatgacctttgcactcgtttttttatgttttgttcggagttattgctggatacgtttcctcaaggatttataaaacgatggagggcctcgcatggaaatcaaacatccttctcacgagttttcttattccgggaattatctttggagtatttttcgtctcgaatttgatgttatggtctaaaggctcatctgcagccgttccttttggcactctgtgcgctctgctttttctctggctgttcatttccatccctttaacttttgtcggcgcttactttggattcagagccaaacgaat

SEQ ID NO: 86609 - DNA, 552 bp, Heterodera glycines
  SCN-specific regions: Sequence locations=1-136,158-252,275-434,457 -472,501-552
atccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgaccctcatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaac

SEQ ID NO: 86610 - DNA, 606 bp, Heterodera glycines
  SCN-specific regions: Sequence locations=1-88,110-606
gatgcgaattgcactgatttccttgatgacggagagaatgaaattgagttgttgcaagaagctaccgacaaaacggaccaattagatttgaaattgaaaaacaaaaagtcaaagtccgttgggtccgaccactttttcgatgtccgttcaaatcaagttgctgcatcagcaaattgtgctcatctctctttcaccgatctgaatttgagccgacctctactcaaatccatttctgaggccggttttcaaaacccgaccccaattcaaacggcttgtattccggtcgccttagctggtcgtgatatttgcgcaagttctgcgacgggcaccggtaaaacagccgcttttatgctgccaattctcgagcgtctgcttttccgtccctcacggcgaacttctgtcactcgtgtgctcgtgcttgtacccacacgggaattggcaattcaagtcttccaagtcagccgacaacttgcaaaatacactcaagtggaaatttgtcttgctgcagggggactggaccttaaggcccaggaggcggctcttcgccttggcctggacattgtcatcgcaacgccagggcgactgattgaccatcttcacaattct

SEQ ID NO: 86611 - DNA, 723 bp, Heterodera glycines
  SCN-specific regions: Sequence locations=1-35,58-185,219-229,258 -283,318-619,663-688,712-723
gcgtgccctggcccactctttcgcaattcgtatattcatttatttttccatattttgattttccattgcttctgggcgtagtttcattagattatttgcataaacttttcgttaacaattttaatgctacttaagttaatttttcaaagaaattttaggaaggaagggactgatgctgcgaaaaattgtcaacaccaataaattttttgtccaaaaaacaattttttgcttattatttttcaaattttaaaaattttggtacttgttgattatttatgcggagattttaaaaaaatatttttttttgtaatattaatcgggttttcaaagggtttttcttattagttgagaatttgtttagacttatttatcagcaaaacatttaaaaaagagagcaaaattataagataaaactgataaaaacaactgaaaaagcataatggtcagagacgaaaattaacgccccaattgtgtgtaaatgtttatttattgagctgatccgttccgctgcatttccttttatggactgaaagtgaattgctgctacttgagctgcttgaatatgtacgtctcaactcttcttcctgatacggctgttgttctccgtttttcatggccgtaaaaataaatttttttaaatataatttaattaatttttattaccttccaacgagtgccgagtatcttcgaaatgttgctgttttccatgtccggacactcagc

SEQ ID NO: 86612 - DNA, 638 bp, Heterodera glycines
  misc_feature (16)..(16): n is a, c, g, or t
  misc_feature (28)..(28): n is a, c, g, or t
  SCN-specific regions: Sequence locations=1-638
ggcttctcccccctcnccaaaagcctcnctcattttggaggcacaggccgattttgcgttgaaattgctgcgcgaagtgtccacggacgaccgttcgtgcattgtttcgccgttttctgccgccgtcactttgtccatggtttacgcgggcgccaaggaaaagaccggcgaagaaatgggccaactgctggcaaatggtgcgcccgagtcggaggtgcacaaatacttcggtgctttgctcaaatcgatcacaagtggaacgaacagcagcaacactttggagacggccaacaaattgtacgtggggaagggcagcaaagtgaaggacgcgttcaaagagcaaattgagggaaattacgggggacagtttgagacggtggactttttggacggcaaagggacggcggagaaaatcaacaagttcgtgaaagaagcgactcataagaaaatccgcgatttggtcacgcccgacaattttgacgggaacactcgtttggtgctgatcaacgcgctttacttcaaaggcacatgggcggacaaattcgactcaaaattcaccgaaaaagcgaaatttcatgtggacgcgaaaaacttcaaagagctggaaatgatgcatttgacagccaatttcatttatt

SEQ ID NO: 86613 - DNA, 585 bp, Heterodera glycines
  SCN-specific regions: Sequence locations=1-151,173-250,273-585
ctggaaaaagtggtgacttatccgatgcatgcgcagccagtcccagcggagagtcagttggcttcgggctttgaattcggcggatcgcggctcagtgccgggagcaatcagtttgggggaatttcaaacatgggcaacaattcggaagcaatgcatgggaaatcatttggagggccttccttcaaattcaatcccctccaggggacgggaaacaacgagctgttgacttttctcgacaatttgcagtccactttgcgctcttccggattcaacgaccaatcggtgtcagaggtgatgcaggcgatgcaagtgctggccaaatacaacataatgggtcttggcctgggcctcggtgttgcggcgatggcccaaatgcgtaacactgagagtgcgatggcccagcagaatgtgctgcttggtgctgccgcatcgaatacgccgttgcaacagcaacagcagcgctacgatatcatgtcacagtcgaacatcaccgggtcactgttggactcgtcgcagaacattgaccagtcaatcgttggaggatcgggcggtgttctgatcgatgtgatgagccaaaagaagtcg

SEQ ID NO: 86614 - DNA, 658 bp, Heterodera glycines
  SCN-specific regions: Sequence locations=1-658
taacttcctcccgggttcaaaatgggcccgaccctttcgttcgtctcttgcatttctgcaacagcgaagaaggcgaaaccatcgaattgcccgaattccgaatttttgtgccggacacttatgacttgggcatcctcgtgttggaccagaagactttgcccaattccaccgttaatttccccgtgcccgagaacccccgtcgacgcctgcagcaggcaaaaagaccgacggaagtcggcactttggacgaaagcaatggcaaaaagggggcggaagatgggtttgtgactgtcgacgcgccaaaaagtcacaacgccaaaggcctggacgaccttttgccgcccggcaaaacggtgaccaaaacgaacggcgatttgttgtgggagacgcaatcggtggagatggaggaagtgccggccgaatacgacacgtcgatacggcaaagtcagcagcacaattgggaggaagagtccaacgatggaaatgaaaggaaaaattggacgaagaaaaagcaaccgacgaaggaagagaaaaagaggaaatgatcagacagactcactctgctgtgatggcatttcctataaatatcctaattaccctccctaattacccctccccgcttttctatggaatgccctcaaccgaccgacactttgtg

SEQ ID NO: 86615 - DNA, 562 bp, Heterodera glycines
  SCN-specific regions: Sequence locations=1-41,73-100,122-146,168 -275,301-562
ggaggaaagaaatgcaacagaaagagtgaagagaagtcggacggaagcggcggaggaggagaaaagggaacgattggacgacgaggaggacggaggaccagccgaaacggcggaaggaatgaagacaaaacggacgaagaaacacacgttggactcggacgaggaggacgaaacggagggctaccaacggctggacatggacaaggtggagggtcaggaggagtcgaccctcgaatatgagggacacgtgaagatcatgcctttcaacatgaaagacgatttggaggaggggcatttcgacgcgaacggcacattcatttttgacaagaagcaaagtgtgatcaaagacgcgtggttggacaacatcgagtgggacaatgtgaagaatgcggccggcaaacattggggcaaattggatgacgaggatgacaaaaaggcggacgatgagaaggaagtggagccgaaggaagtgtatcgacgacttatcgaattgctaaacgaaaaagagacaattggcgctgcgctgaagagactgaacaacgaaaaaaagtcaaacgcagcg

SEQ ID NO: 86616 - DNA, 675 bp, Heterodera glycines
  SCN-specific regions: Sequence locations=1-427,449-620,643-675
tttcgctcttccgaaagtctctgaccaattaccaaatcactcaaaatgccctcctcaaaaatcgcttcttttacgaatttctgctcgcaaatgaccggcaagtggcgcgagaagtcaaagacgaatatgtggacaccaccagcaaaatgttcttttcttatttcaaggcgtacgtttcccggctgtttaaatttcaaatggtcgactctgcgacaaagtccgatttgctcggggccgaggacgtggtcaaacatcccacgacaatctccgcattgccgagtcttttcacttccggcaaaacccaccaaacgcgaagtcgagcgacggttttttcattgggtcatcgccaaaatttgctgctcgatgatttgttggctccgctcattgtgccccacgtggcgcaggaaaataacgaaacgttccaattcgaaagtctttttcggagtgttcagtacgctttggtcgaccattgcagtcatgagtttctgttcatttgtgattttttcatggtcaatggtcagtcggccgtcgatttatttacttcagtgatgggtcggtccatcagccttttattgaaaacgttggaagaaaaaattgctgccaatttcgatgcgatttcgctttttctgtgcatttgtttctgcgcgaaatttcgcgaaatgatgggcgaccgtg

SEQ ID NO: 86617 - DNA, 753 bp, Heterodera glycines
  SCN-specific regions: Sequence locations=1-753
tcctcttcactggcgtcaacagtcactcttccgtcgttgctgtcagtgcgccgaaaggaattcttctttatggaccaaatggttgtgggaaaactctgattgcgcgtgccattgccaaagaggtggatgcgtacttcatcaattttggaacttcgctcgtcgattttgtcaacggatcatccgttactatgaagtctctgttcactttggcagagaaaattcagccgtgtgtcattttcatcgatgaaattgatttgctgttccatcgcaatcggaatgactttcagctgctgaagacgcaattcctcgcgcaatgggatgagtttctgcgctgcaattccaactgcaacgtgatcatcatcggtgccaccaatcgtgtgctcgacttggttctctgccgcttctcactcaaagttcacattcccttgcccgatgaagaagcacgcgagaagctcctgcgcaagattttggctaacgagaatttggaggcggactttaactacgccgaagttgttgaagcgacgcaaaagatgagcagttccgagctgaaggaggtcatccgtttcgcgttccttctgcgctaccagcaagtcgtccaaactcagatcagtgttcttcagcagtcgtcttcggtggccaacgagggaagcgaaaatgaagcggagaaaatccaaatcaaattgtcgcacaacgacatcatccgagcgttccacgacttgaagaatgtatcgatggcgccattttccgagtcag

SEQ ID NO: 86618 - DNA, 215 bp, Heterodera glycines
  SCN-specific regions: Sequence locations=1-215
ggcataatcgaccgcggtaccgaatgatcaacatatttggaaccgaagctcctacgcctgtcggaacactggacgagcctcgactcatagcaagaagacatccacaatcaaatcgaatgtctcactattgtatagctctactgaagtgcgtttaatttattctgggaatgacgacgacctaattggcgccagcagcaccggaaagagtggcggct

SEQ ID NO: 86619 - DNA, 402 bp, Heterodera glycines
  SCN-specific regions: Sequence locations=1-177,215-217,388-402
gaaccgcttcagtgcccaacgcaacgcaatggccacttacctattcctcgctgcagctgccttcggagcgggaatttactgttggaagacgtaccttggcccgatgcttgaccaaccgaagagcgacgacgaggagaagcccaagccggaaggaggcgaagaagcgacgaccgccggcgaggaggagaagaaggctggcagcaagggcgacaagcacaagaagaaggacaagaagggcgaaggcgcagcagcagcaccagcggcggacaaaaaggaggagaagcgcaaggacaaacacaaatccaaggagtcggggaagagcgacgacagcaaagcgggcaagaaggacaagcacgggaagaaggacaagaagggcaagaagaaggacaccaccgatgcatc

SEQ ID NO: 86620 - DNA, 576 bp, Heterodera glycines
  SCN-specific regions: Sequence locations=1-576
ttgttttgatggtaacgcgtaaaagttccctaaaaatgctgagaaattcgtgaaatgatcaaagagactgccattccgcccaccgttttgcgagtgcacaacgaacgggtgaaggagtcgcttcagttggtcaacaacgaatacttgacgaaagcgtccgttcattttgacacaacgccactccatgtcgattaccgtgttcttggtccgccagcaactctctatcggaacaaccatcgtgtcactcctgccacgtcaaactgtgaatggcgtccgggtgacgctttggtgaatgcacaaattggcacctgggtagcctatgcgtttgggaaccctgtgggtgactcggtgcgacgattaggcctaaccgaaacgatgtggagaaatttcgtggacaagtatgcaagtgaaatgcgtaacaagggcattgtttgtgtgcctccggtgcgtgtctctatttgctggtatacgtccgtgaacgaggtcttgaatattttgcacaaggaagctctgaacgggggcgttgagttctgtctcattggtcatgcgaaaggctctgagggtgatgatgtgcat

SEQ ID NO: 86621 - DNA, 532 bp, Heterodera glycines
  SCN-specific regions: Sequence locations=1-532
cccggctctcgagttgtgctccaatggagcattgtgcaaagggtggaaagccaaaaatcctggacaactgtacacttccgttgaccggcaaaaatgttgttcgtcgtatcatcaccgaaatggctgtgtttgatgttcacccaacggacgggttgagcttggtggaggtgtacgaaacgttctcagtggaagatgttgtgcgggccaccggctgccaatttaagatttccgaaaatttgaaaccgatgttacaggcttgattgatcacatgaaaattttttgttcggattattaaagaaaattacagtaattcacttaatgattttttaattgtgatatttttctcttgccaaaccgttgtgttgttccatattacttatacttaacatattcaatcatacatatcatatttgtatatgattttttttttatcacttgtgttgcttttctgtataatctttcgattcttttttccaattatcattaattgcataaactgtatttaacaaactcattaataaagtctttaaca

SEQ ID NO: 86622 - DNA, 459 bp, Heterodera glycines
  SCN-specific regions: Sequence locations=1-261,283-459
cgatagaatttattcactttcctaatataagtttttttgtaaaaatgagcaactttatatttgtcgcctttttaactgcagcgttttttagctcaggcctcgctctaccggctccttatgatgctgaatcggtggtatcttctgaattaaatgttccactactttcagctgacgcaaatgttgaagcagcaattaccaatgaaagtgattctgctgctgagatacaagctccatcaattccggtaccaattgaacaacaaactgctgctgcatcatcatcatccacgccgaaaagtgagcagacgccaaaaaaagtaatgaacatgaaaagcgcgatggaaggcgcggcggccaacgtgtacggggggcttccgttagaccagcagcccaagacgatcgctgaagcggcggcaaaagcaaagcagacgcccgccaaacttccggctgactacgacgtga

SEQ ID NO: 86623 - DNA, 574 bp, Heterodera glycines
  SCN-specific regions: Sequence locations=1-574
caactgttgcgaattgtgctcagtttggctttcgtgtggcaacttctttcacttcaccaattctgcggcacatttgtctgtccaaaggccttcctccatgacatctctgttggccactgcaaacgctttacgctgatcggaaaggactcaaagacgggcgaattcggcgctgtgttggacgagcgcaaatggcacaaccaactgttcatgagcagcaccaacggcctcccaatcaaagaacagcagcagcaattcatggacgaattggccgccaaattgccgtgccctggacgccactgtattccgattacgacgccttcgttttttttctggactgagaagaacagaaatctcctcgacactgttgtggactccttttccggccaactgttgctcgcattgtgctcgcttctcaccattggcattggcttcgcccggatgttacgctctgcggcagaatacgaatgcttcgactattgcatggccctctattctgtcttttgctggtgttgctctgcttgggcctcatcgtatttgctgctctattggacaccttattggtcttgcatgaact

SEQ ID NO: 86624 - DNA, 276 bp, Heterodera glycines
  misc_feature (88)..(88): n is a, c, g, or t
  SCN-specific regions: Sequence locations=1-276
aattaaaatgcgaggaaaggcgtgcaaatggtccaaatgttcccataaaatccgtcctccccttttgttcgcatcccttcgcccgtcncattcatccgctgctgcactcttacgattagtgccaaacattcctctacacaatgctttatctcaaatccttatccccccttcagaccaaatgcgcggcatttgctggttgatctgccctaccaaattgacttttttttgtacttcactaatcagacaaacgaacaatatttatttaacagctgagag

SEQ ID NO: 86625 - DNA, 559 bp, Heterodera glycines
  SCN-specific regions: Sequence locations=1-327,349-371,393-559
ctattcccaattcgtcaatgccttttctggtccacaaattctttctcattttctccaaatggaaatggccaatgcccgtccaattgactccaattgatcacaaattcttcggcacttttttgagttggtctccgttcggcgattggatcggccgcagagatttggcatgggaaaaagcgcggagaaagcatcgaacgaaaaaagagcagcaaaatgaaattgaaaaggcaatgaaaagcattcggaaggaattggcaatggcagtgataatgccgacaattgggggacgaaatttggccgaaaaagtgaacatttcgagcgcaaaagtggtggagaatgagctgaagcgagcatgtgacaaattgagaagcaaaatggaaacaaaagatgaagcgatagcattcactgagaagtacgaacattttattgtcatcgaatgcaaaggctcaagtcacaacgtggacaaattctgcgattttgtcggaaaaaggctgcgctacgaactgcttgaatttgtggagaaccctttggccatttgggtggacttttgccacgtccg

SEQ ID NO: 86626 - DNA, 683 bp, Heterodera glycines
  SCN-specific regions: Sequence locations=1-10,32-412,435-683
atacttcggaccttccaattttgccgtgccgaaaatccattttttcttgaaattcacaataaaaaggcgcgaaattcgcttaattggacgggaaaacttatcgcagatgaattaggacaattcgttcgtgccattcgcttggctatgggtgtatttaaagatggaacacaaatggctcgttttgaggaccaattgccccccgccaaaatgataagtcctgactccacgtcactttatatggcccacattcgactcgaaagattttgcgcttccgagcatttccatgttggaaagtttggtttagccactcgtcagatcgccaatttgttgcgggcgttcactcagagagtgtctggcatttacagcttggagcgttgttccttcttagccgattctttgttccgtttgttcaccaaattttatgaatgtatcaaatggcatttccgacaaagcccaaataaaagcgaaatcgaaaagtttggagcagcaattctcaaatttggccgttttgtttgtgggacgctgagagagggcgacaacgcgggttccttttgtctcccgagctcgactacgataggcaccgaattgctgttaccatccactcttcgaaaaataaaacagaagacaaaaggaagaaaagagcaaaaaacaatcaccgggagaataaaagtttcgacagagaa

SEQ ID NO: 86627 - DNA, 302 bp, Heterodera glycines
  SCN-specific regions: Sequence locations=1-65,88-302
agcctttttgggggataggcgcatttccacacgtgaccgttcacatggggtgtgttcaaatttcttatatttaaatgtcaacaaaacgccgcctgcttgccaaaaaatttccattttttggctgtgatgctaatcagctgcttctcccccccccaacccccggtgttaattcccatgacattgggctaagctttggtgtgattcacacattcatcagcccttgaatacgaatgttgtatacataaaatttcttctcatatttacataaaaatctgtccccaccccccaaaaaaaaaaaaagc

SEQ ID NO: 86628 - DNA, 659 bp, Heterodera glycines
  SCN-specific regions: Sequence locations=1-659
gagtccttagtgagtgactcctccggatatttatgcggttcgccatgctgaacgtcttgacgacagtgaaaagcgcaaggtgtggcattacaacagtcgctttgccaaggacaatccgccgctgtccccgcgcggtgtacaacaggcggaggaactgtcggtcgaatttcggaacatttccatcgactactgcttcacctcgccgtatgaacgttgcgtccaaacggcgtcaaaaattttggagggtcgttcaacactgatcaatgttgaaccggggcttattgagtcatttaatctgatctgcgatcgttccggtgtacagaaaatttcgtttcagacgggcaaagaattggcacaacgatataccaacatcaaccggcagtacgaaccgatgtacttggcacctccggaaatcgaaaaaagcaaaggcgtccatggatgtttcccccgagttgaggacaccttccgtaaaattgtggccaaatgctacggcgacattttgatcgtgtcccatcaaggcccagtggccgccctgcaacggatgttgaccggaagcatggaattcggggggagcgcaacagtgagcaagtatgttgaagtgcccggcatggctggtcgatttgaagcggaatatatttacgactcctctcacttatccg

SEQ ID NO: 86629 - DNA, 579 bp, Heterodera glycines
  SCN-specific regions: Sequence locations=1-499,521-579
tgcatcgtccagcgagttgccaaagggtaatggacgcaatggcgttcgtggcgaggaagaagtgaagggaggaaaagaaattgctagcaagacacttaatattcaatcgaagcgtttttatttggacgtcaagcaaaatgatcgtggacgtttcgtcaaattggctgaggttgctatgaatggtcgaaagaatcgtttgttcatgtcaatgcgaatttgcaagaatattaaggaattgttggggaagtttgaggggcacgtgccagcgtcggaggaagtgaatgggaaagcggagaatgtgaccattcaatctgaatctatcgtgaccgagagacgtcgatattacatcgaccttcgcgaaaatcggcgtggttcctttttgcggattactcagctcgagacgcattccgggattcgcaactcagtggcattgccatttgaggggatcggccaattgcacgatgcactggactcaattctggaggaatatggcgaagggttcattgaggaggaagccgaacttccccattctcagatgattcgtactgatgggaaaagctttttttttgatcctggcca

SEQ ID NO: 86630 - DNA, 556 bp, Heterodera glycines
  SCN-specific regions: Sequence locations=1-97,119-556
catttgatgacgacttcaaacccaacctttcaactgcagttgatgtgaatgtccaacaaaaacctgtagacaaaacatcagcagttggtgacatcgaagtgaaaaataatgaaattgttcaaaatggcaaccaattgagcaaagagagcgtttcaactgtaccatatgaacagcagcatggtcaggtgatcggacaagtgaagacggtcaaatacaaagcgctcttcgaattcaacgctcgctccggcgacgaattgagcatacaaccgggcgacttgatcctcgtattcgagggacaccaatccgagccgggttggcttgctggccaaattcgcgacaaagtcggctggttccctgcctcttttgcggagcccctttccgccgctgctgctggcccattactgaagaggggcggcagtttggccggctctccttccggcgaacctttggccatcattcgcgaggagtgtgagccgccgccgaccgggcaaattcaccccacggaacaaaggcgtggaaatgctttcgacaccgacttcactgctgcatttacgag

SEQ ID NO: 86631 - DNA, 543 bp, Heterodera glycines
  SCN-specific regions: Sequence locations=1-177,206-520
cctgttttgttccacacggcggttccgttgtcgcgaaatgtgccaccaaaaattgcgcttgacatgctgctgactggacgtttcttggaagctaacagtgagttttatttattgttaatttttgtatttaatcaaatgttttcggtccattttttggatttttttttgccaaaattcttttatttttttcattaattttttttttgctttgtccattttcagttttccatgggttcaatcttcattaattttggtattcttaacattttctgtatattcttccacaattaagaaaaacagtttttttgaaataaattcttttacaaaaaaacaaaaaattcaggaaaaatttgctgaattttccagaaaaaaacgtacaattaaaatttttttttttcatttccttgaatttcattattacttaatttttatttatttttggaattaagcaagaggtaactaaaaattttttcatttttttggcgatgttttattcggctccgccgcctttccccgttcgaaaaaaaaaaaaaaaaaaaaaaa

SEQ ID NO: 86632 - DNA, 711 bp, Heterodera glycines
  SCN-specific regions: Sequence locations=1-167,190-468,491-711
tccgaaatgatggaggcgtgaatgttggcagctcgtctgctgaattggcattgaatgacgagaagagttgggccaattacagacgaagattggcaacctttgatgtggccagtcgaattgcgaaaccgaaggaaatttcgcctgttgtgtgcgcacgtcatggatggaaaatgtgggggaggagtttttgcaatgcgacgactgtggcaaagtgttatacatcaaattgccggcgacgaagtgtccaatcgcgtgctgaaccattgcattcgacacattcaacgcaaattggtcgaagcgcacaccgtcatttgcccatggcgcattagcccggggctgaacacttccgcaacctatgacatcactgcgcgttatcaccaactggtggacagcggccagcccgaacttccgttggcggacaatgtactcgacgaagcgttggccgacaaatttggcgtgcagagccgatttttcttggctttggccatttttggatggcttccaatatcaaaacaagcgacaaatgacgtggagatgaacaaaccgcagccgaactttcactgtcccctctgtggacgacatctttgcgcatcggtgttttccagtaacaatccgctggacccacgcgaacaacaccagcattattgcccggtggtggaggacagtgtcagcccattgtggcgcgaatgtcttcaaatgtgcaccaactga

SEQ ID NO: 86633 - DNA, 538 bp, Heterodera glycines
  SCN-specific regions: Sequence locations=1-514
acgactttctctttttgattgaaaaaattcgagcaaagatggagggaaatatgtggaacaaataacaattatgttgattttatcgtccccaactccgaggtccatttggcaaattttggcgctattgagaacgcccatttgagtattttaatacagaatttaatcgatgtgatcaggtcgagaaatgcacgacaattagtgaaagagtttggcgacaaatatttagaggaagtgatgaagtttctcgacgaagcaatggcagcgtcaaatgagtctctcccgcttgccaaaattgtgcctgttttatgcgacgcctttgccaaaattggcaccgtttctttcggctccattttccattctttgctcagctcaacggaattgcacagattcactctttttgtatcggaatgcagcaaacgcgatgatttgttcgatgcaaatttaaaatgaatgatcaaaaattggtcacttttgaactgtccaatttataaaacaagtataactttttatgtacaaaaaaaaaaaaaaaaaaaaaaaa

SEQ ID NO: 86634 - DNA, 318 bp, Heterodera glycines
  misc_feature (9)..(9): n is a, c, g, or t
  misc_feature (29)..(30): n is a, c, g, or t
  misc_feature (176)..(176): n is a, c, g, or t
  misc_feature (265)..(265): n is a, c, g, or t
  SCN-specific regions: Sequence locations=1-318
gcaacctgnaattgtgccaagggcggagnnctggcatctccggaggatggaccaatttgagtcggccagttggggggaccaaatcggtgctgcataattgagaagactgcgagcgatggctttgtaggtggtcaagagtacttcttttgattgtccccaggttgttcctgccaaancccggaggatgttgttgcgtttttggatttttgatcggagtttctctgaatgggcattgaatgtgaggagtgggtcgaaggtaattccnaggagttttgggttgcgcaggaagggatagggccgtcaatggtgtgaatacgc

SEQ ID NO: 86635 - DNA, 735 bp, Heterodera glycines
  SCN-specific regions: Sequence locations=1-539,561-663,685-735
acgaaggcgaaaaatgcgcttccgattgatccatgccggctttcggcacccattggtggtgcacattgagcagcaccaaatggaagtgatcgccatggatggaaatgaagtcaaaccattccgaaccgacgcattgatcatttacccgggagaaagattcgatgtccgagtcactgcccttggccacccccgttggcccattcaccgaatggtggtcggattggccgagcagtttctggcagaaacagaagaacccatttacgggttggccaacttagactatcattggcacggagaaactgccgacccaaattgggacggtggcgaaaaagttgattttctgctgaatcgatgcactgctcgccaatgtgtgctgctgggctgtcccttcagaacagaaaatggcacattcgccgcattcgacggacgcaaatttaaatgccattccatagacgaactgagaaacaatggcaaattgaacaattatccctccgggcatgggtatgattaataaaagcgaatttgattgattatcacttccaaatgctcacacacaaaaagaaatgatgatgatgaagtgattgaaagccatcacattttgttggactccgaccagaaaactgtcgatggtttccgtttcaaaatgcccgcggcggttgggcccttttccacacgaaacggcgtggaaatcgcagaagcattgcgacgggacaactgctcgcgctgcgaaagcaa

SEQ ID NO: 86636 - DNA, 359 bp, Heterodera glycines
  SCN-specific regions: Sequence locations=1-359
ctgtcgctttgaattttgctgcatgtgcctcggtccttgggccccgcatgtttcaggctccggttggtactcctgcaaccgctttgacgatgacgcggctaagagggctcgagattcacaggagagatccagggcggcacttaaacgatatttgcactactattcacgcttcactaaccaccagaactctctcaaactggagagaaagctttttgaaaaagtgagcgaaaaaatggaacaaatgcaggtgctcggcttttcgtggattgaaacgcagtttttgcagaaggcggttgaaattcttgtcgaatgccggcgtactttgatgtacacttacgtgttcgccttttaccttgtcc

SEQ ID NO: 86637 - DNA, 612 bp, Heterodera glycines
  SCN-specific regions: Sequence locations=1-612
tgccggagccggtgttcgcattttggcttaaccgtgacccgacctctgaatttggtggtgagatcaccattgggggcactgatcagcgacgatttgtggccccaatcacttacacaccggtcacacacaaagcctactggcaattcaagatggattcgatcagtggaggtaatggcaaacttgcgtgccaaaatgggtgccaagccattgcggacaccggcacttccctgcttgctgggcccaaaaatgacattgaaaagattcagaaacacattggagcaattccgctcttccatggcgagtatatgatatcatgtgaacgtattcccacactgcccgatgtgacgatcaacatcggtggcaaggcgtacacgttgaagggcaaggactatgtgctgaaaatgaccagcatgggcaaaagcatatgcctttccggttttatgggcattgatttgccggaacgtgtcggagaactttggattcttggcgatgtgtttattggtcgttactacacggtgtttgatgtgggccaaagtcgtgttggttttgcgcaggccaaagacggaaatgaaattccaattgagcctcaagtgcgcgattgcgtaaggggag

SEQ ID NO: 86638 - DNA, 294 bp, Heterodera glycines
  SCN-specific regions: Sequence locations=1-266,288-294
atcctgacgatgggtcgttgagtccagagagaggatggagcgaattgactcgatcatttgcactctgccggagaatgtcattgaccaaattccggacccgccagaagttgcgcaactcccggctgatgtgcgccagcgcgtcaaacaaattgaacgccagcagggaaagtcattcagcactaaatttgaagagatcatgaaatatgtggacactttgcctgaaggcacaaaatcggctgccaaaaacattttccattgaatttttcatggaaaaggaggagaggaaagaagtgg

SEQ ID NO: 86639 - DNA, 550 bp, Heterodera glycines
  SCN-specific regions: Sequence locations=1-58,80-550
cgacctccgtccgcacccgactacttcggtcgtgtttccttcgctctcagcccctcccaaccgcctttgactgtcaattcgaccgtcgtcggcgttccctcctcccccgtcaacattccgccatgcgtcggccattgcgacatttgctcggggcgcatccctccggatgagcatttcccattccattggcaagccaactttacccatgtcatttgctgtgttattccgtgcgtttcgccattcactccctatggtcttgcgccatacaccgggcttaatgacggcaccatggatttggcattgatccccaaagtctcccgtttcaccaacttacaaattataagaaaggtggccatgtacggcgctcgtttcattcccgatgagtaccccgacgtcaaagtgtaccgggtgtcccgttggaagttcacgcccgaggcgctcatcgttccgtcaggggaggacacggacaaagccgcggagcaggggcagcactcgggtgcttggaatttggatggggaaattctgcttcagccatcggaccgaccattgc

SEQ ID NO: 86640 - DNA, 689 bp, Heterodera glycines
  SCN-specific regions: Sequence locations=1-511,533-572,595-689
tttttgtttctcgctgatttcaaagaaggcggcctattcaaccgtttatttcgctaagagcgccaaaccagtcgaaaatttgcagtgaaaatgtgtctcaagaagaaaatcatcaaagaaaaaaaggtgcagcaaattttccgtgaacgtgacattctccgacttttgtccacgcccgcaaatgcgtgcccatttgttgtccatttgttttgcacatttcaagacgatgagtcgctgttttttgtgctttcctatgcgcccaaaaaagatcttatggcccggctgaaaaagctccaacggttcagcgttggccagtgccaatttgcgatggccgaacttttcttggcactcgagcacatccatgccctggacgtcatccaccgtgatgtaaagccggaaaacattttgttgcgcgaggacgggcacattttgttgtcggactttggctgtgccaagcaaatcattgcaaagcgggaaaatgtggcggaggaaaatggtgacaaaaccgacggacaaagagcagatgatggccagaaagcagagaaaagtgctgacagcaaaagcagcaaaaaacgggaggaggaggaggcgacaaagctggcactgagacggcggtgctcatttgttggcagtggcgcctatgtgagcccggaggttctgaatggcaaggaagtgacgggtgcatgtga

SEQ ID NO: 86641 - DNA, 770 bp, Heterodera glycines
  SCN-specific regions: Sequence locations=1-770
tggaatcgtacgctgccggactcgttcaaagatggctcaccaaactgcaaatttcaaatcactacagtaacacagtgaagggaatatgccgagacaataagggatactgtagaaaactttaccgctatttgaatgccaatttggaatggatcagtgcacagattgatgccaacccaggcgatttgtactggcgccaagtcaatttgacattcaatcagctgaccggaatttttgacggctatgcgatggacagcggaaaaagcttctctccacgggttaatttcaccattacgcccatttacatgatccaaatatcgggcgaactcattgatctgagcattttgttcaaaaaagtgcccagaagcaaaggagaagccgttgaattggccgaggcggggcattgttcggggctggtcaaagtggcggcgggaaacagcgatttactaatgtcccatgttgcgatgagcggcttcaacacaatgaatcgcattgtcaaattgtacaaatttgcttatgacccaaaggatgtccctggcttcgccgtttccttttcgggttatccggcggcgcttgcctcggccgatgactttacgctgacaagtgccggattgctttcaatcgaaacgaccatttcggtgttcgacaaatccctgtacagtcaatttgtccatccccaaggccaactccattgttggctgcgatcgtacatttccaaccaattgacttccaccgcgcacgattgggtcaaaatttttgcgcgtttcaattca

SEQ ID NO: 86642 - DNA, 758 bp, Heterodera glycines
  misc_feature (49)..(49): n is a, c, g, or t
  SCN-specific regions: Sequence locations=1-222,245-758
atgtattaatttttttttaatgcgaattccttcctacaatagagtttancaaattctgctgtaactcaaaaagctttattccttcctggatatagcatatattttgaacaaacggaattcgtataacacgacagaggagcagtgctcgcattaattggctgaccgaactcaccacgcgcgattcaactccagttacaaccacccaaacttcaaaggatttttctgaaatcagcaaacatttagcgctcgttgaggacgaagacaatattaaaaggattcaagcaaaacgagaaaaagaagcccacgaacgcgcgttggcttttgtcaagaatcagttattgaactcgcggaaagacgactggctccatcaaccaatcgaagaattgcttggctacgcaccgaaatactaacggaatggcgaagcaatgctttgttactgttggcagtacgcgttttgacgctttggtcgaatctctgttccgtagcgatgttctcgatgctttaaagaaactgaaagttgaatgtgtgacaattcagaatggcaatggtgtaattcctaagcaaatacaatccgccatattaaatcaaacgcaatgcatcattgacggaataacgtttcatttgttcgattacaaagccagcataagggagtatttacaaagtgcagaattaatagtgggacatgcaggggccggcacctgcttggaagcacttgagtgtggaaagccttttatcacagttgtcaatgattcactgat

SEQ ID NO: 86643 - DNA, 387 bp, Heterodera glycines
  SCN-specific regions: Sequence locations=1-15,38-52,77-323
ttaagaagatctttcttctaaaacgggagatttttccaaatgtttccgttccgttttctcttcgttttcgttttcgctttgctcactttgtgcggcttttctcacatgacattggcacagcccggaagcaatgggccaattggcgaacctaacaaaatgttgcgcatccgccgggaaaatgaacgcaaggaaaattgacgttttccatggaacgaaccaaagaggatgaagatgaccgaagaacaaaaaacactattagcaattaaatgccgttttcattgttactttttagggtggtgttttggtataaaatcaaaagcttgaaaaaaaaaaaaaaaaaaaaaaaaaaaaaaaaaaaaaaaaaaaaaaaaaaaaaaaaaaaaaaaa

SEQ ID NO: 86644 - DNA, 702 bp, Heterodera glycines
  SCN-specific regions: Sequence locations=1-597,619-702
ttctctagtctgaacaagtccaaaacgtgacattcgtctacaatttatccatttcattggcattgtacggcctgtttttgttttacacggccactcgcgaccttttacatccctacaatccggtcctgaaattcttgacagttaaatcagtcattttcctgtccttttggcaaggtatattaaaatagatagatccaatgcaagtgtacacttctcctaggtttccttctcgccgttttgggtgccacttcagccattgaccccatttacgacttggatggcaatgaaatcattggcaggggcaccgttgccgcgggatatcagaatttcttcatttgcatcgaaatgttttttgccgccattgcccttcgtttcgcgttcagtgtttctgcttacatcgatgcgcatactggtgaaccattcgaattataagcattgaatcaaaagtcttcagtaaccgccggaagtgatgtcaggcctatgactctgcagagcatttccagttcgctgaaggagacgatgaaccctcgagacattatgcaagatgccattcacaatttccatccacaataccagcagtacacacaggtcattataaaaattagttgcttcatcagtttgattttttagcattccaatccttgtcgatcggtaagcttttttggcgctatttgaaaaatggtcatattgcatttataaata

SEQ ID NO: 86645 - DNA, 540 bp, Heterodera glycines
  SCN-specific regions: Sequence locations=1-540
tggggaaatttgccccttatttccttattttcttttttccactttcattcctgttgctaatggtgtgatcactcgatcactaacacctcgacgtggtgctgctggtgaaatggcccagaatttgttgaactctaaccattcgcgtgagtcccttcagaagacaagtcgtgtaacattctggatgatgactatgttgagcctagtcttggtgttaggcgatattcagcggggtcgtcatcacggactcgtacagtcaaagttatgactgaattcaaattacttggacaaatttggcccgaagacgtctacatcatttatttggatacatcaaaatttgacaaggacgatcaaaaacggataattggccatgatgaaccagatgtgttaaaaacagcgagtgacggaagtttttcatggaaatttttggtaaagcacaacgagtcggacgaagacattgcggtggacgtacatatgcacatttttgggactgttccgaatgaaaatcttcaccgcaacattgtgatagcagaagccaactcg

SEQ ID NO: 86646 - DNA, 558 bp, Heterodera glycines
  SCN-specific regions: Sequence locations=1-91,113-558
tatgtttgtgcttgttcttttaattgccttacttcaattatcacttccattcaccttatccgagccgtctgtcgagaaacaaataaatggcgaaaaccaaatcaatttgatgagtcggctcaatgctcatgatttttgttaacaaattccgattttttattggaatatagcgacgagaaagcgctttcagcagtggaaaatggattttttatgcgatgttccgatttggacgagcattggtttgattgtcagagtgtcaccgaatcggtcaatgccactgacatcaatcaaatggaactgctttgtccttatttcggcatttcgaagggtccacttctttttgccaatataagctgccgagttttgccatgcattgaatgctatgggacaagaaactttgcgaaagaatttccctgtaaaaagtatactggtcattactttctctcggcacttctttattccattttccttggaccttttgcggttgatcgcttctatttgggttattcggcgattgcggtgggcaaattgatgacattgggaggattgggtgttttg

SEQ ID NO: 86647 - DNA, 584 bp, Heterodera glycines
  SCN-specific regions: Sequence locations=1-335,357-584
gttcgtcaataatgcacggcgacgggggcagtccaattgcagcgcaacaacgccactctccgacgacgctttcccgtcgttcgtccagtgctcgccctacaccgtcgttgtcgcccgtttacatttgtccggtccgcgaggcgatcactgccgagcacgcagaccaacagtcggcatcgctaccacatgggagcgccgctggcggtggcacgctgctgtacccgttgcgcaagggtgagcgcgtgcgagtgttggccatccgtggcgagtacacgcgttgcagtcgcttgcctgctgctgaacatcgccagcaacaactacgacaacagcggttggcgttgcagaacggcctggtgccgaccaggacgctccagtttggcgccaataatggcactacggcattaaacgacgagcggatgacggaactgtgactgatgattgacttgctgatcagtgtggtgatcggagtttgctgtgtgccatgaacggacaaagaaaagtgaacgaaacgatggaaacacgtacaaaaaaggacaattaaataaagagacacaaaacaacaacacttttcatatgattaatta

SEQ ID NO: 86648 - DNA, 659 bp, Heterodera glycines
  SCN-specific regions: Sequence locations=1-350,372-413,438-559,582-637
acagcgtcgaaaattatttacttgtccgaacaaacctggtcgactgttcgtccaagtacggtaacgagggctgtgacggtggactgatggacagcgcatttgaatatgtgcgagacaacaacgggttggacacggaggagtcgtacccgtacgaggccgtaacgggcaaatgccaattcaaaaatgagaccgtgggcggcactgtcgttagcttcaaagacttgaaggaaggcgacgaagagcagctgaagattgccgtcgccacaattgggcccatttccgttgcgctcgatgccagcaatttgtccttccaattttacaaaaccggcgtttattacgagcggtggtgcagcaaccgatacttggaccacggcgttctcctcgtcggctacggtaccgacgaaacgcacggtgactattggctggtgaagaacagttggggcccgcattggggagagaacggttacattcgaattgcgcgcaacaaacaaaaccattgtggcattgcgacgatggcatcgtaccccgtggtctgagaaagtgtgggaatgaatgggacaagaagggatcagaagaagaagcaggcataccaaatagaagcaattcacaatcattatcattgctatgctttttggtaataaataaaattgcttagcaaa

SEQ ID NO: 86649 - DNA, 648 bp, Heterodera glycines
  SCN-specific regions: Sequence locations=1-131,153-445,467-600,623-648
gttggatcgggcgcctggtcggatcaagaaggagcatctacatcgttttttgatctcgcggaagatgttgagctggcgaaagaactcgttgaaggactccaaaaacaagaccaagaagtgccggattggcttaagctggtggctgaggggaaaatgccacttgacgagtcggaagcagccagcggtgcaaattcggtgccgatcgctgttcgcgttccgtcggaaactgttcctgacaccaattctttgccaactgctgtaactgttccgactgataatgtggctgcaaccggtgctaattcggtgccgcttggaacccgcgttcaagacgacggaaccccgaatggagaagcaaaggacccagccatccagaacaattctgctccattgccttctgaagacgccaacgatgagtggtgatttgagtagggtttattcggctccggactttcattgttttgttgttcagccttatttattgacgatctctttcatcattcttaaatcacaacgtacttagacattcgtatagctgccccatttgattacttacggatatctagcaacaaatttttgatcagtgtcttatctatttttgagagttgtttctggttttgttttattactttgataaaactttttattgca

SEQ ID NO: 86650 - DNA, 574 bp, Heterodera glycines
  misc_feature (551)..(554): n is a, c, g, or t
  misc_feature (566)..(566): n is a, c, g, or t
  SCN-specific regions: Sequence locations=1-355,378-498,520-574
agcggtgaagacttgctgttggcattccgaactttgggttttgacgaatatttggaaccattggaagagtttctgaaaaaaatatagagaagcaaacaagttacaaagctgtcagacaacaacgtcgatcatgaattcagacaaccatttgattcaaacaatgaatcgtggcgatgaaaggtccgctgacatatatttgcaagagcaaacgctgatgatcacctcaagccaccaacccgtgcaattgttatatgatggagccaatggacaatactttatacctgttcagaatgggaatgacggttctgtttgtcatattgctctgaccccaacacagtcaaaagtggctggctactacagtatcatcataattttttgtaacattggtactttctcatttaaatttccgaacaacaaagcggattatttatccattggcgaattacaaaaagatgtacatgaaacttttttaaattatgtactaaaacgttagatttattgtttcaaagaatttccccagtaaccgcattattagtataaacaatttactnnnnaaaaaaaaaaanaaaaaaaa

SEQ ID NO: 86651 - DNA, 716 bp, Heterodera glycines
  SCN-specific regions: Sequence locations=1-124,155-716
accaaagatctgcttggccaatgtggcctgataccattgtggctttcctgatttcttggaccctttgccgaacaccacagattggtgggtggacgaatttgtgcgtttccacaatgaagtacaatttgatggaatttggattgatatgaacgaaccctccgtctttggcacaaatgagaaacatccatggtactttgacacgcaacctgcatttgccggcaagccaccaattgcgccgctgatgtgcccagagccgaacaacaaattggactacccaccgtatcgcacatggaatgcatacaaatgggactcgaagaatacgaagagaacgctgaacgaaaaaacattatgcatgattggaaaaagtgggcgccgcaactggacaatgtacgatacgcactctctctacggctggtcagaaatggtcgccacacaaaaagcgttgcgcgtctcaactggcaaacgcggcccgctcacttctcgttcaacatttccatcatctggccattacggtggccattggcttggtgacaaccaatcccgatggcctgatctccggctgtcaataatcggggtcatggagttcaacatgtttggcatcccacaagttggcgccgatgtttgcgggctcatcggagactcaaatgaagaactttgtcttcgatggcaacagcttggagctttccattcttattaccgcaatcacaatgatgtta

SEQ ID NO: 86652 - DNA, 600 bp, Heterodera glycines
  SCN-specific regions: Sequence locations=1-56,78-222,244-600
gtttgaagctctctaacgattgtacatatgaagggcaaaacattgaacattttgttgttaatgagaaatatagagaggcagttacaatgtcgttatatgcgattgagccctcgtataaaaacattactgatccactcaaacaacgttatcaatacaaagaagaattcattgccatgtgtagaaatgcttctgcatcaccgtttgatgttttgcttagaatggagcaaagtctaaaggacgattgccaattgccatcacaagaacaggcggaaaattatgccgcaattcttgaactttttcagaaaattgaacagcgtcatcatatgctaaatctaaatgatgccattcctatggataaatacaaatctataaaaagctcaattttggccaaatcagcaagggaagctctacaagaaaaactgaatacaatcctaaacagtgcaaacagtgctgaggaggtcttgcaagccttgaacaaattgaactcggatctgcattattacccatgttggttgcaagcaatggctgatggcaacgaatggaaacgagaaccgctttttcatttcgctcaaattgtgcgtttggatttgatgaaagctt

SEQ ID NO: 86653 - DNA, 485 bp, Heterodera glycines
  SCN-specific regions: Sequence locations=1-485
agcccatcccaaaaactgataaaaaaaatggcgttcctctcccgtctctccatccttccaaattcgccaatttcgctgcttgcagtttctttggccgttttggctttcgtcgctttggcatcggccaatccgccgacggcacgcgaaacggcgccaaatgcacagcaaaacaatgccaattcagtggcaactggggaaattgcgaaaaatattgcggaaaagatggagcggatgaatgagttcattaaggcgaagaagttcatcgatgcacataatttggcatttgagaagggcgaagtgtcgttcaaagttgcgccaaaccatctgatgcattttacacctgcccaatataatcgaattcgcggcttgcaaatgcgcagcaaccgacaacggcacaacatggcaactctggcgggaaacagcagtactttgccggaaaagttggactggcgcgagaaaggggcggtgaccgaggtcaaagatca

SEQ ID NO: 86654 - DNA, 423 bp, Heterodera glycines
  SCN-specific regions: Sequence locations=1-142,164-258,281-423
tttcaaatccctctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatctgaaatgggggcaaatcgatcagaaaaaatgagggcacacctacgcgaacttgctgagaaaatgccggtcaacgaatcgaagcgtctgtcaccgagtggacccgacccacatcatcattagggccatggatggatctca

SEQ ID NO: 86655 - DNA, 642 bp, Heterodera glycines
  misc_feature (9)..(9): n is a, c, g, or t
  misc_feature (614)..(614): n is a, c, g, or t
  SCN-specific regions: Sequence locations=1-190,212-642
gaatgtggntctcccggatttatttccccgagaatagaccgatgaaaactgccgtggctaatgcgattgtttgccctgtttgttttgcaaaatttgagccttttcccaatctgcatgcccatgtcttacggcacttggacaaaaaatgcatggccgagtttttcagctgtaaattgtgcaaagattcgaattgcgtccttttcctttctgtcacggcaattcgtgagcacattcgaactgcccacggcgttgccactgattcgtaccttctgaccaacatttaccctggaaataatatacacaaagggaccacgcgaattatggtccaggaagtattgaagcgtttcgcgcggattcgttttgaacaatggagaaatgttagacaaatcaaaacgaagttggggtcgatgaaacggaactgttcctttcctcctgttgacgaccactcgtggaaacgaaaaaaagtgggaaacgaaggcggaaaggtggcggaggaggacgttatcgacagaattttgttttctccgtcacaaattcctcaaaaccttagcgagcgtttgcaccgtctgaaaaagatggaccgcatttcgcggcatcaaatgatcgtgccaatntgcgggatgtcgtcgttcgtcggtttgt

SEQ ID NO: 86656 - DNA, 636 bp, Heterodera glycines
  misc_feature (618)..(618): n is a, c, g, or t
  SCN-specific regions: Sequence locations=1-636
aaggaattggataccgaaatccgtacgctcttaacgaaacaaagatatattccagccgcttttcgactcatgacgacgaattgctgtgcaaatgcaatcattttgcgacctgcggtaaggaaggtgtggcgagttatgttggtgaacagtacatggacgtgtgccggcctggtcgaggcggatactgtagtcgggtagtgtttttgaacgcggatggcacaattcgggaagtcatcacatcctgtttgaaacgggaacaactcgtgcccagggaattgccattcgtctgccaaaattcgaccactccgcaatggaacaaattggtgaactgttgcaagtctgaatcattttgcaacgacatccaatttcccattgaacttggtcttcgcaatggctttttgcccgaatccttcgatggtttgccatccgtttttctgacccttctcatttcgcttgtccttgtgctgttgtttgcattgagcatttgtgttgccatttcctgttgctgttttcctcgaaaaagggctgttgttgaccgatgcattggttggttggtgcagtgccgttccccaacattgaacagttctaaggctgattgtgaaatggacagtgaaagtntatgtggcgcaccgatgg

SEQ ID NO: 86657 - DNA, 469 bp, Heterodera glycines
  SCN-specific regions: Sequence locations=1-469
aatgagttcaggattaacgtcgtcagtgtgcagttgttggagaacccggccactccgagtgaccacataaactcgaaattgttttcgaaatattcgaaaacattaaggaagacgtcgaatgggaattggttttcgtgggcactgatggccgagaagaacacgaccaagtgctcgactcagttctcatcggaccgattcaggagggacgacacaaatttttgtttgaggcgccacctccacaaattcacaaccttcgacccgaagattctatggatgtcactcttttgctgctcaagtgcaaatatcgcgaacagcttttcatgaaaatcggttggttcgtcacccacacttacactgacccggaactcgtcgaaaaccctccttctcagcctgtcattgaaaagctcaagcgaacgattgtcagcgaggatgtgcgcgtgacgagttacccgatcaaatgggacgagga

SEQ ID NO: 86658 - DNA, 629 bp, Heterodera glycines
  SCN-specific regions: Sequence locations=1-385,412-629
ggtaatgactgcacttgcattgccatgttgttaaatcttctttggggcccgttggattggacaaaatgcttgtggatgatgtcggcgatgttacggtgactaatgatggcgcgactattttgaaattactggaagttgaacatcccgcaggaaaaatactcgttgatcttgctcaactccaagatgaagaggttggcgatggaacaaccacagtcgtcattattgccgctgaattgctaaaagcagctgatgaattggtccggaagaagatccacccaacgaacatcattaacggatatcgcttggcctgcaaagaagctgtccgctacatgaccgagaacctttccttccctgttgaagagcttgaccgtgccagtcttattcgtgctgctaagacatcgatgtcttcaaagttgattggatcggagtcagacttttttgccgaactttgtgtcgatgcaacagtggcagttaaacggactgacaaggcaggcagagtgagctatccaatcaattcggtaaatgtgttgaaagctcatgggaaatcgagcaaagaaagtcaattgatcagtggatatgcattgaactgctcggcagtgctgacgaagtcgtacagactcgcatttcag

SEQ ID NO: 86659 - DNA, 442 bp, Heterodera glycines
  SCN-specific regions: Sequence locations=1-78,100-442
agcctttgaaccttgatggactcgctgaaaggccgctctcttcgtctcgtgctgaaaaatgtgcgcgtctacgcgcggatgtccccaaaacagaaggaacgtgcaataaacgcgttgaaagccatgggtttgacgacactgatgtgtggcgatgggaccaacgatgtcggggcgttgaaacacgccgaagttggcgttgcgctgctgacccatccgctgaagcccgaagaggcgacggctgccacctccgcgggcagtggaacaccgacgcaaagcaccttcggcaccagtggcagacagcaccaaaatgagggcggcggcggtgagcagactcggcgttacaacaaccgcgagccgacctcagcggatgccaatggacagcgacaacaacagcagcagttggccatgaccacggcgggcggtggtggcacgtcttcacgac

SEQ ID NO: 86660 - DNA, 224 bp, Heterodera glycines
  SCN-specific regions: Sequence locations=1-224
cactcttcggcctggcactgtgcttttcatcgacaatttccgagtgatgcacggacgaaaagcatttcaaggtgaacgagtgatgtgcggttgtttatttgaatagagacgtgtttctggcaaaggcaaggccaaaactgtcgccagaattctaccgaaatgtgtgaagaattgggcggtgtgtgtttaatttaacttatatttactggcattgtaatattttc

SEQ ID NO: 86661 - DNA, 294 bp, Heterodera glycines
  SCN-specific regions: Sequence locations=1-213,235-294
aacgattaactggcttggctggctgattaaacggtccaatatgaatgggttggaggcctcccctcgtaatcattcgccggtaaagtctctgatcggcggaggatgggtagagcgttgatgagaggccaatagaggtgtcccccactttcttacaatctaatcattctccataataactttcactcttcggtcgtaccaaatggccatccctgaatggaatttctttcatttactgtcgccgcctccgctcatctatgaattcctcatcttttacttttcccgcctttttccttt

SEQ ID NO: 86662 - DNA, 386 bp, Heterodera glycines
  SCN-specific regions: Sequence locations=1-386
agttccaatcgtacgacgacagccatcaaatggcgaatgatgggcgtaaaccacgtccgccattcgaccaaagccaaaaaagtgttggggaagacgcgctttttggacttggatttgcccgaatctttcgacgcccgccagcgatggaatttctgtccgtccatttccctcatccgcgaccagtccagctgcggctcgtgttgggccttcggcgcggtggaggccatgtccgaccgaacatgcattgcgtcaggcggaaacattcggatcgctctgtccgctgactatttgctgagctgtcgccataagtgtggctttggctgcgacggcggcgatcctctgcaagcgtggcgctattgggtgaatgagggcattgtgacgggctc

SEQ ID NO: 86663 - DNA, 482 bp, Heterodera glycines
  SCN-specific regions: Sequence locations=1-111,140-482
gcctgggctctcgtggtgcgtcatccgctgctgttgttgcttctgcgcagcattgtgcctattttcggcaatggcagtggtggtgtacggtgccgaaagcgctgggcctaaagcagaccaggccatggctgccaagcagttcaacccgtccgcatttccggccatgccaccagagcttgagaaaatcctgccagccgatgttgtgcaaaagttgaaagctgtccatgccgatatgtcgttgaacatcatgcagaaacaagacaagattgaccgtatcatgagctccttgccgggagaggttttggaccaaatcccggccccgcccggctttgaacgtctccccgacgatgtgaagaaccgtctgaagcagatcaatcgccaaaccaacaaagcatgggccgactagcaaaaggaactgcaggagtatgtcaagacattgccgcaggaacaacgtgccattctgatgatgggcccaatgggag

SEQ ID NO: 86664 - DNA, 516 bp, Heterodera glycines
  SCN-specific regions: Sequence locations=1-5,27-446,478-516
cagcaggcagaagagcaaaaggcaaacgaaggctgtgacccgggggagaaggagcgcaaggaacgtgagagtttgatcgaggaagcgtacgctttgtcacaagaggccaacatcagcttagagcaaatcatcaaacggtacaccaaatgccgtaatcagttccttgaacgtgtcgccgaccaaatcagcgaccaactacaacaggatcattctgacagcactgacgacatcagcaccaacaaacatgagcggaagaagcgtccgattgtgttcatttcgccacagttgcgcaaacgggtcaaaatacaacaacaattggcggaagcggactcggtcaacgacggcgacgacgacagtgaacaaaagcaacaaaaagaaaaaagtccatttaccattcccggcggtgctgaagacgacgaaatgacagatgtccattctcaactggagcagaaacaacaacagcagaagcagcagcaggaaacagaagcaaaaaaaagtgatgggacaacaaaaacg

SEQ ID NO: 86665 - DNA, 663 bp, Heterodera glycines
  SCN-specific regions: Sequence locations=1-23,45-104,126-178,200 -360,382-663
tggaattgagtgaacgatggactgggccccttgggtcgaagctgtaaagcaagcgcatgaaaatgacgccggaaaattgaagccatggcagcaacggtatctcgactggatgatcctccaagctcgactctgtggctatttgacggtgaaaaagaacgacaaaaaggcacaactccaacaggaagtgaatttctcgtggaattccgctacaaaccaattctgcttccgatttctgtaatttgcccattcgttccgttttacctctttttcagggccaatcacatgcaggacaatggcgtcattgtccctatcgaacatcgctatttgctcaaaagtgcccctccgcgtgctctcgcgttactctccaaaggaaatgacccggagaatggtccgtgggaagtgacaagcaaaaaacacgacgctcttttcgctgccttaaattattgcagtgcgcgggagattcggcaagggttgtggcagagttacgtcacaagatccgcattcagttcgcaaatgttgaacaactcacaaaacatcgaggaattgcggcataacactgagggctttgccaaagcgcttggcttttcgtcgactgcgcaccaccgaatttcttccaaaatggccgggagtccccaaactgtccgcgtctttgtcgacgaactt

SEQ ID NO: 86666 - DNA, 382 bp, Heterodera glycines
  SCN-specific regions: Sequence locations=1-382
aaaagcaaatcgttgaatatctgcgtgaatattccaccaaagttgactgcattttgaccagcggtggaacagggttctcaaaaagggatgtgacgcccgaagcgaccaaagaagtcattgagagggaatgcccacgaatcgctgtggcacttctgaagaaagggcttgacattacgccattcgctgctctcacccgtctcaccgcgggaattgctgccaattgtctgattatcaatttgccgggaagcccaaaagcagcgagagagggatttgaagtgattgagccgattctgagccatgcgattgccatcgtgaagggggatgagagcgaaacttcagttctgcacaagagaacggcttaataagacagaagagactgtct

SEQ ID NO: 86667 - DNA, 392 bp, Heterodera glycines
  SCN-specific regions: Sequence locations=1-171,309-309,341-392
tgctgtcgggacaaacgggccaaccaattaaagtgccgtgcacggttcgttaatgctatagctatttgctactaataccccaatacaaactgccccctgatctccaacatggccaccaatgccttccgctcaacttctgtcgaaattgtgcctctatccctgcaaaatgcccaccgaatgcgctctcgtcctgtcggctgctgcacaaacttttgctgccacgtgtcatcaaatggaaagagatatgagtgaaaataccggcttccaaagcaacttcttgaaatggtaaaggccctccatgaaaaagttgccgtcattgaaaaaagcgtcgccatcattgaaaaaaacgtcgccgttattgaaaaaaaagccaccgtcattgaaaaaaatgt

SEQ ID NO: 86668 - DNA, 275 bp, Heterodera glycines
  SCN-specific regions: Sequence locations=1-275
taaaaaaaatgaaaaagtggacctttctaatccttttctttctggggattgatctgcagaaattcgtgaattcagcttttacccaagacaccgaagagaaatattgtgtggaaaacattgaaagcgacgaaaaagttttaatggaacgaattcgcgacgcgaaagattgggcactgactaatgggctgacttttccggtgccaagaaggaaactgaaatgtgacgcatgtgacaaaatcaatgataatgttgttttggacgacatggcacagttt

SEQ ID NO: 86669 - DNA, 400 bp, Heterodera glycines
  SCN-specific regions: Sequence locations=1-226,250-400
gtttgggaacaccctgatgtgaaatggtcttcccgtcgggacattattctcgactcatgcctctacaaacattcaatggttttccattatgaactcactcgtcattgtcattttcctttccgggatggttggaatgattctcctcaggactctccatcgtgatattgctcgctacaaccgtcttgacgaagaggaggatgcgcaagaagaatttggatggaagcttgttcatggcgatgtgttccgcccgcctcgccatgcgttgcttctttcagtgttcgttggtacgggcagccaagtgttgctttgtgcttttatcactcttgcatttgctcgtctgggatttctttcgccagctaaccgtggctctttgatgacctttgcactcgtttttttatgt

SEQ ID NO: 86670 - DNA, 454 bp, Heterodera glycines
  SCN-specific regions: Sequence locations=1-13,35-168,190-454
aaacatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccaccttctcctgtgcaatttgaaatgggggcaaatcgattagaaaaaatgagggcacacctacgcgaacttgctgagaaaatgccggtcaatgaatcgaagcgtctgtcaccgagtggacccgaccctcatcatcattagggccatggatggatctaacggag

SEQ ID NO: 86671 - DNA, 613 bp, Heterodera glycines
  misc_feature (573)..(573): n is a, c, g, or t
  SCN-specific regions: Sequence locations=1-104,126-613
taaatcccgcaattctgatgcgaattgcactgatttgtttgatgacggagagaatgaaattgagttgttgcaagaagctaccgacaaaacggaccaattagatttgaaattgaaaaacaaaaagtcaaagtccgttgggtccgaccactttttcgatgtccgttcaaatcaagttgctgcatcagcaaattgtgctcatctctctttcaccgatctgaatttgagccgacctctactcaaatccatttctgaggccggttttcaaaacccgaccccaattcaaacggcttgtattccggtcgccttagctggtcgtgatatttgcgcaagttctgcgacgggcaccggtaaaacagccgcttttatgctgccaattctcgagcgtctgcttttccgtccctcacggcgaacttctgtcactcgtgtgctcgtgcttgtacccacacgggaattggcaattcaagtcttccaagtcagccgacaaccttgcaaaatacactcaagtggaaatttgtcttgctgcagggggactggaccttaatgcccaggaggcggctcttcgccttggcctgnacattgtcatcgcaacgccaggccgactgattgaccatct

SEQ ID NO: 86672 - DNA, 628 bp, Heterodera glycines
  SCN-specific regions: Sequence locations=1-224,258-268,297-322,357-628
tggatttcgtttccctattttgaagaacatgttcttcccgcgtgcccctggcccaactctttcgcaattcgtatattcatttatttttcctattttgattttccattgctttgggcgtagtttcattagattatttgcataaacttttcgttaacaattttaatgctacttaagttaatttttcaaagaaattttaggaaggaagggactgatgctgcgaaaaattgtcaacaccaataaattttttgtccaaaaaacaattttttgcttattatttttcaaattttaaaaattttggtacttgttgattatttatgcggagattttaaaaaaatatttttttttgtaatattaatcgggttttcaaagggtttttcttattagttgagaatttgtttagacttatttatcagcaaaacatttaaaaaagagagcaaaattataagataaaactgataaaaacaactgaaaaagcataatggtcagagacgaaaattaacgccccaattgtgtgtaaatgtttatttattgagctgatccgttccgctgcatttccttttatggactgaaagtgaattgctgctacttgagctgcttgaatatgtacgtctcaactcttcttcctgat

SEQ ID NO: 86673 - DNA, 566 bp, Heterodera glycines
  SCN-specific regions: Sequence locations=1-566
caagaaattgtcctttaagcttttgtctacttttcgctttaatctcttctatttcctccttcaaattgccccattatccgccattaattaatgtcttctcccccctcgccaaaagcctcgctcattttggaggcacaggccgattttgcgttgaaattgctgcgcgaagtgtccacggacgaccgttcgtgcattgtttcgccgttttctgccgccgtcactttgtccatggtttacgcgggcgccaaggaaaagaccggcgaagaaatgggccaactgctggcaaatggtgcgcccgagtcggaggtgcacaaatacttcggcgctttgctcaaatcgatcacaagtggaacgaacagcagcaacactttggagacggccaacaaattgtacgtggggaagggcagcaaagtgaaggacgcgttcaaagagcaaattgagggaaattacgggggacagtttgagacggtggactttttggacggcaaagggacggcggagaaaatcaacaagttcgtgaaagaagcgactcataagaaaatccgcgatttggtcacgcccgacaa

SEQ ID NO: 86674 - DNA, 727 bp, Heterodera glycines
  SCN-specific regions: Sequence locations=1-184,206-283,306-727
accgaagttttactgagcgcagtgcaacgcgttctggaaaaagtggtgactgatccgatgcatgcgcagccagtcccagcggagagtcagttggcttcgggctttgaattcggcggatcgcggctcagtgccgggagcaatcagtttgggggaatttcaaacatgggcaacaattcggaagcaatgcatgggaaatcatttggagggccttccttcaaattcaatcccctccaggggacgggaaacaacgagctgttgacttttctcgacaatttgcagtccactttgcgctcttccggattcaacgaccaatcggtgtcagaggtgatgcaggcgatgcaagtgctggccaaatacaacataatgggtcttggcctgggcctcggtgttgcggcgatggcccaaatgcgtaacactgagagtgcgatggcccagcagaatgtgctgcttggtgctgccgcatcgaatacgccgttgcaacagcaacagcagcgctacgatatcatgtcacagtcgaacatcaccgggtcactgttggactcgtcgcagaacattgaccagtcaatcgttggaggatcgggcggtgttctgatcgatgtgatgagccaaaagaagtcgggcacaaatggaacgaatactttcgccaactccgtgatcaaagaacgcgttgtggatgatggacacactgaacttgatgttcccgataacattgtcggcgccgttttgg

SEQ ID NO: 86675 - DNA, 424 bp, Heterodera glycines
  SCN-specific regions: Sequence locations=1-424
cctgaacttcctcccgggcgtgcccaatttgcccgaccctttcgttcgcattttgcatttctgcaacagcgaagaaggcgaaaccatcgaattgcccgaattccgaatttttgtgccggacacttatgacttgggcatcctcgtgttggaccagaagactttgcccaattccaccgttaatttccccgtgcccgagaacccccgtcgacgcctgcagcaggcaaaaagaccgacggaagtcggcactttggacgaaagcaatggcaaaaagggggcggaagatgggtttgtgactgtcgacgcgccaaaaagtcacaacgccaaaggcctgcacgaccttttgctcgcccggctaaacggtgaccaaaacgaacggcgatttgttgtgggagacgcaatcggtggagatggaggaagtgccggc

SEQ ID NO: 86676 - DNA, 422 bp, Heterodera glycines
  SCN-specific regions: Sequence locations=1-65,97-124,146-170,192 -299,325-422
tgtcttaaaaagagttcgctttaccgaggaaagaaatgcaacagaaagagtgaagagaagtcggacggaagcggcggaggaggagaaaagggaacgattggacgacgaggaggacggaggaccagccgaaacggcggaaggaatgaagacaaaacggacgaagaaacacacgttggactcggacgaggaggacgaaacggagggctaccaacggctggacatggacaaggtggagggtcaggaggagtcgaccctcgaatatgagggacacgtgaagatcatgcctttcaacatgaaagacgatttggaggaggggcatttcgacgcgaacggcacattcatttttgacaagaagcaaagtgtgatcaaagacgcgtggttggacaacatcgagtgggacaatgtgaagaatgcggtcggca

SEQ ID NO: 86677 - DNA, 528 bp, Heterodera glycines
  SCN-specific regions: Sequence locations=1-429,451-528
cgatttcgctcttccgaaagcctttcacacattaccaaatcactcaaaatgccctcctaaaaatcgcttcttttacgaatttctgctcgcaaatgaccggcaagtggcgcgagaagtcaaagacgaatatgtggacaccaccagcaaaatgttcttttcttatttcaaggcgtacgtttcccggctgtttaaatttcaaatggtcgactctgcgacaaagtccgatttgctcggggccgaggacgtggtcaaacatcccacgacaatctccgcattgccgagtcttttcacttccggcaaaacccaccaaacgcgaagtcgagcgacggttttttcattgggtcatcgccaaaatttgctgctcgatgatttgttggctccgctcattgtgccccacgtggcgcaggaaaataacgaaacgttccaattcgaaagtctttttcggagtgttcagtacgctttggtcgaccattgcagtcatgagtttctgttcatttgtgattttttcatggtcaatggtcagtcggc

SEQ ID NO: 86678 - DNA, 602 bp, Heterodera glycines
  SCN-specific regions: Sequence locations=1-97,121-512,537-602
caattacttattgaattgtccttcgactacacatttaatctcacgaacggacgtgccctggtgcaacaatggcaaaggaggaatactgtttcgatgcaaaggcggcggcagcggcggggcaatctcgtcgtccttcgacaacggcatcagtacttgtgcaaggagatggccagtcaagcagatttgtggatgcgatcatcagaaaagtcacgcagccgcctcttcaacgcttcacggatgagatcaccgacgaggaactcaaacaactctgcaaggcggccacggacgtcttccggatgcagccgacgctcgtcaggatccgcccgccggtcgtcgtcgtcggagacatccacggacaattctcggatctgcagaggatcttcacaacgcatggccccccgccggagcagcagtacatgttcttgggcgactacgtcgacagaggagcacactcgatggagacaatcatccttctcttctgctacaagatcaagtacccatcgaacttcatgctgctgcgcgggaaccacgaatgctccaacatcaacaaagcttatggcttctacgaggagatcgaccgccgttacccgcgaccgggcgct

SEQ ID NO: 86679 - DNA, 503 bp, Heterodera glycines
  SCN-specific regions: Sequence locations=1-503
ctcttccgtcgttgctgtacagtgcgccgaaaggaattcttctttatggaccaaatggttgtgggaaaactctgattgcgcgtgccattgccaaagaggtggatgcgtacttcatcaattttggaacttcgctcgtcgattttgtcaacggatcatccgttactatgaagtctctgttcactttggcagagaaaattcagccgtgtgtcattttcatcgatgaaattgatttgctgttccatcgcaatcggaatgactttcagctgctgaagacgcaattcctcgcgcaatgggatgagtttctgcgctgcaattccaactgcaacgtgatcatcatcggtgccaccaatcgtgtgctcgacttggttctctgccgcttctcactcaaagttcacattcccttgcccgatgaagaagcacgcgagaagctcctgcgcaagattttggctaacgagaatttggaggcggactttaactacgccgaagttgttgaagcgacgcaa

SEQ ID NO: 86680 - DNA, 687 bp, Heterodera glycines
  SCN-specific regions: Sequence locations=1-181,219-221,392-416,438 -597,619-687
ccccgaaccgcttcagtgcccaacgcaacgcaatggccacttacctattcctcgctgcagctgccttcggagcgggaatttactgttggaagacgtaccttggcccgatgcttgaccaaccgaagagcgacgacgaggagaagcccaagccggaaggaggcgaagaagcgacgaccgccggcgaggaggagaagaaggctggcagcaagggcgacaagcacaagaagaaggacaagaagggcgaaggcgcagcagcagcaccagcggcggacaaaaaggaggagaagcgcaaggacaaacacaaatccaaggagtcggggaagagcgacgacagcaaagcgggcaagaaggacaagcacgggaagaaggacaagaagggcaagaagaaggacaccaccgatgcatccaccgtggacgaagccctgggagaacagggcgcagcggagacgagccaagcagagcaatagccaggccgtgatgcgtgcaaatgacagtgttcgacgacgatgtctcgcgacacccacacatatcccttcgatcattcccgtcccttccgattgctgtgttttgtctgttccaatgcttcctaaatgttccccttgtgaacagtgatccttccttatgtgatctgaacatatatatgttgtatgcccattaatatattatgcttcgcttgttcgatatttg

SEQ ID NO: 86681 - DNA, 150 bp, Heterodera glycines
  SCN-specific regions: Sequence locations=1-150
cattttaattcttaaatcctgcgcaagatcgtctacttcaaactgttgcgaattgtgctcagttcggctttcgtgtggaacttctctacttcccaattctgcggacatttgtctgtccaaggccttcctccatgacatctctgtcggcca

SEQ ID NO: 86682 - DNA, 657 bp, Heterodera glycines
  SCN-specific regions: Sequence locations=1-534,569-657
ggtttctctcctcttattattactttctccgccggtccctggcaaaattaaaatgcgaggaaaggcgtgcaaatggtccaaatgttcccataaaatccgtcctccccttttgttcgcatcccttcgcccgtccattcatccgctgctgcactcttacgattagtgccaaacattcctctacacaatgctttatctcaaatccttatccccccttcagaccaaatgcgcggcatttgctggttgatctgccctaccaaattgacttttttttgtacttcactaatcagacaaacgaacaatatttatttaacagctgagaaaaatataattaaattcggcagattatccttttttctatttttagaataccgaaaagactatcccttagggttaaaggaactgaaaatccgaaagttttcttgactaagagataggttcttgagaagccttcccttttatggcacagtacccgagtatcaccaacgtttgtgtcaaggaactgtttgtcttggccattcgtccgttcgaatttcgcttcttcccattcccttggcctttgccaatggcttctcatctgtctgtcactgttcttacgtcaataattgctctttttgttcttcttctggcactccacggaactgctcccaatcagctcaa

SEQ ID NO: 86683 - DNA, 535 bp, Heterodera glycines
  SCN-specific regions: Sequence locations=1-392,414-535
tattttctgcgaacctttgggcattttgagtgaacaactcttctgcaatgctacaaaagtgtttcttctattcccaaattcgtcaatgccttttctggtcccaaattctttctcattttctccaaatggaaatggccaatgcccgtccaattgactccattgatccaaattcttcggcacttttttgagttggtctccgttcggcgattggatcggccgcagatatttggcatgggaaaaagcgcggagaaagcatcgaacgaaaaaagagcagcaaaatgaaattgaaaaggcaatgaaaagcattcggaaggaattggcaatggcagtgataatgccgacaattgggggacgaaatttggccgaaaaagtgaacatttcgagcgcaaaagtggtggagaatgagctgaagcgagcatgtgacaaattgagaagcaaaatggaaacataagatgaagcgatagcattcactgagaagtacgaacattttattgtcatcgaatgcaaaggctcaagtcacaacgtggacaaattc

SEQ ID NO: 86684 - DNA, 596 bp, Heterodera glycines
  SCN-specific regions: Sequence locations=1-408,431-596
tcttcggaccttaacaattttgccgtgccgaaaatccattttcttgaaattacaataaaaaggcgcgaaattcgcttaattggacgggaaaacttatcgcagatgaattaggacaattcgttcgtgccattcgcttggctatgggtgtatttaaagatggaacacaaatggctcgttttgaggaccaattgtttcccgccaaaatgataagtcctgactccacgtcactttatatggcccacattcgactcgaaagattttgcgcttccgagcatttccatgttggaaagtttggtttagccactcgtcagatcgccaatttgttgcgggcgttcactcatagagtgtctggcatttacagcttggagcgttgttccttcttagccgattctttgttccgtttgttcaccaaattttatgaatgtatcaaatggcatttccgacaaagcccaaataaaagcgaaatcgaaaagtttggagcagcaattctcaaatttggccgttttgtttgtgggacgctgagagagggcgacaacgcgggttccttttgtctcccgagctcgactacgataggcaccgaattgctgttaccatcc

SEQ ID NO: 86685 - DNA, 657 bp, Heterodera glycines
  misc_feature (590)..(590): n is a, c, g, or t
  SCN-specific regions: Sequence locations=1-382,404-657
tggtggacggcgcccgaacttttgcgagaaaacaatcggcacgggcacaaaagagggcgatgtgttcagttttacgattatttatgtggagatggtgaacagagagacggtttggaatgggacggagagggacgacgacgtggacgaaatcctttatcggctcaaacgcaccaacaacacaatccctcaccgtcctcagctccgcccccgcgaagacaccaatcaaagtttggtccatttgatcagagactattgggctgaagtgccggccgaacgcccgcgcatggatatggtgcggacgatgcttaagcagatggtccaggacggaaaccaaaacctgatggactacgtgttcggcatgctcgagcagtacgccagttcactggagcaggaggtggaggagcgcaccaaagagttggtggaggagcgcaccaaagagttggtggaggagaagcgcaagagcgacattctgcttaatcggatgctgccgcggcaggtggcggacaaactgaagctgggcgaggcggtggagcccgagtccttccaaatggccaccattttcttctcggacgtcgtctccttcaccactntggccggcaaatgcacgccattacaggtggtgaatttgctgaacggactgtacaccgcctttgacgg

SEQ ID NO: 86686 - DNA, 293 bp, Heterodera glycines
  SCN-specific regions: Sequence locations=1-293
accgtgaagccctttttgggggcatggcgcaattcacgcgtaaccgttacatgggtgtgttaaatttcttatattaaatgtaacaaaacgccgcctgcttgccaaaaaatttccattttttggctgtgatgctaatcagctgcttctccccccccccccccccgctgttaattcccatgacattgggctaagctttggtgtgattcacacattcatcagcccttgaatacgaatgttgtctacataaaatttcttctcatatttacataaaaatctgtccccaccccccaata

SEQ ID NO: 86687 - DNA, 587 bp, Heterodera glycines
  misc_feature (14)..(14): n is a, c, g, or t
  SCN-specific regions: Sequence locations=1-587
cttaagtgatgtgncactccccggcatatttatgcggttcgccatgctgaacgtcttgacgacagtgaaaagcgcaaggtgtggcattcaacagtcgctttgccaaggacaatccgccgctgtccccgcgcggtgtacaacaggcggaggaactgtcggtcgaatttcggaacatttccatcgactactgcttcacctcgccgtatgaacgttgcgtccaaacggcgtcaaaaattttggagggtcgttcaacactgatcaatgttgaaccggggcttattgagtcatttaatctgatctgcgatcgttccggtgtacagaaaatttcgtttcagacgggcaaagaattggcacaacgatataccaacatcaaccggcagtacgaaccgatgtacttggcacctccggaaatcgaaaaaagcaaaggcgtccatggatgtttcccccgagttgaggacaccttccgtaaaattgtggccaaatgctacggcgacattttgatcgtgtcccatcaaggcccagtggccgccctgcaacggatgttgaccggaagcatggaattcggggggagcgcaacagtgagcaag

SEQ ID NO: 86688 - DNA, 199 bp, Heterodera glycines
  SCN-specific regions: Sequence locations=1-199
ggacgcaatggcgttcgtggcgaggaagaagtgaagggaggaaaagaaattgctagcaagacacttaatattcaatcgaaccgtttttatttggacgtcaagtcaaaatgatcgtggacgttttgtcaaattggctgaggttgctatgaatggtcgaaagaatcctttgttcatgtcaatgcgaatttgcaagaatatt

SEQ ID NO: 86689 - DNA, 494 bp, Heterodera glycines
  SCN-specific regions: Sequence locations=1-121,143-494
aaccgaaacgaacattcggcacttcatttgatgacgacttcaaacccaacctttcaactgcagttgatgtgaatgtccaacaaaaacctgtagacaaaacatcagcagttggtgacatcgaagtgaaaaataatgaaattgttcaaaatggcaaccaattgagcaaagagagcgtttcaactgtaccatatgaacagcagcatggtcaggtgatcggacaagtgaagacggtcaaatacaaagcgctcttcgaattcaacgctcgctccggcgacgaattgagcatacaaccgggcgacttgatcctcgtattcgagggacaccaatccgagccgggttggcttgctggccaaattcgcgacaaagtcggctggttccctgcctcttttgcggagcccctttccgccgctgctgctggcccattactgaagaggggcggtagtttggccggctctccttccggcgaacctttggccatcattcgcgaggagtgt

SEQ ID NO: 86690 - DNA, 499 bp, Heterodera glycines
  SCN-specific regions: Sequence locations=1-181,210-499
tggcctgttttgtgcacccccggcggttccgttgtcgcgaaatgtgccaccaaaaattgcgcttgacatgctgctgactggacgtttcttggaagctaacagtgagttttatttattgttaatttttgtatttaatcaaatgttttcggtccattttttggatttttttttgccaaaattcttttatttttttcattaattttttttttgctttgtccattttcagttttccatgggttcaatcttcattaattttggtattcttaacattctctgtatattcttccacaattaataaaaacagtttttttgaaataaattcttttacaaaaaaacaaaaaattcatgaaaaatttgctgaattttccagaaaaaaacgtacaattaaaatttttttttttcatttccttgaatttcattattacttaatttttatttatctttggaattaagcaagaggtaactaaaaattttttcatttttttggcgatgttttatt

SEQ ID NO: 86691 - DNA, 640 bp, Heterodera glycines
  SCN-specific regions: Sequence locations=1-203,226-504,527-640
tatttccgattttctggcattaaacgacgcagtcaacggaaatgatggaggcgtgaatgttggcagctcgtctgctgaattggcattgaatgacgagaagagttgggccaattacagacgaagattggcaacctttgatgtggccagtcgaattgcgaaaccgaaggaaatttcgcctgttgtgtgcgcacgtcatggatggaaaaatgtgggggaggagtttttgcaatgcgacgactgtggcaaagtgttatacatcaaattgccggcgacgaagtgtccaatcgcgtgctgaaccattgcattcgacacattcaacgcaaattggtcgaagcgcacaccgtcatttgcccatggcgcattagcccggggctgaacacttccgcaacctatgacatcactgcgcgttatcaccaactggtggacagcggccagcccgaacttccgttggcggacaatgtactcgacgaagcgttggccgacaaatttggcgtgcagagccgatttttcttggctttggccatttttggatggcttccaatatcaaaacaagcgacaaatgacgtggagatgaacaaaccgcagccgaactttcactgtcccctctgtggacgacatctttgcgcatcggtgttttcca

SEQ ID NO: 86692 - DNA, 513 bp, Heterodera glycines
  SCN-specific regions: Sequence locations=22-513
atgactttctctttttgattgaaaaaattcgagcaaagatggaggaaatatgtggaacaaataacaattatgttgattttatcgtccccaactccgaggtccatttggcaaattttggcgctattgagaacgcccatttgagtattttaatacagaatttaatcgatgtgatcaggtcgataaatgcacgacaattagtgaaagagtttggcgacaaatatttagaggaagtgatgaagtttctcgacgaagcaatggcagcgtcaaatgagtctctcccgcttgccaaaattgtgcctgttttatgcgacgcctttgccaaaattggcaccgtttctttcggctccattttccattctttgctcagctcaacggaattgcacagattcactctttttgtatcggaatgcagcaaacgcgatgatttgttcgatgcaaatttaaaatgaatgatcaaaaattggtcacttttgaactgtccaatttataaaacaagtataactttttatgtcc

SEQ ID NO: 86693 - DNA, 328 bp, Heterodera glycines
  SCN-specific regions: Sequence locations=1-328
taattgtcgagagaggaccaaattgtggtcctttaccgggagaattgatgtttcagcatggaggtggtcggttggggtgatggagacgcaacctgtaattgtgcgaagggcggagttctggcatctccggaggatggaccaatttgagtcggccagttggggggaccaaatcggtgctgcataatcgagaagactgcgatcgatggctttgtaggtggtcaagagcacttcttttgattgtccccaggttgttcctgccaaagcccggatgatgttgttgcgtttttggatttttgatcggagtcccacggaatgggcatcgaatgtg

SEQ ID NO: 86694 - DNA, 655 bp, Heterodera glycines
  SCN-specific regions: Sequence locations=1-583,605-655
tcgacggaagcccccatattgcagtggacaccttctcgagttgacgaaggcgacaaaatgcgcttccgattgatccatgccggctttcggcacccattggtggtgcacattgagcagcaccaaatggaagtgatcgccatggatggaaatgaagtcaaaccattccgaaccgacgcattgatcatttacccgggagaaagattcgatgtccgagtcactgcccttggccacccccgttggcccattcaccgaatggtggtcggattggccgagcagtttctggcagaaacagaagaacccatttacgggttggccaacttagactatcattggcacggagaaactgccgacccaaattgggacggtggcgaaaaagttgattttctgctgaatcgatgcactgctcgccaatgtgtgctgctgggctgtcccttcagaacagaaaatggcacattcgccgcattcgacggacgcaaatttaaatgccattccatagacgaactgagaaacaatggcaaattgaacaattatccctccgggcatgggtatgattaataaaagcgaatttgattgattatcacttccaaatgctcacacacaaaaagaaatgatgatgatgaagtgattgaaagccatcacattttgttggactccg

SEQ ID NO: 86695 - DNA, 249 bp, Heterodera glycines
  SCN-specific regions: Sequence locations=1-249
cacatgacctgcaaaaacttatcctgtcgctttgaattttgctggatgtgccttggcccttgggccccgcatgtttcacgctccggttggtactcctgcaaccgctttgaccatgacgcggctcatagggctcgagattccaggagagatccagggcggcacttaaacgatatttgcactactattcacgctttactaaccaccagaactctctcaaactggagagaaagctttttgaaaaagtgagct

SEQ ID NO: 86696 - DNA, 557 bp, Heterodera glycines
  SCN-specific regions: Sequence locations=1-557
cagaaagtgccggagccggtgttcgcattttggcttaaccgtgacccgacctctgaatttggtggtgagatcaccattgggggcactgatcagcgacgatttgtggccccaatcacttacacaccggtcacacacaaagcctactggcaattcaagatggattcgatcagtggaggtaatggcaaacttgcgtgccaaaatgggtgccaagccattgcggacaccggcacttccctgcttgctgggcccaaaaatgacattgaaaagattcagaaacacattggagcaattccgctcttccatggcgagtatatgatatcatgtgaacgtattcccacactgcccgatgtgacgatcaacatcggtggcaaggcgtacacgttgaagggcaaggactatgtgctgaaaatgaccagcatgggcaaaagcatatgcctttccggttttatgggcattgatttgccggaacgtgtcggagaactttggattcttggcgatgtgtttattggtcgttactacacggtgtttgatgtgggccaaagtcgtgttggttttgc

SEQ ID NO: 86697 - DNA, 425 bp, Heterodera glycines
  SCN-specific regions: Sequence locations=1-266,288-330,357-425
tcctgacgatgggtcgttgagcgcggagcaaaaaatggagcgaattgactcgatcatttgcactctgccggagaatgtcattgaccaaattccggacccgccagaagttgcgcaactcccggctgatgtgcgccagcgcgtcaaacaaattgaacgccagcagggaaagtcattcagcactaaatttgaagagatcatgaaatatgtggacactttgcctgaaggcacaaaatcggctgccaaaaacattttccattgaatttttcatggaaaaggaggagaggaaagaagtggaaaaagcagcatggattaatgaaagcaaggctaaacaatatttattaaatattttattttttggtaaaatatttccaatttttcatttccaataaatatttttgctttgttgaaaaaaaaacccccatatc

SEQ ID NO: 86698 - DNA, 213 bp, Heterodera glycines
  SCN-specific regions: Sequence locations=1-89,111-213
cccgttccgctacgtatattccgcactgcgcacctccgtccgcaacccgacatacttcggtcgtgttttcttcgctctcagcccctcccaaccgcctttgactgtcaattcgaccgtcgtcggcgttccctcctcccccgtcaacattccgccatgcgtcggccattgcgacattcgctcggggcgcatccctccggatgagcatttcccatt

SEQ ID NO: 86699 - DNA, 578 bp, Heterodera glycines
  SCN-specific regions: Sequence locations=1-514,536-578
ccttttttgtttctcgctgagttgggcgaaggctcctattcaaccgtttatttggcttcagagcgccaaaccagtcgaaaatttgcagtgaaaatgtgtctcaagaagaaaatcatcaaagaaaaaaaggtgcagcaaattttccgtgaacgtgacattctccgacttttgtccacgcccgcaaatgcgtgcccatttgttgtccatttgttttgcacatttcaagacgatgagtcgctgttttttgtgctttcctatgcgcccaaaaaagatcttatggcccggctgaaaaagctccaacggttcagcgttggccagtgccaatttgcgatggccgaacttttcttggcactcgagcacatccatgccctggacgtcatccaccgtgatgtaaagccggaaaacattttgttgcgcgaggacgggcacattttgttgtcggactttggctgtgccaagcaaatcattgcaaagcgggaaaatgtggcggaggaaaatggtgacaaaaccgacggacaaagagcagatgatggccagaaagcagagaaaagtgctgacagcaaaagcagcaaaaaacg

SEQ ID NO: 86700 - DNA, 640 bp, Heterodera glycines
  SCN-specific regions: Sequence locations=1-640
gtccgaatggcactcgtacgctgccggactcgcagaaggctctctcaccaaactgcaaatttcaaatcactacagtaacacagtgaagggaatatgccgagacaataagggatactgtagaaaactttaccgctatttgaatgccaatttggaatggatcagtgcacagattgatgccaacccaggcgatttgtactggcgccaagtcaatttgacattcaatcagctgaccggaatttttgacggctatgcgatggacagcggaaaaagcttctctccacgggttaatttcaccattacgcccatttacatgatccaaatatcgggcgaactcattgatctgagcattttgttcaaaaaagtgcccagaagcaaaggagaagccgttgaattggccgaggcggggcattgttcggggctggtcaaagtggcggcgggaaacagcgatttactaatgtcccatgttgcgatgagcggcttcaacacaatgaatcgcattgtcaaattgtacaaatttgcttatgacccaaaggatgtccctggcttcgccgtttccttttcgggttatccggcggcgcttgcctcggccgatgactttacgctgacaagtgccggattgctttcaatcgaaacgaccatt

SEQ ID NO: 86701 - DNA, 672 bp, Heterodera glycines
  misc_feature (640)..(640): n is a, c, g, or t
  SCN-specific regions: Sequence locations=1-207,230-672
tttttaatgcgaattccttctttcgctaaaattacaaattctgctgtaactcaaaaagctttattccttcctggatatagcatatattttgaacaaacggaattcgtataacacgacagaggagcagtgctcgcattaattggctgaccgaactcaccacgcgcgattcaactccagttacaaccacccaaacttcaaaggatttttctgaaatcagcaaacatttagcgctcgttgaggacgaagacaatattaaaaggattcaagcaaaacgagaaaaagaagcccacgaacgcgcgttggcttttgtcaagaatcagttattgaactcgcggaaagacgactggctccatcaaccaatcgaagaattgcttggctacgcaccgaaatactaacggaatggcgaagcaatgctttgttactgttggcagtacgcgttttgacgctttggtcgaatctctgttccgtagcgatgttctcgatgctttaaagaaactgaaagttgaatgtgtgacaattcagaatggcaatggtgtaattcctaagcaaatacaatccgccatattaaatcaaacgcaatgcatcattgacggaataacgtttcatttgttcgattacaaagccagcataagggagtatntacaaagtgcagaattaatagtgggacatgca

SEQ ID NO: 86702 - DNA, 676 bp, Heterodera glycines
  SCN-specific regions: Sequence locations=1-109,132-569,591-676
aacattcgtctacaatttatccatttcattggcattgtacggcctgtttttgttttacacggccactcgcgaccttttacatccctacaatccggtcctgaaattcttgacagttaaatcattcattttcctgtccttttggcaaggtatattaaaatagatagatccaatgtatgtgtacacttctcctatgtttccttctcgccgttttgggtgccacttcagccattgaccccatttacgacttggatggcaatgaaatcattggcaggggcaccgttgccgcgggatatcagaatttcttcatttgcatcgaaatgttttttgccgccattgcccttcgtttcgcgttcagtgtttctgcttacatcgatgcgcatactggtgaaccattcgaattataagcattgaatcaaaagtcttcagtaaccgccggaagtgatgtcaggcctatgactctgcagagcatttccagttcgctgaaggagacgatgaaccctcgagacattatgcaagatgccattcacaatttccatccacaataccagcagtacacacaggtcattataaaaattagttgcttcatcagtttgattttttagcattccaatccttgtcgatcggtaagcttttttggcgctatttgaaaaatggtcatattgcatttataaataaa

SEQ ID NO: 86703 - DNA, 570 bp, Heterodera glycines
  SCN-specific regions: Sequence locations=1-570
cgaacaattggaaactgaaatttgtggaatgtgccgaagagattgccgaagaccaatggcacggtctgatcattgccaagcaccaagacggagtgatcagctacgaatcgagccatggattcgacgacatttttggcacagaacaaataaaagaaacggaaaaatatttggaaattaatttgtccaaaaatgctgaaccacttggaaatgaacttcaagaagcgctttcttctgcagcattttttgacgattttatgccatttgttttggcatttgaatttggcgccacattttgcgcagaaaacggcggtaccaccaaattgtgcaaagagaaatgcctttcccaatcattggtcgccccaaaaacaaaggcaccgtttgttggcccaaccaaattccatcggacaacgccacgcgcagtgccaaaaaccacttttggcattgtgccaaaaactgaagaaacctttggctttgtgccatttgcacgaaatgtggaccattttggcacaaattgtacgaacattttcttcccggcggaagtggacaaattcttgctgaatatcaccgcga

SEQ ID NO: 86704 - DNA, 646 bp, Heterodera glycines
  SCN-specific regions: Sequence locations=1-74,101-368,390-406,428 -440,466-646
aaaatatgactctggacttcaaatatccaaacaccgataaagcgcagtggttgaccggagaacagctcgccgatatgtacaagtccttcatcaacgactatcccgttgtgtccattgaagatgccttcgaccaagacgactgggaaaattggagcaagttgcaggctgccataggcattcaacttgtcggcgacgatttgacagtcaccaacccgaaacggattcagaaggcggtgcagaaaaaggcatgcaactgcttgttgcttaaggtcaaccaaattggcacggtcactgagtcaatcgaagcttcaaaactggcacgaaaaagcggatggggagttatggtttctcaccgttctggcgaaacggaagacaccttcattgctgatttggttgttggactcgccactggacaaatcaagactggcgcgccgtgccgttctgagcgtttggccaaatacaatcgtattatgcgcattgaggaggaattgggcactgacgctgtctacgccgggaaaagtttccgtagcccgcaaaactaagagcgtgtggaaacgaagaaaaataggactgttcgttgactattcgctggatgtttagtttcctgacattgattatttgttttcgaaaatcacttgaatgctat

SEQ ID NO: 86705 - DNA, 642 bp, Heterodera glycines
  SCN-specific regions: Sequence locations=1-145,167-207,229-371,395-642
aattaaattattctatttttgtgcatgtcttctctgctgctctccatcttcccaattgtgtttttggtctgttgcaatgcaatgccaaatttcccgtgctgcccgggcagtcagcaagtggttgctgtgatgtccaaatacattgacactttctcttctgctgctgacgagtctacagtatgctcaaccgctaaaagtactgtggatggaataaaaaatgaactgtcctatcgcgtgggatgcccaagcggaggagaagcacaaattgtgaatgaaattgatcaacagctgaagaacattgcgaaaatggaaatcaattatgaggacgagtgcccgtacaatttgggctttgcccgtgccatgttcgacttggccgctgctgctgctggccatgcggggaacggcacagaatggcaatacatgaaagtacaatttgagcaggaaagccaagcaatcaaagcaattggacaagaaaagaactttgaagttacggatgtgcattttggagtcccaagcaaaggggtttctgcacatcaaaatgtgccgagtccgagccatgtgattgccaaccctggccaacacagttcggttggccaaggaaagaaagaagaaccgttgtcatcggacttcgatttttgaggg

SEQ ID NO: 86706 - DNA, 637 bp, Heterodera glycines
  SCN-specific regions: Sequence locations=1-324,346-507,548-637
aaagctaaaagggaatattaatggctttcgagtttatttgcataatcactgcttcaagttgcttcttccctgcccccttcgattctctctcttctcatgcaaaattcgctggccgatgtcgctggctctgctccccaaaatgtccaagtcggaagtgccgttccttcccttcctctgacggctaattcgtttgccaattttcccactaccacacacaatcagcagcagcaaagaatggtgcccttcttctcctcaaaatcactcgtcatcgtcaacaaatgcgacgaatcagcaacatccctcacaacagcaccaaatgcatctccaacagcaacaagttcaaaatgctgtcgcccaattgttgcgccaacaatttcccaccagcgcgcctggaattatgggaatgaacgctcttttgaacgcggccggaataagcggcggacaagcttttcctaacattggcacttttcctgtacatcagcaccaatttgacttacaatctctcgccgcggctgctcagccacatcatcaccaacagcagcagcagttgtcctccgctttgaacttgcaggcgttggttggggctggagcagtgcaccaaccgccgactcccatcacttccgccgcggcacccaat

SEQ ID NO: 86707 - DNA, 555 bp, Heterodera glycines
  misc_feature (3)..(3): n is a, c, g, or t
  misc_feature (14)..(14): n is a, c, g, or t
  misc_feature (17)..(17): n is a, c, g, or t
  misc_feature (37)..(37): n is a, c, g, or t
  SCN-specific regions: Sequence locations=1-132,154-533
ggngcctatttggnggntggggttctcaatgacgaanaaatttgtaaagcacaaaggccccccggttttcaacaagaaagaacggtaccgaatggtccgcggcatcaaatgggtcgacaaaattgtggaagcagctccatatgtgaccaccttgaaaactttggatgacaataattgtgacttttgtgtgcatggcgatgacataactttgaccgccgatggaaaggacacttatgccgaagtgaaggttttttggcgttacagagaatgcagccgaaccccgggggtttcaacaacggatttggtgggtcggatgcttctcctcacgaaaacgcatcacaaaagcaacgaacgcgagttggacgacgtggagcgtgaccatgcacttaaattgagcacggaccaagaggaccgctccccttggacatgcatttcacattttctgccttcaactcagacaattatgcaattttctgagggccgagctccaacccccgaatatcgaattgtttacgtctgtggctcttttgaccttttccacattggccacctttg

SEQ ID NO: 86708 - DNA, 346 bp, Heterodera glycines
  SCN-specific regions: Sequence locations=1-41,64-112,139-265,287-346
tctcggcttaagcaaaaagggaaaagccgaacgcaccgatggaaagggagaaaaagaagaaaagcggcggagaggagacaaatgctttaccttttccttgctcaattgtgtacaaatccctccccttttccccatttcgctattccccgactctccaatttcttttggctgttagcttttgctttccgagtgatccttccgatgaattcgccgtgccttttcttccgtcaatgactcatccccaaaaggcaattaattcattaatttttcttctcccttaaatatatttgtgccaattgaggagtttaataaatgttgtggtgcaaaacaaaaaaagaaaaaaaaa

SEQ ID NO: 86709 - DNA, 711 bp, Heterodera glycines
  SCN-specific regions: Sequence locations=1-60,96-185,207-711
ttggcttaaatcattccaccttgggtattttgcgcaaccgttcgatcaatagaattccaattcgaattgaagaatgtgctgagaatgaaaatggatttgccgatgattatgcaaactatctcttcgattccgaccaatccgacagcgacaatgccgaagaggaaaacgaagtgtcggtccaaattcaaagccaacccatcggaggccaccgacgcaaaaagacgaaaagctatcggccgattgaaattgtggacggatttccgttgaagcgaaacatgggggcgcagaagtggcgtcgtgtggaaaacactaggcttttgacgagttttgccgacactcaggacatttgctttgatggttccgatttaatccccgagacgatttctgcgttctcacgccttttgcgagatgaggcaaaaatgaaggtttggaatgacttcctggagaaagacgaatcaggacagaaaaagaggcttttgcaattcgaatacgaaattctcatggcacgcgacgcttcgaaggcgcagcattcgcaacaatcggtcaaaaatacggacatcaaaaagtcggagagtcagccgcacaataaaaatggtcagccttcgtcgggtggtggcaaatcgtcgtccgattgttttcagcgactcgacaaaaaattccggcgactgtttgctcaaacgacggaacgtccaatttgattgcctctacaga

SEQ ID NO: 86710 - DNA, 545 bp, Heterodera glycines
  SCN-specific regions: Sequence locations=1-128,150-365,387-545
tctttactcactttgtttctgcttcagccatttttctcgcgatgactcatcggcaagagttgagctgaaagtgacgtcttcaaacggaatgcctttgtaatggaggataagacggatctgcgcatttggatgaacaaatatggaaatgtgttcgaatttgctcttacgggttccgcaattcctctcgacgaaaaataagcaacatccaccagtccatctgccttggagacaagacaaaaagccgaagttgaagtaaatgaatatttgcgggatccaaaaattaaatccagggccgatccatcattatactgggaagtcaattcacaaaaatggccaatgattggtgacgttgtacggaaatttctttctccacctgcaacaagttcagaaagtgagaggcttttctcaacggccggtctaatttcagatgacttgcgaaagagtttattaccagaaaatcttgcaaaacttttgtttcttcatcacaatttgcttttaaccggtttctcaattgaatgattttgcttttacaaatttgctttcaa

SEQ ID NO: 86711 - DNA, 359 bp, Heterodera glycines
  SCN-specific regions: Sequence locations=1-328
gtgtgagaaacattttattttggcttgaaaattgtggtgttaaagaaaaatgcaattcttaggccgcgatttctggctatttttaattattccgcttttatgtgctctcattgcacaatattaaattcctaattgtaagtccgactacgaatatctgagaactctcctctctctgcgatttctttttatttgacattttgacccttactcattttggtctaatgttaaaatactgtgcttctttctgtttcagcttcttaagcaatttgtggtctggtgatgaatgaatgatttgtctatttaatcaacagaataaatgtttttgacgaaaaaaaaaaaaaaaaaaaaaaaaaaaaaaa

SEQ ID NO: 86712 - DNA, 585 bp, Heterodera glycines
  SCN-specific regions: Sequence locations=33-69,102-120,142-163,255 -284,421-421,443-456,486-495,565-585
ggctccggcatgtgcaaggctggtttcgctggcgatgacgtgccccgtgcggtgttcccgtcaattgtgggtcgtccccgtcaccagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcacccgaggagcatccggtgttgctcacagaggctccgctgaacccgaaggctaacagagagaagatgacccaaattatgttcgagacgttcaacacgccggccatgtacgtggccattcaggccgtgctgtcgctgtacgcctctggccgtaccaccggtatcgtgttggactccggcgacggtgtcacccacaccgagccaatctacgagggttacgcgctgccccatgctattctccgcttggacttggccggccgtgacctcactgactacctgatgaagatcctcactgagcgtggttactccttcacgaccaccgccgagcgtgag

SEQ ID NO: 86713 - DNA, 251 bp, Heterodera glycines
  SCN-specific regions: Sequence locations=1-251
gtggatctctagttgcaacgcgactattccagaagttgcgtttcgccgaaaagggcgggcgtctggcctgggccttcatgggagccatcgccaccggagcgaccatctggtgcacccatttcgtggccatgatcgcctatcagccgggcgtggacgtcacctatgaacccggtctgaccggcgtgtccctaggcatcgccatctgcggaagcgccctggccctgtggttcggttcgcgccagatgcggttc

SEQ ID NO: 86714 - DNA, 629 bp, Heterodera glycines
  SCN-specific regions: Sequence locations=1-629
gacttttttgttatttccttggatccatcagtgacaaatgccatgcaaagttccgttagctcgaatgagatgatatttggtggaaattcgaccgtttgttctgaggagtctcatgcgatgtctgaaaaggtgcagacaattgcttcttccatttacagagaatttgaaacgatgatacaaaaacatggacaggaaagcataaaagatttgatgtcgctagttgtaaatgttttggagagcttagacacggcataccaagaaaaggatgaactgattgtcgacctcgaaatgcttaaggatgaaaatggacagttgctgaaccaatacgaaagggaaaggcaaatgcgcaagaaccaagaccagaaaagtttggaaagggaggaattcatgtcggagacaatccgcgaattggagagcaaagtgcagagtatggccagcattgtcagaatgctcgaattgaaggccaaaaatgccaacgatcatgcaatgcgactggaggaaagggaggccgatcagaaaattgaatatgaaaagctgcacgaacgttacaacgaattgttgcggacacatattgagcatgtcgagcggaccaaattcctgatgggttccgaaatgttcgacatggccca

SEQ ID NO: 86715 - DNA, 594 bp, Heterodera glycines
  misc_feature (14)..(14): n is a, c, g, or t
  SCN-specific regions: Sequence locations=1-291,313-594
gtggattatttgcntattttctgaagccgaaaaagatgatttggaaaaatggtttggaagaaatcgatggccttttttaactcaaattagcgcgacaaatattcggaaaatagctgagtcgacaggaaaactgttggtgttgagctcaattgaaggaatggacagacacaacgccagcacggaatcggggagtttttttgccttgataaaacgaacagtggtcgaagcccgtgtggacgctgaaattgagcagcactttcagtttggctggttggacgggacccaaattgccagtggcgttgtgatggactctcttcttctgccgaatttggtcgtgctcaattactccagctacgaattttacctcagcaaagatcacccagcgcaaatgacggccaagtcgttgcttttgttccttcacagtgttcggctgggggaagtgacagtccacgggggccgcgcgtggatcacacggctgcgaaggatggcctacgaaatcaccagcaatgtgtacgacatgttccaacaccaacccattctcaccgtttgcctttttggagtgccattggcattcttctccatcatcacttactc

SEQ ID NO: 86716 - DNA, 293 bp, Heterodera glycines
  SCN-specific regions: Sequence locations=1-249,272-293
ttctttgggatggacacttcgatgagaatgactccgaccgaatggcaggcaaagccctcgaatggctttcataccatttgaaattggcaaaaaatgacgaaacgaattacgacgagacactgaccagagtgatcagacttttggggttgagcatacagcggaaatggacggaagcgaagtcattggcggaagagatgtttatcacagttgctccatcggacaatgcgcggcaaatgatttattcctccatggaacaaatgcagcaatttttgaattttgacgaacacattgaa

SEQ ID NO: 86717 - DNA, 340 bp, Heterodera glycines
  SCN-specific regions: Sequence locations=1-178,200-340
gggggggggggggaggcggggcgggaaggcaaaggcgggaggcgcacgagaacaagggaaatccggccgcgcacgctcacttcactaaagagggaagctggcgtttgattctctcctggctcgacatcgacttggtgtcgggcgtcttcattttcgtgcccatgctgcgtccggcggcggtcccacctgtgggcggccgcaccatccgtctgcgttcttgaagcttttcgtcttcactcatcgttcccacatagccccaacacgcgttgcgggctatgtcccgcctcaaatcaactcccaaaaggaccaccgaaatggccgaaaccctgaccttcaccct

SEQ ID NO: 86718 - DNA, 580 bp, Heterodera glycines
  SCN-specific regions: Sequence locations=1-14,36-68,108-580
gctttccctccgttctttctccaactgctgccactttcaattgcccttcacggcaatggctgatgacattcctcctcctcctgctgttgctgctgatggtggtgatgtcgtcgttgatttggagcaacatgttcgccaactcatcatgtccatcggccagggaagcgaggacgcagtgcacgagctttccattctgatcgagtcattcaaccaggagcagctcgtcgactttctggagattatggcaagaatgtacgtcgagagcggagtcagcgttgacatgccgggtggccaaggaatcaacatgttgatggtcgctgcgtcctctggaagggtggactttgcgcgctacttgctcgcccacggtgcaaccgttggacacttggacgccaccggaagcgtcttcccactaatgctagctgccgaatctggtgagttggaggtgtgccgtctgctggtcgaggaatgggcagctgaagtcaaccagcaagcaattgatggcacgacacctttgatgagcgcgagcagtgagggacgactggacgttgtgatttatctcatcgatcatggcgtcgaaatc

SEQ ID NO: 86719 - DNA, 751 bp, Heterodera glycines
  SCN-specific regions: Sequence locations=1-67,93-231,254-751
ccgacgactggtctgacacctgctgaatctgttcggcgttcgcagatctctgcattggtggaaccgaaacaaccacaacaacagcaacaagacatcaacaacggcgccggcgacgaacatggcggagtgcttcgcaggtcaatttcggtgctcagtgataattggtacgattgggttgaaggcaatcagacggacaaagctggtttaagcaatcaacaacaaaatgtcatcgtccatcagtcagtcaacagcaccatcgacgcggatgagcatggcatatctgatgaagccagcccggtcgcctcactgtccacaatcgaccttggccgtgtgtacaccactgttggcactgtgatggaatcgctgctggttaactttgcgcacctgtggcaatatcggttttttcgcgttgccttcgtccttctttccatctacttctgcctgggcttcttggaacggtgtgctgtagcgatgaccgccgcatgcgtccgctgggcttggccaccggtgcacttcatgctcggctcgtcacggggaacgctgttctatttgactgactggttcgcgtggatggacgacttcttgtcaagttgggtatgcgacatggccaacagatactgtcaccaatacgatgtgatgtgcgattgtcagtgctcctttgtcagccgaacgcagcgggcagctttgctcggtggccgtcgcttctgatggatgtaaagaatttgatagcgatttgacatatatggatgat

SEQ ID NO: 86720 - DNA, 582 bp, Heterodera glycines
  SCN-specific regions: Sequence locations=1-424,447-451,475-582
cacgcgggtgacgacggttggatggtggtgaagaaggagtcgttcaagaagttgtgcgacttctacgaggagcgtcgtcgcgtggagtgcggcggtggcaccgtcgccgctgacccattcgcggaacaattggagcgcgaatttcgcgaggcaacgatggctgacaacaacagcaacaaccgcaccgatgaacgcgtggatgagaaattgacggcggagagtgaaccgaaaaaggcagacgaattcgtgaaggaagttggacaagaaccggctgccgaggtttatgtggcacaaattgtggatttgaccaccgaaaaagatggaaagtcagaaaaatcggagaagaccattccctgtgtccattcggttgtgatgcgcggcgtatgtgccggatgtggacaggattttcgtcagccaaatgaatttatcgggaactcggctgccattttcaactttgaacaacagcagcaaaagatgaaccagaccgtgcccatttctggttccttcggtgttgatgaccaccagaaaactgcaaaaaacatctatccgtctttggaactattggaaaaagaaccacgcgga

SEQ ID NO: 86721 - DNA, 262 bp, Heterodera glycines
  SCN-specific regions: Sequence locations=1-185,211-222
ttttgtctcttttgcttctttttgccgacttttcatggctcgccgtttcttctcccactgacccatcttatcgtacgaaggcacaaattgatcattcgggcaccaaaaaagtcgttaattctcgccactctcccgcgccggcgccgcacagccaacggaaggagaagcagggcaaaaaagagaaggccaaaagcagcagcagcagttcatcggcggaggaggaagaaaaaaaacacaaaaaaaaaaaaaaataaaaaaaaaa

SEQ ID NO: 86722 - DNA, 668 bp, Heterodera glycines
  SCN-specific regions: Sequence locations=1-88,110-668
gagaaatggcttcatctttccgctcctcaatcatttccatcgtcgcaattgtctgtttgctgtgcaaatgctgcttttcggcaccccatccatgctgtcctggcagccaacatgtcgtttcgatgatgaaagatcacaccggcacattctccgcttcgatgccaaagtcttcgctttgtatgagtgccgaaagagtcgccgctgcggtggaaaaccaactgaaaacaatttggtgccctggcaatggtagtcaaacactcatcaacgagatcaacgcaactcaatcatcatcagatgagtgtgctcgcagtctcggcttcgtccgtgccatgttcgaaattgccgcttccgccgcttcccatgccggtgccaacgccgatttggctgtccagttccgagaacaagttggcacaattgacagcaattgtgccgcgttgggcattcatgttgggcaaatcagcttggatgcccccaagggagaccatccgcaagtgcatgactctgagagtgtgcttagtaaccctggcaccagcgggtctcacaagcgcttttaagtgaatttcgtagattcgatgatgtcatcatttgttgattgatatgcaatagaaattattttattcgaaaataattattcatcttttttattaatgaattttggtgagtcggtg

SEQ ID NO: 86723 - DNA, 566 bp, Heterodera glycines
  SCN-specific regions: Sequence locations=1-187,210-566
agtttcgccggcacattgttgctagaaggtggcgaagaattttcgccagatgcccagtgcgcacagcaatggaaaaagcccaatgagtcgctgtttgtggtccaacaattggcccgccaagggcttggcccgcgtcaaattttggcaacgctttatcctcgctattgttccaccatttcggacgacatccccgatgagtggataatgcagttactccgtgaactgtgcgagcaccggacacgccaaaaattgtccaattacaacacatttgaggacgcagtggagttattcaggaagagcaagcgcattttggtgatcaccggtgccggtgtgtccgtcagctgtggcattcccgactttcgctccgagaatggggtttatgcacggctcaaaaaggactttcccgagttgccaacccccacggcgatgttcgacattgacttctttcggcagaatccgaggcccttctacaactttgccagggaaattttccccggccaatttcgaccctctctgtcgcacatgttcatcaagtttttggacgatgaaaagaaactgttgcgcga

SEQ ID NO: 86724 - DNA, 518 bp, Heterodera glycines
  SCN-specific regions: Sequence locations=1-25,47-47,77-83,107-518
gagaatcggctgtcaattcgtttgtattttgccaaaattatggcaatttttacgaaaattttcaattttattaaaacgagtacagaaaaagaaaacaagcaaaaatatttgcttgtatttgttgaaatttggaacaaaatttgtccgcgtattcatgcagaactccaacagaatgacatttcatcgactgttggcatactgtacaacatttggcggggaattgcatcccgatacaatcaaattccgcttggaatttttcaaggttatgagccaattagggtattatcgtcagataatggcttactgttactggatgaaaaaggcacctacagttctaatgtgatccgtgctgaactttttgaggaccatgtggtgaatatgttgcgactgtatgagcaacagagcgaaggaaattcgttcggccttttgttgcgccgttgcaaattggatggcattgcgtataagcatttggacaaatttgcaaatggaaacgaattcgaaaaattacgagcgaaata

SEQ ID NO: 86725 - DNA, 421 bp, Heterodera glycines
  misc_feature (30)..(30): n is a, c, g, or t
  misc_feature (44)..(45): n is a, c, g, or t
  misc_feature (60)..(60): n is a, c, g, or t
  misc_feature (72)..(72): n is a, c, g, or t
  SCN-specific regions: Sequence locations=1-199,221-281,303-421
aagaagaagaggggtaccataaggaagggngaggaagaggaatnngacgagatcttcagnaatgggaccagnaagcgcgacaacagaccggacaccgaccacgactacgcaggcacgcgccaattggcgacggcgaagggagcgaccggcaaacaccaacggcagaagggcggcggagggacggcgaaagagccgaaaaagaaaacggcacttgtcaatgggaccgattcggtggtccgttcatcggcacggccgcaccgtccgaccaaacgttttgtttttgaaacaaacgaatcattcattcgtgggacttcgaaagtgcgcccaacatcgccacgcaaacatggcaagaaatcgactgcggagggaggaagcgaaggggaagaatcggaggatgacgggaaggaggacagcgtggaaa

SEQ ID NO: 86726 - DNA, 379 bp, Heterodera glycines
  SCN-specific regions: Sequence locations=1-267,289-379
ttctaaaaatcgtcgactttcaagcggtgtgccgtatggttcgagcacgctcaaaacattgtgtcgtcgttgttgataatacgttcatgacaccgtacttgcaacgcccgttggaacttggcgccgatgttgcggtgcaatcgctcaccaaatacatcaacggacacgccgatgtgctgatgggcaccgtagttaccaacaaggagcagcttgatcagcacatatacgcccagcaaatttatgctggcgccgttccgtccgcctttgatgcctttttggtgcttcatggcatcaaaacgctcccattgcgaatgcgccagcacgtggaaaatgcgctggcaattggacgatggcttgagaaggacccgcgtgtggaaaa

SEQ ID NO: 86727 - DNA, 631 bp, Heterodera glycines
  SCN-specific regions: Sequence locations=1-631
cgctgaaattatcagttatctgtcgccctctgatctcgctttgtctgctgccggtgtctctcgcctttggagaagtttgtccgaggataaactgctttgggcaggaaaatgtcgtcaacattcgataaatgaaatgtttcctccgaacatttgtcgcaaggaaaattgggcgagaagtgacacagggggcgaaagcagctccgaattagccaacatttataatgacagttcgcgtgcgaagtctgtcgcttttcctcccccaaatccatctccaatgcccttgtgtctccaccgctctcgatggaaggccgtttttctgaggagtcttcgtgtgtcaaacaattggaagctgagaagaccgactgctgtctgtcaattgaggggacatgacgaacatgtgatcacgtgtctgaagctgcgaggtgacctcattgtcactgggtctgacgactgcactttgcgcgtttggtctgctgcgacgggaacgtgtgtccacgtccttaacggacacattggcggtgtttgggcacttcagctctcacaggatggcaaaattgctgtcagtggttccacggataggacagttcgcgtatgggacactgaaaagggaactctgattcattgtcttaac

SEQ ID NO: 86728 - DNA, 240 bp, Heterodera glycines
  SCN-specific regions: Sequence locations=1-240
gtgcaaacagtgcactttgccatgtttgctgtgggagagggaaagccacgcgacgaaacgggcgattgacggagtgttgcgcgaggccgagcaaatggggattgcccttgaccctttggagtgaattccttttgctgatgcattggcttttgccttttctgcctgatcaaaccggctgttttctgtttgagtgttccttttgcccatctccccccccacgatgactcgcattttatccat

SEQ ID NO: 86729 - DNA, 485 bp, Heterodera glycines
  SCN-specific regions: Sequence locations=1-3,25-31,54-458
caatcgcaggggctgtccagtcgattgcggattcggtaacaaaggcaaagtttgtcggaactacgaaattgggcatcgatgaatgtgtgctcttccagattctacagtcccttcgttctttggtcctttcgcccggcgggcgccacctaaccaatgaaacattatgcgaaattttgcagtgctgttttcgcattggtctcgagtcttcactacccgaactgcttcgaatggccgcggagaacgctttggcggaaatgtgccgttatctcttcgcctccatccaaacgtttgagcaggacatccgacccgggctcaaagaattgatgaagtaatttagacagacacaaaagaattaattgatttgttcttttcgtacattattcccaaggttttttaaaatcagcataacggctttggaattcaaaaatttcttgcatgaggaataaagggtcagtgccaaaaaaaaaaaaaaaaaaaaaaaaaaa

SEQ ID NO: 86730 - DNA, 656 bp, Heterodera glycines
  SCN-specific regions: Sequence locations=1-599,629-656
gcacttcttcgccagacattccgcttatttttcagtcagttgaccgcgatcggtccggtcaaatcagtgccgatgagcttcaacaggcgctgtccaatggcacatggaagccgttcaacccggagacgtgccgaatgatgatttcaatgttcgactcaaacaacgatgggggcatcaattttcaggaattcggcgcactttgggagtacatcaacgattggacgcgcacttttcgcactttcgaccgcgacaacagcggaaacatcgaccgcgacgaattggtcaatgcgttgacacaattcggttatcgtctgtccggcactttttacgatatgttaatgcgcaaatttgaccgaactcaaagcggtcgcataaacttcgacgacttcatccaactttgcgttgtgctccaaacactgactaccgcttttcgagaaaaggacaccgaccgggacggatggattcgaatttattatgaggaattcctcgccatggttttctcgctgaagatgtcaatgatggctaaacaatgagcaaaagaagggggaattattgactgatgaggatttgctaatacagtaacccacttatttttgtatgttttctgttaaacattatttacatatcactttcaattttacgacatttttgtttga

SEQ ID NO: 86731 - DNA, 561 bp, Heterodera glycines
  SCN-specific regions: Sequence locations=1-140,162-256,279-438,461 -476,505-561
ctaatccttctgattgtgcttttggccgtcgtctcattccgtctctcggcttctactggtgacaaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagagaaaatgagggcacacctacgcgaacttgctgagaaaatgccggtcaatgaatcgaagcgtctgtcaccgagtggacccgaccctcatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaaccccta

SEQ ID NO: 86732 - DNA, 587 bp, Heterodera glycines
  misc_feature (586)..(586): n is a, c, g, or t
  SCN-specific regions: Sequence locations=1-436,458-519,541-587
acgtgtgcgaatttggtgagaaagccgttgaaagcggaggagggcggacaaggcgaagagatgagctacgacatcgaaatgcgcatcatggccaccgccggtttggttggcattccaaatgtgggcaagtccacacttttgcgtgcgatttcgagggcaaagcctaaagttgccgcttatccgttcacaactctcagcccaagcgttggaatggttcagtacggcgacttcttccaattggcagttgccgacattcccggattggtgcaaggcgcacatcgcaacgagggactcggcttcagtttcctccggcacattgtgcgctgcgaatcatgaaatgactttgtacgacgacgaactaagcaaaaaagaagcggcgattgtcataaacaaaacggacttattggacggagaaatggttaagtcagcgatcgtttcgatgtttccggagcaaagtgtgtttttcgtttcgggaaggcatcgtttgggaatcgaaccactgctaatgtttttgcgggaaaaacacgagcggttcttgaaagagagagaagcgaaaatggagatagagagagagcagttgatgatng

SEQ ID NO: 86733 - DNA, 517 bp, Heterodera glycines
  SCN-specific regions: Sequence locations=1-334,356-517
acaagtgtcccctccttcccctacactttgtcttcttcgtccgtcccttctcttctgaattgccattttgcggtgctcagttggcggatgtccaagctctccaaacccattggctgcagcagcacgtggcgcagttggcccgtccgcacgtttgcgtcgactgcgacgccggcttcaccaccgcggaagcgttgcgtgcccacagggaaatgcaacacgcggaaaaaacggcgcggaaggaacagcgaatttcgagcagaaacgaagtgaaatgaggccaaagattagtacaaaataatatttattgaacttctgtgaaagttgccgccaaatcgaattttaattttcattttttgtactgagttcggccaaaaaacgtgtaattcccccccccccctccgctcacatttatcattttccaccgcactttttattttattttatttgtcccccctttcactgaatgccattccttccttttccttttcctccctttttttcccatttttcgcacttc

SEQ ID NO: 86734 - DNA, 434 bp, Heterodera glycines
  SCN-specific regions: Sequence locations=1-144,167-193,217-434
tggactctctatttattggtacacatctcgttttttgaaacggtgtgtgtatgtgacattcgtggtgagtcgaagtgataaataggcaaatgtctggtgatcagaaggggacccacgcgtttgggcgctggcatttgtggcgccaaaaaatataaaaattaaaatacttgagcagtgaaccctctcggagtggtaaatccattttaaaatgaattttgggccaagtttttttcaggtcggtgtcatcagtgcgttcaatttccctgccgccgtttacggttggaatgccgcgttggctctcgtctgtggcaattccgtgctttggaagccgtctcccagcactccgttgacgtccattgccatcactcgactcgttggcgaagtgttgtccaaaaacggactgtcgcccgacatttgctcattgatttgtggcg

SEQ ID NO: 86735 - DNA, 103 bp, Heterodera glycines
  misc_feature (40)..(40): n is a, c, g, or t
  misc_feature (43)..(43): n is a, c, g, or t
  misc_feature (71)..(71): n is a, c, g, or t
  SCN-specific regions: Sequence locations=1-103
aggtgctgtcccctgtcaattggcgaatgccgatcaaggnagncatcggaaggatgaaatgtccccgcatnggaagagcaaccggacgaaattagacaacagg

SEQ ID NO: 86736 - DNA, 588 bp, Heterodera glycines
  SCN-specific regions: Sequence locations=1-342,364-409,442-588
ccatttgctatttttattgaacgatggaagaaggacaatggaaaccggagaaaatgctgcagttaaactcgtggatcaaaagaagtcggctaaaaagaaagtttatgtgccgggaattagccgaattttgaaggcgagcgaagaattggtatacgatgagaaggcgtatttgttgtttcacacattcgaaacgaactatccgtgtttaagttttgatgttttgtccgactctttgggcgacaatcgctccgattttccaatgaccgcttggcttgctgctggctgaccgagcaaaggacaacgaattgctggtgcttagactgtcgaatttgcacgcaaatgaaaagacattggaaaatgcaaagaaaatggcccaaggaaagggcgacgagtcggagagcagcagcagcgaagacgacgaggaggaggaggagacggagggcggcacaaagagtgcgcggatgcacgcggcagtgatccctcaccacgggggcatcaatcggatgaagtgccaaacaattggggctagcaatgtgtgcgccgtgtggaatgaccagcagaaagtgcagttgtggaacttggacccgg

SEQ ID NO: 86737 - DNA, 715 bp, Heterodera glycines
  SCN-specific regions: Sequence locations=1-67,109-151,184-202,224 -245,337-366,503-503,538-538,568-577,647-648,709-715
ttttgcttattcactttctttctcccgctaattcgtggacaaaatgtgcgacgaagaagttgcggctctcgtggtggacaacggctccggcatgtgcaaggctggtttcgcgggcgatgacgcgccccgtgcggtgttcccgtcaattgtgggtcgtccccgtcaccagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcacccgaggagcatccggtgttgctcacagaggctccgctgaacccgaaggctaacagagagaagatgacccaaattatgttcgagacgttcaacacgccggccatgtacgtggccattcaggccgtgctgtcgctgtacgcctctggccgtaccaccggtatcgtgttggactccggcgacggtgtcacccacaccgtgccaatctacgagggttacgcgctgccccatgctattctccgcttggacttggccggccgtgacctcactgactacctgatgaagatcctcactgagcgtggttactccttcacgaccaccgccgagcgtgagattgtccgtgacatcaaggagaagctgtgctacgtggccctcgacttc

SEQ ID NO: 86738 - DNA, 583 bp, Heterodera glycines
  SCN-specific regions: Sequence locations=1-62,84-583
cagcaacatcgcacaaaaatggcacgccgacgaagaaagaaggagccgcgaaagcagtcgtacaagctgtacgttcgacgtgtgctgaaggaagttcatccgggcaaggaaatctcaatgcgtgcgttgaacatcatgaactccttcgtcatcgacgccttggaccgcattgcaacggaggcgacgcgaatggcccacaacgaccggcgcaaaaccatcacgcttcgcgacatggagttttctgtccgactgtgcctgcctgacgtcatggccaaagatgcgaaccagaaggctcagaaaacggtgaccaagttctatgctgcaaaagtgcgggatcggatgagaaggacggagatgcgtcgtggcgaatttgcgatgatgcagatggcagcgctgtgagcacactcaacttttggacgaccggcggatgaagccacctgtatattgttgatgattggccccgtatcccccattactgtatgtgtatgtattatacaatgtatctaccattcttgtgtgtgtatgtattattcactatgtgctttatatgtatacctggtcaataaaatataaccccaaaaaa

SEQ ID NO: 86739 - DNA, 196 bp, Heterodera glycines
  SCN-specific regions: Sequence locations=1-196
tgttatcagctgctcgtgcaacttctgctgctaatatcggtttcgcaatcggtgattttcaaattcacgtgcagccagaaatgcccgagattattaactttgtcgttccggagctcattccgctcttaaaacacacaatgaaatcgctgaatagaatttttgtctttttcgaagaacttttgtcatgccgatttcc

SEQ ID NO: 86740 - DNA, 821 bp, Heterodera glycines
  SCN-specific regions: Sequence locations=1-821
ctcctggcttttttgattggcccttccattggcgcctttttctcgatcggtgcccgcggaaagtggcgagttcgacccgtccccggctctactggcaattgcactcacactggcagaattggcacttttggtgttctttttgccggagacattggccaaggcaaagaatgacgattgccataaacaaagtgggcatagccttcggcatttgttgtcccctcgggcgctgttttccttcgacttcttgtctccggcatcggcttcctccccgccggtttcggtgccattgctccaaaagtattcccgcgtctactttctgttcatgctgctgttctccgccatggaatttactctcggctttctcacccatttgcgcttcaattacagctcaatgcaacagggccggctttacctgttctccggcttttgtatgctggtcattcagggattcgttgtgcgacgcattccgtcaacactcaaagcacaaagtcacggagcgctagttggactggtctcaattgtgccagcttattttgtcatcgcttttgcacattgccaaaatggcattgaacagcccttttcatgggacttcttctgttctcagtcgcatcagccactgttgtgccctttctgactacgctattttccaatcagtgtgatcagtcggcgaagggtgcttgtcttggcactttccgttcagttggtgcattggccagagcttgtggcccattagttggagcacttttattttggttgttggggccaactctgagctattgccttggtgccatcggactcattgcgccgggcatcattttcta

SEQ ID NO: 86741 - DNA, 484 bp, Heterodera glycines
  SCN-specific regions: Sequence locations=1-66,88-484
tatttcttttgccgcccatttacttaatctcccaatttttcattttttcatggccctctctgcccttctgcttcttctccccctgcttctcaatgttcaaaatatcccagatgagtcagtccaatcggatatgaaggctgtttattcggctatttcatcgccggaacaatggaagaactcacaaaattcattggcttcactcgaatcacaactgacagagccccaaagagcactggcaaaaatgcattgggaattggagaccatccaaaaggaaaagccggaggcaccgccacaattcgacttgggacttttctcggaagctttggaagtgatggtcgaaatggacgaagaagcgaaagaagtgaagctgaggaaggacaaactgattgaatgggcaggaggagaggaagcaaaaaaaaattgaaggaaaagatgacggaggaggacacagtgccggaagtgagggtgaacgagaatggtaagg

SEQ ID NO: 86742 - DNA, 540 bp, Heterodera glycines
  SCN-specific regions: Sequence locations=1-331,368-417,439-540
aatggagggaacgacgtcgccgccttattttttgcgtagtcggacgaggaaggaaggaccggccgtgctggaactcattgagaagcttcaacaagccaacgacaaagttgaccaacaaatcgcagaggaacaccaattgcgaaatgaagtccttcagatggcaccgcgcgcgatgaagaaatacctcggcacacgctttgaacgactgatgaatgccaaattggaattcccccaaatggcggacagtgaacgcaaatccgaggccgagttggccaaggcgaaagaagaacttcgccagttgaaactccaagcagtcaaagaggcggaggaacagaaaagggagttggaggaggcgcagcgaatggagagggaattgaaagagcgagtgaatcggaaattggccaagctgagggcattggaagaaatgtgatggcaaatgtcagtcgttcttcagtttgtgcgggttttctctgttgtgttagtcatgtaattatttgaccgtatgtttaacaataaataggatttatttgcaaaaaaaga

SEQ ID NO: 86743 - DNA, 272 bp, Heterodera glycines
  misc_feature (17)..(17): n is a, c, g, or t
  misc_feature (25)..(26): n is a, c, g, or t
  misc_feature (46)..(48): n is a, c, g, or t
  misc_feature (74)..(74): n is a, c, g, or t
  misc_feature (90)..(91): n is a, c, g, or t
  misc_feature (100)..(101): n is a, c, g, or t
  misc_feature (145)..(146): n is a, c, g, or t
  misc_feature (172)..(172): n is a, c, g, or t
  misc_feature (180)..(180): n is a, c, g, or t
  misc_feature (188)..(188): n is a, c, g, or t
  misc_feature (206)..(206): n is a, c, g, or t
  misc_feature (241)..(241): n is a, c, g, or t
  misc_feature (266)..(266): n is a, c, g, or t
  SCN-specific regions: Sequence locations=1-272
gtgggcatcggcacaanttccaacnnccgagaatctcatcgcattnnntggaagggtacttcgcgcaacatcgnactgggggaaccagcnntgatgtctnnttgccggccccgactattggcacgaagggacgcgaagggaagtnngcgcaaatttctcgagggaacaggtntggcaccngatttgcncggaacaaattctgtccngagttggaactagcaagaaaagcgtatcatggcantctatgagggatggacagttgatgngagatg

SEQ ID NO: 86744 - DNA, 717 bp, Heterodera glycines
  SCN-specific regions: Sequence locations=1-717
tcaagtgtcacaacaattggcgggagaagctgcgctcgttgcaggaatacggcgacttcaagcagttcctccgcttgtgccatttggagcccggctacggctacgaattgttggcgccggtgcactccgatttcccggccgagggcagcatttgtgagttgcaagttgggcgcagacagctcgtgctcatctatccggacgacgaggggtgcactgtccgcttcgcattgccttccaaacggatccgtgtgtggcgcgtttcccattccgaacaccaactgttggcccagatgagcttccaattggagtatttgcgacagccggacgagttcgggctgatcactctgcgcactgatcagtccgtccttttgtcgctgttcctccaatcaattgctgacgaaatcttgcaggatcaacaatataaaactgaatctccgttcaaatttgttgacgacgccatttcgctgaaagcagcgtccgacgggtcgtccgcggtggcaagcagttcaattgttgctggagtcggcgatgaccaaaagagtgtgaagtcctgctccaacaactcgtcctcatccaaccatgccaacagtagcagctgcgcactggacgcattggtgaacggcgccggtggcgatggcactgaatatcgcattaaactgatttcgtaccaaatgccatttttggaccatgaaaattttgaggatgtgttggacgcgg

SEQ ID NO: 86745 - DNA, 728 bp, Heterodera glycines
  SCN-specific regions: Sequence locations=1-728
actggctggtgctttgtgtcccaccggtttgaactgcccaacagtttgcggaacgtttgggtcgcatgggcaacgaaaagggcattccgattgcggagccggagattgtggctttcaacagcccggataactcggaccgagaatggatgacgatgttcgagcgatgcgtcaacaagcacatccaattcatcatgctggtggatgaaaagcgcaaggacacccacggactgctcaagctgtcggaggcaatgcacaaagtcaccacgcagcatgtgacgctggagaaagcgaatgacgttgtgcggaagaaccagcgccaaacgctggagaacatcctgaacaagctgaacatgaagaactttggcctcaactacgtgccggtgatggagccgtcggcgtgccgtcgcttttcgctcgaaaacggaaatgtgcttgtgatcggctacgatgtcaaccatcctgctcccatgccgcaacagacccgtcgtttgttggcatcgcagggcgaatcgcaattgagctcgcttgacccgtcatgtgtcgggatttgtgccaacatggctcctgattttaatgcctttgttggggattatttcttccaggaatcgcgccgagaagccattgaccaaatgcagttggttgatcgcatgaagtggattttgcaaaatgtggaaaagcatcgtcctggcaaaagtcgtcccgagtacatcttcatcttccgagacggt

SEQ ID NO: 86746 - DNA, 766 bp, Heterodera glycines
  misc_feature (134)..(134): n is a, c, g, or t
  SCN-specific regions: Sequence locations=1-462,486-487,509-726
gtaaaattctctcgtaaatacaattcgtgcagtgcccccggtaccgtttcgtttggcatggagccgcttcaccagcagagtttccagcgaaagttctcaatttcggcctgccgacgacagtcgtcaattgattntggaggacaatcactttctgttgacaattgtgataagcaacgcgacgaaccacgagagcatttcgtacaaacaggacggaggacgattcgactcgtcacagttcacgctgaagttccacgcgaacactttgtacaaaatttacgtgaagacgaagccggcacagcagtttttaagtttgaacatcgccgggaacgtgctcagtttggctccgattgagggcggcagcggagaatacgtggccatttggaacaccgctgacaaagagccgaccaaaaaagggacacggcaggacattgaatttgtgctttcggccaaggacaaaacattgagcaaaaatttgcaagtcaaattttacccccacaacgacacacacgcgggatggggacagaagttggaccaaatcacttggcgctgctccaccaacgacattggccatgtgtttgtgttggaagagcaagccctttaaagcgaaagacgacaattgcattttaaaaagcgatgggcggagatcaaacggtgacggccaaaattaattttcaattcccatttcaatgcattcattcatttctattttctttaatattttgcaacaaaaagttcaattagcaaaattgtttgcccattccttttt

SEQ ID NO: 86747 - DNA, 485 bp, Heterodera glycines
  SCN-specific regions: Sequence locations=42-133,161-485
ggggggggggggggatgcgtgggggtggggaggggggtgggattttcctttctgtaattgttagattatccaaaaaagggggtttccaaatgcttttttccccgaacagtgttctgctattgcttctgatcgtcctccctttctctctttctttcattttaatccctcaaaatgtccgccaaatttcccccgccctttcgtcgcgtcccttccgccgatttggccatttttctgtcattgccaaacgaaacccaattgttctcatccccggcgacgggggaagtcggctaaaggcgaatttgacgggcaaaccgtcggtggtccattacttttgccagcgacagaccaacgatttcttcgcgctttggctcgatttgcaacaatttggcccttttgtcatcgattgttgggccgacaatatgcgcctcaacttcaacagaacgagcggaagggcgcaggatttggagggagtgaaagtgcgagtg

SEQ ID NO: 86748 - DNA, 572 bp, Heterodera glycines
  SCN-specific regions: Sequence locations=1-203,225-541,563-572
tccccttcctttatctgcacaaataacaatttgttcgccgttaattctgtgaatccgaacgcacattcgcagcaaatggccatggaaacattgggaggcggcgaagaacggaacaaaatggagactgaaatggacgtgtcagttggagaagaatcgcctcatcagcaacggtttctggaagaatgtctgaatttgagtcagaaatttctgaaggagatgagtaaagacgaagagcagcaacagaatgtaataaatggcgaggcgaatgatggcaaatcggacgtggcaaaagagttgctgatttgccattcttcctctcccactgcatcgcctcaaccgagcggatgtttcttaacgtccgccaatgtcgtagcggaatcggacggaatccttcgggaacagaacagaagcggagaagcggacggacaaagcaccgccgcaacgacaccgaacgcatcgcgaaggccgagcaattcatccgctgccgcggtcagtggaagcgttgaagacgaattggccaaaatcaaagtggtcttacgacagcacgagaggaggatccgattgcttgagga

SEQ ID NO: 86749 - DNA, 648 bp, Heterodera glycines
  SCN-specific regions: Sequence locations=1-648
aaaatcggcaaacgttttggggtgggcaaaggaacaattggcaaactgaaatttgtggaatgtgccgaagagattgccgaagaccaatggcacggtctgatcattgccaagcaccaagacggagtgatcagctacgaatcgagccatggattcgacgacatttttggcacagaacaaataaaagaaacggaaaaatatttggaaattaatttgtccaaaaatgctgaaccacttggaaatgaacttcaagaagcgctttcttctgcagcattttttgacgattttatgccatttgttttggcatttgaatttggcgccacattttgcgcagaaaacggcggtaccaccaaattgtgcaaagagaaatgcctttcccaatcattggtcgccccaaaaacaaaggcaccgtttgttggcccaaccaaattccatcggacaacgccacgcgcagtgccaaaaaccacttttggcattgtgccaaaaactgaagaaacctttggctttgtgccatttgcacgaaatgtggaccattttggcacaaattgtacgaacattttcttcccggcggaagtggacaaattcttgctgaatatcaccgcgaggccatacgaaattgcatgcaatgactatgaaaaacgtgccaaaatt

SEQ ID NO: 86750 - DNA, 639 bp, Heterodera glycines
  SCN-specific regions: Sequence locations=1-64,86-639
ttactcgaaccggcgccgtcgtcagtcgattatttcttttggcaatcggacgaagcgtcgtcatcttctgtttgtgcagaagaaagacgacagatgtatgaacaatacggcggacaaaagcaaatgagacggaccgaaaatgacaaaaacacggaacaatgccaacggaacgcccagcggaacatcggcgaaagaatgccaacgatggacgacaacaacgaccaacagccgtcgatgctgcgaagaatgcctttgcaatcgatggaaaacgcatcgctactgaagtcgtccgaattttcctcttccgaacatttttctgcttgcaaaaaagaacccatcgaacagagcgaagtcattgcgccaaagaatcggttgggtccaccagcgcattggcgagtggaagaaacggagaagagacagaaacggagtgcgaaaagggcaccacttcccagacaaacgacctaccaaatcgacgagcacggcagacaggtggtcgttgtgaggaacgatgattcatatcggtcaaatgacgaagacgacgagcggacggaaaacgcagagcgcggagtgccacccatcgcgcgcaacggatttgtgaagccggcgtattcctactcgtgtcttatcggactttcgctg

SEQ ID NO: 86751 - DNA, 690 bp, Heterodera glycines
  misc_feature (657)..(657): n is a, c, g, or t
  SCN-specific regions: Sequence locations=1-112,139-406,428-444,466 -478,504-690
tattggtatggatcttgcggcagcgaattcttaaagagggaaaattgacttggacttcaaaaatccaaacaccgataaagcgcagtggttgaccggagaacagctcgccgatatgtacaagtccttcatcaacgactatcccgttgtgtccattgaagatgccttcgaccaagacgactgggaaaattggagcaagttgcaggctgccataggcattcaacttgtcggcgacgatttgacagtcaccaacccgaaacggattcagaaggcggtgcagaaaaaggcatgcaactgcttgttgcttaaggtcaaccaaattggcacggtcactgagtcaatcgaagcttcaaaactggcacgaaaaagcggatggggagttatggtttctcaccgttctggcgaaacggaagacaccttcattgctgatttggttgttggactcgccactggacaaatcaagactggcgcgccgtgccgttctgagcgtttggccaaatacaatcgtattatgcgcattgaggaggaattgggcactgacgctgtctacgccgggaaaagtttccgtagcccgcaaaactaagagcgtgtggaaacgaagaaaaataggactgttcgttgactattcgctggatgtttagtttcctgacattgattatntgttttcgaaaatcacttgaatgctatgagtat

SEQ ID NO: 86752 - DNA, 364 bp, Heterodera glycines
  misc_feature (325)..(325): n is a, c, g, or t
  SCN-specific regions: Sequence locations=1-120,142-182,204-364
catgtcttctctgctgctctcatcttccaattgtgtttttggtctgttgcaatgcaatgccaaatttcccgtgctgcccgggcagtcagcaagtggttgctgtgatgtccaaatacattgacactttctcttctgctgctgacgagtctacagtatgctcaaccgctaaaagtactgtggatggaataaaaaatgaactgtcctatcgcgtgggatgcccaagcggaggagaagcacaaattgtgaatgaaattgatcaacagctgaagaacattgcgaaaatggaaatcaattatgaggacgagtgcccgtacaatttgggctntgcccgtgccatgttcgacttggccgctgctgctgctgg

SEQ ID NO: 86753 - DNA, 658 bp, Heterodera glycines
  SCN-specific regions: Sequence locations=1-375,397-558,599-658
caccggcggtgggcggacattcgcgtgagttctccgaaaaaaagaattaaaacaagctaaaagggaatattaatggttttcgagtttatttgcataatcactgcttcaagttgcttcttccctgcccccttcgattctctctcttctcatgcaaaattcgctggccgatgtcgctggctctgctccccaaaatgtccaagtcggaagtgccgttccttcccttcctctgacggctaattcgtttgccaattttcccactaccacacacaatcagcagcagcaaagaatggtgcccgctcctcctcaaaatcactcgtcatcgtcaacaaatgcgacgaatcagcaacatccctcacaacagcaccaaatgcatctccaacagcaacaagttcaaaatgctgtcgcccaattgttgcgccaacaatttcccaccagcgcgcctggaattatgggaatgaacgctcttttgaacgcggccggaataagcggcggacaagcttttcctaacattggcacttttcctgtacatcagcaccaatttgacttacaatctctcgccgcggctgctcagccacatcatcaccaacagcagcagcagttgtcctccgctttgaacttgcaggcgttggttggggctggagcagtgcaccaaccgccg

SEQ ID NO: 86754 - DNA, 653 bp, Heterodera glycines
  SCN-specific regions: Sequence locations=1-199,221-492,514-600,622-653
gatcgagtgtggccgatggatgtacgactggtccatttcgcctgctaataacttcgtaagccaacaatgggcgcctatttggtggttggggttacaatgacgaagaaattggaaagcacaaaggccccccggttttcaacgagaaagaacggtaccgaatggtccgcggcatcaaatgggtcgacgaaattgtggaagcagctccatatgtgaccaccttgaaaactttggatgagaataattgtgacttttgtgtgcatggcgatgacataactttgaccgccgatggaaaggacacttatgccgaagtgaaggaagcagggcgttacagagaatgcagccgaaccccgggggtttcaacaacggatttggtgggtcggatgcttctcctcacgaaaacgcatcacaaaagcaacgaacgcgagttggacgacgtggagcgtgaccatgcacgtaaattgagcacggaccaagaggcccgctccccttggacatgcatttcacgttttctgccttcaactcagacaattatgcaattttctgagggccgagctccaacccccgaagatcgaattgtttacgtctgtggctcttttgaccttttccacattggccacctttgcttcttggaagaagctcgtcgtcttggcgat

SEQ ID NO: 86755 - DNA, 162 bp, Heterodera glycines
  misc_feature (13)..(20): n is a, c, g, or t
  misc_feature (23)..(24): n is a, c, g, or t
  SCN-specific regions: Sequence locations=1-33,55-120,150-162
ttttttttttttnnnnnnnntcnntttttcttcccccgtcttttgtttttaaaaaccgcggttttggttctgaaacgaacgccacccttgtacttacttgctactctatatcactctaacgagactgccggtgacaaaccggaggaaggcggggatgacgtt

SEQ ID NO: 86756 - DNA, 547 bp, Heterodera glycines
  SCN-specific regions: Sequence locations=1-79,101-175,200-547
ttactcgttggacacgcgtggtgctggtgggctttccccgccctgggctggcgtcggaatggattttggcccatatctgaaattgaccgccatgctcatcgtcctgtctacttttgggctcggcttatcattggcccacatgaaaaaaatgctgcaaatcggcaaagaattggccaaacaaaacgaaacgacaaaaacagcgtcggccacttttgttggacaggacaatttgcgaacacttcgggcattcaccgggtgtcaggccggcctttccgtactttccatttatgtggccgcctcattagcatttatgaaattttggtatgtgcgtactcatctcgtccaggagttctcctgctctttgatggccattactttggccgttgtccaattttttgtgcttcgaatggccaatggcggcggattacttctgatcaaaggaattgttttggccaatgcgtgccaaattgtccaggaattgaacatgtctctgtccgccttttacacctttttttacgcgggtcggatttacgacgcggttgaggag

SEQ ID NO: 86757 - DNA, 405 bp, Heterodera glycines
  SCN-specific regions: Sequence locations=1-101,124-172,199-325,347-384
cgcccgcacctgaagaggcgcccccggcggaaggcgcgccggcggaggcgtctgatgtgccctcggcttaagcaaaaagggaaaagccgaacgcaccgatggaaagggagaaaaagaagaaaagcggcggagaggagacaaatgctttaccttttccttgctcaattgtgtacaaatccctccccttttccccatttcgctattccccgactctccaatttcttttggctgttagcttttgctttccgagtgatccttccgatgaattcgccgtgccttttcttccgtcaatgactcatccccaaaaggcaattaattcattaatttttcttctcccttaaatatatttgtgccaattgaggagtttaataaatgttgtggtgcaaaaaaaaaaaaaaaaaaaaa

SEQ ID NO: 86758 - DNA, 672 bp, Heterodera glycines
  SCN-specific regions: Sequence locations=1-83,119-208,230-672
taaagtttgagttcctattttgcattggcttaaatcattccacatgggtattttgcgcaaccgttcgatcaatagaattccaattcgaattgaagaatgtgctgagaatgaaaatggatttgccgatgattatgcaaactatctcttcgattccgaccaatccgacagcgacaatgccgaagaggaaaacgaagtgtcggtccaaattcaaagccaacccatcggaggccaccgacgcaaaaagacgaaaagctatcggccgattgaaattgtggacggatttccgttgaagcgaaacatgggggcgcagaagtggcgtcgtgtggaaaacactaggcttttgacgagttttgccgacactcaggacatttgctttgatggttccgatttaatccccgagacgatttctgcgttctcacgccttttgcgagatgaggcaaaaatgaaggtttggaatgacttcctggagaaagacgaatcaggacagaaaaagaggcttttgcaattcgaatacgaaattctcatggcacgcgacgcttcgaaggcgcagcattcgcaacaatcggtcaaaaatacggacatcaaaaagtcggagagtcagccgcacaataaaaatggtcagccttcgtcgggtggtggcaaatcgtcgtccgattgttttcagcgactcga

SEQ ID NO: 86759 - DNA, 558 bp, Heterodera glycines
  SCN-specific regions: Sequence locations=1-143,165-380,402-558
tattgaatgttttgcttctttactcactttgtttctgcttagccatttttctcgcgatgactcatcggcaagagttgagctgaaagtgacgtcttcaaacggaatgcctttgtaatggaggataagacggatctgcgcatttggatgaacaaatatggaaatgtgttcgaatttgctcttacgggttccgcaattcctctcgacgaaaaataagcaacatccaccagtccatctgccttggagacaagacaaaaagccgaagttgaagtaaatgaatatttgcgggatccaaaaattaaatccagggccgatccatcattatactgggaagtcaattcacaaaaatggccaatgattggtgacgttgtacggaaatttctttctccacctgcaacaagttcagaaagtgagaggcttttctcaacggccggtctaatttcagatgacttgcgaaagagtttattaccagaaaatcttgcaaaacttttgtttcttcatcacaatttgcttttaaccggtttctcaattgaatgattttgcttttacaaatttgctttc

SEQ ID NO: 86760 - DNA, 402 bp, Heterodera glycines
  SCN-specific regions: Sequence locations=1-371
ttacagcaaagatcacggcgcaggaagttgtcaggattccccacgtgtgagaaacattttatttggcttgaaaattgtggtgttaaagaaaaatgcaattcttaggccgcgatttctggctatttttaattattccgcttttatgtgctctcattgcacaatattaaattcctaattgtaagtccgactacgaatatctgagaactctcctctctctgcgatttctttttatttgacattttgacccttactcattttggtctaatgttaaaatactgtgcttctttctgtttcagcttcttaagcaatttgtggtctggtgatgaatgaatgatttgtctatttaatcaacagaataaatgtttttgacgaaaaaaaaaaaaaaaaaaaaaaaaaaaaaaa

SEQ ID NO: 86761 - DNA, 288 bp, Heterodera glycines
  SCN-specific regions: Sequence locations=1-288
cctccggttggtctttatcgcggctattctctgtcttcttggatctctagttgaacgcgactattccagaagttgcgtttcgccgaaaagggcgggcgtctggcctgggccttcatgggagccatcgccaccggagcgaccatctggtgcacccatttcgtggccatgatcgcctatcagccgggcgtggacgtcacctatgaacccggtctgaccggcgtgtccctaggcatcgccatctgcggaagcgccctggccctgtggttcggttcgcgccagatgcggttc

SEQ ID NO: 86762 - DNA, 648 bp, Heterodera glycines
  SCN-specific regions: Sequence locations=1-648
cattttctgacattttttgtttctttttggctccatcagtgacaaatgccatgcaaagttccgttagctcgaatgagatgatatttggtggaaattcgaccgtttgttctgaggagtctcatgctatgtctgaaaaggtgcagacaattgcttcttccatttacagagaattttaaactatgatacaaaaacatggacaggaaagcataaaagatttgatgtcgctagttgtaaatgttttggagagcttagacacggcataccaagaaaaggatgaactgattgtcgacctcgaaatgcttaaggatgaaaatggacagttgctgaaccaatacgaaagggaaaggcaaatgcgcaagaaccaagaccagaaaagtttggaaagggaggaattcatgtcggagacaatccgcgaattggagagcaaagtgcagagtatggccagcattgtcagaatgctcgaattgaaggccaaaaatgccaacgatcatgcaatgcgactggaggaaagggaggccgatcagaaaattgaatatgaaaagctgcacgaacgttacaacgaattgttgcggacacatattgagcatgtcgagcggaccaaattcctgatgggttccgaaatgttcgacatggcccaatcccttccga

SEQ ID NO: 86763 - DNA, 381 bp, Heterodera glycines
  SCN-specific regions: Sequence locations=1-219,241-360
ggcgccgcaagggacaacgaaatggaagacgaagaattgaaagtgaaagccgtggtggaagagacgacgacaaatgaacagggcaaaactgagacaaacgtcgaacagagcgaaaaggaggggccgatgaactgaccgaaagggaccgactgatcggcaggaacgtcatccctgacggggatttgtcacggagaatagaaacaaaaaaagccacttgcatttgcgttgttttattttgttgctacagtaatcacatagttcacctttgtagatgctttactgtactcttttcatttttctctctttctgtccctctctttcttttctttccgcttttggcttataaattcctttttctccaaaaaaaaaaaaaaaaaaaaa

SEQ ID NO: 86764 - DNA, 651 bp, Heterodera glycines
  SCN-specific regions: Sequence locations=1-339,361-651
ttaggaggaattgccagggaatgagacacgaatacttgcagttaaggatgtggattatttgcagatttttgaagccgaaaaagatgatttggaaaaatggtttggaagaaatcgatggccttttttaactcaaattagcgcgacaaatattcggaaaatagctgagtcgacaggaaaactgttggtgttgagctcaattgaaggaatggacagacacaacgccagcacggaatcggggagtttttttgccttgataaaacgaacagtggtcgaagcccgtgtggacgctgaaattgagcagcactttcagtttggctggttggacgggacccaaattgccagtggcgttgtgatggactctcttcttctgccgaatttggtcgtgctcaattactccagctacgaattttacctcagcaaagatcacccagcgcaaatgacggccaagtcgttgcttttgttccttcacagtgttcggctgggggaagtgacagtccacgggggccgcgcgtggatcacacggctgcgaaggatggcctacgaaatcaccagcaatgtgtacgacatgttccaacaccaacccattctcaccgtttgcctttttggagtgccattggcattcttctccatcatcacttactcaatctgttc

SEQ ID NO: 86765 - DNA, 548 bp, Heterodera glycines
  misc_feature (504)..(504): n is a, c, g, or t
  SCN-specific regions: Sequence locations=1-300,323-358,381-548
tccttaatgaggagaacgtgcgcctttttcgctacccttttctgaagaaccctttttgggatggacacttcgatgagaatgactccgaccgaatggcaggcaaagccctcgaatggctttcataccatttgaaattggcaaaaaatgacgaaacgaattacgacgagacactgaccagagtgatcagacttttggggttgagcatacagcggaaatggacggaagcgaagtcattggcggaagagatgtttatcacagttgctccatcggacaatgcgcggcaaatgatttattcctccatggaacaaatgcagcaatttttgaattttgacgaacagattgaagcggcggagaagcaaacggaaagagaaaaagacgaccaaaattcggaggaatcggagaaaatggcactgaaaaaattatttgagcaaaaaaagtgccgaatttgaaattaacaaagcaaaagcaaccgaaaaactttccgagatgttggcagtacgattngagccaattttgcagaaggaggaggaacgaatgatggaagtgta

SEQ ID NO: 86766 - DNA, 617 bp, Heterodera glycines
  SCN-specific regions: Sequence locations=1-87,127-617
tcgtccgattacacatttcctttccctccgttctgtcgtccaactgctgccactttcaattgcccttcacggcaatggctgatgacattcctcctcctcctgctgttgctgctgatggtggtgatgtcgtcgttgatttggagcaacatgttcgccaactcatcatgtccatcggccagggaagcgaggacgcagtgcacgagctttccattctgatcgagtcattcaaccaggagcagctcgtcgactttctggagattatggcaagaatgtacgtcgagagcggagtcagcgttgacatgccgggtggccaaggaatcaacatgttgatggtcgctgcgtcctctggaagggtggactttgcgcgctacttgctcgcccacggtgcaaccgttggacacttggacgccaccggaagcgtcttcccactaatgctagctgccgaatctggtgagttggaggtgtgccgtctgctggtcgaggaatgggcagctgaagtcaaccagcaagcaattgatggcacgacacctttgatgagcgcgagcagtgagggacgactggacgttgtgatttatctcatcgatcatggcgtcgaaatccaacatgcgaacgccgaa

SEQ ID NO: 86767 - DNA, 687 bp, Heterodera glycines
  SCN-specific regions: Sequence locations=1-88,114-252,275-687
aacgaacaaaacgaagtacaatcgacgactggtctgacacctgctgaagctgttcggcgttcgcagatctctgcattggtggaaccgaaacaaccacaacaacagcaacaagacatcaacaacggcgccggcgacgaacatggcggagtgcttcgcaggtcaatttcggtgctcagtgataattggtacgattgggttgaaggcaatcagacggacaaagctggtttaagcaatcaacaacaaaatgtcatcgtccatcagtcagtcaacagcaccatcgacgcggatgagcatggcatatctgatgaagccagcccggtcgcctcactgtccacaatcgaccttggccgtgtgtacaccactgttggcactgtgatggaatcgctgctggttaactttgcgcacctgtggcaatatcggttttttcgcgttgccttcgtccttctttccatctacttctgcctgggcttcttggaacggtgtgctgtagcgatgaccgccgcatgcgtccgctgggcttggccaccggtgcacttcatgctcggctcgtcacggggaacgctgttctatttgactgactggttcgcgtggatggacgacttcttgtcaagttgggtatgcgacatggccaacagatactgtcaccaatacgatgtgatgtgcgattgtcagtgctcctttgtcagc

SEQ ID NO: 86768 - DNA, 650 bp, Heterodera glycines
  SCN-specific regions: Sequence locations=1-461,484-488,512-650
aatgtcttccgttgcggacgaggaggacagtggcaccaacgcgggtgacgacggttggatggtggtgaagaaggagtcgttcaagaagttgtgcgacttctacgaggagcgtcgtcgcgtggagtgcggcggtggcaccgtcgccgctgacccattcgcggaacaattggagcgcgaatttcgcgaggcaacgatggctgacaacaacagcaacaaccgcaccgatgaacgcgtggatgagaaattgacggcggagagtgaaccgaaaaaggcagacgaattcgtgaaggaagttggacaagaaccggctgccgaggtttatgtggcacaaattgtggatttgaccaccgaaaaagatggaaagtcagaaaaatcggagaagaccattccctgtgtccattcggttgtgatgcgcggcgtatgtgccggatgtggacaggattttcgtcagccaaatgaatttatcgggaactcggctgccattttcaactttgaacaacagcagcaaaagatgaaccagaccgtgcccatttctggttccttcggtgttgatgaccaccagaaaactgcaaaaaacatctatccgtctttggaactattggaaaaagaaccacgcggagggacactgatggactgcgtggatggagagg

SEQ ID NO: 86769 - DNA, 305 bp, Heterodera glycines
  SCN-specific regions: Sequence locations=1-35,57-227,253-264
tccgttctttctttgccatgaatttcccctcgattttctccgttttgtctcttttgcttctttttgcggacttttcatggctcgccgtttcttctcccactgacccatcttatcgtacgaaggcacaaattgatcattcgggcaccaaaaaagtcgttaattctcgccactctcccgcgccggcgccgcacagccaacggaaggagaagcagggcaaaaaagagaaggccaaaagcagcagcagcagttcatcggcggaggaggaagaaaaaaaacacaaaaaaaaaaaaaaaaaaaaaaaaaaa

SEQ ID NO: 86770 - DNA, 461 bp, Heterodera glycines
  SCN-specific regions: Sequence locations=1-113,135-461
actcctctaaaaattaccatcctctcagaaatggcttcatctttctgctcctcaatcatttccatcgtcgcaattgtctgtttgctgtgcaaatgctgcttttcggcaccccatccatgctgtcctggcagccaacatgtcgtttcgatgatgaaagatcacaccggcacattctccgcttcgatgccaaagtcttcgctttgtatgagtgccgaaagagtcgccgctgcggtggaaaaccaactgaaaacaatttggtgccctggcaatggtagtcaaacactcatcaacgagatcaacgcaactcaatcatcatcagatgagtgtgctcgcagtctcggcttcgtccgtgccatgttcgaaattgccgcttccgccgcttcccatgccggtgccaacgccgatttggctgtccagttccgagaacaagttggcacaattgacagcaattgtgccgcgtt

SEQ ID NO: 86771 - DNA, 654 bp, Heterodera glycines
  SCN-specific regions: Sequence locations=1-185,208-654
actatttcgccggccattgtggtagtggtgccgaagaattttcgccagacgcgcagtgcgcacagcaatggaaaaagcccaatgagtcgctgtttgtggtccacaattggcccgccaagggcttggcccgcgtcaaattttggcaacgctttatcctcgctattgttccaccatttcggacgacatccccgatgagtggataatgcagttactccgtgaactgtgcgagcaccggacacgccaaaaattgtccaattacaacacatttgaggacgcagtggagttattcaggaagagcaagcgcattttggtgatcaccggtgccggtgtgtccgtcagctgtggcattcccgactttcgctccgagaatggggtttatgcacggctcaaaaaggactttcccgagttgccaacccccacggcgatgttcgacattgacttctttcggcagaatccgaggcccttctacaactttgccagggaaattttccccggccaatttcgaccctctctgtcgcacatgttcatcaagtttttggacgatgaaaagaaactgttgcgcaactatacacaaaacattgacacattggaacgcattgcgggaatttcaaatttggtggaatgtcatggctcatttgcgcgtgcaacatgttt

SEQ ID NO: 86772 - DNA, 567 bp, Heterodera glycines
  SCN-specific regions: Sequence locations=1-47,69-69,99-105,129-567
atccaccgttccgtccgatgctgagaatcggctgtcaattcgtttgtattttgccaaaattatggcaatttttacgaaaattttcaattttattaaaacgagtacagaaaaagaaaacaagcaaaaatatttgcttgtatttgttgaaatttggaacaaaatttgtccgcgtattcatgcagaactccaacagaatgacatttcatcgactgttggcatactgtacaacatttggcggggaattgcatcccgatacaatcaaattccgcttggaatttttcaaggttatgagccaattagggtattatcgtcagataatggcttactgttactggatgaaaaaggcacctacagttctaatgtgatccgtgctgaactttttgaggaccatgtggtgaatatgttgcgactgtatgagcaacagagcgaaggaaattcgttcggccttttgttgcgccgttgcaaattggatggcattgcgtataagcatttggacaaatttgcaaatggaaacgaattcgaaaaattacgagcgaaatatcccaagcttaaagaattgtttcgttt

SEQ ID NO: 86773 - DNA, 590 bp, Heterodera glycines
  SCN-specific regions: Sequence locations=1-236,258-590
acaactgaagaaattcccgtcacttacggatgcgtttaagaagaagaggggcaacatactcaatttcgaggaagaggaatttgacgagatcatcagcaatggcaccagcaagcgcgacaacagtccgtacaccgaccacgactacgcaggcacgcgccaattggcgacggcgaagggagcgaccggcaaacaccaacggcagaagggcggcggagggacggcgaaagagccgaaaaagaaaacggcacttgtcaatgggaccgattcggtggtccgttcatcggcacggccgcaccgtccgaccaaacgttttgtagaggaaacaaacgaatcattcattcgtgggacttcgaaagtgcgccgaacatcgccacgcaaacatggcaagaaatcgactgcggagggaggaagcgaaggggaagaatcggaggatgacgggaaggagtacagcgtggaaaaagtgttcaagaagcgtgtgaagggtggaaaaatggaatactttgtcaaatgggctgggtatgacgacggttggaacacttgggaaccgcgtgagagcttgaaacatttggaagtgctcaagcagtacgaga

SEQ ID NO: 86774 - DNA, 509 bp, Heterodera glycines
  SCN-specific regions: Sequence locations=1-225,247-300,322-509
acaatggtcttgtttgaaacaccctcaatccgcttctaaaaatcgtcgacattgaagcggtgtgccgtatggttcgagcacgctcaaaagattgtgtcgtcgttgttgataatacgttcatgacaccgtactttcaacgcccgttggaacttggcgccgatgttacggtgcaatcgctcaccaaatacatcaacggacacaccgatgtgctgatgggcaccgtagttaccaacaaggagcaccttgatcagcacatatacgcccagcaaatttatgctggcgccgttccgtccgcctttgatgcctttttggtgcttcatggtatcaaaacgctcccattgcgaatgcgccaacacatggaaaatgcgctggcaattggacgatggcttgagaaggacccgcgtgtggaaaaggtgctttatcccgatctcgagtcgtatccgcaacaccaaatccacaagaaacagagcatcggaatgtccggcatgctctccttttacattcgcaca

SEQ ID NO: 86775 - DNA, 633 bp, Heterodera glycines
  SCN-specific regions: Sequence locations=1-380,402-633
gtatttggacgtaacgcaaatgatcgtggacgtttcgtcaattggctgaggttgctatgaatggtcgaaagaatcgtttgttcatgtcaatgcgaatttgcaagaatattaaggaattgttggggaagtttgaggggcacgtgccagcgtcggaggaagtgaatgggaaagcggagaatgtgaccattcaatctgaatctatcgtgaccgagagacgtcgatattacatcgaccttcgcgaaaatcggcgtggttcctttttgcggattactcagctcgagacgcattccgggattcgcaactcagtggcattgccatttgaggggatcggccaattgcacgatgcactggactcaattctggaggaatatggcgaagggttcattgaggaggaagccgaacttccccattctcagatgattcgtactgatgggaaaagctttttttttgatcctggccacaattctcgcggggactttctgaaaatcaccgagttgaagtcattcatgggagtgcgcaattccgtcgtcctttcaatcagagcaattccgcaattcactcaagtcctctccaagctctacgatgactctcaggagctcagagccgtagaggaagtgaacgtgaacaatgtgc

SEQ ID NO: 86776 - DNA, 627 bp, Heterodera glycines
  SCN-specific regions: Sequence locations=1-571,593-627
tggacgcaagcggccgatctcctgctttaactgtaccgacaagcagagccgcggcatatttcggcatgttcgctgtccatccctttttccagcgtccggacttggcaagcgattgttgactgttgctgaacgctatgcccgtattgtgtggggcagtgacgagatgcatttggatgttggctggagtttggccgaattaaagttgggcatgggacgactgcagagatactacaagcggcgcgggttcctatcaaccggcattcttcgccccttcaatggggctgtggcgcgcttcatcacggtagaccgaaacgatctgtggattgagctgatggtcaaggacatacgtggagcattggatgacatcggcggagatccagagaaacggatgaaaagagtgaacagtcgggggagattggccagagaagcagacaaagacgacggcggcagagatccacaaaaaaggatggaaagagtgcgaagctttgggagattaaccatagaagcagacagggacgacatcggcagagacgcgcaaaaaaggatggagagagtgcgcagtttatggagattggcaagagaagcagacaaatcggatgagagtaaaggcaaagatggggaggaaaa

SEQ ID NO: 86777 - DNA, 603 bp, Heterodera glycines
  SCN-specific regions: Sequence locations=1-17,41-603
agtctttcttggttcctgctgccgccgccgccgccgccgcttcgctcgttgccgcctcggaccgtgtgtctgtcaagggctacactgctgacgccaagggctccctggactgcaagttcggcagcggcgacattctgaagaagtgcggcacctgtgcccagagcatcaccgagtgcgctagctcgaaccccaacaaaacggaggaaatttgcattagtgagattgcctcgttcgctggcgactgcggtggctgcgctgttgacatcctcgagtgcctctaaaggccaagatccacatcgcataactgtgactatggtgctgcctaatagactacgtctttgtagcgcccagacttattaaatttacatatgtattcttccgcctccattatacaaattgactaattgggcctctagacatgggaaaatgtggcgagtactgttgatggtcttgatgctcaattccaaatgtacgttcgatgtggaataggttgcacagcattagagacctgagatacacatttcctctttcacaccagacctcaagtatggagagaatctgcgagtagaatttgattgcatctgttgcacgactgaagaaaga

SEQ ID NO: 86778 - DNA, 636 bp, Heterodera glycines
  SCN-specific regions: Sequence locations=1-636
aaagagctttcgctgaaaattatcgttatttgtcgccctctgatctcgctttgtctgctgccggtgtctctcgcctttggagaagtttgtccgaggataaactgctttgggcaggaaaatgtcgtcaacattcgataaatgaaatgtttcctccgaacatttgtcgcaaggaaaattgggcgagaagtgacacagggggcgaaagcagctccgaattagccaacatttataatgacagttcgcgtgcgaagtctgtcgcttttcctcccccaaatccatctccaatgcccttgtgtctccaccgctctcgatggaaggccgtttttctgaggagtcttcgtgtgtcaaacaattggaagctgagaagaccgactgctgtctgtcaattgaggggacatgacgaacatgtgatcacgtgtctgaagctgcgaggtgacctcattgtcactgggtctgacgactgcactttgcgcgtttggtctgctgcgacgggaacgtgtgtccacgtccttaacggacacattggcggtgtttgggcacttcagctctcacaggatggcaaaattgctgtcagtggttccacggataggacagttcgcgtatgggacactgaaaagggaactctgattcattgtc

SEQ ID NO: 86779 - DNA, 588 bp, Heterodera glycines
  SCN-specific regions: Sequence locations=1-361,384-588
ctggtcggaaaatgacaccctccgatgacgagaaagccgcgccaaaacgacgacgaaaaccatggcaaacggatggtacaatcggagcccagaaagccgttccaaagacagtatcagcaacaccaaactccggcctcggccataaaatcgattctcaagacgccaaacggtggtgacataaattcgaattcggcatctgcggcaacaggtggtcgttatcagagaaaacatttcggcccgggacagaagcgccgtgtcagttttggctcacaatcagagagcaatgacagtgcgattagaaagcacaaaatgccgaaagtggaagtgtcgacagagcaaatgacgacgccgaaagtcgggcagcaaaaatttcagacaaaaatgaacggaagcgcgtcatccggcaaagtcataaatggaccgcaaaagaaacttgccgaagaacaaaacagtgtgtcgccagtgcgttcgaacatgccgaaaagtgggggcaatgccaatattggcggcggtgccgccccaacaccgattccatcgcccaaaaatcagaagcaaaaccagcaaaaacaaccttcaaaagctggacaa

SEQ ID NO: 86780 - DNA, 586 bp, Heterodera glycines
  SCN-specific regions: Sequence locations=1-405,428-586
ttatcggaacccgggccaagtgaagtgcaaacagtgcactttgccatgtttgctgcgggagagggaaagccacgcgacgaaacgggcgattgacggagtgttgcgcgaggcacgagcaaatgggcattgcccttgaccctttggagtgaattccttttagcttgatgcatgggcttttgccttttctgcctgatcaaaccggctgttttctgtacgattgctccttttgcccatatccccccccgcgatgactcccattgtgtgcatgctgatgtggaggagactggccgtgagaacattcaacgggctatctgcaacatgggcttataggatcgtaaggctcgcttctactcactgaaaacagtgtcactgacgatgcaacgtgacaatgccaagctgatccacgtttgctgtgagctgactctggtcaaagcggctgtgcaaaaacagcagcctgttcttccacgacgctttgtccaaaccatcattttggcccaccaaacgcccaccgttttgtacgtgaagagcgatgtgtttcagtggttggataccgcctttctggttaccgttagtgaaaaatacaacg

SEQ ID NO: 86781 - DNA, 558 bp, Heterodera glycines
  SCN-specific regions: Sequence locations=1-434,458-527,549-558
cattcggaagaaagcgaaggtacggcggaaggccagcggccaattgaaaaaccgaacgacaaaaacggagatgcatttgaagacggaagtgaagagaaagacatggcgattccgttgttgggcgagggatcggtcggatcggcaaaaagttcgccgagaaaggcaaaggcggcggagggcggcggcactttgtggcgaaagcattcgccggcgatggttctccgtcgtcgcaaaacttcttccgcctctttacgcacttcagcttcgacggatgtgttacaaatcagccaaatgcaaaaggaattggacgagtccgaagttcgtccctcttcaattggcaagattttccgcttcaacaccggcaattggcacttggctttcgtcggtctcatcggctgttccatcagcggattggccgtccctttctttgcgcttgtttatgcccaaattttctccgtgttcagtgaaccgttggaccaattgcagtccgatgcccttttctgggctgccatgttccttctcgtcggctttttgaatgcctttggctttttcatttcg

SEQ ID NO: 86782 - DNA, 486 bp, Heterodera glycines
  SCN-specific regions: Sequence locations=1-32,55-459
tcgaatcgaggggctgtccagtcgattgcggattcggtaacaaaggcaaagtttgtcggaactacgaaattgggcatcgatgaatgtgtgctcttccagattctacagtcccttcgttctttggtcctttcgcccggcgggcgccacctaaccaatgaaacattatgcgaaattttgcagtgctgttttcgcattggtctcgagtcttcactacccgaactgcttcgaatggccgcggagaacgctttggcggaaatgtgccgttatctcttcgcctccatccaaacgtttgagcaggacatccgacccgggctcaaagaattgatgaagtaatttagacagacacaaaagaattaattgatttgttcttttcgtacattattcccaaggttttttaaaatcagcataacggctttggaattcaaaaatttcttgcatgaggaataaagggtcagtgccaaaaaaaaaaaaaaaaaaaaaaaaaaa

SEQ ID NO: 86783 - DNA, 630 bp, Heterodera glycines
  SCN-specific regions: Sequence locations=1-529,552-630
gaatcccgatttccatttctctactcactataaaatgctccaaacggccttaccattctgcttctgatcagtgttgtgatcggccattccttggccaaccttggcccaaccatcaaacataatcctcattttaaagccgtacaaactgcgcatcatttgcatgatgccattgcgaagaagcacgaggccgaagttacgcagatcatttgctccattagcaacgaacagcgtcaagcattggctttggagttcaaaaaacaattcggcactgatctgattgccatgctgaaaaaggagttcaaaagcgactttgaagaactgatcatttctttgatgcaaacgcccgccgtttacgatgccaaccaaatgcgtgccgcattgtccggctccaatgaggcggtgctaatcgaaattttggcgacgcgcacaaaccgacaaattacggcgctgaagcaggcgtatgagcggttggacagaaggcatcagcacaatcagttggaggaggacatcaaagcgaagacgaagggacccttccaaaatctgttggtgtctttgctcagctgctctcgcgaagaaagtgcgcccgcaagcattgtattggcacacgacgaggccatgaaactgttcaga

SEQ ID NO: 86784 - DNA, 700 bp, Heterodera glycines
  SCN-specific regions: Sequence locations=1-640,670-700
acccaagtttgacagtttcccaaaaacattctgcccatatggtcacttcttcgccagacattcagcttatttttcagtcagttgaccgcgatcggtccggtcaaatcagtgccgatgagcttaacaggcgctgtccaatggcacatggaagccgttcaacccggagacgtgccgaatgatgatttcaatgttcgactcaaacaacgatgggggcatcaattttcaggaattcggcgcactttgggagtacatcaacgattggacgcgcacttttcgcactttcgaccgcgacaacagcggaaacatcgaccgcgacgaattggtcaatgcgttcacacaattcggttatcgtctgtccggcactttttacgatatgttaatgcgcaaatttgaccgaactcaaagcggtcgcataaacttcgacgacttcatccaactttgcgttgtgctccaaacactgactaccgcttttcgagaaaaggacaccgaccgggacggatggattcgaatttattatgaggaattcctcgccatggttttctcgctgaagatgtcaatgatggctaaacaatgagcaaaagaagggggaattattgactgatgaggatttgctaatacagtaacccacttatttttgtatgttttctgttaaacattatttacatatcactttcaattttacgacatttttgtttgaata

SEQ ID NO: 86785 - DNA, 600 bp, Heterodera glycines
  SCN-specific regions: Sequence locations=1-15,37-171,193-287,310 -469,492-507,536-600
taaaagatccgaaaaaatgccaaacattttcaaaatccttctgattgtgcttttggccgtcgtctcattccgtctctcggcttctactggtgacaaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagagaaaatgagggcacacctacgcgaacttgctgagaaaatgccggtcaatgaatcgaagcgtctgtcaccgagtggacccgaccctcatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaacccctaaaaaaaaa

SEQ ID NO: 86786 - DNA, 590 bp, Heterodera glycines
  SCN-specific regions: Sequence locations=1-472,494-555,577-590
gcacgtggaggcgcgggggggcacggaaacgcattttacgtgtcgaatttggtgagaaagccgttgaaagcggaggagggcggacaaggcgaagagatgagctacgacatcgaaatgcgcatcatggccaccgccggtttggttggcattccaaatgtgggcaagtccacacttttgcgtgcgatttcgagggcaaagcctaaagttgccgcttatccgttcacaactctcagcccaagcgttggaatggttcagtacggcgacttcttccaattggcagttgccgacattcccggattggtgcaaggcgcacatcgcaacgagggactcggcttcagtttcctccggcacattgtgcgctgcgaatcatgaaatgactttgtacgacgacgaactaagcaaaaaagaagcggcgattgtcataaacaaaacggacttattggacggagaaatggttaagtcagcgatcgtttcgatgtttccggagcaaagtgtgtttttcgtttcgggaaggcatcgtttgggaatcgaaccactgctaatgtttttgcgggaaaaacacgagcggttcttgaaagagagagaagcga

SEQ ID NO: 86787 - DNA, 493 bp, Heterodera glycines
  SCN-specific regions: Sequence locations=1-342,364-493
gccgctgacaagtgtcccctccttccgctacactttgtcttcttcgtccgtcccttctcttctgaattgccaattttgcggtgctcagttggcggatgtccaagctctccaaacccattggctgcagcagcacgtggcgcagttggcccgtccgcacgtttgcgtcgactgcgacgccggcttcaccaccgcggaagcgttgcgtgcccacagggaaatgcaacacgcggaaaaaacggcgcggaaggaacagcgaatttcgagcagaaacgaagtgaaatgaggccaaagattagtacaaaataatatttattgaacttctgtgaaagttgccgccaaatcgaattttaattttcattttttgtactgagttcggccaaaaaacgtgtaattcccccccccccctccgctcacatttatcattttccaccgcactttttattttattttatttgtcccccctttcactgaatgccattccttccttttcctt

SEQ ID NO: 86788 - DNA, 623 bp, Heterodera glycines
  SCN-specific regions: Sequence locations=1-184,207-233,257-623
gaaaaggagacacaaatagagaaaaaagatatgtttttctctggcactctctatttattggtaccatctcgttttttgaaacggtgtgtgtatgtgacattcgtggtgagtcgaagtgataaataggcaaatgtctggtgatcagaaggggacccacgcgtttgggcgctggcattttggcgccaaaaaatataaaaattaaaatacttgagcagtgaaccctctcggagtggtaaatccattttaaaatgaattttgggccaagtttttttcaggtcggtgtcatcagtgcgttcaatttccctgccgccgtttacggttggaatgccgcgttggctctcgtctgtggcaattccgtgctttggaagccgtctcccagcactccgttgacgtccattgccatcactcgactcgttggcgaagtgttgtccaaaaacggactgtcgcccgacatttgctcattgatttgtggcggaggggacgtcggaatgtgccttgttaaggaccctcgggtcaatttgctctcatttaccggctcaaccgaggttggccgtgtggttggtcagcatgtccaagcacggtttggcaagttactgctcgaactcggcggtaacaatgccatc

SEQ ID NO: 86789 - DNA, 449 bp, Heterodera glycines
  SCN-specific regions: Sequence locations=1-449
ccctggaaatttgcgaatgacgtaaggagatcggaaggatgaaatgtcgccgcatggaagagcaaccggacgaaattagacaacaggccatcacagaattcattggagggtgtccgccggaattcacccagatacttgcgcatattgatggactccagttggaagaccggcccaattacgagatgattgagacgatgctgcgtgagcacctcacccgaagccgtgttccggagcacccgtacgactgggaagtgggaaggcgcaacgcgatggcacaagcgcagagtgaggcagcgaggaggaagaaggataacacgaaagaaggcggaggaggaaaaaacaacacgcaagggatgagtccggccctggtctgatcgtatttgctcgccattgtacatattactgtgcctgtctgatcataattgctcgtcattatacataatatgctg

SEQ ID NO: 86790 - DNA, 319 bp, Heterodera glycines
  SCN-specific regions: Sequence locations=1-172,206-297
tgccgtagaattcgctttctgatgttgcacacgcaaaaaaatgaagacggaatcaacaattcttccaggaaatttatgagatgtacatcaaattctcgatgaaccctttctatcgacaagacactccgatcagatcgccaagttttgagcaaaaagcggcgatgtatggacggaagtttttaggggtttaaaaaagaccttggaaatttaagtttttgttgccatcagatttgtgtattttttgcattacattattttatacgggtttaaatcttaaataaaagaattcgcttttagaaaaaaaaaaaataaaaaaaaa

SEQ ID NO: 86791 - DNA, 619 bp, Heterodera glycines
  SCN-specific regions: Sequence locations=1-167,207-469,491-619
gccgaaaacggaagaggccaaaaaggaagaagcaaagcccagtgccccggccgtcttaactgaagctgccgataatgtgaacaaagcggtcgatgacttaagcgttaaacaggcaaaagcattgaaaaacgcggccgaagcaacggcagagaaaacgccggaagaacaggaaaaagcattgaaagaagtggcagaaaaaggaggaaacgaacagctgaagacggctgtcaacaaaattttggaggcaaaagcgaaaaacgacgcggaattggaaagcgaagtgaaaacgaaaacggcaacactttctgaggacagcaaaaaggccagcgcagagttgactttgataattgaagacaaaaagacgactttggacgagaaggtgaagcggacggaagagctgacagccaaaatgtcggacaacacgaagaaggagctgaatctgaacaacagtgccgacgtcgtcgccttcgtcaagtcgtactccgccgtcgccgtgccggcggtggccacggagggcaaagcatgatcaatcagtctgatcggaggattcggcattgttgtgtgatgaaatgtagccaataatgaaattcattgattaaattaattttcgctaaaaaaa

SEQ ID NO: 86792 - DNA, 596 bp, Heterodera glycines
  SCN-specific regions: Sequence locations=1-378,400-445,478-596
ggaatcctactttgctggggtttatttttttgttttgtctttgctatttttattgaacgatggaagaaggacaaatggaaaccggagaaaatgctgcagttaaactcgtggatcaaaagaagtcggctaaaaagaaagtttatgtgccgggaattagccgaattttgaaggcgagcgaagaattggtatacgatgagaaggcgtatttgttgtttacacattcgaaacgaactatccgtgtttaagttttgatgttttgtccgactctttgggcgacaatcgctccgattttccaatgaccgcttggcttgctgctggctgaccgagcaaaggacaacgaattgctggtgcttagactgtcgaatttgcacgcaaatgaaaagacattggaaaatgcaaagaaaatggcccaaggaaagggcgacgagtcggagagcagcagcagcgaagacgacgaggaggaggaggagacggagggcggcacaaagagtgcgcggatgcacgcggcagtgatccctcaccacgggggcatcaatcggatgaagtgccaaacaattggggctagcaatgtgtgcgccgtgtggaatgaccagcag

SEQ ID NO: 86793 - DNA, 615 bp, Heterodera glycines
  SCN-specific regions: Sequence locations=1-95,117-615
tacagttttgctccgttaacaacagcgccattctcagcacatcgcacaaaaatggcacgccgacgaagaaagaaggagccgcgaaagcagtcgtacaagctgtacgttcgacgtgtgctgaaggaagttcatccgggcaaggaaatctcaatgcgtgcgttgaacatcatgaactccttcgtcatcgacgccttggaccgcattgcaacggaggcgacgcgaatggcccacaacgaccggcgcaaaaccatcacgcttcgcgacatggagttttctgtccgactgtgcctgcctgacgtcatggccaaagatgcgaaccagaaggctcagaaaacggtgaccaagttctatgctgcaaaagtgcgggatcggatgagaaggacggagatgcgtcgtggcgaatttgcgatgatgcagatggcagcgctgtgagcacactcaacttttggacgaccggcggatgaagccacctgtatattgttgatgattggccccgtatcccccattactgtatgtgtatgtattatacaatgtatctaccattcttgtgtgtgtatgtattattcactatgtgctttatatgtatacctggtcaataaaatataaccccaaaaa

SEQ ID NO: 86794 - DNA, 509 bp, Heterodera glycines
  SCN-specific regions: Sequence locations=1-145,167-212,234-509
tctcgtccgcttctattcattgccgcccttctcttcctcttcggctgctgtcgtgcggatggaaatgttgtgcatctgtcgagcctcaattgtgccacgaaggacggaggaatcgatggcttcaaagctgtggacgacggtctgatcttggattcctcatctgtcaccgctgatacgtctgacctgcccctcatcggtttccagaagaacggaaaggaggacttgatcttcaaactctttgtgcgcgatggaggatgcgtctcaaaggccaatttcttcaccaacggtcaaccgtgtacactcggagagtcggaggacgtgactgagtcggataagtgtccgggcgagggcggcacctccagctgcacatcccacgaagtcacctgtacgggcatcggaatggcgaacgtcgcggaggagtccaatggtcacgccttcaaagccaacctggccaatctcaccaaacttaccaatccgtgcgcgcaatggaaggcacattttggcggtgt

SEQ ID NO: 86795 - DNA, 592 bp, Heterodera glycines
  SCN-specific regions: Sequence locations=1-184,218-435,477-592
agaacaagaaatttcgcgcagcgaaatcaacgaaatcaaagagattccgcgcaacgaattcaaaacggcgccaatcactgagagccgtgaaagaccgttcattaaaagcgaaatcatccgcgacatcagctccgcaatgaacttcttgaacgagcaaatccgggagtactcggaacgaaccaaggacagagaggaattcaagggcatcattgaggccagaaacaaactcgagacggccatcaaaccattgcacggagtgatggagtccgacatggcttcttcgagcctggagacgtcgatgaccaactcggccaacatcgcccgacaagccctggaggagttgcccgtgaaacaggtccgacaaatggaacaaattgcggaggagggaaagagcaaaacggtggaggagcaggagagggcactgcgcgagtacgcggagaagaacagcgaaagtgtgaagaaggctgttgaccaagtgtccgtcgccaaggaccgggcggacatcgctttggagacgtacttgaggagccacgctgacaccttctcccaggaggcgcgaaaggccaacgaccagatgctgttcgtgatgaag

SEQ ID NO: 86796 - DNA, 228 bp, Heterodera glycines
  SCN-specific regions: Sequence locations=1-228
aaactccgacgatgattcattgaagacgctttgttatcagctgctcgtgccaacttctgctgctaatatcggtttcgcaatcggtgattttcaaattcacgtgcagccagaaatgcccgagattattaactttgtcgttccggagctcattccgctcttaaaacacacaatgaaatcgctgaatagaatttttgtctttttcgaagaacttttgtcatgccgatttcc

SEQ ID NO: 86797 - DNA, 642 bp, Heterodera glycines
  SCN-specific regions: Sequence locations=1-167,189-642
ccggcgcctttttctcgatcggtgtccgggaaagtggcgagtacaacccctccccggctctactggcaattgcactcacactggcagaattggcacttttggtgttctttttgccggagacattggttcatgcaaagaatgacgattgccataaacaaagtgggcatagccttctttttcttttgtcccctcgggcgctgttttccttcgacttcttgtctccggcatcggcttcctccccgccggtttcggtgccattgctccaaaagtattcccgcgtctactttctgttcatgctgctgttctccgccatggaatttactctcggctttctcacccatttgcgcttcaattacagctcaatgcaacagggccggctttacctgttctccggcttttgtatgctggtcattcagggattcgttgtgcgacgcattccgtcaacactcaaagcacaaagtcacggagcgctagttggactggtctcaattgtgccagcttattttgtcatcgcttttgcacattgccaaaatggcattgaacagcccttttcatgggacttcttctgttctcagtcgcatcagccactgttgtgccctttctgactacgctattttccaatcagtgtgatcagtcggcgaa

SEQ ID NO: 86798 - DNA, 588 bp, Heterodera glycines
  SCN-specific regions: Sequence locations=1-61,83-588
atatttcttttgccgccattaataatctccaatttttattttttatggccctctctgcccttctgcttcttctccccctgcttctcaatgttcaaaatatcccagatgagtcagtccaatcggatatgaaggctgtttattcggctatttcatcgccggaacaatggaagaactcacaaaattcattggcttcactcgaatcacaactgacagagccccaaagagcactggcaaaaatgcattgggaattggagaccatccaaaaggaaaagccggaggcaccgccacaattcgacttgggacttttctcggaagctttggaagtgatggtcgaaatggacgaagaagcgaaagaagtgaagctgaggaaggacaaactgattgaatgggcaggaggagaggaagcaaaaaaaaattgaaggaaaagatgacggaggaggacacagtgccggaagtgagggtgaacgagaatggtaaggttgaagtgaaggacggcgccggaggggaaggacggttggaagtcagacgaacaaaggacgagaaaggcagagagcaggtggtgatcacccttatgaagaatggcggaac

SEQ ID NO: 86799 - DNA, 354 bp, Heterodera glycines
  SCN-specific regions: Sequence locations=1-330,352-354
ttttgcttgcacagcagtgcccgatgattactacgcgctccgtttgctgtacaatttgcccgtcggatttgcaattgcgctgctcatttaccacttggcttggtaccggatcaacttcgccgactccattctgatcaacccgttctggaaggagttcgtcaaatggctgatgatcgtttctgccgccctgtcctattcgcttaatcccttggtccgtgcttctctcggctgtgccctgttcgccggactgggcagcaccgcgcatggattactgtccgtttctgtggtctaaaacttaaacaagggacccattgcgaatgtcatccaaaacttcaacatttccacgatgataac

SEQ ID NO: 86800 - DNA, 550 bp, Heterodera glycines
  SCN-specific regions: Sequence locations=1-350,387-436,458-550
taaggatttgacatataataatggagggaacgacgtcgccgccttattttttgcgtagtcggacgaggaaggaaggaccggccgtgctggaactcattgagaagcttcaacaagccaacgacaaagttgaccaacaaatcgcagaggaacaccaattgcgaaatgaagtccttcagatggcaccgcgcgcgatgaagaaatacctcggcacacgctttgaacgactgatgaatgccaaattggaattcccccaaatggcggacagtgaacgcaaatccgaggccgagttggccaaggcgaaagaagaacttcgccagttgaaactccaagcagtcaaagaggcggaggaacagaaaagggagttggaggaggcgcagcgaatggagagggaattgaaagagcgagtgaatcggaaattggccaagctgagggcattggaagaaatgtgatggcaaatgtcagtcgttcttcagtttgtgcgggttttctctgttgtgttagtcatgtaattatttgaccgtatgtttaacaataaataggatttatttgc

SEQ ID NO: 86801 - DNA, 327 bp, Heterodera glycines
  SCN-specific regions: Sequence locations=1-297
gtgtttggacccaccggatcaattgggcttatggcatgagtcctgaaattaattccagtgccgaaccaccaggaaagcaaagtggctgaagagtgtttggaatatcagaaaaaattcgacaaaaagataaaccaaatcgcaagtcattggcacggcgtccgcgtgagcgcgccgaaagcatttggcggcataatgatcgaattgtcaatttcaaaaggaaagtacaatctgagcgacacccaaaattttaacattgaatttggaaatccgaaagatttgatgacaaaaataacggacaaaaaaaaaaaaaaaaaaaaaaaaaaaaaa

SEQ ID NO: 86802 - DNA, 543 bp, Heterodera glycines
  misc_feature (520)..(524): n is a, c, g, or t
  SCN-specific regions: Sequence locations=1-60,82-325,352-442,466-506
cattgactggattgtgcgccgtttggacacacagcgaacattggcattgaatctgccatcggcacaattccaacccgagaatcgatgcatttggaaggacttggcaacatcgactgggaccagctgatgtctttgccggccgactattggcacgaggacgcgaaggaagtgcgcaaatttctcgaggaacaggttggcaccgatttgccggaacaaattctgtccgagttggaacagcaagaaaagcgtatcatggcattatgagggatggacagttgatggagatgagaaatagagaaaattgactggaaattcgcattttaattacctaattatttatttattttacatggacatttcgtttcttaattttgtggggacacttcccccccccccccgaaatgtttaaaaaaaaataaattttccgttataaaattttttcttgtaaaatattatgatttctttcaaaactatgtatttgtttccgctttctttggttttttaataaataaaaaaagcnnnnnaaaaaaaaaaaaaaaaaaa

SEQ ID NO: 86803 - DNA, 655 bp, Heterodera glycines
  SCN-specific regions: Sequence locations=1-655
aacaattgcgggagaagctgcgctcgttgcaggaatacggcgacttcaagcagttcctccgcttgtgccatttggagcccggctacggctacgaattgttggcgccggtgcactccgatttcccggccgagggcagcatttgtgagttgcaagttgggcgcagacagctcgtgctcatctatccggacgacgaggggtgcactgtccgcttcgcattgccttccaaacggatccgtgtgtggcgcgtttcccattccgaacaccaactgttggcccagatgagcttccaattggagtatttgcgacagccggacgagttcgggctgatcactctgcgcactgatcagtccgtccttttgtcgctgttcctccaatcaattgctgacgaaatcttgcaggatcaacaatataaaactgaatctccgttcaaatttgttgacgacgccatttcgctgaaagcagcgtccgacgggtcgtccgcggtggcaagcagttcaattgttgctggagtcggcgatgaccaaaagagtgtgaagtcctgctccaacaactcgtcctcatccaaccatgccaacagtagcagctgcgcactggacgcattggtgaacggcgccggtggcgatggcactgaatatcgcattaaactgatttcgta

SEQ ID NO: 86804 - DNA, 705 bp, Heterodera glycines
  SCN-specific regions: Sequence locations=1-705
gtggaagaattggccactggctggtgctttgtgcacgcaccgttttgcactgccaacagtttgtggaacgtttgggtcgcatgggcaacgaaaagggcattccgattgcggagccggagattgtggctttaacagcccggataactcggaccgagaatggatgacgatgttcgagcgatgcgtcaacaagcacatccaattcatcatgctggtggatgaaaagcgcaaggacacccacggactgctcaagctgtcggaggcaatgcacaaagtcaccacgcagcatgtgacgctggagaaagcgaatgacgttgtgcggaagaaccagcgccaaacgctggagaacatcctgaacaagctgaacatgaagaactttggcctcaactacgtgccggtgatggagccgtcggcgtgccgtcgcttttcgctcgaaaacggaaatgtgcttgtgatcggctacgatgtcaaccatcctgctcccatgccgcaacagacccgtcgtttgttggcatcgcagggcgaatcgcaattgagctcgcttgacccgtcatgtgtcgggatttgtgccaacatggctcctgattttaatgcctttgttggggattatttcttccaggaatcgcgccgagaagccattgaccaaatgcagttggttgatcgcatgaagtggattttgcaaaatgtggaaaagcatcgtcctggcat

SEQ ID NO: 86805 - DNA, 702 bp, Heterodera glycines
  SCN-specific regions: Sequence locations=1-18,40-460,484-485,507-702
taaaattctctcgtaaagaaaattcgttcagtgcccccggtaccgttttgtttggcatggagccgcttcaccagcagagtttccagcgaaagttctcaatttcggcctgccgacgacagtcgtcaattgatttggaggacaatcactttctgttgacaattgtgataagcaacgcgacgaaccacgagagcatttcgtacaaacaggacggaggacgattcgactcgtcacagttcacgctgaagttccacgcgaacactttgtacaaaatttacgtgaagacgaagccggcacagcagtttttaagtttgaacatcgccgggaacgtgctcagtttggctccgattgagggcggcagcggagaatacgtggccatttggaacaccgctgacaaagagccgaccaaaaaagggacacggcaggacattgaatttgtgctttcggccaaggacaaaacattgagcaaaaatttgcaagtcaaattttacccccacaacgacacacacgcgggatggggacagaagttggaccaaatcacttggcgctgctccaccaacgacattggccatgtgtttgtgttggaagagcaagccctttaaagcgaaagacgacaattgcattttaaaaagcgatgggcggagatcaaacggtgacggccaaaattaattttcaattcccatttcaatgcattcattcatttct

SEQ ID NO: 86806 - DNA, 646 bp, Heterodera glycines
  misc_feature (564)..(564): n is a, c, g, or t
  SCN-specific regions: Sequence locations=1-646
aattcccgtcgagccgaccgttgaagtgcttttggcccatttgcgccacgaccgaatggaaacgcggatggccacgctgaattggattcggcaccttcactccgtccaaccaaataatatgtttcgctacatggaccgcttcttccccattctgctggaacttttgtcggacccggcggacgacgtgctaatgttggacattatgctgatcacggaaatttgtggccaaccaaaacagcagcaacagttggacattcgcactttgagacttggcgaggaacttaaccaagaactgaagtccgtgtctccttacttggtcaaattcagcgtggccttgcttaagatgttcaaagacgatgacaaattaatcgacgagcgcggcattcacattgtccgacaggtctgcttgttgcttgagccgacggatgtgtttcgttcgttggcattacttctcggcacaatggtgaacatcgacggatttgtccttccgactgcgggacaacagcagccacaactgacaacggccccctcaggcaccaaagacccctttttcgaccttcaatntgttgccgaaatggtcaaaatcctcaaccagattctgatgactaccagtgagctgtttcctctccgtcagcgactccgttgc

SEQ ID NO: 86807 - DNA, 354 bp, Heterodera glycines
  misc_feature (330)..(330): n is a, c, g, or t
  SCN-specific regions: Sequence locations=1-283,307-328
accgaatgggaacaacacgagggtacgcaattcttgacacttaccagcaattgcgcatgattttccataagaaattgacaaattttagcggtcgatgctttggtcaaccagaacgttttccatgtcaatccaccggcaccgaatggggacaacgatggcgatgatctgcaaatgttttttgaggacgatgttgttgatgcttatcttcagaatatggacccgaactaaaagaaattcatccgccgatgatctttcactcatttatcgtgtttcattttaaaaatgtttaatgtgtgtctgtctgacaatgagaataaaatcacgactcanaaaaaaaaaaaaaaaaaaaaaaaa

SEQ ID NO: 86808 - DNA, 658 bp, Heterodera glycines
  SCN-specific regions: Sequence locations=1-658
ggtccctccggcggttgtccagtgcccactgttaacggttttcgtgcctcattttcgggcgtaattgacatgcgcaaaaagtcaatggcggatgaaattgtgccctcaatttttgtgccccgcaaacggtcggcctgcgactttggcacgttcagcgcattacgaggaatgtcgcgccaaaacaccgctccaattaaaatacgcgcgaccaccgtccgtgatgacagcagtaaacggccagagactgaaattgtccatcgttcgcagcttttggcgcccgaaagtgtcgcgtgggcggtgccgacgacgcgccaaaattcagcggaagtgccaaaagagaaaagcaatgcgcaaccgctaaaacatcaacgtaattgccaacggcacgcgccggcaagccgaggcaccctttcgtttccgctggtcaaacgaattgcccttggcagggaaattcgcgtgaatcattatttgctgaatgacggggaggacttgaccgatttaattgtgccggacaacgaagacggacaaaaggggacgaaggagcggcaaaatgagcaacaacaaaggccgaggaacggcacagaagtgccaaaaacgcccaacggcacccttttcggctccgcgtcctttcgcggtccgtcgcttaacattccttcgg

SEQ ID NO: 86809 - DNA, 622 bp, Heterodera glycines
  SCN-specific regions: Sequence locations=1-14,41-45
cgagaagtgagggcaagatccggacaggagggcatcccccggaccacagcgtctcatcttcgctggaaagcagctggaggatggccgaaccctcgcggactacaacatccagaaggagtctactctccatcttgtcctgcgtcttcgtggaggaatgcagatctttgtgaagactctcaccggcaagacgatcaccctcgaagttgaggcgagcgacaccatcgagaatgtgaaggcgaagatccaggacaaggagggcatcccaccggaccaacagcgtctcatcttcgctggaaagcagctggaggacggtcgaaccctcgcggactacaacatccagaaggagtctactctccatcttgtcctgcgtcttcgtggaggaatgcagatctttgtgaagactctcaccggcaagacgatcaccctcgaagttgaggcgagcgacaccatcgagaatgtgaaggcgaagatccaggacaaggagggcatcccaccggaccaacagcgtctcatcttcgctggaaagcagctggaggatggccgaaccctcgcggactacaacatccagaaggagtctactctccatcttgtcctgcgtcttcgtggaggaatgcagatcttt

SEQ ID NO: 86810 - DNA, 713 bp, Heterodera glycines
  SCN-specific regions: Sequence locations=1-713
caggattcggtaacgtcggcttgcactcccaccgttatttgcacagagatggtgcaatttgcatcggagtacaggaatatgactgcgcaatttacaatccgaatggaatccatcccaaagagcttgaggattggaaaatcgcaaatggttcaattcgcggctttcctggagccaaggctttcgagccattcaccgacttgattttcgagaagtgcgacatccttgtcccggccgcttgcgagaaagctattcacttggggaatgcacatcgtattcaagcaaaggtcattgctgaggcggccaacggaccgacaactccggctgctgatgcagttttgatgaacagaggcgactgtcttattgtgcccgacatgtttatcaacagcggaggtgttactgtgtcgtacttcgagtggcttaagaatctcaaccatgtctcttttgggcgtctgacttttaaatatgagcgtgactccaactaccatcttttggagtcggtgcagaagtcactcgagcgcaccttcgaccgtgccgttccggtggatcccagcgaggagttccaattgcgcattgccggtgccagcgagaaggacattgtccattctggccttgagtacacgatgaaccgttcggccaagcaaatcattgccaccacgaacaaatacaacttgggcttagacttgcgtactgctgcctatgccaacgccatcgaa

SEQ ID NO: 86811 - DNA, 650 bp, Heterodera glycines
  SCN-specific regions: Sequence locations=1-197,219-618,643-650
tctgttaaaaaagcaaagcaacggttgacatgcaaaaaaaaaattcaaaattcagcgcaaagttcgggaacactcgcggaagcttaagaaaatgaccaaagaatttggccggaaaaagagcgaaaagtcaattgcagtgccaaacaaatgtcccttcaaagctgaaatgttgatggaggcggaacagaaacgggcggaggcaaagaaaatggaacaggagagaaaggcacgtcagaaaatggccaaaaagggcggtgccaatgccaaatcggtgcgttcatttgcggccgaagttcgacggaccatcgaaaatgcggacattgtcattgaggcttcgggaagtgagcacaacatttgtcgtcagagagcagtcaaaaagaagggcgcaaaacagcggaagacaaagaagaagaataccgattggaccgatgagtccccgccaccaattgtgtcattgttgggggaggaggaagacaatgccgtggcatcgccgccgtcagttcccatcagcagccgtgccattcggaaggcggtgaagcgtcacaaaaaaaaaccaacagaaaattgccaaatctgctgacaagcttgctcttcaactggatgaaaagatggaattttgaaggaaaaaagtgtttttaaatttttgttgt

SEQ ID NO: 86812 - DNA, 669 bp, Heterodera glycines
  misc_feature (43)..(44): n is a, c, g, or t
  SCN-specific regions: Sequence locations=1-669
gaaaaggggtggcggcactgactttggacgaggactaccaacnngacggcgaatgcaagtccctgcagcagccgaccagcatcggcgaaggaatgttccgcggggtgcgcggtttgggcacaagcgttgtggaaggagtcaccggtgtcgtctccaaacctgtcgagggcgttaagcagggcggcctactcggtgggatcaaaggcatcggcaagggaatggtcggtgcaattgctcgtcccgtgtcgggggtggtcgatttggtcacaacgacggcggacaatgtcagaaatgccatcatcaatgttgaggacgtaaagccaattcgcccgccacgtgtcatttcccacgacaaaatcatccgtccgtacgtttttgaggaggccgtcggatacaaaatatttcgggagacggaccgtggtcaatttgcgaaaactgatcactacctgacttatgggggcatcacaaaacgtttggtcatcattgtgacggacaagcacgtaattgaggctcggcaacacaaactaacgggtaattggaatgcaacttggaacccgaaatacgccgaactcaaaaggccgactcgagtgggctcaaatgggaaatttggcattaagctcaggctgaagaaggagaaaaggggattttcgtttttctcttcgaaagatg

SEQ ID NO: 86813 - DNA, 660 bp, Heterodera glycines
  SCN-specific regions: Sequence locations=1-660
tgaagcgcaattgatttggccgagctttacgcggagacactcaaacaaagtgaggccacactgaacacagaaaatctccaaattttgctgacgatattttccatttgccttcaacatttaactctgatagtccatcgtcggaccgtcgcattccatttttgaacaaaacgctcgactgggccctcaaatcggcgaagggaaagcccgaaatgttgagggcatgcgcacttctgcagaggaaatttggcgatgttttcttcagcgaaggacaggaagaacaagcggaacgttatgctcgctctgctgaatatttgcttgacgaagtaattcttatgctaatcgggcaattattaattgttctttaggccgaccgaatcgaagggattccaattggtggagaagggagcagtggcgaaaaccgcgaaacagacaatgccgacgacgcggcgcagaaaatcgactccgaactcgaattggactaatttccatgacgcagacatatcgaaaacggtggttttgtcatcgcaaaggatttacatgattagtttcgattatttttgtgatgtccaatctctctccccacggttttcccaatgattggccggtcataatcacctctaattcccatcctattccaaattaacttgtttatttgatttg

SEQ ID NO: 86814 - DNA, 483 bp, Heterodera glycines
  SCN-specific regions: Sequence locations=1-60,82-240,262-293,317-459
gatttttgtccactcttttaaatattccccaaatgcgtgttctcccccttctcttttctgccctcctcctcctctctgttggcctttgctttgcccagtttgatcagtctccgtccgctgctctgaatcatgtgcgggccaaaagaggctacaagccgtggaagaagcaatccttctcctcttcttcaagcgaaatgtacagaaggagaagacccagtggtaacggtcattacagggattacaacggctacgaacgggcgctgggaaaaattacgcggagctattaacggacgagcagaagaagagaagcaaaaagccaaacaatgggcgtaacacttttaattgatcaaacgatattacagtatccaacaccaaaattacagtaaccaaacatccaatggaacgaatgactcatttaattcagcaaatttgctggaattgccgataaagaaacttaacaaaaaaaaaaaaaaaaaaaaaaaa

SEQ ID NO: 86815 - DNA, 497 bp, Heterodera glycines
  SCN-specific regions: Sequence locations=1-77,99-193,216-375,398 -413,442-497
caaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaggcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaacccct

SEQ ID NO: 86816 - DNA, 414 bp, Heterodera glycines
  SCN-specific regions: Sequence locations=1-414
ggttgcagcccgcctggtagagcaggcccgagacggcgtggacatgcccttggcgtcctggcaggacagggtcagaacgaattcttgcgaggtcttcatgatggacccgattgtagggtcgtcatctgacagccgcgcgaaaccgccagtggcggccggtctcagtgaccgtggccgatgtgctcgccttccttgaccttgtagaccgtgccgcagtaggggcacatgccttcgccggtcttggccacgtcgatgaagacacgggggtggttgctccacagcggcatcttcgggttggggcagaagaccacgccggggccttgtacgtcggcggcggtcacttccaccacggacttgggtttgcttgcggtgttgctcatggcgatgtgctcccggtcagaccttggtcagcca

SEQ ID NO: 86817 - DNA, 339 bp, Heterodera glycines
  SCN-specific regions: Sequence locations=1-299,321-339
ttgtattcgttttatttctctacttcggtggtattcctcgattcgtctttacacgcattttaagcatcatcaaatccaattcaaccgcagcttacctcaaacaatgtcctcctcttctggtcacccgcaaacatcaagcgcatccgcaatacgggcattgcaaatggagttgcgctcattgcaatcacaaccgttggagggtttcactgtcacctgtgatgatgacaacatgttcaagtggacagtcggcatttttggaccacccggcacattgtaccagggtggctacttcaaagcacatttgaaattcccaacaaattacccatactcacctccaac

SEQ ID NO: 86818 - DNA, 695 bp, Heterodera glycines
  SCN-specific regions: Sequence locations=1-695
cattgacccggctatgttcgacgcctttttacgcgatcatttgaacgttactgcaccgagaacatggcagttctcgagccgcttagacttcgcattaccaattatcgagagttgggttttataccagcgaaaagcaccttacgggtcaaacaattcccatcctcaattaatgaaagtacggacgaatgggaaatttcatttgacgagtttgtctacattgagcaggctgattttagagaggttgccgaaaaaagttatcgtcgactgacattggaacagccggtgggactgcgtcatgtcaatttggcagtcaaaattgacaaactggagcgggatgagcacggaaatcccatcgaattggtggtaactgcgaatccggtgagtagtgagtgtaagccgaaagcattcattcattgggtggcgagaccggtgctttgtgaggtgcgtctctacgacaaactatttgtacacaaaaatcctgaggaccctgccgaagtccctgggggttttttgactgacataaacccgaactcgctccatgttctttcaaatgcaatggttgacggaagtattattcgcactattcgtccgttggatcgctttcaatttgaacggaacggctttttctgtttggatccgaatgattcgtggtcaagtgagaaaaaattcgtcttcaatcgcatcgtttctctgcg

SEQ ID NO: 86819 - DNA, 670 bp, Heterodera glycines
  SCN-specific regions: Sequence locations=1-170,195-670
attgggttgcggaggaaccgtgtccgtggcgaggagtacgaccaactgatcgacaatttcatgaatgcgtgcaggaaaaaatacggacagaatgtgctggtccaattcgaggattttggcaataaaaacgcctaccgattgctcgagcgataccaggacgaatattgcatgttcaacgacgacatccaaggcaccgcctcagtggtcgtcgccggactgctcgcgtgcacacgagtgaccaagctgagaatgcgcgacaccaaatacgttttcttcggtgccggcggagccgcgttgggcgtggcggaaatgtgcgttcgccagatgcaaagtgagggactgtcctttgaggaggcgtgtggccaaatttacatgatggacatcgacagactgatcaccacacagcgcaaaaacattgagccaaggcatttgccgttcgccaagaatttgcccgactcgcagtctctgcttgaggtcgttctgtcggttcggcccggcgcgctcatcggcgcttcgacggtccgtggcgcattcaccgacgacgtcattcgcacaatggccgagcacaacgcacgaccgatcattttcgcgctgtccaacccgaccagcaaggcggaatgcacggcggatgacgcctaccgagtgaccaatggcaccgcgctgttcgcct

SEQ ID NO: 86820 - DNA, 727 bp, Heterodera glycines
  misc_feature (701)..(701): n is a, c, g, or t
  SCN-specific regions: Sequence locations=1-498,520-727
cccataacggactgtactttttgaagacaatggcctttgtcgcgtggagattcgcaaacagtcggagccttttcgtctggcaattcgcgtctttaaattgctcgaccccgcggtgggctcttttgggatgcttaccaaagtgcggtacgaagccgagctcagcactttccatatggccccccaatctttggcggactgcccaccgcccgttggctccgtcaacggcgtccgatcttttccgcctccaatttaaattgtggccgcgaggatggacaaaacgagaacttcgaggagtgtttgtgggccgacttcgccaaaacgccggggaccaacacggcccactgggccattggagagcacacgcaacactgggaacagatcatgcgcacgacgccctcctcacggcccaaaggccaattctacttccaatacgtggaccccgtggccgaatttcctctgccgcagctccgttccgtgctcatcccctgcacccaaacgccctcctctctttctttcaaattttggttgagtttgggcctccaggcgcagatttgcactttgggctcggacaatgtcgcgctgtcgtgcgtttatctaaacgatgccgacgcccccggccctttgaccatcgatgtcgacaccgccgaccaccaacccttcaggttcgcgtttaatatgcttcgcattgaccgtggcgctantggtggggcgggcggtggtcgcattg

SEQ ID NO: 86821 - DNA, 532 bp, Heterodera glycines
  SCN-specific regions: Sequence locations=1-110,132-469,491-532
gttgatcccgaagctcctcgtaaagtcggattgtacatcaagacatcgatgtgttcgaaatcacgaagcatttgctggccaagtattggccaatttgaaggcactcgattctgattggttctgtcagaattatatgaaacgcaaagcaaaatttgggcttttgccattggaaaaagtgaatatgtggggtggctctctctcattgggccatcccttcggcgctaccggcgtccgattgttggcacacgcggcgaaccgactgcaggccgaaggggggcgtttcgcagtgatcgcggcgtgtgctgcaggcggacatggcatgggaatgttggtggaaaattacgagtcgaaacagaagtaaaagagggagacggagggacggacggaattcactcgtcgccatttgtataattgatttacaaatagaaatatcggaatagtgaaaacactaattcaatgggaatgaatgagaaattgtaattataaaaattgtactgcttaaattcttattaaagattacgtgccggaaaaa

SEQ ID NO: 86822 - DNA, 746 bp, Heterodera glycines
  SCN-specific regions: Sequence locations=1-6,30-624,646-746
ggattattgcgttattagtattttttacttgttttctatttgcccattgtatcaaagcatcgttctgctccttcatcgatcacagcaaacggaagtcgtcacacgtggcggcatcatggagaagaagatcatctacttcaagctgatgcaaattgggctcactttggcattcatgtgggaactcctttcacttcaccaattctgcggcacatttgccgacccaaaagccttcatccatgacatctcagttggccattgcgaaagctttacgctcatcggaaaggactcaaaaagcggagaatttggcgctgtgttcgaccaggacaaatggcacaaccaactgtcgatgagcagcaccaatagacaaccaatcgaagaacaggacgaattggccgcgaaattgccttccgctgaacgccattgcattccaattacgatttcgctttttgactggattggcgaagagagaaatcttctcaacaatggcactttgttctttttttccctcctattgtggattgcattttggtcgcttcttccccttggccttaccaccatcatagtgctacactctgcggaagaatatgaaggattccccttttatttcaatgccttcgcttctatcttcttctggtgtgtttctgctgcggtctcaaccaattttctgctttattggacgagcttctggacttgcgtcaacttccaagcggaccacacaaatgtgccaatggtcactttggtgatca

SEQ ID NO: 86823 - DNA, 245 bp, Heterodera glycines
  SCN-specific regions: Sequence locations=1-83,106-155,178-245
atgaagcggaggaacaaaggacaaagaatcagctggcaaaaggaaaagaagaaggtgattctggagtgattgtgccatgaaattcaaaacaacaatttattttttatgttggttaaaaaatacaatcaaaaagaaataaagccccccccctctctctcccccagtcgccatctcccgactcgccctttagttcctcattttattttaactatttcctgcgcatttgccccaattttgctgattgc

SEQ ID NO: 86824 - DNA, 608 bp, Heterodera glycines
  SCN-specific regions: Sequence locations=1-189,211-608
aaataaaatttccttggaccgacaaaaatggcaaaattcgttgccattgctcttctctcgctgaccattgtttcgatggcacttgcaaaaactggcaaaagtcaaacggcagacgaagttgagggatttcgcaatatgaacatcggcgacaacaataaggttgacgccggaaaggagcccgcggctgataaagcaaccaaaaagggaaaagctcagaaagccggaacgaaatcggcggcggccactaatgagcccgcggctgctaaaggaactaaaaatggaaaagccccgaaaaccaaagcgaagcaagaggtggccactaatgagcccgcggctgctaatgaatggaacgaccaattgatgggcatgggcgttgagaaatttaacgaggagcttgctgtgttgttgccaaaagccaacacttttatggaaaatgctttgagcttcatcaatgaacaaatggaaaaaaatggtattgcaactggcgctgccggggactcgtgctcgaccgggatcccggccaactaggagaccaatgccacaggacggcaccggaggagggaagaaaggatgacgagctctttggatgatgaaggtggtggaatatg

SEQ ID NO: 86825 - DNA, 291 bp, Heterodera glycines
  SCN-specific regions: Sequence locations=1-264
tgttcgattgtgtcgaccgcagaccatcgcccaagggctttggcttctgtgaattcaggaccacaaggagctcagaatgcggttacaaatctgaacggagccgagctcaatgggcgtgcgctgcgtgtcaattggaccaacaaataagaaggttgtgcttgaactggacggatgatgatggatggattgtcatttttgaggatcgttttgacaattttcatttttctttgttgattggttttttgaaataaaggaatggttcgcaaaaaaaaaaaaaaaaaaaaaaaaaaa

SEQ ID NO: 86826 - DNA, 233 bp, Heterodera glycines
  SCN-specific regions: Sequence locations=1-200,228-233
catttcctcctataccttcttcccaaatgtccttccttcgtctgatcacttttgttcttctgatcactctgtgctctttgccttctctggtcgaaagcggcctcattggcattgtcggcactcccgttgaagccgcttggtgcggtgttttgggcaaagaatccagccattgccctactgctggaggcggtcaacatggcggaggaggaggaggaggaggaggaggaaatttc

SEQ ID NO: 86827 - DNA, 604 bp, Heterodera glycines
  SCN-specific regions: Sequence locations=1-291,322-604
gaattaaggaggtgttcttgctggactgtgacggacttgttgctgctggacgtaacgccactgtcacttggaattgaaacgcttggtggtgtgttcaccaaactgattacgcgtaatacgaccattcctacgaagaagagccaagtcttctcaacggctgctgacgggcagactcaagtggagatcaaagttttccaaggcgaacgcgacatggcattggacaacaaaatgctgggccagttttctctcgttggtattccgcctgccccccgaggtgttccacaaattgaggtcgcttttgacattgatgccaacggaattgtgaatgtgtcggcacgagaccgtggaactggcaaagaacagcaaattattatccaatcgtccgggggactcaataaagaccaaatcgaaaacatggtacgtgaagcggaaagacacgcagcagccgacgcagaaaagaaagagacgatcgaggcaattaaccatgcggagtcggtgctgcacgacacggagtcaaagatcacggaatacgcggaacatctcaacgcagacgaagttaatgtggtcaaagagaaacttgaagagttgaagaagaagttggcca

SEQ ID NO: 86828 - DNA, 621 bp, Heterodera glycines
  SCN-specific regions: Sequence locations=1-621
cagggttggccggacggggagagctggcaatcgcgggtttgccccacgttggtcaccgagaaagacgccgatttttgtgcccatttggtcaaaaatttcgagtccgccggccttccagtcagtgccgagctgctgcacgtggcgctcaaatgcgcctggtacaagacggaacgtgaacagcagctgcaaggccaaccaattgcgggcggtgccgtcggctttggcagcggggcgcgacaacggacggggcttggctatacggcggcgccaacaatgatgatgggccaaggtgctggcaccgtcgccccgggaataacgaccatggcaaaagcgtccgtgacaaaccctcttggccagtcgtcggggccgtccttctcccaacaggcgaccattacgaagcaaatcgatcgcgccaagtcgttggtggccaccggcaatgtgaagggcatggaccgggtgtcgatgatgcggtcggcgttgaagagcaccttcaaacactccttccaagcggccactgttactgggtcggactattcgttaccagcatctgacccgaggccagaatggaaaatcaaattggacgaacaggcggaaaagatcaaccaatgcatcaacagacaa

SEQ ID NO: 86829 - DNA, 585 bp, Heterodera glycines
  misc_feature (565)..(566): n is a, c, g, or t
  misc_feature (568)..(568): n is a, c, g, or t
  misc_feature (571)..(571): n is a, c, g, or t
  misc_feature (576)..(576): n is a, c, g, or t
  SCN-specific regions: Sequence locations=1-585
cgcttcgcgaatgaaaggcatcgatttcgaaactgggcaacaaatcctttgcccttctaatttgctttggttggctccggctctgatgaacaactcggtggctatgctcggcaccaaactgttttcaaaagcaaaggattggacggagttgcggaggaattgtccatggaaatgcatcggatcggagcacgcaattttggcagggacgaccgaattggcacagtgaatggcaaaagccttctggcaccgttccttgaggagccgttggtctgctggctgaacactttgccgaccgcgttgaagaccggcttcggactgccgaccaatgacggcaccgccaacaaatttttgttgcgcaacgccctccgctctttgggcgtgccggaatgttttgtgcagcggcctaagcgtgcgatgcaatttggcacacggatggtcaaaatggagaacgcggagaatggcgacccaaagttaagagggcccaaatttgcgagaaactgatgctatgatttgctgtgctaatttatatttgttattgaaataatcaattttatttcaaacgacnnanaanaaaanaaaaaaaaa

SEQ ID NO: 86830 - DNA, 746 bp, Heterodera glycines
  SCN-specific regions: Sequence locations=1-467,489-556,582-746
caaattcgacgcctgggaaaaagtaaagggatgccgaaggcagatgctcagcacaaatatgcggagattgtcaattcgttgttgaaaaatgcggggattaacaacgcgaacacttcggaaacagaatcggacggaatccgacggacgaaggagggcaaagtgtacaaaattgagctgaaccgttccgacaaatacaatgccatcacttgggagatgtatgagggtctgatcagcgcacttggcgatgcaagcgccgacagagaaacgagtgtgacagtgatcacaggcgttggttcctatttctgtgccggcaatgatttgtccaattttacgcgcggcgtcaaaacgagcgacgatttgcgtgctatggccgaccgtggggagcgcgtgttggagcgttacgtgcgcgcgttcattgagcatgaaaagccgctgatcggactgatcaatgggccagcgattggaatttctgtcactgttttgcctctgttcgatttggtcatcgcttcggataaggccactttccacgcgcccttctcttcgcttggccaatcccccgagggctgctcctcctacacttttcctctgattatgggcacgtcgaaagcatctgaactccttttgttcgacaaaaaaatgtccgccgaagaagcattggagcgcaatttggtctcccgcgtcattcccaacaacagttttggcaccgaaactgaacggatggtaaattcgctggcgtcccttccgcc

SEQ ID NO: 86831 - DNA, 714 bp, Heterodera glycines
  SCN-specific regions: Sequence locations=1-443,465-504,532-714
gtgaataatcgccattactaaatgtttttttgtcggagattttatcaacttaaaagggaaagaaggaaaagtgagagactaacgaccaaacgaaaaccatcgattcgatcgtaagaaagaaggaacgcatttctctctgttcttttgccgtcccttctccgatttttccctcctccccatttattcatttctcctcccaatttcttcctaaaatgccctcctccgttggcccctcttcctcttccgatttgctcatccgtcttttcctcctcctcgactcggccgttcactttgccctcggcgctttcctcttcttctgtccgtccacctgtgcccatttccttttgaaacgcccttcttccgatggcgtccattggcaccttttgcgctgcgtcggtggccaattgatggcctccgccactctctcgtggcgttgcgcctccccccgccgtctccccgagctgcgttcgtcctgtctgatgctccgtctcctcggcagcgttctcttcgtgttcctcttcctccacatccgtgctgttcatcccgatttgatgccatttcttgtgttgcgacaactcatctggttctgcttttccatgattgctttgtgtgttgcgctattaattgtttcgggatggccaatcggtgataagctttttgctgcgaaccgttggggcaatgtgctgtaccaaattgatacaatcgcttccatta

SEQ ID NO: 86832 - DNA, 701 bp, Heterodera glycines
  SCN-specific regions: Sequence locations=1-75,99-701
acctgcttcgacgtgctgatacctcttcccgacgaagtttttggcctgctcatccaagccatcgtttgggcagtgaaacacacaatgagaaatgttgcggaaaatggagttgacattctccgcgagcttttgaccaaagtctcaacaacgacggacaaagcgcaggcacaatgccttttacaaaaagcactttatggtgatcatggaacatgtccttggcgttgtcaccgattacaaccaagtgaactttgttgggctgacgaatctggctgaaagcgtttgtctgttattccaagcagcagaaacaattattgaagtgccactgaatccgacaaatcccagccaaccgaacatggaatttgtttacgaggctattgccactttattcaccactcatttcaaaaatttgacagagccgcaaattcgagtcacagtcaaagggttcttcagctttaaccgcacagttacaaagatgcgtgaacacatccgagacttcctcgtccagatcagggaagaagccggcgacgacactgcggaccttttcttggaagagaaagaggctgagatccagcgcattcaatcgttaaaacaagcgattcccggggttagaaatccgaacgaattgttggaggaggacatggtctgacaatgcgtccgtcgggtgggctcgtccctgccttccccgtttttgttttttccat

SEQ ID NO: 86833 - DNA, 486 bp, Heterodera glycines
  SCN-specific regions: Sequence locations=1-486
tgggcggctcttacgactggctcggctacttggaaacgccactctttctaccgggactgatcgcaatcaaacgagtgtgtggccgtatcagaccggacctcataccaaagcaggagcggctacatcgaacagactctgacctaccataatctatcggaaaccagcgtgatgcttatgcccatgggcgcgttcggcactgacataggcgcattgcgcgaactagaatactgaccatcgaccaaccttccatgaacatggatgcaagatgttacgaggcactacataataatagtgacaaccaaacatctgaatctggctgcataatcctaactcactacactccacattcatgaatgcgccattgcctaaacttggtaacagcggaccactggtaaacccctagttgactgcacaatatgagcaaaagcattaaaaggggcataatataaatcgaagatgaaaagtaaagttgtttttttggtagag

SEQ ID NO: 86834 - DNA, 708 bp, Heterodera glycines
  SCN-specific regions: Sequence locations=1-332,354-660,683-686
aaagcgcgtccactttacacaccgacgccgaaggtcggatggcaatggccgacccattggccgaggccaaagaaaaagccatgaaagcgaagaacccacatttgttcaccatcgctacgctcactggccatttgatactcacttatggccattgctccgccgcgatggacaacggaccggcgagggcggcaaattacgcggaacaattgaggaaaacgggcgacgaattcggacaaccggtggaagtgtcgcgactgttcagtgaggacttcgactttcactctgcgaaatgcgaagcggccgatttgatgcaatcgaacgctttgccaagcgtgagaacgccacgagggcacatgggcccagcggcatttctgatgcgcgtctcgcgcatcgacgaggctgggcttgactcggcacagccgttgaaatacacccatttggacattggcatatccatgggggagtacccaaacacttcgttcccttcccctctgctcgcacttattgcacaacatgttttgcctaaggtcaagtgaagtttggtgaaagaggctaataattaacgctttggctaatttttaaggggaaaattgcaatccgagattttaaattattaacgacagtgcgcaaataaatatctttattgttccctgtctattcacatctttaaaataaattgttaaatcaaaaaaaaaaaaaaaaaaaaaa

SEQ ID NO: 86835 - DNA, 636 bp, Heterodera glycines
  SCN-specific regions: Sequence locations=1-636
cagcgaatggcactcgccgaagatgttggggacatggcatcactgttggactccaatgggaaataccgctgcaacacctatggattgtgctttgagccaatagacaatgagatttgcttgggctcttccaaccgaattctcattgacatggtgcttgccccggctgaccgtgacgtcacttgccttctctttgccactgctcgttctttttaccaggaacaacaacattccgtcggatcttgtccaaaaattgtaaccaaatgcacggttaacttgcgtcccattgaattcaatctttcggaggagggccgtgaatcgatgtcatctcccatttataatgcccattggacttcgactgaaccgatttggtctttgtgcttcaattcgcaccacatgaaaatttgcgttggcatggaaaaatgtgccaaaatactgaacgtactcagtggacaaaatttttatgtcggaagcggcggaaaaaatgtcatttcgtgtattttttccaaggacggaaataccctttttctgggccggaaaaatgccgatgtttccatgttggacatgcgcatgacatcgaaccataaagtcggcgaattggcccagtcgccctctaccggatacatgcatttgctacag

SEQ ID NO: 86836 - DNA, 606 bp, Heterodera glycines
  SCN-specific regions: Sequence locations=1-292,330-606
ccgttagaatacgccacagaaatttggaatccattgaaaaaagaaaatgtccacaaaattgaagcagtccaaaaattttacaagaaaagccttcaaaaaatgtgggcttgtccccatgccgtatgaaaaaagattaaagttttgcggaattaagacattggaaattaggcgcaaaattaatgatattacaactacttttaaaataataaaaaaacatacacatcttaaaccatctaacttttttgctgttgctaaacgggctattcgcaaaccctttttattacaaaataggatatatattacaaaaataaaaaataatttttttaatagggttattaattcatggaatttattaccgaaaaatattatggaaataaatgaccccaaaaaattccgagaaattgcaaaagaaataattaagcaataatgcatattttccccattgagaggtgtgatttgtttcatttatgtctattgtttttaatttgacacctattctgtgatttgacacttatttttgtgatttttgactgccatttatgttttatttttattctcactttttttctttttacaccactgttagagtgcatagcaccttgtggt

SEQ ID NO: 86837 - DNA, 596 bp, Heterodera glycines
  SCN-specific regions: Sequence locations=1-258,281-418,441-449,489-596
cattcctctgtttaaagcccttttttaatcggaaatgaatccaacggttttttctttgttttagcggtgctctttcttgtcaaagtcgactttttacagtgcaaatacaatgaaccaatggcacgacaggtgctgcaaaagcatgcttcacaatttcagcagcattgtaaaaatgcccgcagaggaagtgccgtggccaaatgttgcagtgccatcagaagcataatgggccgattcacaagccaaaaaaaggcaatgaaccaaatgctggccaagtgtaaagcgggcacaacgccaagcgaagcacagcaaatgcgaagaaaattggaaggatcgaataaactgaaggattgtggccagtttaaaagccaaattcagcacaagttcagcgagttgaagcagtactgcaacaatggggcagaaaatgaggaggaaaacgacgaatgatcagagagggagagagaagaggagagagtagagagagagaggaacagcaaaattctaatcactagtgatcactgataattgccgattgattgaccggtacgactcatttggctgattgaagttttttttatggcataaagagttgcgtt

SEQ ID NO: 86838 - DNA, 362 bp, Heterodera glycines
  SCN-specific regions: Sequence locations=1-106,128-142,295-362
cattggtgggattattgttcggatgagagggggagacatggcctttttcgattttttttgcaacccatatacttttccaacattgtttcagtcatcgtgccatcttttgttttgttacgtatatataaaaatttattggccgaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagtcccttgggggggaccccccttttaaaaaaaatccccggggccccatggggggggggaaaattcaaa

SEQ ID NO: 86839 - DNA, 754 bp, Heterodera glycines
  SCN-specific regions: Sequence locations=1-47,70-199,223-702,726-754
ggtgtggaaatgaagtcgatagaaacaaatattttaatctggcaaacttaaaatacattaaaacttattgaattatctaatttccacagtacttgcccggtacgtttgctgttacccagttggcgtcgcccatttgacattgcccagttgaccccaccattcgtttttaaacttgaccacttccatttatcgtcagaagtactcttaattgtgtttgccctgtccaatatttatcggcaattctgcttttgactttaatccacagctttcaaacgatggctcgtgcgcctgttttcctcaatgtttatgacatgtataagctcaacgacatcgtcttttcgagtttgggcattggagtgtttcacagcgggatcgaagtgtacgataccgaatatgcctacggtggacatcccttccccttttccggaattttcgaaaatacgccacgcgatgctgaagaattgggggagaatttcaacttcagggaaagcattcctttgggcgaaactgatttttctgctgaagatgtgaacaaaatgattcagaatttgggccaagagtaccggggggacagctaccatttgatcactaaaaactgtaaccatttctctgccatccttagcaaggttctaacgggccaggagttgcccccgtggattaaccgtttggccaacatttccggttctttgccatttgtcgagcgatggatccctcaggaatggcttactccaatcgcccttcaacagtcgttgga

SEQ ID NO: 86840 - DNA, 762 bp, Heterodera glycines
  SCN-specific regions: Sequence locations=1-41,63-156,184-238,260 -599,622-725,747-762
actcgggcggcgagaatgcggagacggaggacgacgaactgagcggtgaaggggcggcgggcgatgaggaggagggcgacgcgtcgccatgcgagtgcgttcaatgcgaggtttgcatggccgaaaattggtggcgtatggccgcctaccaaaacacttttcttcaacagcagcagagccaaacggacggcgacacttcgggcgccacgtcagtcaccgattcgaatggcttcgacgtgccctccaacgcgtcgtccgccggcttggatttgatcggctccgccgccacgctcattctcaaccagcagcagcaaatgatacggcagggcgacaccgccgagcccagcgcggacgaccttttgcgagccgacttttccatgccaaaactgcgcgagtttttcgaatgccaaaaagcgatgggcgtgccgaactttcccgaggatttcgatgaattttggctgctcgtcgtcaaggcgcgtcttttcaacgtgttcaaataccgcggccccgaggcgtacaatcgaattgtgctcaaaattcgtgacattgcgcaccaattccgagcacaagtcgaagaaaatgagcacagcgatgggacggagaagccgaaaagagggaaaaagcaaatgaccaattaattaatcaattgaccgaccgatgccaaaggcgaataacggaggcaaaaacagacaaatgaccaaacaataaacaaataattgtaattgttttttaagcattttgtttctcatctctaactttaat

SEQ ID NO: 86841 - DNA, 391 bp, Heterodera glycines
  SCN-specific regions: Sequence locations=1-293,315-391
catttctcctccattgtcttcctttccctctattttgcgctgcatattcatcgtcaaattgtgctgccgacattttctttgactcccaatgtctgatgatgttggtcctcccgctccttccggttccgtcgatgactttgcgcagcgcaccagccaattcctcgacttcatccacggcggaaacatcgaccgattgcgtgcgctgatcgactcgctgagcgccgatgagctgaacaccttgctgcagatgaacgacccgcgcaacggacaacaatttgcactgttgatcgcaattatgaaaggacacacagaaattgctgcacttttgttggagaaaggcgcggacgtgcatcagaccaccgttcgccaagtgaaccatgtgaacatggcc

SEQ ID NO: 86842 - DNA, 630 bp, Heterodera glycines
  SCN-specific regions: Sequence locations=1-630
tcttaataaatggttcgaattttgttggccaacggtggagtcggccaacatcaactccttcaaaaagtgttgaagaagcgattaagcattgcgttggtggagatatttcatcgcagaatgactattcattggttttctttggtcgcaaattaaactccgaccaacgcttagctgacattccgcatttggacggcgagtcacgctcagttcgattagtctgccgaaaattgcccggtgttagcattgaaaagaacctggcggatgtggacaaactgcggtcacaatgccgaactttgtaccagaatcttggcgaggaacttcagcaaaagctggagacatatatggtggacgataacaatgccatattcaattccattctcaaagaccatcccgaacttgtgcatgatccgatcgcccttcccattgtcaaggatttgcgactgctggtgcctgccatcattgagaaccataaatttgcctacgagcgtcctgtttgtgccaagattttgaagaaaactttgctccaattcggcataatgcagcaagggcccgcagattcgtttatggcacaacagggagccaatgggtttccgggacaacgaatgcccgcatttaataaccgagaaaggc

SEQ ID NO: 86843 - DNA, 372 bp, Heterodera glycines
  misc_feature (30)..(30): n is a, c, g, or t
  misc_feature (325)..(325): n is a, c, g, or t
  SCN-specific regions: Sequence locations=1-320
caccgaaaatggcagcaattgaggaatttngaacacatctcctgcttacactacgaaaaggacagctttcaaacccaacgactgttgtgcaaacccaagaagcatcactcaatcagcaaaagatgtggtcacttttgaatgggccaaagagaaagtgcaaatcgaagaacaccgttcgctcgagccttctaagaaggaacacaaatggacaaaaatggaacagaattgaaaagaaaagcaaaagaagaaaatgcattttctttggattgataaagcgatcattcgatgattaatttgtaataccaataaacaatttatgcaaaanaaaaaaaaaaaaaaaaaaaaaaaaaacaaaaaaaaaaaaaaaaaaaa

SEQ ID NO: 86844 - DNA, 438 bp, Heterodera glycines
  misc_feature (33)..(33): n is a, c, g, or t
  SCN-specific regions: Sequence locations=1-340,437-438
ccggaaatggcagtacttgcaccgaaaatggcngcaacttgaggaactttgaacacactctcctgcttacactacgaaaaggacactttcaaacccaacgactgttgtgcaaacccaagaagcatcactcaatcagcaaaagatgtggtcacttttgaatgggccaaagagaaagtgcaaatcgaagaacaccgttcgctcgagccttctaagaaggaacacaaatggacaaaaatggaacagaattgaaaagaaaagcaaaagaagaaaatgcattttctttggattgataaagcgatcattcgatgattaatttgtaataccaataaacaatttatgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaata

SEQ ID NO: 86845 - DNA, 624 bp, Heterodera glycines
  SCN-specific regions: Sequence locations=1-223,245-624
atcgcccgacagcccgtggcgccggagcccgagttgccatggtcgacctggacactcagctgaacaacttgttggaccgtgtcgatactccgcaattcatcatggcttttatgagtatgagccaacaggacccaacgtttttggcaaaggcatttgaggttgtgatggaagagtgtcgtaccaccggcttctccaatccgattttgccccaaagtgccaccattccatctcttcggcctgtccaccgtctgcccactccgctccaccaacaaccgcccggcgtcccttccgcttcgtcgtcagcgcggcatcaatcggcgagaagtcctggctctttgtacctgccgcctccgctgcagcccaaagcgtatgtgcaaggctcatccctgctggggccatctcggccaacttccaccgtttcttacacgcaaattacgccgtacgccgccatccccgaaagttgggttgtcgacgcaccgatacgaaaacagccgaagccgagttcaccggcccgggaatatcgcaccccagtgaatttaccgttcaaagacttcagtcaatcatgatgaaagttatttttattttttcattgccttgacaaaaaaatgtttgtttattgtgacc

SEQ ID NO: 86846 - DNA, 625 bp, Heterodera glycines
  SCN-specific regions: Sequence locations=1-250,272-311,334-421,448-625
caaaaaagatcttatggcccggctgaaaaagctccacggttcagcgttggccagtgccaatttgcgatggccgaacttttcttggcactcgagcacatccatgccctggacgtcatccaccgtgatgtaaagccggaaaacattttgttgcgcgaggacgggcacattttgttgtcggactttggctgtgccaagcaaatcattgcaaagcgggaaaatgtggcggaggaaaatggtgacaaaaccgacggacaaagagcagatgatggccagaaagcagagaaaagtgctgacagcaaaagcagcaaaaaacgggaggaggaggaggcgacaaagctggcactgagacggcggtgctcatttgttggcagtggcgcctatgtgagcccggaggttctgaatggcaaggaagtgacgggtgcatgtgattggtgggcatttggcgtcactttgttccaactgttggtcggccggctcccattctcggccgacagtgagtatttgctgttccgacaagtgctcgcgctgtcctacaaattcccggacaatttcccatgtgccgcggcacgccaactcgtccaagcattgctagtgcttgagcctacgcaacggattggtgctgcgg

SEQ ID NO: 86847 - DNA, 105 bp, Heterodera glycines
  misc_feature (103)..(103): n is a, c, g, or t
  SCN-specific regions: Sequence locations=1-105
aatttcccatttttgcccgctgaaaagaaatcgaccgcttaccgggaaagaatcgaatcgcttcccaaagtgcaccaaagcactttaaagaaacttctgggcnca

SEQ ID NO: 86848 - DNA, 650 bp, Heterodera glycines
  SCN-specific regions: Sequence locations=1-216,238-650
cctttttcttctggcttccttatacttaacctataatataatgggctgagtcggaagcgaaccaattgtccatttggtatgacattggcggaattgtcggttctgtgcttggcggattggcttcagaccgactcggtcaccgcagtcccatcattctcctgatgcttgttttgtccgttccgttgttgttcatctactctggccttggttcctcgcgggttgagcacgttattggcatgtctttgctcggagtgaccatctcgggcccatacaatctcatcgttggcacaattgccattgatttgggttctcagcaagccttggccaacaatgctgaggccctgtctaccgtaactgggctcattgatggcattggctcggctggctccgcattgggccaactttttgtgccgttgattcaaaatgaacttggatggatttgggtcttccatttttttattttaatgaactttctttcatccatgtgccttatccgtcgtttcttccacgacgctcggctcatttccctttcgtttgctccgaggcaaaatggtcgtcggcaagagaacgagccgctgatttcgaataactgaactgaaattgctattgtatttaattcatataatgccaaatatactcttaagtcgtca

SEQ ID NO: 86849 - DNA, 661 bp, Heterodera glycines
  SCN-specific regions: Sequence locations=1-589,611-634,660-661
ccactccgacaaccaatggccaacccaagcgatttaactgtgtttattatcaggagccagcaattaacatcgacgaatggatcaacaccttcaaagaagcatttctccgtgccacttcttctgcttgctacgaaattcaatttgctgttcatgccacgtcgacgtccatggtgccgtttgaagaggtgaacaaacgaaccaacgagaagctgacactgatcagaaaagcatgtgaatatggatgggccatccgctggatgattaaacgacaccaaattggacaaatggttcagtgggaggacgcaaatttggacaatttgaacaatgtcagcattgatttgagtggcgacaaacaaaacattgggccattgtctccacaaaacgaagaaaaagaaacgggacaaatcggcggaaaagggtgccgaaatgtgcttaagaagtgaaataaattgagaaatgatcggctatttttgagattattgaatggacaaatggatctgttaattattttagatgctcatttgctcgttaattttgttgtaattctttcatttctggcatatgtaatttcgcaattctatccgtgccaataatcattttcatgtaatttcgtgcattgaattaaatttgttctaaaaaaaaaaaaaaaaaaaaaaaaagg

SEQ ID NO: 86850 - DNA, 631 bp, Heterodera glycines
  SCN-specific regions: Sequence locations=1-216,238-395,418-456,542-631
acgcatcgtaatgtactaaacttggacaaaaacctggagaacattcgccgaattgaccaattcgcccgcaaagtgatcgaacattgcacccatgcggcactgttcaatttcagcattgagcagaacaaatggctgaagacggaggtggacggcccgctgttcatctacgaacggcttgaccagccgctgtactcgatgattgtcgtcaatcgccagtcgcccaaaaattttgtggaaccaatcacggacgggctgcagttgcgctacgagccgccctacatttttgtgcatcgcgaagatggctgtattcgcggtctttgggtgttcggcgaagacgaatgcaaacgagtttttgacactctgacgaatctgggcatggagctgaagatgaaaagtgccggtgccaccaccagcagccccaaaaacagcatctccgccatcaacaacgacagcggtgccgtcgccgctttcgctgccgcaacgccgccgacgaaaattgtcgctgccgccaaaccgtcaccgccgccaccgtcgcagcagcaacagcaacagtcgatccgcgtcagcagcttcatctcttccaacagcagcccgttcaacaacaccaatcagtacaccaactcgaacaggg

SEQ ID NO: 86851 - DNA, 608 bp, Heterodera glycines
  SCN-specific regions: Sequence locations=1-608
acatccgaaaatttgggcattatatggaatgatgaaatggaagatttctcatttcccgatgtgaaaaattggttcggatatgccatttcaccaaccaattttgttgcacccggaaaacgtccaatgagctcatttagtcctatggtcatctacaacaagcacacggggaaagtgaaatttgtcattggcggctccggcggtgccaaaattccgtcgtctgttgccaaaacagtgttgcatgtgttgtgcctgaaccaaacagtgaaagaggccattgatgcgccagtgttgcacaaccaattcactccgaaccatgttatttacgagaatgggacaccgccgaaattgatcaaagatctaaacgaaaacttcgggcacattatgaagtcgtacgacaacaacaacgtggttgtgcaagctattcatgtggccgatgacggcttcatctatgcaaatggggacttccgtcgtcgaacttacatgcacccggccggcttctaattggcgtggcacggtgccatgaatttgtggacggacccccggagttttctagactgaatatacaatataacaccaccatcaacgcataacaccatagattatagaca

SEQ ID NO: 86852 - DNA, 535 bp, Heterodera glycines
  SCN-specific regions: Sequence locations=1-15,41-213,236-340,362-535
ttttattatataattgcttttattcttttttgttttgtttgcaccaaagaaaatgtgatagaaattgttcagcacaaaacaaagccttcccatctctcagttttaattaatggacaaaagtttgactttgacaagtttggtgcgcatgtttccgattatcgtgctgaccgaaatgatttaattgacaaaccaatggaattcaattcgatggcatttttggaagcaaaaaatgatccaatgttggtgttcgacgaattgatgttcaaatggttggcattctcagaagcagataatgtggcaaaaacaaccgccaccacaacctcctcacccaatggcacaattagaactgtggattttgtgattgattttgtgatgaatgtggccaatgtggacacatttttgtggccaaaattgttgtacggtattgacgagctgcgcaatcagtacaatagcagtagcagtgatcggccattaagctttgcgtatgatcaaaacactcgcaaagtttggctttccaaaggcataatgtcatgct

SEQ ID NO: 86853 - DNA, 654 bp, Heterodera glycines
  SCN-specific regions: Sequence locations=1-276,298-654
ggatggaaagggaccgtgaaagagctgaagatttcgccggatgccttcatgcaatggctcttagctacttacttaggaaccaggttctttttcgctgacttacgaggcgtctatcacgcgtttattccgtgagggtcgcacggaaacgattcgctcgtgtactaacgaatcgtgtgattttgtcagggcgatgttggacccccagcagaagaatgaggaacgtttgcgcttacttcgactcgcggcagaacgccatcagaatttgacacgggatgcgatgtgtgggaagggcgtggacaggcatcttttcgccttgtacgttgtcatgcgccatttggaagagagttcaccgttcttcgacaagattttcccgcctcaatatttgctgtcaacttcacaaaccccactcaaccaattcgattccgagcaggaaggcatttccatggcacagaaattgaagctggtgagtgctggcggcggttttggcccggtcactgacgcgggttacggagtttcgtacatcgttgcgggcgaagaccaaatttctttccacatttcgtcaaagaaaagcgctactaacacgagttcaattcgttttcgggaggatttgaagaagactttgctcgaaatgaagcaattgctaacagttgaaca

SEQ ID NO: 86854 - DNA, 636 bp, Heterodera glycines
  SCN-specific regions: Sequence locations=1-636
gagtgatgccgattttgtgcccttttgtgtgctccaagtttgatgggcggtggtgggagtttcagtgccggtgggcccggaaaagggatgtacacgcgactatacgtggatgtccttaaccagcaccattggatatacaatgctaccgctttcaatcattcctacatggactccggtcttttttgcattcgcgccagcgccgacccgactaagcttaacgatttggtggacattattctcgcggagttcggccgtcttactaagggcgtgtggctggatgaattggagagggccaaagttcagctgaagtcgcaactgttgatgaacctcgaaatgcgccctgtccaattcgaagatttggcaagacaaatgttggcccatggacagaggaaaacagctgacgaatactcggatttaatcgaccgagttgagaacaccgacatcattcgcatcgcccacaaaatgttggacagccgactttcgattgttgggtatggagacttgagaaacatgccgacgtacaaaagcatcgagtcaaggctttgaacactcagattttgttttgttatattcaacaaatttttgcatggaatatacacttatttgtttaataaattgatgatggtgaaaaaaaaa

SEQ ID NO: 86855 - DNA, 753 bp, Heterodera glycines
  misc_feature (644)..(644): n is a, c, g, or t
  SCN-specific regions: Sequence locations=1-753
ccagtttgagagaatgaaagcgtcgcgcggtctgatcgttcgtgattggaaacccgacgtggtttatttggtccaattcccacgcacccataatgtgctcagtccatccccatttgcactcaaattggagacatggcttcgcatcaatgggcttaaataccgcaatgtgaacaacgaattcacaaaggcgtcggccaaaggtcaaattccgttcattgagctgaacgggcgccaatttgccgactccaatctgatcattgatcatttgcgcaaccatttcaaagtttccatcgattcgcgcctcagcacgcacgaacgcgcgttgggtcgcgcattcactattctgatcgaagaatcgctttttcggtgccttcagtacgaccatagcattgactttgggtggttggccaccgaaaatggttgggccgttcacatgagcggattccaaaagtttctgtttcagaagatcaaactcaaaaagttccaaggattttacaaaagcgttttgatggcacaaggctatggacgccattccgagacggaggtggaagaaatcgcgaaaaaggacctgatagcactatcaacgctgctcggtgacaaaaactttttgtttggagaatttccgacaacactcgatgcaactntatttggccatttggtgcagttcacggacactccgctccattcaaaggcgatcaagccaatgcttgagaaaaatgtgccgaatttgttggcatttgtaaagcgcatgaa

SEQ ID NO: 86856 - DNA, 581 bp, Heterodera glycines
  SCN-specific regions: Sequence locations=1-254,281-287,311-409,431-581
aatccgttgttaatgcgtgacgattattttggtcctgcaacaaaaggttcgaatggctctcgagaatttggaagatgaccctgaaatcggtggaactgattatccactcgaaggaatgacgaaagaaacccagaaacaactcatcgccgatcatttccttttcaaggaaggcgaccgttttttggaggccgcaaattcaaaccacttttggcctgcaggacgtggcattttccacaatgctaaaaagacctttttggtgtgggttaatgaagaggaccatttgcgcattatctccatgcagaaagggggcgatgttggcaacgttttgaaacgattgatccgcggtgtgaaaggtatcgagaagcaagttccatttgcgcgtgatgatcgactcggctatctgacgttttgcccctccaatctgggcacgaccatccgtgctagtgtacacatccgtttgcctaaaataagcgcaaagcctgaattcaaaaagatctgcgaggacctcaagttgcaagttcgcggcattcacggagaacactcggaaagtgaaggcggggtttacgacgtgtcgaacaagg

SEQ ID NO: 86857 - DNA, 669 bp, Heterodera glycines
  SCN-specific regions: Sequence locations=1-25,47-52,75-341,363 -543,565-669
actctctattacgactaacttcaatcgtttctcaacaaaatatgaatgtaaataaagaagaggaacgactggaaaagaaagtgaccaaatgggctattatgctaaccagtgaagacaagattgaacatgccttgaggcgattggatcatgttgagattaacttacaacttttgtcttcgactggagttggtaaagcggtgaatgctctgagaaaacatcatcggtggggcgaaagggcggccggattggtgtccaggtggaaggaagtggcaaaggcggagacggcacgcgcggcggaagaggcgcaacgacagaatgaaaatggggacggagacacaacggaagaggaagacgagcgggaggaagaggagagagcgaagagtcaaagcgaagaagggacagacgacgacaacgaggaatcgcgaccgaacccacttgtgttgagaatcaaaaaggaaccgcaggaagaagcatctccaacgaaacacgcagcaacacccaacaattcatcggcaacaaaattactctcacaatcagcaagacaaaacgaagaaacggaagcgaaaaagagacaccactttgacgatgactgcgaaactttcgaggatgagcagccaatcgacgccttcgcctcccaacttgccgctgctgacaaagtacaaaaaagtt

SEQ ID NO: 86858 - DNA, 664 bp, Heterodera glycines
  misc_feature (31)..(31): n is a, c, g, or t
  SCN-specific regions: Sequence locations=1-569,620-664
gtgaaaaagatgtcgagaaatctctgccggnccaagttgagcaaattcttcgcgtggacatgaccgctcaacagaaacaatattataaattggtgctgaccaggaactacgaggagctcagcaaaggcgtgaaaggcagcattaatgggttcatcaacataatgatggagctgaagaagagttgcaaccattgttgcttggtgcgtcaatatgacgaaattgaggaagaaccgcaggcgaggctgcagcaactgttgaagtcctccgggaaactcattttgcttgacaaattgctttgtcgacttcgcgagacggggcatcgggtgctcattttctcgcagatggtcatgatgttggacattttggaggagtacatgcggttacgccgatttcctactcaaagattagacgggtctatgcgttccgatttacgcaaacaagcacttgaccattttaatgctcctggctcacccgacttttgttttctcctttcaacacgcgccggtggattgggcattaatttggctactgcggacactgttataatatacgattcggactggaacccgcaaaatgacctgcaggcaatgagcagagctcacagaattgggcagaaaaaacaggtcaacatttatcgactggtcaccaaagggtctgtggaaga

SEQ ID NO: 86859 - DNA, 706 bp, Heterodera glycines
  misc_feature (670)..(670): n is a, c, g, or t
  SCN-specific regions: Sequence locations=1-36,58-419,441-706
ccttctacgaggatgatgttgatgaggagttcgaattactggaatatttggccaagggcatttatggcgtatacgcggacatcaaagacttcgacatgtcggattcggagaaagtgacaacgcgaaatgcgcagccaaaagtgttagacaccagagatgatggcaaatttacggcaaaatttatcgcgcccagaagcagggagcccgactcggtgttcctccacatatttgggagcaaaaaagatcctcatttgtatttggacgtgtccgaagtgcaatggggcaatgtgtacatttttgacttgaacaaaacggaagtgatcgctgttcggccgcgcagagttgcggatgaattgaggaagttggaagaacgggaccgaccaccggtgaagagggagcaaccaaaaccgcaaccgcagccacaaccacaacctcaacctgtgacttttcaaaaaattctgtccggtttggtttggccaaccactgaaaagtacaccctgctggtgtcatcgcgtgattttgatttggatggacgaggatcaccgatcaaacaacgtgccaccaatcccgacccgaccagagccgagacaaactacaagggcacattcgacgtcaaaatggcactgacggaaaggccggaaactttttacgtgtgggtttcaagtgccanagggggccaaaaacggtttgtcatcccggcttatga

SEQ ID NO: 86860 - DNA, 607 bp, Heterodera glycines
  misc_feature (604)..(604): n is a, c, g, or t
  SCN-specific regions: Sequence locations=1-261,283-298,320-410,434 -564,586-607
tctctctactaactgttgcacatcccaattttactttcttccttagtaagtagggcttggtgcacaatgcgcacttttctgttcatagccgtagtcgggttgatgttggccgtcatcttggagaatgtaaatgcgacagggaaaaattcgccgacaaaggaacttatacatgagcaaggtaacctacagaaccatgctaccggacaatcgccgccagacagtccaaaccataaaaatgaccatgaaaacgagattagtaacctacagaaccgtgctaccggacaatcgccgccagacagtacaaaacgggaaacagaacataaaattgagaaaggaaaaccgtcgccagacagtccaaagtatgatgagcaagccttaaaatggtgaagaaactgtgtggaacgatgatgccaaccatgaacaaacccaaagctgttgtagtagatgtagaaaaaaactgtggtatcatcacgctattattgttgtgtaaaaaacgatccgtttttacctcttttcgggaaaaaaaactggaaaaaattcacaaaaaaaaaaatctcacattgtgcagattttattgaaattagccaattaaaaaaaacagtgncga

SEQ ID NO: 86861 - DNA, 714 bp, Heterodera glycines
  SCN-specific regions: Sequence locations=1-26,48-276,334-335,366-714
acagtcgcaggacggcgccgcaacgacagcagcaacctgcaccagccgagtgtcaccaacacggacagccgaatgatgttcacgataaaggacattgtgcaccaatcgttcagcgactttggcttcctggtgcctggccgtgtcgcccgttacatcggcgttcagggcgacttggacccgctgttgaccggcacagccgtgctcgagatggttctgcagttcttggagtcgcaatttctgcaccagcaacaacagaatgaggacgaggaggacacggaagatgaagaaggagaagaagacgagttggaagaagaagaggaaggagagaaggagtcaaaagagagaggaggaggagggcaacgggatgtgcggactgagcaaggggagcaggacgaagtggcgagaagcaatgcctccgcgttggaccgtttgcgtcgtttggtggcggagaaatacgcggcttttgtggtggaagggacggacattccgcaggtcaaattggacgaggtggccccccttgtggaagcggaacaacagcaggcggtgtccgcggaggaggagcgcaacgtggccaatgacagcggcgtggacacaccgccgacgactgagacaacgacggaggaggcggccgagaataataatcagcccagcagttaaagaatgaagtgccaaaagtgtgatattgaattcaaataaatgccatgccccaagtgt

SEQ ID NO: 86862 - DNA, 615 bp, Heterodera glycines
  SCN-specific regions: Sequence locations=1-499,524-615
catgatctatcgcgaggtgaccgccagttcatttgtcaaaatatccgtcgacggacgcattgttgaccctggatcaactccgctcgggatcaaccggccggatatatccttcacacggccattcacgaggcccgtcccgatgtcaaatgtgtgcttcacctccacagcgcgtcgggtgccgccgtttcgtcaatgaaatgcggtcttttgccactgaatcaggaatcgatggtcatcggacctgtggcgtaccacgaatattgtggaatgctttctgccgaagatgaaaaaacggagattgtcaaacatttgggggacaaaaaagtcattttcttgcgtaaccacggctttgccgcctgcggcgcctccgtggaagaggcgctccacttggcctatcacacgctgatcgcctgtgagactcaagtgtccgcgatggcggcgggcgaaaaaaatttgatatacccaaatgaaattgcgaagaagcgcgcttatgacatcgcacagcacggagccaacggaatgaatcgtacggcatcgggccaaaacggtacaatggcacacacttatgagaaaatgggagacatcgaatggggagtgggcgaattggagtgggag

SEQ ID NO: 86863 - DNA, 595 bp, Heterodera glycines
  misc_feature (34)..(34): n is a, c, g, or t
  SCN-specific regions: Sequence locations=1-7,29-257,280-417,440 -448,488-595
caattcctctgttaaagcccttttttaatcggantgaatccaacggttttttctttgttttagcggtgctctttcttgtcaaagtcgactttttacagtgcaaatacaatgaaccaatggcacgacaggtgctgcaaaagcatgcttcacaatttcagcagcattgtaaaaatgcccgcagaggaagtgccgtggccaaatgttgcagtgccatcagaagcataatgggccgattcacaagccaaaaaaaggcaatgaaccaaatgctggccaagtgtaaagcgggcacaacgccaagcgaagcacagcaaatgcgaagaaaattggaaggatcgaataaactgaaggattgtggccagtttaaaagccaaattcagcacaagttcagcgagttgaagcagtactgcaacaatggggcagaaaatgaggaggaaaacgacgaatgatcagagagggagagagaagaggagagagtagagagagagaggaacagcaaaattctaatcactagtgatcactgataattgccgattgattgaccggtacgactcatttggctgattgaagttttttttatggcataaagagttgcgtt

SEQ ID NO: 86864 - DNA, 664 bp, Heterodera glycines
  misc_feature (573)..(573): n is a, c, g, or t
  misc_feature (612)..(612): n is a, c, g, or t
  SCN-specific regions: Sequence locations=1-40,62-664
catcgtcgatgcgtacggcatagtccactaccgggagattaatccagccccctacacaatggtcacctttccctttctgttcgctctgatgttcggtgatttgggccatggattaattatgtttttgttcgccctgtacctggtgatgaaggagaagcgtttggaggcacagcgaataaaagacgaaatttttcaaatgttttttggcggtcgctacgtcatctttcttatgggattgttctccatttacaccggtctcatctacaatgacgcgttcagcaagtcgttcaatctgttcggcagttcctggctcaatccgtaccccgtcgacatacttgagaaggcggacccggagcaaattcttacattggacccatgggaaagttatgcttcgtcaccctacccagtcggtgttgacccggtgtggaatttggccgagacgaacaagctgaacttcttgaactccatgaaaatgaaggcatcagtgatcatcggcatctctcaaatgacttttggtgttgcgctcagttactacaatcataagtattttggctcggatttggacatcaaatntacgttcatccctcaaatggtcttcctttcctgcatctntatctatttgtgcttgcaaatcattgccaaatggattttctacgatgcattg

SEQ ID NO: 86865 - DNA, 659 bp, Heterodera glycines
  SCN-specific regions: Sequence locations=1-659
ggacatggaagtgttgaaggaggaagtccggagacggacccggactattgggaaaagctattacggcaccatttcgaacaagaacaggaggtggagcggatgaatttgggcaagggcaagcgtgtgcgaaaacaagtgaactatgccacggaggcattgcaacaggactggcatgccgggactccgggacaggaccaagactattccgattcctattctggtgcctccgaccatgatggttctggcagcaacgaagacgagtttgactctgcgcgtgaggaacggcgccgtaagcgagagagagacagcgagaaactgccgccactgttggcacgagttaacggacagctggaagtgctcggtttcaacccgcggcaaagacgcgcctttttcaacgccgtaatgcgctggggaatgccaccccacgacgcgtaccaatgccaatggcttgtccgtgacttgaagggcaaatccgagcgggcttttaaggcgtacacttcgttgttcatgcgtcatctgtgcgaaccgggagcggattcacaagaatgcttcaacgacggagtccctcgcgaaggcatcaatcgagtgcaagtgttgacacgaattggcataatgtcattgatccggaagaaagtgcaggaatttgaagcaatcaacgg

SEQ ID NO: 86866 - DNA, 696 bp, Heterodera glycines
  SCN-specific regions: Sequence locations=1-673
cagacgttgaacgtggcatttggatgtacgaacaatctattctctcctctgagctcatccttcctacccagacgttgaacgtggcatttggatgtaacgaacaaatctattctctccgtctgaactacatcattcctacaccagacgttgaacgtggcatttggatgtaacgaacaaatctattctctccatctgagctacattcttcctacaccagacgttgaacgttgcatttggatgtaacgaacaaatctattctctccacctgagctacatccttcctacaccagacgttgaacgttgcatttggatgtaacgaacaaatctattctctccatctgaactacatcattcctacaccagacgttgaacgtggcatttggatgtaacgaacaaatctattctctccacctgaactacatcattcctacaccagacgttgaacgtggcatttggatgtaaccaacaaatctattctctccatctgaactacatcattcctacaccagacgttgaacgtggcatttggatgtaacgaacaaatctattctctccacctgagtaaactgtttcgtagtgggcgcgtctgtttaccactgtcttttttttatggtcgtgtgaactgcaattgacctggaattatgattttctttattcgataaaacttaccatcaaaaaaaaaaaaaaaaaaaaaaa

SEQ ID NO: 86867 - DNA, 667 bp, Heterodera glycines
  SCN-specific regions: Sequence locations=1-133,164-667
ggctctccttctctctttttgtgactctctatattccgtcctcctttccttttacttccaccaatgcccctcgtgcacaattgcatcgctggcactcgccattccctcttaattgttttgggcctcattatgataatggccaattgtggacaagcgatgcggcagcaggcggtggccgtacgtggccaactccgttgtgggaacagacccgcctcgggggtcaaagtgaagttgtgggacgaggacgacgggcccgaccccgacgacgtgcttgacgaggcgtttaccgactcttctggctccttccaaatgagagggtcgacacgcgaactgacaaacattgaccccgtgctgaagatttatcacgactgtgacgatgggataatgccaggacaacgcaaagtgaaactgcgcatccccagccaatacatcacaaacggagggttggccagacgaacttttgaagtcggagtacttaatttggagacagtctttgctggggaggaaagggacttcatttgaacatggaggggaagaagaactggcgaaatgaaagctgatttattatcacatacagtataatcagtcattccatttgatattctttgtataccacattcgtattcagcaaaagaatgtagaaacaataataaactatacaatttgc

SEQ ID NO: 86868 - DNA, 721 bp, Heterodera glycines
  SCN-specific regions: Sequence locations=1-721
catgacgaacttgccctacccaaactcggcccttccctacccaaccgccgatccgccctcgcacataatgccacagccatcctcctacactccgatgccgcaaccgggaaattatcaggctccatatccaaattcatacccatcggaccccatttcttacccaactcctgccacaaatgtgacgccacaatccgatggagtgtatccctatggaaccgggactatccaaccaacccacattcatgccagtttgcttagtgcggtcgaggatcgaattcgacaacgacttcgagacaaaattggcactccgtttgctgagttgcaatccatcgatgtgaacctgcaagaattgcgtgtagggaaacaaaacttgcgcgatatgctcgacaacattgccagagaccaacgcgaattggagcgggttttagacatttatacggataaaaaggaagagctcgaaagtgcgttgaaagtggtcgattcaaatggcactacggacaacggagttgcattcaacgaggaacaggcgatcgatgcacaaacgcccgtccatcgacaaatactcaaatgccatgtgcaagacagtgccattgacgacaccatttaccacttgggccaggctttgcaccaaggggccgtcaatttgcagacctatctgaaatatgttcgccagctgtccaaacaacagttccaacatcgtctgttgatgtacaaatgccgg

SEQ ID NO: 86869 - DNA, 694 bp, Heterodera glycines
  SCN-specific regions: Sequence locations=1-568,590-666,689-694
ttgcttttcttttgctcgttttggcaagggattcaaggctcactttcagttgtttggacgggtgcgaatgtgacactgatgacgaggccatccattgtcacaatcgtcccgatcggcactttgtccaattgcccccgtcgcgtctccgcggtttcactgtgctcgcgctcacccgcaataacatcgatgtgctgcccagcgaagaagtactggctcgagaaactgcccgacctgaaggccgttgacgtcgaaggaaatgaacatttcgactgtttcacgctcgaccattatcggacattgatggtgatgagcgattgcggaaagactcctgaacaattggaggccgaccgggccaaactgccgacggacacacagccaaatgaggattgcgacttcgaatgcgtggcgaaccgacgcagtcgcgagttgcgcgagtacgtcaaacacttgtgggagatggtcaaagagaaggtgagccgactggccaagaagcacggattggacaaagtggtggacgacgtgggcaatttcttcgacgacgtgggcgaacgcatctccaacatcaaactgaagaagaagaaatgagacggacggacggaaggaacaaaagagaaaaacaccaaaaaaaattggaaaggaaattgaaagattgccatttaaatcgacgagttcagaacttcctgtccattttgct

SEQ ID NO: 86870 - DNA, 694 bp, Heterodera glycines
  SCN-specific regions: Sequence locations=1-168,190-694
ttgaaacggcgatgagaaagcacaggagacaattaacaggtgctccttccgctcatccgtcttccccttgcccttcctctttgcttcccccgcccgtctcgtctctctccgtcccattgcatcaccgatccagcatttctggcggcgggtcccgcccaattgccattcggaaagggccccaaggcttcggattttccatacgatccgtccgcgtttatttgagcgaaatgtccgagtattactccattgaacatattgtggccgctgtgcgcgagggttcgcccgcttgggaagccggtctccggacaaacgatttaatcacgcgcgtgcacacccaatcggtccacaacatgactcaccccgaaatgatgcgccgtctcctctcctgcggcaatgaactcactgtccatgtcgttccattgtccagcacctccataaaagagggcgaaccgcgtcgaaacattggcaaacccttgcgcaagaagccgcgacggccgccaaccgcacaacagaaaaacaaacaacagagtcgcaaaggttctgcacttctgcgacgactcagcggcaaacggacagtcggagacatcgttcccggcacttcgtctcagaagcaaatgttcattccccgttccgtgtcctcccaagaagggagggctcaacctttcaacagttcgacttcgaaattggagtaaat

SEQ ID NO: 86871 - DNA, 679 bp, Heterodera glycines
  SCN-specific regions: Sequence locations=1-679
ccttgtcgcagtgcggattctttgccaaatgttgcaggacctcaacgtggaagccaacggactgagtgaggactttatgttcgacatgaccaaggcggagattccggcggagactttcaaaaagattgtctcttggatggaggaacacaagggtcagccggtgcctgaattcgaggaggatccgaacactttcgagcgcaaatggctcacccaaaacgattttcagcagaatttcttcaagtgtgaatttgcggaggccgccgcgtttctgaacgccgccaacttcctcgacttgcagtctctgttccgtcacgcaacgcaggcggtggccgcgcgtattaaggaccgttcgccggaagagattcgtgaaatgctccacctcaacgacaaggaggacaaaccgttgacggaggaggaaaagaaggcgattcgtgagaagaatgtctggtgccactactgattgtgatgcgattggccatgcgattccttccctttaccatttatgcctcaacaaacatttcaccgacggatgcccccccccccccgccaattgttttcttcagtccgttaattatttctcttgccccacaaattttgctttctgtttgccttattgtcctattgcgtgtccaattattgttaggattgtttttgaaaaaaatctataggttaaagcctt

SEQ ID NO: 86872 - DNA, 618 bp, Heterodera glycines
  SCN-specific regions: Sequence locations=1-575,597-618
atcccattttcgctccgtgcgcccggcctttctttacaacaaaatgccaatcttacgtccaaacaaaagaaatggaccatcactggatgagttacacttggccgatgggattggggccgaatgttttgctgatggaactcatggggaacggaggcgcacttctcggcatcaaattccatccgtttcaatggaaaaatcgaatctccccagcaacaaaaacacgtggtgcactccgtccagattgatctgcaatttcgaggaaagcattctcaacggacgcatcccagcaaatagtgttgtcagcggtttccgtctccaacttacggtcatcggtaacggagtgtctacggacaatcgcctttcattcccggcaagcaaacgcctgacattgccagtgcttacttacttcttcaacgatttgatgtctcaacattcgggacggtttccagtggcggttccgccttcgccgttgcatttggctcgctgcgagttggcggcggagacggttcccattccgaaacggtgcacactgcaaatagtgctcttacgtccgtgcggttcggtcgttaagctgttcatggtcgcggtgaatgtgctcgacatgccttccaattcgag

SEQ ID NO: 86873 - DNA, 712 bp, Heterodera glycines
  SCN-specific regions: Sequence locations=1-31,53-712
agtggactatgctaaatgtgtaaaattaaaaataagtttggtttttgtgttggcacatgtggggtttaaagcgtggggaaattccttaaaaatggtcaactttaattgatcagccaattcatctgctatcaccgcctcagcttccctctgtagcactttgtcttctgttgctcggttcatcaaccgtttttgccgttcggcggacagtgtcgtgccgccggtggcggaggacgaattggtcgtcgtgcccggcgtaaccaccggcgccgatttgttgtcccaaattttgttcgaccccggcgactttcttttggtgccctcgcccttttattatcgtttcgtcaatgactttggcgagcgtggctcggtgcacattggctgtgtgccggcactgtccgaggacggcacgcgcacagaactgcgagcggaacgctttgaagaagtgtaccaggaaataatgcagcaccaacagcagggaaaagtcagggccattatgctggtgaatccgcaaaatccggaggccggctacttttccctggacgaaattcggccggtcgtccactgggccctgagtcgcaatttgttcgtgcttttggacgaaatttacgatttgtccatttacgacgaggacagcgaatgtccgtttcgaagtgcggtcgaactgttcgaagacgaacgcagccgacagaagctgatttggctgtggggactg

SEQ ID NO: 86874 - DNA, 603 bp, Heterodera glycines
  SCN-specific regions: Sequence locations=1-515
attcgatgtcggacgaaagaaacgctaaaattttgctttttgcaatctctgaaagaggcgtgccaactcaaacttggttctaacattgctgcgtcgatgactaaggatgagcatggtcgactatttgacggcttatgcaacgacagatttaacgacttttggatggtcaacgacaaactgatgggactccgttcatcatcaggcgaagaacagtttagcactattcccgcccgattttatgagtcatcatattcatttcgtcaattgcttttacattccaaaaaacaacttgacgatggcaatatgggtgaagtgttgttgattgacgcgctgcacaaagtgtttcccgattatgccattgaaacagactttgaagcggtgacccatggcattctgttgcccctcaacactccgctcatttggctggctagaaaccttgtgtaccctgacaattttgttcacattgtaatacgcagaaaaactgctccatttgataagaattcaaagaatttgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 86875 - DNA, 623 bp, Heterodera glycines
  misc_feature (611)..(611): n is a, c, g, or t
  SCN-specific regions: Sequence locations=1-38,60-455,477-478,500 -508,531-573,595-597
actaaatccgaagaaatccctccaaaatgtcttcttccccgtccgtctctgtgctcgccgtcgtcgcaattgtctgtttgatgtgccaatgttgcttttcggcaccgcatccgtgctgtcccggcagtcaaaaagtggtttcacttatgtccaattacgttggcacttttgccaattccatttccaagtcatcgctttgttcggatgcccaaaatgttgcggacgcgttgaaaggccaactgatcggctgctccgcttcttcccatgccagcaacaacagcgaatggcagacattgagtgggcagtttggtcagaaagtcactgagattgactcgaaatgtgcagagtttggcattagcattggcaaagtgcccataaacggtcccaagggtgtccatgttcaaaatgtgcccaactcggaaagtgtgatttctatgcctggattggccggctcacacacccaatgaatgctgaaccgaaataacattgcttgaaattagatgatgaattgagaagattattattatttttgatatttatttgtagttggacatgaagttagtgaacactctttttataaataaattaaagcaatttaaaaaaaaaaaaanaaaaaaaaaaaa

SEQ ID NO: 86876 - DNA, 518 bp, Heterodera glycines
  misc_feature (450)..(450): n is a, c, g, or t
  misc_feature (454)..(454): n is a, c, g, or t
  SCN-specific regions: Sequence locations=1-451
ccatggaattggcgattatttgtgcccaattttgcccaaaacgggagcccgacagcaattccatcattgacccgtacatttgtgtcaaatttttggcgtcccacgcgatgaacgcaaagcacacacgcgcacattacggaacaacggtttcaacccggtctggaatgagtgcttttccttcccactttgttgtcccgagttggcaattctccgcgtgtgcgtcaaggactttgaccggacaagttcggacgactttgtcggcgaattttctgtgccagtcaacagcattcgaccaggttactcgcatgttcgcctcaacacacatcgccaacatacgcctgatgaagcggcttcaattcttattcgaacagccttttcatgatcaaacacatccatttttgcactcaatgtttccagtgataatttgcttcctaaattttttttttcgcngaanaaaaaaaaaaaaaaaaaaaaaaaaaaaaaaaaaaaaaaaaaaaaaaaaaaaaaaaaaaaaaaaa

SEQ ID NO: 86877 - DNA, 584 bp, Heterodera glycines
  SCN-specific regions: Sequence locations=1-504,526-584
cctttccgaaatgcgtgggaacaattcgggcgctgttcgtgttcttgaggttgatgagtctaatttgcttcgctggagccttatgctttatccggaccgtgaaccatacaacaaaggtgcttttcgtgtgaatgttgattttccaactgagtacccattcaaaccgccatccgtgacattcgcaaccaaaatttaccatcctaacatcgacgataagggccaagtctgtctcggcatcattctcgcggagaattggaagccggcaacgcgtgcagagcaagtgatgaacgcgctgctgtcgctgattgccgagccggaaattgctcatccgttgcgctccgatcttgccgaggaattccaacgggacaagaagaagttcttcaaaaatgcagaagactacacgaaaaagtatgccgaacgtcgcgactgagtttgtttggacagatggagttatttgtgcatgaaagtcccgctggtatctacgaataatctctcgccactcaaattgttcaatttataaattattgtgttttgtctgtcgttgattattttaacttcgtatcgatttaaacttgaagaaaatt

SEQ ID NO: 86878 - DNA, 721 bp, Heterodera glycines
  misc_feature (683)..(683): n is a, c, g, or t
  misc_feature (686)..(686): n is a, c, g, or t
  SCN-specific regions: Sequence locations=1-525,547-721
ggagagtcgcggggtacaaataacaggaagaacatcgaaagcactttgaaatatttggaccatcgggagaaggcggggtaccaactaaaatgtgtccagttttacccggacaatgggtctaacccctttgaactgtgcgtgtacatctcggaagcgggcgacaacatttatcactcagttcccacgagcatcgacgaaattgtcaaacaaattattcgaagcagaggaccaagcggaagcaatttggagtacgctttgcgattggccgactgtcagcggagaatggccccgaaagtgtgggatgaacacctctttgaaattgagcaaagactgttgaaagaatgtgagtatttgcgccatgaagacgaaattctggagaaattgaaccacaatttaagctatttggtcagagagcgaaataattctgaagcgtagagatttcgtcccagtgaagaattcttgagaaattaacactgattcggatagttcttgttaggcgcttcttactggtccaattcactggtcttaaaaactccaaaaaacttaagcacaatttaataacataaaaattttgggaaaactcacattaaatgaagcccgactatccctcctcttctgaatgttcaactctcttaatttcgttgaccagttacttgaccatataattgtgaggatttattggngtntgttcatatgtacgccttacgttgtcactcactca

SEQ ID NO: 86879 - DNA, 256 bp, Heterodera glycines
  misc_feature (138)..(138): n is a, c, g, or t
  SCN-specific regions: Sequence locations=1-256
acagatgggcgttcggcgagtcggacggtgactttctgcgcattgaggaggcactgtacctggctgaacttggcgccgccgttgtgctgaaccacaccgtgcaccgctcaccattccacatattttctcactgatgtngctcaatgaatgtgtcactgtttaagtatgcagtgtatgctcagcttgtccgtgccggttatgttgttcggcggccgtctgacgcatccgtcactgatgacgcgtcctcctccgcgtc

SEQ ID NO: 86880 - DNA, 683 bp, Heterodera glycines
  SCN-specific regions: Sequence locations=1-683
tcacgcgcaaatgacagcggaattgctgcgcaaagcgatgaaaggctttggctgtgacaaaagcaaagtgatccaagcgttggtcaactgcaacaatgcacaacgccaagaggtcatccgcacgttcaagcaaatgtatggcaaggaactgatcccggagttgaaaagcgaactaacaggcgacttcgaacacttaattattgcacttatggaactgccggcagtgtacgacgccgcacaattgcgccgttcgatggagggacttggcaccaaagagcatattctgatcgagattatgacgacgcgaccaaatgcgcaaatttatgccgtcaaaatggcttatcgccaaatgtacaactcggatttggagcgtgacatcatcggcgaaacttccggctatttccagcgtctgctcatttcgctgtgttccggcgcgcgtgatgagcaaatgcacaccgacccaattaaggccaatcaggatgcccagcgattgtggcgcgccggtgaggcacgcctcggcaccgacgaaatcgccttcaactctattttggcggtgcagaactttgcgcagcttcgcatggtctttgacgaataccaacgacagcatggccattccattgaacaggcaattagcaacgagtttagcggtgacattcgtgatgccaatttggctttggtgaaga

SEQ ID NO: 86881 - DNA, 121 bp, Heterodera glycines
  SCN-specific regions: Sequence locations=1-20,42-48
tggtctgcttgcacacgaactgagtgataccctgcttccggaaaagccctaagcttcagctatagacgaccgtaccgcaaaccgacactggtgcgcgagatgagtattctaaggcgcttga

SEQ ID NO: 86882 - DNA, 723 bp, Heterodera glycines
  SCN-specific regions: Sequence locations=1-723
gtggtgtgcctctccaatcgccaacaacacaccgtttgttctgcaaagctaggccgttgcctgatggactgccggaagccattgaacgcggcgatgtcaacccgacggacgacccgaaaaatcgtgctaaaatactcaccgagaaattcgaaatggacgcgaccgactcgcgcaaaatttggtgcttcggaccagagggcactggtgccaatttgctgattgacgtgacaaagggtgttcagtacttgaacgaaattaaggattcggtggtggccggtttccaatgggcaaccaaggagggtgtgctctgcgatgagaacatgcgcggcgtccgttttgacatccacgacgtcacgctgcacgccgatgccattcaccgtggcggtggccaaatcattccgacggcgcgtcgtgttttctacgcttcggtgttgacggcaaaacctcgtctgcttgagcctgtctatctcgtggagattcaatgtcccgaagcggctgttggtggcatttacggagtgctgaaccgtcgccgtggtgtcgtctttgaggagagtcaaattgctggcacaccgatgtttatcgtcaaggcacatttgcccgtcaacgaatcattcggattcactgctgatttgcgctccaacactggtggtcaagcgtttccgcaatgtgtgttcgaccattggcaagttcttcccggcgatccgtttgatggcacttctcgtc

SEQ ID NO: 86883 - DNA, 558 bp, Heterodera glycines
  misc_feature (556)..(557): n is a, c, g, or t
  SCN-specific regions: Sequence locations=1-296,318-342,365-459,486 -513,535-558
ggagaaaagtgcgaagcgggcgacgcgcggacaacgccaaatttatgaagaaaacagcagactttgttatgctatgtgctggccagcatttgctcttccgttttggtgttctctctcaatactttctttttctgccgcaaaagggcgcgtggattggactcgcgttaagctctgccagtcaagcattttctgtgattcttatgtctatgatgatgaaaaccgtgcggaatgagcgtaatcagctggtcgatgctgggttggacctcaacgatccgaatgcgtttggagagtactgcaaagacatcgtcattctgagtgtgtctgcacagcttctgagtctgatttggaccggcttcttcttcgtcctgctgtccattccctttttcacactttacaaactttggacgaacattctcggcccttggttcttcagaccgactcttgacgacgatgagaaagaggacaagaagaagcagaaaaaacccaaatttgtacatgtgagacgatgaccaattgctgttgttgtttttgtttcataaactcccttataaacganna

SEQ ID NO: 86884 - DNA, 587 bp, Heterodera glycines
  SCN-specific regions: Sequence locations=1-221,244-356,378-587
aaatcaaaaaaccggaactgattttgtagctggaaatgcccggggatggcgtccagaatttgctggaagaagcgtcgtcagaagcacacaaagccaacctaaacagtggaataattcatcaatgtcctttaatgtggagaaaagaggacgagtaagcaaaagcaaatccatgtcgacaactttggaaaacgaatcaaacgatgaagaaggaacaatgaaacccgcaaagagagaccaaaaccatcgaaactcaacgaatgacttgcgaacaacttcgactaattcggtttccaacggagaatatgccgattgtgatgagatggaattggacgagccgttctctgaatctgaaggggaagactttccacaagcgaagggcgttgagaagccgtgtttggtcatcccccgtggacgcatccgctcgctttccggtacaattccccccgtgggctttgcgccccattggggcgggccgacgatgtgtttgagttgcttccaatttttccaattgcctgagatgatttgcgagttttccactcatctcctcactgagcatcaaatctttatcgatgggatggatatattcg

SEQ ID NO: 86885 - DNA, 699 bp, Heterodera glycines
  misc_feature (630)..(630): n is a, c, g, or t
  SCN-specific regions: Sequence locations=1-229,253-699
ggtttgggaacacactgatgtgaaatggtcttcccgttgggactatattctcgactcaatgcctcatacaaacattcaatggttttccattatgaactcactcgtcattgtcattttcctttccgggatggttggaatgattctcctcaggactctccatcgtgatattgctcgctacaaccgtcttgacgaagaggaggatgcgcaagaagaatttggatggaagcttgttcatggcgatgtgttccgcccgcctcgccatgcgttgcttctttcagtgttcgttggtacgggcagtcaagtgttgctttgtgcttttatcactcttgcatttgcttgtctgggatttctttcgccagctaaccgtggctctttgatgacctttgcactcgtttttttatgttttgttcggagttattgctggatacgtttcctcaaggatttataaaacgatggagggcctcgcatggaaatcaaacatccttctcacgagttttcttattccgggaattatctttggagtatttttcgtctcgaatttgatgttatggtctaaaggctcatctgcagccgttccttttggcactctgtgcgctctgctttttctctggctgttcatttccatccctntaacttttgtcggcgcttactttggattcagagccaaacgaattcaagcgccagtcagaacgaaccaaa

SEQ ID NO: 86886 - DNA, 638 bp, Heterodera glycines
  SCN-specific regions: Sequence locations=1-490,513-561,583-638
tacctattacctaaatgtcgcacgggaaaattcgaatttgcctgaaaagaaccttaaattaacaacttttttaacaacgacagaacaaagccaaaacaaaatagcaaaaggagacagtgaagtgtttggagaaggaatggacaatgaacagcagaagaaaacgcatagagaaagaagcaaaagccagtaaagtgccgaatgtttggttatgtgccctttgcatcattcagcaacgattggtccgcccaattctctcctccgtttgcttcgcccacccaaccgaaaagtcgtccctcgtcctccaattctcccccctcggcagcagaagaagatgaaaatccgctgccagccgcgttcagaattggcaatgagtcggagagcagtgacgagagcggcgcggaaaggtcggaacacgaggaggaagtgatcagacgaagcaaacagatcaggaatcgagaaagatgggaactgctcaagtacaaaatgttgatctcttcgtgctgcactccgtcaaaaaaccccagtaaaaatgacaacgaattgcctgctaattgtaagcacgaaacggcggaggatgaggagcagtgggacgaggaaagggagcgcgagttcgtgttcagtttgttgtaacggaagag

SEQ ID NO: 86887 - DNA, 668 bp, Heterodera glycines
  SCN-specific regions: Sequence locations=1-114,136-668
tggagcactgtgccgacgcgtatgttggcctggcgcggcatcgagcacatccaatcgttgcgcgacaaccccaatttgtccgcccaactcggcgttccgttgggctgtgcccgttcctccggcctcccttcactcagtgccaaattcgccgctgccgtacgccatgacaccggcggcatgtcaccctcatcatcggccatgcctaccgcgcaacagatgcgtgccgaacagtcggccaaattggcgatggcacacgtgcgacggggtgccgaactgacgcgtgacaacaaatgcttcgaggctatccagtgcttcaacaaggcgctcaatgtgtatgagcactgtgccgacgcgtatgttggccgtggcgcggcatgtgccggctgtcgcaattttcccgccgcgcttgccgacttggagcgtgccgtccaactgcagccgaaccaccggaatgccaacaagtacaggctggaggtgttgcacacttatgccaaggagcttgaacgtgatgggaaattggcggacgctcgggccaagtttggccaactgttggcactgtgccccgaccaccagggcgcgctggacgccattgcacagttggacaaaaatgatgacaacatcggcgacacggacattgaactcgtcgagctgagcgacgacgaacacac

SEQ ID NO: 86888 - DNA, 505 bp, Heterodera glycines
  misc_feature (485)..(485): n is a, c, g, or t
  SCN-specific regions: Sequence locations=1-137,159-483
ggtcttacccctttgtcgtctattttactctgatacccgacccaattttgctgaatttaattgtgttcacttattactccgtcctttctctagcaacgctttgattgaattgactttaatgagacgtcatcaaattttgaagaaaaatgcattgaaaattttggcaaaatttcttccaaatcgctgcttctccaataatcgcatcactgacagtggcaaaagtcagaaaatggtccaaagaattgacgggcaaaagcggtgggaaaagcgacagcaaaaaagagacaataaaagcaatgaaatgacggaaatgcactttaaaaagttgaaggaacagtggcaaaagtgaaaaggaaatttgtgaaaaatggaaatgataaaagaaaaggaaaggtgaaaatgaagtggacaaaatctaattgatcattctgataatcgtttgaccattttattattgacttttggcgaataaaactaaaactcanaaaaaaaaaaaaaaaaaaaa

SEQ ID NO: 86889 - DNA, 705 bp, Heterodera glycines
  SCN-specific regions: Sequence locations=1-143,175-316,338-705
tgggccgaatttgccctcatcgctttttcctgttgacgaacattctctggttggccccgatggcgagtcgcctctgttcacccaccgaatcggcaaatcggcgccggagggccaaccgggcgaaaatggcgcggcagtgacactgacgggggaggaggcggctgaagggcggcgccaaatgagctactggttcatgaacgtcaaggcaagcgacaaaatgtcgctggaccgcgcagtgccggacgtgcggccgaacgcctgtcgctcgctttcctacgatttggccaatctcccttccgcctcggtggtcattgtgttcactgatgagcccacttccgtccttttgcgcaccgtccattcggttttcaatcgttcgccaatgtctctgctgtgcgaagttgtcctcgtggacgacttcagtcagagagaggagctcaaagctccgcttgtcgcccatttgcgtcgcttcggttcgcgcgttcggctccttcgagcgaacgaacgtttgggattgataagggcgaagatagtgggagcgaaatacgcccgcggtgatgtcgtcctatttttggactcgcattgtgaaacatcgccgggatggctcgagcctctcctccatcggatcaaagacaaaacggtcggctgtcgtttgccccgtcatcgacatgacttctgactcttcgatgcaatactcgggcggatcag

SEQ ID NO: 86890 - DNA, 696 bp, Heterodera glycines
  SCN-specific regions: Sequence locations=1-615,642-696
ggtaaaagttggctaaacgcttcctccggcgctctcggttttcttgattggatggtaagttgagcaaatgagtaacgaaggctttgaatgaatccgggccgagaaggatgagggaaaaaagtgcgcttgaagcatcactcagcaaatccaactcgaagctgtactccatggccaattgaaacattttcggaaccaaggccagaagacgttcagtcattgtcgcatatttccccgttttcttcacggagtcttcgacacaatttgctgccaatccgttgacaatttcgagcgcagaacggactctgtccccgccgaaagagtagtcgagagcggctttcacacaacgcaaaatatcgtcgagcatttggggcggactttgggcaattccctcggcggcgatgtccgaaacaaaaatgagcagccgaaagaaagaggcgcacaaatgcggcacattcagcaactcctcggtcatcaacggcaacaacagctccaacccatgcatcgaaattttctccctccccgccaaacattcggactccgtaacagaaagaggcggcacataggttttcgagtggaagagacaaaggatttcgatcagcgagctcaaatcctgtgtctgctgctcctcttcactgctgtcaccgcgcagcacaaaaacaccggaacgaaagcgatggaattgcgtttgcttgtagg

SEQ ID NO: 86891 - DNA, 714 bp, Heterodera glycines
  SCN-specific regions: Sequence locations=1-588,612-661,694-714
aacacttcaaaagcgacctcatcgccgtttctcatcgttcgttcgtccgtccgtccttcacatcaattcgctcgccgttttcgcaatggcacttcgacgcatcaaacaggaactggcggagctgaagcaggaaccgatcacgggttgcaccgcggcaccgatggatgacggcaaagacatgttccactggaaggccaccatcaaaggaccgcccgagtcgccgtacgagggaggcaccttcaacatggacatcgttttccgtcgcgactacccattcactccgccaattgtcaaattcgaaacgcccgtttaccatccgaacgtcaacaagcagggtggcatttgtctggacgtcctgaagacgacgcattgggcgccgtcgttgaccatttcgaaagtgctgctctccatctcttcgcttctctgcgacccgaatccggatagtgcgctggagatggacatcgcgattatctaccgcaacgaccgcgagcagtacaaccgaaatgcccgtgaatggacgcagaagcacgcgatgaaatgagacgacaaacgaccgatggatgggagaggatgcagaagacaaccgccgaagagggaggaggagggaggatacattcaactgaccctattcccacatatgatcccaactgtaaagattgtattattgtatctcactgtatgtacagtattatgtcgcctggttactgtttaagc

SEQ ID NO: 86892 - DNA, 566 bp, Heterodera glycines
  misc_feature (548)..(548): n is a, c, g, or t
  SCN-specific regions: Sequence locations=1-544
ccccattcgtcccttctctctgccgatgctttcgccttcgtttgcgctgtttctccgtccgctttttcttctccttgcgatgattttcctctccgtcgccttcgaattcgatctccgcgacgatggccaatccgtccgctttggtccttcctcttccggtggcaccagcggcgcatccgttgcctcccaactgttcgtgaactcggaggacaacgcgggtttcattggcggaattccgggcggatccgcgcggcgcagactcatccaaccgccgccgctgaaaagggatggaacggcgctgccgtggggggcggaagaggcgtgggcacggatcagcagaagcggggggagaaggttctgattgaagagcggagagagtaaggaagagtgatcggacgaaaagggactgatcagaagaggaaaagccaccaaagaaaggaatcatctgatcggtggcacccaatgatctttggtccaatgggcaattcgacgtgataattctcatttcggaaaatcaaatataaaattaaattgagtgaattctaaanaaaaaaaaaaaaaaaaaa

SEQ ID NO: 86893 - DNA, 740 bp, Heterodera glycines
  SCN-specific regions: Sequence locations=1-489,511-577,599-700,722-740
caaagggcccgtggttgtggaaagtttgaaaaagttggacgtcgatttgagggagttggcgctggagaatgcaaatataatcgagattggccccaaagcctttgcggggatgcgcatcaaaaagctgattttggacaataacaaaatcaaaaccatccaaaagaacgcgttccgcgggttggactccgtgctgcaggaattgtccatcgcttccaacagactaacggaagtgccgaccgctgctctcgaagggttgcgtgcgcttaattcgctgaatttgcgatgtaatcgaatcggaaaccctagcaacgcggcctttttaaacacgccaagtctaattgaagtgcaattggagtgcaataagatttgtgccatttcggacggagcatttcgcgaagtgaaagagactctgcagaacgtcattttggacaacaactgtttggagcaggtgcccggaggagcactggaggaaatgaacgctttgatttcactgcacatgaagcacaatcagattgagcaattggacgatggccatctccgcaatctgagcagcctttcgttgctcactctcacgggcaacaaaatttctcaaatctctccgaattttgcccaaaatactccgaatttgcgttacatttatttgggcgacaacaaattggaacggatcgacccgagctcaattaagcaattttctgcagccgaaatcattgacctcagcttcaataatttggctgaaataa

SEQ ID NO: 86894 - DNA, 661 bp, Heterodera glycines
  SCN-specific regions: Sequence locations=1-247,270-346,368-661
aacgcgtgttggcactcttcgcattgccttgcatgggtctcattcttttcctcagcgaatcgccccgttttttgatcagtgcacgtaaaatgaaagaggcgaaagaggccatcattcgaatgcataaattcgacgggcgtccgtatgacgaaaaggcgttggacgcactgcttgaaaaggagctacaacaaatgttggaactttccgtcactaaaaagaagtacaattatctgcacctcttctacaacaccaaattcaccatgtacactttgtcagtgtcattcagtcttttcgtggtcactctgatcacttatgcccttgtctacaacatcgagaagatgtcgggcaacattttcctgaatatgatttggatgggcatgttcaaatacacgatgaacttggccattgcctttgccgacctcaaattcaaatggttgggccgtaaattgtcccatttgctctccgaagtgctcgtcctcgctgcgcttggtctcttcgttacgctgcgtttgacaggtttcgatgccaactttacctttttgtccaacggctctttggtcgctgcggttggcttttgtggcattttgttcaactcggacaaattggccggcagcgaactgttccccaccggagtgcgcaatttgtcctgctcctttggcca

SEQ ID NO: 86895 - DNA, 696 bp, Heterodera glycines
  SCN-specific regions: Sequence locations=1-696
tttatttacttccacctttgttcggcaacgaccaagcagtcgaaacaaccgacgcagaagtaagcgcaacggcaccagtcaaacgacacagtgacaacaccattcattccttcattatttatcgcaacaacagcagcgacgcatgggccaaatcaatgtatgcgacgacgtttggttggacacattggcatggatcaatcgtgtagaagtcggcatgaagttcgcgctggtcaatgttcggttaaacgctttggcggacaaacatttcaagcagaggaagtggtgcttcggcgagtttcatacctgtgagcggatgacggaagaatcgggcgcagaaatcatgacatcgatcgacggctccgacttcagcacgttgccactgcccaccactccgttgccggacagtgtcgtcggcttccgatcaatttccatttggtacatcaatgaagaggtcgtcaattttctgcgcacaattcgccgtctccttaccaaagacattgcgctggaattctccactttcttcacggaatatcgcagttggaaagtgatggcacaacacatttggccactgttgaaagatgggatcagcaccttgtgcctgaagaagtgtgacttggccatgctccgtaaacacgtgtcgcccaccgtgctgttcgactgtgccggcctgcaccgaatccacacgcaaatgctgcc

SEQ ID NO: 86896 - DNA, 538 bp, Heterodera glycines
  misc_feature (520)..(520): n is a, c, g, or t
  SCN-specific regions: Sequence locations=1-32,54-466,489-515
agctttgagactttattattaacacatcctgatttttgtgaaaatgttgcccatttttcggagtggaaacaccgacggcttctctctcatttcagcgccattccttcttggcctcctctcagctgcgcttctgctggtggcacaaacagctgctctccaaacggacccctccgcgtcggacattgattacgaaatcgttttgccggttgcgtcgttgccgtcgctggactcgccccgggggacgacgttaaattggcaggacgaatgggtgcgacgcttttcgccacggcttgttgttgtgcaaaacggcggatggaagcacaggacattgccccgaaatgacgacgacgcccaccaacggattgtgctgcacaaaaagtggtccgccttggagccgtccattcgctttttatgatcgctttttttgatctgaaaatgggcacggatttcggtcgacgcatgaccaacctaaagcttgttttgctttattgcccctgctttacatattgttttacaaaanaaaaaaaaaaaaaaaaaa

SEQ ID NO: 86897 - DNA, 749 bp, Heterodera glycines
  SCN-specific regions: Sequence locations=1-210,232-516,538-749
ttatttgaaaaatattttgcgcaaattttttttatttttgtccgaaatgaaactcctttttaccccaatgtttttttctgtcattcttaaacaattcttctcctgctgctggtccaacatgtaaatggaggaagagatcgagtgcaagagattcaagaggaagagggtggctacagtagtagtggcggcaacggtaccgaaacaccaacaaaaaataaagcagtgaaacaatggcagcaagcacggttcaaaattatgcaggaaaagattgccgaataccttggtggattagcgaaagcaacaagaaagagtaaatatgtgcacaagcttgtggatgacatccagtacacaacaccagaaccgtttgaaggcactgtgaccagaagaactgagaaaaccaaaaatggcactggcaaagaaaaaaatgccaaaacgaacggcactggcgcaaaaacaaaaatcaaacaaatggcaacggaatacggtcgcgcacaccgtacatccatggccaaatacaaagaaaaagccccgctctttggagcggatgatgaaacggtggaaacaatgatgctgtatgtgcagatgaagttggacaaaatggccaacaaatatgaaaaatatgtagaaagtgatgataaaaagaacaaaaaattggccgaaaacttccaaaaaaagcgggcggacttggccaaattggccaatgaaatgcctgctgagggatgcaagctcagtgttggatacaataaaga

SEQ ID NO: 86898 - DNA, 762 bp, Heterodera glycines
  misc_feature (744)..(744): n is a, c, g, or t
  SCN-specific regions: Sequence locations=1-450,496-762
cctttaaggttgaattataattttgatgatataaaatgactaaaaagcgatcaagcatttcatcggccagcttttttgtcgaagacaccggcagcaattcgactgatgttggagtgaaagagaacagtgccaaaacaaatgacccaaataaatttgagaaggccggatggctttacaaatggacaaattatgtcaagggctatcggcagcgatggtttgtccttaatgctgaaggaattctgagctattatcggcacccatcggaagtcaatcgcgcttgtagaggcagcataaatttgagcgaagcgaacattcacagcaatcagggcgagtcgagccacagcttgatcatcactactccatcagcccaaacctttcatttaaaggcatcaaatgagattgatcgttcacaatggcttaaagcactcgaatatgctaaacacagggcaataatacaggccgtttcacttgaggaagatgaagaggaaagccaacttttgctcaacaaaacgaaaggactcaaagaatcatcgacaggaaaattggaaaatatgtcgaaggatcttcggacttccggcgttaaattctacaaagaattggatgagctgatgcattttatagttggccattgcaacgcaaaagaggcaaaaaattgtaatgagatagccaaccaactgagggcaattgctgacaattttataaagaattcaaatgaattggtgctgaattacaaaaatgactacnggacacttttgcgacttg

SEQ ID NO: 86899 - DNA, 614 bp, Heterodera glycines
  SCN-specific regions: Sequence locations=1-560,582-614
gggcaatggggcgggacggacacatcgcaagagacatttcccccctccatgatgcctttgctcacttcgttttggtaaaaaaacgtttgacttcgatggcgcctataatcccccgagaacaagctcaatgtctgcaaaatgtcttcaaacatttcgcacactttgaaattaatagcgcaaccaaagattggactcaggaagaattgcgtctttacaaacgcttgtttctcggcctgcggctttgcactttgacttttcctcctcaattgttacgcaatttgcaaattcttttcaaatgcatccgccaattttgtttcaatgccaaattaatgcgagaaaattgttggtcagcaaatttaaggatctcaaatgaagagaattcactctcaatctgtgaaattaatgaccagcgcattgagagagttcttcgagaattattcgttttattttttccgcaaaaaaatttggaatgtccaaaatcattttcgctgtttaaacttttggtggaacatgttacgccgtgtcttatccaaacgccaaaatggttggccgatgaagtgcaaaaagaaatgaaagaatttgttaatagtgggcagactcataataaacaaagg

SEQ ID NO: 86900 - DNA, 530 bp, Heterodera glycines
  misc_feature (502)..(504): n is a, c, g, or t
  misc_feature (513)..(513): n is a, c, g, or t
  SCN-specific regions: Sequence locations=1-336,358-384,413-504
accgcgagttcgctgtccacgctggtcatcctggagtagacgacgatgtaatcgaattcagccacggcatgaaaatttacgaaaattgtcccggctccgtggaaccgttgtgggtgcgcggcgctggccataacgacgtggaattgcacgccgcatacctggacaggttgagacagttcatcgactcggaggtgtgcaacccgcccacccacagagagcagttgaaaaatgcgaagcggccgcagacgaaccaacaggcgcagaattagccttttgtgcctccctttcctctgtatgttgtaatgaatgacctatcgatcggatttcgctgatcacttctcctgtgtccatgtccttcttttttcactcgcctcaccatttgagatcatttcctcccccacccccaattgatgtaaatccgtggccgtcactttcatgtcttactattagcatattttggaatccgaaccattgattgaagcgttaaagagctcttttcgtnnnaaaaaaaanaaaaaaaaaaaaaaaaa

SEQ ID NO: 86901 - DNA, 717 bp, Heterodera glycines
  SCN-specific regions: Sequence locations=1-386,408-717
tatttttaatgaatttatacttttattatttacagttatttctcgcaagaaattaattgctttccattcataaaaatgattttgtttttgcctttacttgttttcatttattatgcacttcgctacctttgggaattaatcccgcttcaaaatgcttcgaaacgcgctgtttttgtcaccggatgtgactctggttttggttactttgttggcacttaaattggcacaatatggaatgctcacatatgctggatgccttactaaacagggacgcgatgaactgattgaggaagcaaaaaaaaacgtggagttgcggcaaaactcaaaacagtgccattggacatcacccaggaccaatctgtgaatgatgcagcggattttgttcgcaaagatttgaattctgttggaaacattgaattgtgggctcttgtgaacaatgccggcatattcagctgttttgggcctgatgcttggacatcgattgatgaatataaattgtccatggaagtgaattgctggggaacaatacgatgttgtcaggcatttttgccgttactcaagcgcagcagaggcagaattgtttctatctcaagtgtagcaggacgcgtttcagtgccgggcggggcgccatatgccgtggccaaatatgggggttgaagcatacatggatgcgatcaggcttgagctgaaatgttggggaatcggctgtagcatatt

SEQ ID NO: 86902 - DNA, 774 bp, Heterodera glycines
  SCN-specific regions: Sequence locations=1-774
ccaacttcgctccgaagcgctccacaccaacacagcagcaacagaatggtgccactcataatcagccttcaaatggaagtgcggtgctgcaggatatggcaaatttgacacttggaaaggacaaggaatcgtcagtggacagcgaaagagcaagcaaacgatcgtccagcgtctacagcagcagtgagcaggacccttcgtgtgatggacaaggggacacttcgaccgaccattgtgccaacgttgcttcgaccatcgcagcggagcacgtctcccattcgacctcttcctcgccctcattaggctcttccgcctcggaccaaatttccaaatcatcgggcaccaatgaagtcgtcaatcgtgtgcagcaaagggggaccaccaactcttcgtccagtctgtacagcagtgaccaatgtgtgcaacggactgtgccgatctcggcccactcgtcaccttccgttgcttcttctctgctctcttcgtccaattctgtcaactcaaatagcaatttcaatgagcagcaacagccgtcgtcgcccgcttcgctaatttcttcttcgattggactgcaaacgtcgaaatcggccgttttaaaagctgccgaaaccatccaaagactgcgccaacaattgccccaggatcgacccaaatctcaatccgttgactatgggaaagtccccatctcctctggaccctaatccacgtttgaaatcgcctcctggcactgcaccgcttgcgcagtcagcgcgtaatttttggaactccgtccat

SEQ ID NO: 86903 - DNA, 760 bp, Heterodera glycines
  SCN-specific regions: Sequence locations=1-760
ggatttttgttgatttttacgaactttgatcattttttctgagcttttttggctccatagccaaaaaagccgaaaattggcaatagcaaatcatctatgctctacacgatataagtgattttaaagcgatctgagcagtgacagttcggaatgttcccttgttagattaatttggcaaaagagactctcttgcattttttaggtgactttcaacttggacagtcgacgaccctttgggatgtccattgtgacgaagaacaaccgttccggatttgcagggatttatgtgcatgaagttaaccctggcggtcttgtggcgttggacggtcgaatcagacccggctttatcattctggaagtcaacgacatttctttggatgaccttagctcaaaggaggcgctcaatctgatcatctcttcggttcgaaatgctaccgaaaccagggggcaactcaaattggtctgtgctcccagcagccgagcccgcacgaccgattgatcccaccgcgtggattcagcacgcaaacgccgccaggggggttggaccaccaattgcagcactttccccctcccccgccaaccgctcattcgcaagggcaacagccgccgatttgttgtattatgccgccacaatgtcagccgaacgcggcgaaaccgatggccagcaaatcgtcaaccattccaaaaacaaaccctcagcaacaggggaaaggtccatgaaaaacaacaccaatttgcgggtgctgcaaattgtgccgtt

SEQ ID NO: 86904 - DNA, 710 bp, Heterodera glycines
  SCN-specific regions: Sequence locations=1-7,29-232,254-710
atattttgttggactgtaaaggtcctgtaaaactgacggacttcggcctgtgtaaagaggccatcgaaggggaccaaaagacgcacactttttgtggtaccattgagtacatggcacccgaaattctgatgagaactgggcatggcaaagcggtcgattggtggagtttgggggcgttgacttttgacatgctcaccgggggaccgcctttttcggcagagaatcgcaaaaggacaattgacaaaatcctcaagggacgccttacacttccgccctatttaagtttcgaagcgaaagacttgataaaacggttgctgaagcgacacgtggacactcgccttggggccgggccgggggacgccgaagagataaagaaacacgcctttttcacccaccacgtcgagaattggacaaatgtttatcggcgagagatcgaagccccgtacaagccgaacatcaccagtgaggaggacgcctctctgttcgactccaaattcaccaaaatgactcccgtcgattctccgaccgccgaattgccaccaatgtccgtcaatcccttcgaaggattcacttatatagcgccttccgtcctcgaacaagtcagccaacccacgttggtccgtccgaggcaacagcgcaaaatacatggccccgccatctttcacagtttccacccccaccaatcgacgaccgacaacggacccttggaa

SEQ ID NO: 86905 - DNA, 394 bp, Heterodera glycines
  SCN-specific regions: Sequence locations=1-114,136-394
ggagttgaaaattttttttataacaaatgatgaacaaaatttataccaccattcatttcttattgcttttgactgttattgctaacaaatcgactaattgtgctacaaatgttcaaggaactcaaactgttaaaacagcagatgcaacctatgatgaagctggaaaaatttcgcgtgattcatcatcaagttccgatgaagatgactcaacaactgcagcttcaaaaatgctactgaatgaagcaaatcacgctttctccaaagataatgatgagccgattaaccagcagcagaaaatgaggcctgaagctaattttagcgttaaatatcttcccccgagactgaacgctgcacaaattgacaacattgcacaacaagcatcatccatgatcac

SEQ ID NO: 86906 - DNA, 584 bp, Heterodera glycines
  SCN-specific regions: Sequence locations=1-584
ggatgagttggcacgccttgacagttgccgaaattaaaatgagcgcaaacggttcaacgacattcccgaacgggacgcatttgaacgtttgtgccgcggtgagttcgacatttcgcctgcaaatgcttccaaactctactgttatttcaagcgggacaagccctacctaaagttggcaccgcacaaagtcgaaattgttcattatgaaccgctggtggttgtgttccgcaatgtgatcagtgacgaggaaattgcggttgtcaaacaattggccaccccacggctccgtcgcgcgacagtgcaaaattcgcgcaccggcggattggaattcgcttcgtatcgcatcagcaaatcggcatggcttaagggagatgagcatccgataattgagcgcattaatcgacgaattcacgagatgaccaatttggacatggagtcggccgaggaactccaagtggccaattacggcattggtggacactacgacccgcacttcgattttgcgaggagcggcgaaaagagtccctacaaagggaagggcaatcgcattgccaccgtactgttctatatgtcacagccgaaga

SEQ ID NO: 86907 - DNA, 693 bp, Heterodera glycines
  SCN-specific regions: Sequence locations=1-224,246-307,329-693
gattccctggcgcctgggactcgcgccggtggggctccgcgacgaactccttgtaagtgcgttgtccacgtcttcgctgctctccagctcaaccattgcacttacaacatttccatcggggaatcgagcatcgaattggaggaactttcccgggaagagctcatcagacgatgcaacgaactcaccgaacggtgcaaaatggaaatacgttctaagaacaaggagaagcagctcaaggaagagaccatcaaaaagctggtggttcttggccagcagaaaggcatcatcgacacacgcaacaaatcgaagaaaggggagaaagagaagcgcatttgggaacttgcacagcacgagaaaaacctcgagataaacaaatatgaagaccgatacaaggagatgcaatacgcactcgacagcacaagacacgaattggaagaggagtaccagaacagaatcaaaactgaggaggagctacggcagtacaaggactgtttcggacagcttcccaactcatacttggcctccgccaacccgcataataatgacaggcaacgtaaccaggcgcggcgtcggcttaaatgagtttcagtgaccaaacaatgcagcggatgagacttaacttgtgcattttcacgaatttgtgacataaatatgaatcttactttgttttgaataaaatatgaacccggacaa

SEQ ID NO: 86908 - DNA, 602 bp, Heterodera glycines
  misc_feature (582)..(583): n is a, c, g, or t
  SCN-specific regions: Sequence locations=1-70,94-438,464-479,508-602
tttccattttttttctaattttgctgaaatgtcggccaatacttgcgcagaatgcccccctctctttcgcttcttttggccctttcgatggccttttgcctaatcactttggtactgaaatgccccgatgaagaatgcaaaaacaatttgagggaaatcatttcatttccaatggacggcgacgaaacaaatggaacaaattcatcgggagcaatggaaaaaacggcggaaaatgcacaagagtttttgctaaaaatgtccaatttcgacaaattcgcatgtaaaattggggacaaatattgaaaattaattgaattaattgaatggattgatcatttgattattatttattttcttttctttcaatttttcgttttgttctgctgccctccggccataggccattcattcgttcattaagtcaattaattaattcaattgttttatatttgtttattttccttcgcttcgttttcattgtttttaattacttttttatttcctatcgttcgctgaataatgtcataatttgaaagtgcatttcaattttggattcgttacataaattgactttttcctcannaaaaaaaaaaaaaaaaaaa

SEQ ID NO: 86909 - DNA, 651 bp, Heterodera glycines
  SCN-specific regions: Sequence locations=1-199,286-487
gatttgtgtaaaattcgatccatcgcccgcctcagaaccacaacacctctcaaaaagcgaaagaggaagcaactcgatgttgaagttgatgagaatgttgctggctttgatagacaagaagcatcttcgccagttgccgccaaaacatttcgacacttttcttgggcaattgcacccccaacggcgccacaccccgtgaaagaggcaaaaaaaagaagaaataatagaaagcggaaatgaggaggaaagggacgaagaggaagaagcagaaaaagagcaaaatgatcaaattcaaattggacgaaaaattgaggaaaccgaacggcagcaaaagacgaaagtgggcggagaagatgagggagtggaagaagtggtccaacaaccgcaaacaacgacagaaaaacccgcggacgcaacacagccaacagcggaaccggcgaaaatccaagtgattacatccgttggcggcgtcgatgatattctacgaaagagacgagaattgaagcgagaaaagcgaaggcaagaacagctgaaaagggaggcggaaaagaagaagaaggaggaagatgaagcgaggaggaaaaaaaaatgaagaggaaacgaggagaaaaagtgaggaaacagaagcgagaaaacggagacatgaagagg

SEQ ID NO: 86910 - DNA, 634 bp, Heterodera glycines
  SCN-specific regions: Sequence locations=1-37,59-192,214-308,331 -491,514-528,557-613
ataacgcggcacagtataaatataaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaacggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgtttagttttcagattttattctatcctcttttatttattagtttttcaaaacaaatttcttccacaactttttaaactatttgttgttttgaatctttttagataaatctaaaccccgcaaaaaaaaaaaaaaaaaaaaa

SEQ ID NO: 86911 - DNA, 355 bp, Heterodera glycines
  misc_feature (51)..(51): n is a, c, g, or t
  SCN-specific regions: Sequence locations=1-304,326-327
gaaattgctgcgttaagaagaagatccggcctgggttgtctcattgctggncaaagaccgtttcaagaatctcgcattctttatcggcgaaaacatggccgagggcaagggcgaaggacaggtggccattgttgagtaccgtcaggagaatggtgaggaagtgcccactctgatgctgatcaaggaggcgctcattgtggagaagtgctgacgacgacgacaagcgatatacgagaaatgcgcgcgatattattattataacttttttgttttaatatgatatggtgacacaatgtccagttactattacatattgttgttgttttcaaaaaaaaaaaaaaaaaaaaaaaaaaaa

SEQ ID NO: 86912 - DNA, 638 bp, Heterodera glycines
  SCN-specific regions: Sequence locations=1-37,59-192,214-490,513 -528,557-612
ataacgcggcacagtataaatataaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctctgggaggaaatgccgccggattggtgccatcgcatgtgaccaatcgctcaatggctccgccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaaccctcaaaaaaaaaaaaaaaaaaaaaaaaaa

SEQ ID NO: 86913 - DNA, 662 bp, Heterodera glycines
  SCN-specific regions: Sequence locations=1-147,186-662
ttcccacacattacttcttactttccgtattttcgccttccgttggcctcgacaacgcaacagcagcaacagcagacggaaacaatcgacgcagaactgtgcacaacaaccgacgtcatctgtctgctgttaaacattggacatatctcacaatcatcaccatcatcatcagcagcagcaaaagcagaggacaacaaaacgcatggaccaaaaccgactcagcgacttcgcttggatggaaacattggcgtggctcggtcgtgcagaagtgggcatgaagatggcgctggtcaacacccggttcaacatgctggtggacaagcaattcatgctacggcagtggcgctttggcgagtttcacatctgcgagcgggaaggagcacaacgaggcggcgcagaaatcatgacatcggaagacggcaccaacttcatcacgttgccactgcccaccacgccgatgccgagcagtgtcgtcggcttccaatcactctccatttggttcatcaacgcggacgtcatcaaatttctgcgccggattcgccgtctgttcgccgaggacatcgcactggaattctccactcggcacacggagtttcgcagttggcaagtgattgcgcgacatgtttggccactgttacgggacgggatcagcacattggtgt

SEQ ID NO: 86914 - DNA, 613 bp, Heterodera glycines
  SCN-specific regions: Sequence locations=1-135,157-512,537-613
actgagatatgcatgccggggatggcaaacgagcttctgccaaagtttggcactacgctggccgttgagcgtacacgacgtgacacaaatgccgagatgatgggtaccaagatgactgccaatgccgagcgggaggcaaagaaggaaatgaatggcgagatgggtgccaagaaagaaatgaatgccgagatgatgaacaccaagaaagatacgaatgccgaagtgatgggcaccaagacgaatgctaaccccgagcgggacaccaagatggacgccgtggtgatgaacaccaagacgaatgccaaccccgagcgggacaccaagacggaaacgaatgctgtcatggtgaacaccaagacggattttgccaaccccgagcgggacaccaagaccgacgccgtcatggtgaacaccaagacaaatgttaaccccgagcgggacaccaagatggacaccaccaatgccgaggtgatggacaccaagaaggaagccaacgcggcagctgcagcgccggtggcggcgtcggacaacacggcaccagccccaatgacatggatgatggacggcattgtgccacgcgatgtcaatgtgatggtggaccgtaccacgaagg

SEQ ID NO: 86915 - DNA, 656 bp, Heterodera glycines
  SCN-specific regions: Sequence locations=1-198,221-358,381-656
ggagacggcgctgctgaccatccgaacgtggacacatttgcgtttatgggcaacccgcaaaaggactatctgatcgcacttgtggtcccaaatcgcaaaaacttgcaagcacttgctgaaaagaatgccgtcaatgagtcgagttgggaggcaactttgtgccaacaaagaaatggccaagcttctggaaaaggaactccaaaactttgtttcggggaaattgcgcagggaggaaatcccgaggaaagtcattatctgtgcggagccgtggactgccgactcgggaatgctgaccgaagcactgaagttgaagcgcaagaacatcgagagaaaatttgcggaggaaatccgacagctttatgaggggaaatgattgggttgttaattcccggaggctatttcgcttcaatttgatctcgaacatcaaatcaagcagtttcattgtgccgtaattgccatcatcatgagctttgtacccccaattatacgcaattaatttttgttctgttttcactggtcattcttctgtcagtgcgcgtttatttattttttgatattcgttagggcttttgtcgagagaaatgtccccatttgtcgctattaattgatgtgtaatgtttgaatttgtattggaattgtacgatttcgtaaaagag

SEQ ID NO: 86916 - DNA, 665 bp, Heterodera glycines
  SCN-specific regions: Sequence locations=1-665
gcggcgccgggtgttcatggccgactttgaggacgcaaattctccacttggcgcaatcagattgagggccaaatcaatttgtacgatgccattcgtggccgaatccgctacgtgaacccggtcacgaagcaggagtacacgctgaagcaggacactgctgtgctcaaaatacgcccgcggggttggcatttgccggagaagcatgtgctgatcaacgagaagcccatgtccgcttcgctgttcgactttgggctttatctgttccacaatgccaaggcgttgcaggagaagggcagcggcccctacttttatctgccgaaattggagaatgcgcaggaggccaaactgtgggccgatgtttttggccatgccgaaacactgctgggcctaccgcacgggacgatcaaatgcacggtgctaattgagcatctgttggccaccttccaaatggacgaaattgtgcatgcattgaaggattacattgttggcatcaactgcggccgatgggattacatcttctcatacatcaaagtgttccgtaaccatcgcaaatttctgttgcccgaccgctttctgatcacgatgacttccgactttttgcgcgcctacacactgttgtccatcaaaattgcgcaccagcggaacattttcgcgatgggcgggat

SEQ ID NO: 86917 - DNA, 665 bp, Heterodera glycines
  SCN-specific regions: Sequence locations=1-30,52-57,79-154,177 -575,598-665
ggaatcctaaaaattatcctatatccctccaaatatatataaaaaatatgagaattcccattatattaatattattatgcatcgttgcattgctaatacatgatgcatgcgccgcgggcaaaaatacgacgaggaaagcaaacagaaatcgtgccaataaaaatgggaatagtgggaccccgtccagacaagcagcggcaccaggaaaacagaacaaaaatacgccggaagcaagaaccaatgggcaatctccgaaaaagggtgataagagcattggaaaccaagcaaatccagccgaagtaaaagatgttcctcaactgtccacgccaaaaaaattattacgtgctgcaaccgttggtgtacttctattttcgagtcttgcagggcagcccataccggcaggagccaattcacatatgaccgaggccgaacagtacaaaatgcatggacagggtaataatatggcggcatatacgaaacaaagaagtaatttatatggagaaacagcagcggcaaccaagccacaaataacacacaataattttgcacgtcatacacgaacaagaaatccgcctccaccacacaaaaagactcttcgatcaccaaacttttcagcattagctgctgaaagagcaaaacaaaaaaaagaagaagaagagcgtctg

SEQ ID NO: 86918 - DNA, 531 bp, Heterodera glycines
  SCN-specific regions: Sequence locations=215-375,506-507
ataaaaaaattttatttaagtttaaatacttttattaattaattaattagttttttattaatggtctttaaaacgttccagaagaatcggctatacgtttttaatttttaactttagatttttagatttttttaatttattataggttttttatattttgtttaaaatttatttttttttaataaaaaaaaaaaatcaatttctttttaaaaaacctgggtttgaatccagttattttttcttttttaatacttgagtaatttttttttataaatagaaagaattaagttggaataaataattaatttttggagtttgataattaataggagaaacctccattttagctttttttttattttctgtatgtttatcttttttttttattaaaaaaaatattatttttttactttttttgtagaaatatatagagtataaaattaagtttaattgagctacattttttttttaatttttattatagtttaatttttgtttattaataggaaaaaaaaaaaaaaaaaaaaaaaa

SEQ ID NO: 86919 - DNA, 640 bp, Heterodera glycines
  misc_feature (635)..(635): n is a, c, g, or t
  SCN-specific regions: Sequence locations=1-564,589-608
acatttttgccggttggattggcgcaaatgctgctgttaagtcaaaaagtcgcgtggccatcgatcgttcgccaattggcccctttaatgtgggcctggtctttgcactcgaatggccggcatttcgggcggaattgctgtcgcaatgaatgcgtacggcgcacactttgttctcgccaatgccgacattaatgatgaacgaaaaagagccatgacttatgcgatcaaccatcacttcatcaactgcattggaatggcgttggccggcgtcggtgcccattatccgacgctgacctcgagtatgtttctgatcagcactgtgctgttcagtgtgccttcctatttgttcgccatacgcaatgatcgccgactgcgcgccgtgacgccgtacggcggtgtgttggccatgctcgcttggttcagtttcgtcctttgatcgcttcccaaaacaattgcaacaaattcggacggaaaagagaataattgatcaaattgtggaattgtaatttcaaatttttaacaatgtatctttattttgataccacaaataattttttgctcgtcattctcaagtttaattgactttatctcattgtctaaataattgcttattaaaaaaaatgtttttaaaaaanaaaaa

SEQ ID NO: 86920 - DNA, 608 bp, Heterodera glycines
  SCN-specific regions: Sequence locations=1-193,215-587
ttttaaataaaatttccttggaccgacaaaaatggcaaaattcgttgccattgctcttctctcgctgaccattgtttcgatggcacttgcaaaaactggcaaaagtcaaacggcagacgaagttgagggatttcgcaatatgaacatcggcgacaacaataaggttgacgccggaaaggagcccgcggctgataaagcaaccaaaaagggaaaagctcagaaagccggaacgaaatcggcggcggccactaatgagcccgcggctgctaaaggaactaaaaatggaaaagccccgaaaaccaaagcgaagcaagaggtggccactaatgagcccgcggctgctaatgaatggaacgaccaattgatgggcatgagcgttgagaaatttaacgaggagcttgctgtgttgttgccaaaagccaacacttttatggaaaatgctttgagcttcatcaatgaacaaatggaaaaaaatggtattgcaactggcgctgccggggactcgtgctcgaccgggatcccggccaactaggagaccaatgccacaggacggcaccggaggagggaagaaaggatgacgagctctttggatgatgaaggtggtggta

SEQ ID NO: 86921 - DNA, 729 bp, Heterodera glycines
  misc_feature (686)..(686): n is a, c, g, or t
  SCN-specific regions: Sequence locations=1-365,389-699
taaaaatattttttgccatgtcttctctgctgctctcctcttccaatggtctttttagtctgttgccatgcaatgccaaaattcccgtgctgcccgggcagtcagcaagtggttgctgtgatgtccaaatacattgacactttctctgctgctgatgcggacaaatctacagtatgctcaaccgcgaaaaatactgtggatggaataaaaagtgatttgttctcttgcggcggatgcccaagcggaggagaagcacaaattgtgggcgaaatcgatcgacagctgaagaacattgcaaaaatggagatcaattatgaggacgagtgtccatacaatttgggctttgcccgtgccatgttcgacttggccgctgctgctgctggccatgcgggcaccgacacaaaatggcaaaatatgaaaggacaatttgaacaagaaagccaagcaatcaaagcaattggtcaagaattgaacattacagttacggatgtgcatgttggacacccaagcaaaggattttccgcgcatcaaaatgtgccaagtccaagccatgtggttgccaaccctggccaaaagagttcggttggccatggaaaggatgacgaaccgttgtcatctgatttggacttttgagggcatagaaaactgaataaattagaaggaaattcatcatacagaaaactatnttgttgacattccaaaaatatttattttaagtaataaataatt

SEQ ID NO: 86922 - DNA, 746 bp, Heterodera glycines
  SCN-specific regions: Sequence locations=1-746
aacgcaccgatggcatattacggacagcaaccagccgccgaccaattaccggttatcagtccgcagaataacaactccttaccaagctcaggaaggagtgcacgtttacgccgccaatccgggcaatgccgagggcggaatgcccaaaaatgagctgggcttcaacgaacaaagcatccgtgccgcttttgttcgcaaagtgttcctcctcgttggtgtcatgctcggtgtcgtcactttaatgtgtgtcgtccctttcgtccacccgcccctaatggcatttacgaagaacaatcactcgctctacttcatctcgctgatcactttcctggtcgtctatttcgtgctgatttgctgtgacagtgtgcgtcgttccttccctaccaatttgatttgcactgccatcctcactttgtccatcggttttgtcaccatggtgatgacggccttttattccttcgagtccgttttgatggctgcggggataactaccgtttcatgtgttgggatcgcactgttcgcaatggtcactaaacgcgacatcaccagcttgctcggctttgtgttcatcgccacgatggtgttgatgatgctcggttttctgctcgtcctttggtcttccttcagctacagtcgccctttgcacattgtctacgcttgtctcggggctttgctctttatggtctacttggccatcgacattcagatgattattgggtggacgcaaatacgaaatttccccggat

SEQ ID NO: 86923 - DNA, 559 bp, Heterodera glycines
  SCN-specific regions: Sequence locations=29-231,253-559
aattattttttttaataataattttttacaaaatgagcaactttatatttgtcgcctttttaactgcagcgttttttagctcaagcctcgctctaccggctccttatgatgctgaatcggtggtatcttctgaattaaatgttccactactttcagctgacgcaaatgttcaagcagctgaaaatgttgagatacaaattccatcaattccagcaccaattgaacaacaaactgctgctcacattactcatccaactgaaactggcaatgagccttctattgcatcatcatcatccgcgccgaaaagtgagcagacgccaaaaaaagtgatgaacatgaaaagcgcgatggaaggcgcggcggccaacgtgtacggggggcttccgttagaccagcagcccaagacgatcgctgaagcggcagcaaaagcaaagcagacgcccgccaaacttccggctgactacgacgcgaaccgcgtggcggaacgcgcggcggcccgtgtgtacgggtggcttccggaagacaagcagcctaaggcgatctatgacgcggcggagaa

SEQ ID NO: 86924 - DNA, 498 bp, Heterodera glycines
  SCN-specific regions: Sequence locations=1-18,40-94,116-249,271 -391,413-498
cagaaaaaggtgtttttaaattccagaaaattgttgggatgccttcgcttgtcacgaggtcatcgaaatcagtggtgacaaaagtctcattgtccagaatatgggaaatataatggttggcgctccgtcttcgcaaccgtcttcgctaaatatccgattgtgctgaacaagcatttgtccgactttttttactacgaaatttcagttatgaaagaaaacgaatttatttggggcttcaacttcggattcgctgttaaacagcagacaaaattggatgaatcaattcgatgtgaaaagggcacttatgcctatgaaaacgatggcgaactttggattaacggagaaggaaagggaagcaatgcccaatattcctacgatattggtgataccgttggaattggcatcaattcggccactcgacagatcattttcaccaaaaatggacttcgtttggatgcctctgattttttggttgatccatcttttgctgatggttct

SEQ ID NO: 86925 - DNA, 556 bp, Heterodera glycines
  SCN-specific regions: Sequence locations=1-556
accgtcgcatttccaaatgacaattttggatcagcaagaggaggaagtgatcgtcggctctgatgacagtcacatgattgtctcaaatattccgcatcgcgcacacaatgtttgtggcgtcttaaacaagcataccatcattgtggcgccggcagacgactcactgaagcgtgactttggcatttacgaactgttcaacatcaatgaccctcaaacgaaatattttgcttggtttgtgcggccagatgctccgaagaaaagtgctattgagacgtttcttgcccactacgaagtcatcaaggacgcggagggtgacgtgcacattccgagcttaatggctgccagaccgattaagaagtttcacttcggcatggacattattcaacagagtgagcatgacgctgactggagacgtccggttatgattctgaagatgcccgcccattgtgtgtttttggtcgcagtgcgtactctgtcgcccaccgcaagtgctccgagttggctcgcattagcagtcggctatggcttggtgaatgcgctgaactcattgcatgag

SEQ ID NO: 86926 - DNA, 621 bp, Heterodera glycines
  misc_feature (597)..(597): n is a, c, g, or t
  SCN-specific regions: Sequence locations=1-466,488-597
caatgctcgattcgaacattctgctggagacggagtcgaaaagtcggcactcgccgagtgaagttcggcacattggccaaattgacggcggatttgcttctccgattattctcacagaagacgccattttggcgcatcgaaataggcgacaaacggacgaagaaacggcggaaacagcgaaagttttctgcgaaaaaaaattttcttataattgtccgaccgctcttctgaccataagcatggattggcagcaaaaaacgacggaagggccgcgagaaaacaatcgcaaaacgaatggaaatgggggcgaagagcaaagggaatgctgcgcgggctttgtcccatcgaatggccaatgcgtgaaaagggagcgaagataatggcaaaaggcaattaattaattaggggcaattaataaaacggacaaaggaaaggcaatgaaaatggaaatgatcctccaactttgaaaactattttgtatatataagtaatttattattgcactgttctcatttcttattcccaaattcagatatttgtgttgtacgattcggaaatgaaattaaaattaattaacgcataaaaagcatttaattnaaaaaaaaaaaaaaaaaaaaaaaa

SEQ ID NO: 86927 - DNA, 265 bp, Heterodera glycines
  SCN-specific regions: Sequence locations=1-200,222-265
atggaatgacttcaactcagaagattatcttcgaaatggacaaaaaccggcaacggattagctgaaaatgctcaaacgaatggaagggcacgacgacgaaatcgcagaagacgctcaaattcagtgggccaaatggtcacattcgccacggcacgacttggaagacagtgacaacatacaaagggataatgggcggaggaatggcactaaaggaaatggactcggtggacctaaatagcatcgaacatctgttatcgtgccccca

SEQ ID NO: 86928 - DNA, 663 bp, Heterodera glycines
  SCN-specific regions: Sequence locations=1-379,402-663
gagttggttgttttaccccatcaattgtggtggacatcgaattcgattgtcattcggaacgtttcttttggagtgatatttccggacattccattcgttctgcttttctcaatggcactgggctcagttccaacttttccgaagtgctccgaagccccgaggggattgccattgattggccttcgcgcatcatttactatgtggacagcatcaaaaacgaattgggagtgttgagcatcgacggacgctttcagaaggctttgctgacggagggactgaacaatccgagggcattggtaatcgacttggaaagtcggcatttgtattactccgattggtcccgagaagggcccaaaattggcagagtttcgttggatggaagtgcaaatgaaattttcatttcggacgacgtacacttgcccaacggaatggttctgctgcagcagcggagatggctttgttgggttgacgcgggcattcagcaattgtcatgcattgggctggacggaacggggcgaagagtgatttacgccccgcttgagtatccctttgggctgacagtgaatggagcggaggagcgcttttactggaccgattgggaagacatgaaaatccattccgtggatgttttcggcaaagggtacacccaatttttgccaggag

SEQ ID NO: 86929 - DNA, 653 bp, Heterodera glycines
  SCN-specific regions: Sequence locations=1-653
ggaacgaaccctccgtctttggcacaatgagaaacatcctggtactttgacacgcaacctgcatttgccggcaagccaccaattgcgccgctgatgtgcccagagccgaacaacaaattggactacccaccgtatcgcacatggaatgcatacaaatgggactcgaagaatacgaagagaacgctgaacgaaaaaacattatgcatgattggaaaaagtgggcgccgcaactggacaatgtacgatacgcattctctctacggctggtcagaaatggtcgccacacaaaaagcgttgcgcgtctcaactggcaaacgcggctcactcacttctcgttcaacatttccatcatctggccattacggtggccattggcttggtgacaaccaatcccgatggcctgatctccggctgtcaataatcggggtcatggagttcaacatgtttggcatcccacaagttggcgccgatgtttgcgggttcatcggagactcaaatgaagaactttgtcttcgatggcaacagcttggagctttccattcttattaccgcaatcacaatgatgttaattcaaaagttagccaagatccggcacagtggaaatccgtggcaacagcaacacgcgttgcgaacttattccgatatcgtcatct

SEQ ID NO: 86930 - DNA, 428 bp, Heterodera glycines
  SCN-specific regions: Sequence locations=1-428
gtgctgaacaaatcaccaatagcgtcgaagagttggacattctttacactgtgccgcattgtgtgccaatctcggcacatcacaaatggaactttgacgatttgttggaaaagatttgggcctatttgaatctgatcagagtttatacaaagccaaagggccaattgccggattataacgcaccgatcattttaaacgcagaaaaaaaactttctcgacgatttatgtatgaaaattcacaaaagtctgtcaaaggacttcaaatgtgccctcgtctggggaagcagcgtaaaacacaatccgcaaagtgtgggcaaaacccatttgctgaacgacgaagacgttgtccaagtgatcaaaaagtgagggaaaggcaccaccgaacgcggcaaagagagaagcgccaaaagagtgccctcctaattgat

SEQ ID NO: 86931 - DNA, 440 bp, Heterodera glycines
  SCN-specific regions: Sequence locations=1-440
tggttcgccgccgcgttcgcttcgtatgtgccgccgtcggcggcaagggcgcagccgcctcaccgccaagcagcacaatgttgctggacgtgccagtggttgttgttggccggcacgactacgacacgtacagagactcggtggaacggctgaaagacaccggctttgagcttggcctgttaaatgtggaggcggagacggaacttgtccaactgcggccgcacattcagcaaatgatgtgtgaacaccaaattttgccgtacgacccgggcccggactggcgctttctcgactatgtgtccaacgcggaggagggcactttccgcgtgtcgcgtcaccaggagcagagtcggacggtggccgacgtgtgcacattggaggcggaggagggcaccagcagcagagcgggcattttcattttggacgacgctttcccttca

SEQ ID NO: 86932 - DNA, 558 bp, Heterodera glycines
  SCN-specific regions: Sequence locations=1-558
taagaaattgtaacctaaaaatgaaaattgagtataaatattgcgattttcccaccttttttcattcctcatcattcctcaattacaaattatttaattccctgcaatgctcgtcgacttcctcttctccgcgtccctttcacttcaactgctgcccctgctgatgtccatcgttgccgcttctgtgctggtgatcgtcacgcaatgctgcggctgcgggaagaaagatgctgccgaacaacagatggcgccgactggggaccaaatgcagcagggaagcgtggcaaagcagggctcacaaatgggacagagtgcggcacaaggcggcgcctccaagatgggacagagtgcggcacaaggcggcgcctccaagatgggacagagtgcggcgcaagactccaccatggcaaattcgcagatgcccggcttgtcgacctacgcaggcgttgcacaatcgccaactccaattgaagtctcggcctgggcgcaacctccgaagcccaagtgaattgccaagaagtgaacggacgatgtgcgctctgcgaagtacaacatttg

SEQ ID NO: 86933 - DNA, 709 bp, Heterodera glycines
  SCN-specific regions: Sequence locations=1-84,106-709
ccactcttctcgagtcgtcttttaacgttttagaaagtcttggcgaaatgctcacttggccttttgtcgacgcttttgtcattgccccaaaaattgcacttttaacgggtcgaaatgactttagctttgaccaattgtactaccgaagtgaaattgcgcttgtcgattccatcgatttgctcgcttttccccagccacgtgccactgatgtgttaagtgccggtgcgcattgtgaagtgcccaccgaacttccgaaggattaccgtgtttttgtggaggatcctcactcaaaagggactgtttacgtcgccttcggcaccgccgtgccgtgggactacgccccgcctcacattgccaatgccttctttgatgcttttgagcggttatctgaccatcgcttcatcttttcattccgtggcactttccccaatcggactctctcttcccatattcgccttgtctcttgggccccccaattggaagtgctttcccatccgaagaccaaagtctttttgacccattccggactgaagagtatcaaagaatcgctgtgttctggcactccgatgctaacaatgccaatgttcgcggagcaagcacataatgccaagatgttgttggagtttggcattggcattgggctaagcaaattttcgattgacgcgcaaacggtgtttgacggactgagtgagcttttacataaaccaaa

SEQ ID NO: 86934 - DNA, 717 bp, Heterodera glycines
  misc_feature (674)..(674): n is a, c, g, or t
  SCN-specific regions: Sequence locations=1-317,341-501,523-717
gcaaaaagttcttcctaaagaatcggaaaaggccaaagtacgccagtctaaggcattggtgccccaggcaaaagcgaatggcaattccatcgatggcacaaacaccgaaaaaaggggttccgcctgtgcatcttcaacagcagcagcgaagaatgatggatccattcctatggaggattttgtactgccggcacagattaaagaaatcgtgccgaagacagacgctgcggaagcgccccttttaatcagcgaagtggacgacgggggaacggcaatcgaagaaggcccaaagaatgatgggccatcggagggaagtggggcggacgagacggaggagaagcgcaggtcggcacctcctcagctgaccaaagagtgtctgccgacgatggtcacgggccgttacagggaggacttgatcttttacacgccgaaggcacgggccaaaatcagagagaaggaaatgcaacgactctcttcaggttcttcgcgtcgtaaacaaattttttcctccttggaactgacggaaagtgatgcaatttcgttggttggttcttcgacttcgagtagcaaagaccagcaaaagatggactccgatgacaaatcagtgccacctccacccaagccaaaagaccttggccaagttcccgtctatctgacggagcaccaaagggatntgttttttaagccgttgaagccgctcttcaacttaaatacggt

SEQ ID NO: 86935 - DNA, 755 bp, Heterodera glycines
  SCN-specific regions: Sequence locations=1-620,642-755
cataagcttttgtcgtattttcgctttaatctcttcgattgttttccttcaaattgcctaattatccgccattaattaatgacttctcccccctcgccaaatgcgctcctcattttggaggcccaagctgattttgcgttgaatttgttgtgtggcgtgtctagcgtcgaccgttcgtgcattgtttcgccgttttctgtcgccgtcactttgtccatggtttacgcgggcgccaaggaaaagacgggcgaagaaatgggccaactgcttggaaatggtgcgcccgagtcggaagtgcacaaatatttcggcactttgctcaaatcgatcgcaagtggacagaacagcaacactttggagatggccaacaaagtgtacgtgaagaaaggcatcagagtgaagaacgcgttcaaaaaaaaaattgaggaaaactacggtggacggatggaaacggtggactttgaggacatcgaagggacggcggagaaaatcaacaatttcgtggaggaagcgacccatgagaaaatcagcgatttgatcgcgcccgacacacttgacaaggagagttgcttggtgctgatcaacgcgctctacttcaaaggcgcatgggcgaacaaattcaacaaaaaattcaccaaaaaggcgacattttatgtggacgcgaacaccaaaaaagagctggaaacaatgcatttgacgtccaatttcatttatgccgagaatgctcagctccaactcctcggcatgccctacaa

SEQ ID NO: 86936 - DNA, 744 bp, Heterodera glycines
  SCN-specific regions: Sequence locations=1-744
gagtcccgggtctgaactcttagggattggttgcccacaattttttcggattcttccttacagaccgagagacgtcgtttgttgacgaagcgcgtgcacgtggcacgttgcccactcattctggacggactttactgcgcatcgacgaggatggaaactgcgttgagattccgatgcagcgtaaaccgacttcgcccgtcaaaaaaaaattgcttggacattggaaaaccggagatggaactgctgcaagtaaatggtggtcaatgggaatttgtccaacgcatcaccaatgaatcgcaactctatttttacatcaatcgtttcaaccttgtgttcggcagcagcagcaaagcgacggggggacgacgatatttcaattgcattgaacgcggcgggtcgaccaaatgtccctatcggatgatgtacatgttggaaagacaggtactctaccaaaccggggaacataaccattcgttctcactgttacgaaggcgaaagccgaccaaaatcaacataaagggactgcttccaacacccgaaaaaggaggtgatttcgagttgctgtctcttgccactgatgtcgcacaattggccgaagaattgggcttggaattccgcgaggaaaggggtcgttttgtgctgatttcgaattctgatgaaagcgacaaggagaactgcccctctacctccactgccatcccacaaaataatgaagttgtcaaatggctggtgttggcggacaaa

SEQ ID NO: 86937 - DNA, 451 bp, Heterodera glycines
  SCN-specific regions: Sequence locations=1-237,259-451
gagttgctctcctttttattttgacaataaacaatttttcccgctaaatttggcgaacgatggcttcttctcattgcgcacccggatgatgaaacgatgtttttttggaccaactctgttgttcctttcatctatcggtgttcaattgcatttgttgtgcattacgtcggggaattctgagggacttggaacgattaggcgaaatgaattgtattcgtctgcttctgtttatggcatccaacccaaatacatctcttttgtggatccagaagagcgaagattcccggatggttttcgcgattggaatatcaccagcctttctgcgctgatttactcttacattcgacggctgaaacccgatggactgatcacttttgacgaatggggcatcagtggacatccaaaccacagagacagtttcaaagctattttgaacttgaatactgaaggc

SEQ ID NO: 86938 - DNA, 545 bp, Heterodera glycines
  SCN-specific regions: Sequence locations=1-53,76-545
agaaaagaacggattggtaaatacaaattttgcttcatccgcgcaccgttggatttgtccacattttgaagagaatgcgcaaagaaaaatatgtcgactttatctacgatgtctctgtggcgtacggtggccgtattattcagtcggaattcgatttgcttctccttggccttacgcctgcccatgtgcattttttggtacagaaaattccaatttcattaattccggaggaagacgaacaattggagcaatggctgaacaacaaatgggcggaaaaggaggaaatattgcgccgtttttattcgaccggcgaattccttccaacggatgcaaacactgagaaatccttccaaaaaactgagttgtcccctcgggcatttcttctgcgactgatcatttcggccgtttggttggcactcaccgccgtttggaccattattttcttcgggtttttatccgctcaaattcgatggagttgtactctgcttacgattatttactttgttggtttgcaactttattttggcggatttgaactgtttttg

SEQ ID NO: 86939 - DNA, 333 bp, Heterodera glycines
  SCN-specific regions: Sequence locations=1-99,121-333
ccttctaggaactttcgcccagaatttccgccaaattttttcaggaatttcataaaccaaagtagaattagtatatattactaagtttaatggttttatttatttatagatgaaaaccaattttaagaataattttcctttaattcgatttcacaaatcgtttaatcatttgtaagaaccagcattttgaaaaacaatctttttaccatgacataaaaagaaactaaaaaaaggttagagtctcaactaaatgatattgtaaatttcgaaaactattcatggtcatcaacaatcatgatcaaataaaaatcactgatcaaatggatgagagca

SEQ ID NO: 86940 - DNA, 640 bp, Heterodera glycines
  SCN-specific regions: Sequence locations=1-49,71-496,521-603,626-640
atttcgattaacgcttagcgctttatggacacagttccatccttgaaaattggtgccaagcatttgggacaggtgaccgagttgagtgttccggccatacacaatctttgctgagcattcgaattgctgacaatgagcatgtaaagtcctcttccatacactttggcaatgcggtgcgcccattccaactgcttttggcccgctgttgcgcacgcgcgtggtgcgtaacgaatgcgtcactcggacggacacgggccgaattggcaaagcaaaatgggagttggaattggcactgatcaccactgatcaggatggtgctgatgatcagcaagaacaacaacagcgtgaactgctcgaaagctgtgatgccggtgactcgttcaacgtgctgttcgagaatcccgaacaggaggtggactttgtgcttaaaaggttgggtttctgtgccgaaacagcggacactgaacacattttggagctgcacaaagtgccggaaaccaatggaagatttgcccattttccggcccgttgttcgcctcgccaactgatcgcccagttcatcgacattcgcagggcgccttctcgactcgctctccgtgtctttgccgaccatgcgcatgagcctgctgaacgtcgtcga

SEQ ID NO: 86941 - DNA, 584 bp, Heterodera glycines
  SCN-specific regions: Sequence locations=1-142,171-249,279-556,578-584
ccaccagcagcacgccaacgacgccaaaggggacgacgacggaaaattggagcgaatcattagcggctgctgctggcggaaagaccatacttgtgctgatcatcgttggcgcactgattgcaatcattgtcctgctcgtggttgttgtgtgctgctgctgctgcaaaaaacgcaaacgccgccgccgccacacttctgccgacgacgacaaggaggacaacaaaaagcgcaaacgtcgccaccacacttctgatgacgacaaaaaggaggaggaccactaccacattgaccagcacaataagaaggagggggagcagcacggaaaggaggacaacaaatcgccgatacaaagcgaactgaaagtgtcgacgatttccgccgtgccaagcgactacaacacgaacaaacggctgggcgcaacagaattggacgtggaagcggaagaggtgccgaagacgaagccggttcccaaaaagccgaagtcagaaggaggcacaaagcgcaaactgtccaatttcttttggtccaccggcaccaccgagaagcgaccgagcgcggcggaacatggcgtggaagtgccggaa

SEQ ID NO: 86942 - DNA, 650 bp, Heterodera glycines
  SCN-specific regions: Sequence locations=1-17,40-61,84-650
ttatttacttttaaaagcacttttgtttttatttgtaacacctttctgagtcccattagtcatgctcaacacgggaaaatttcttggcaaaacttttgtataacgggggcatcgcgtggcattggcaaggaaattgcacttaaattggccaaagacggcgcgaacatagtcatttgcgcgaagacaactcaggacaacccaaagttgccagggacaatttacagtgcagcggaggaaattgaaaaacttggtgggaaggcccttcctctccaagtcgacgttcgtgatgaacagcaagtggaggaggcggtcgaaaaggcggtgaaaaaaattcggtgccatcgattcgctggtgaacaatgccagcgccatttcactcaccaacactttggacactccgatgaaacgttacgatttgatgcattcggtgaatgtgcgtggcacttttttaatgtcccaaaagtgtgtgccatatctgcgtcaaacttcgaacccgcacattctcaatttgagtccgcctttgctgatggattaacaatggttcgctcctcacgtcgcgtgtaccatgtccaagtacggcatgtcaatgtgtgtgttgggaatgcacgaagagttccgcaaagatggcatcgcagtgaacgcactttggc

SEQ ID NO: 86943 - DNA, 689 bp, Heterodera glycines
  SCN-specific regions: Sequence locations=1-689
gcttattgttattcgtccttttccgacattcgttccatcgattcattcgtcgacaaaattctcatcgccgtaaaagcgccttttgagccccaaccgcgttcttcgatcgaagtgcccgacccttgcgaaaccgggcgatacgaaatgaccgttcgcaatgaaaatggcggtcctctccaagcgtacctttgccgtgagcccacgcagaaaaacgcctcggaactcacaccaaacaattgcaaagcggaaacggaggagaccaaagcgattgactctttggggacacaaagcttttgcgggcccaaaattccgtcgaatgagcttcggtcgccctccaaacagcagagaatgctttcgccgttgaaattgctcttcgccaattctcagccgcaccccgacgccgtctcctcaaattccgtgggccccggcggcgttttcttcccgcccccgggcgattctttcctttcgttggaccccccttttgaggagaatgacccgtactgtccgctcttcatgaacgaccaaaacacttcactgaattcgctgttcggctgatcattcgctgcggcggagaaacgaaaggaaaaggcaaaagaaataacggaaggtgccaaaaaaaagagagaaaaatgcacacatttaacattttctcatcagatgttctacttgcttctcataataaacgtttt

SEQ ID NO: 86944 - DNA, 716 bp, Heterodera glycines
  SCN-specific regions: Sequence locations=1-716
aataaaatttctaacgcaattatttattctgctctttgttgtgtgacatcattcggaactcggccaaaattgtgctaattgccacaaaaatgaaccgacgttggatttgcaacgacgtttggatggacattttcccctcttttgaccgtcctcaactcggcctcaaattggcacttctttcccacgtttaatgcgttggtggacaaacatttcaatggcaaaagcgaattgactatttggagaacgatcggaattagcaaggacaaaggaccagaaccggagctgtctgtacgaatcgattacgaatttgtgccatttccattgcccgacgaccgtccgttgcccagcaaaatccgttttaagagccttcagatttattacattgatcacttcgtcatcgcttttcttcgttcaaatcaccaaattttcgacaaaagaggcaccaatttagatttgtgtattccttactcaaacaccacggatggccagcggatttgggatgtttttgttcgtgaaatttggcccattttttcggcaaatattcatcacttgcgcttttcccatcgtgatcatttggaccatttgcttcgtcgcacttcgccaacaattctcactgatctcaaccaattgacttcaatccattcatttgatttgtttcccgctgcgattggtgatgattttgatgtgccaaatgcaacaatctctgctggccaaat

SEQ ID NO: 86945 - DNA, 703 bp, Heterodera glycines
  SCN-specific regions: Sequence locations=1-141,173-314,336-703
ggccgaatttgccctcatcgctttttcctgttgacgaacattctctggttggccccgatggcgagtcgcctctgttcacccaccgaatcggcaaatcggcgccggagggccaaccgggcgaaaatggcgcggcagtgacactgacgggggaggaggcggctgaagggcggcgccaaatgagctactggttcatgaacgtcaaggcaagcgacaaaatgtcgctggaccgcgcagtgccggacgtgcggccgaacgcctgtcgctcgctttcctacgatttggccgatctcccttccgcctcggtggtcattgtgttcactgatgagcccacttccgtccttttgcgcaccgtccattcggttttcaatcgttcgccaatgtctctgctgcgcgaagttgtcctcgtggacgacttcagtcagagagaggagctcaaagctccgcttgtcgcccatttgcgtcgcttcggttcgcgcgttcggctctttcgagcgaacgaacgtttgggattgataagggcgaagatagtgggagcgaaatacgcccgcggtgatgtcgtcctatttttggactcgcattgtgaaacatcgccgggatggctcgagcctctcctccatcggatcaaagacaaaacggtcggctgtcgtttgccccgtcatcgacatgatttctgactcttcgatgcaatactcgggcggatcag

SEQ ID NO: 86946 - DNA, 572 bp, Heterodera glycines
  SCN-specific regions: Sequence locations=1-572
gcaccgaactgatggtgctggcagaacgcagcttcgaccagtgttggccaattgcggagtaccactgaagtcccaccatatttgatgacgaagacgccgtttgcgctggtcaccgatggggcgagtcttcaccacgcggtgatcggagaggcgagacgcatttttgcggaattaattctcaactgccattccgtcatttgctgtcggatgacgccgatgcagaaagcagagattgttgaaattgtcaaatcgcttggcaacgacaaaacggtgacggccgtcggtgacggggccaacgacgtggcgatgatccaagcggccaatgtcggggttggcattagcggagtcgaaggccttcaggccgcttctgccagcgattattccatcgcacaattccaatttcttcagcgcttacttttagtgcatggcacgtggaattttgaacggagcgtaaaagtcattctgtacagtttctacaagaacacctgcctgtacagcatcgagctgtggttcgccttcttctccgccttctccggcgtgaccattttcgagcggtggaccatcgccatgtt

SEQ ID NO: 86947 - DNA, 425 bp, Heterodera glycines
  SCN-specific regions: Sequence locations=1-79,101-425
acaatggacgtgggaagggccgaactgcttaccaggccgacctcatctccaccaattgatgctcactttgttaggccgatttcctttcctaaaggtcatttcagaagaaaaatcggaatttttgccggaaaaagagaccgaaaggtatcgtgccgataactacgaactttggttgggtctgcgcgaagtattgtccaaattcccatcttggcgaattccgctagcccgggtgaccgtttggattgacccgctcgatgccacgcaggaattcacggaaggtctaactcaattcgtcactgtgatggcctgcgtcgccgttgacgggaagccgatttttggcgcaattcacgcaccttttagcaacgaaacagtgttcggaatggtcgactttggccttttcgattcaaatggtcttcctatcaatt

SEQ ID NO: 86948 - DNA, 577 bp, Heterodera glycines
  SCN-specific regions: Sequence locations=1-204,226-577
cattgggctgacaataaagcgcaacaatgtcttctgacgaatcgacgacttcttctgccagtgttgtgagcgttcagctgcgtgaagtgcccatcaaagacttcaaggacgtgcttccggtgctgcagaaaacgctcaacgaattggaacatccgttcatcaagaaggccgaagaaataagcggaatggaacgtgagaagctcttctacatcacttcctctcttgtgctgctcgtgttgatgctctgccctggcaatatgcttctctctactcttatcactgtggcctacccaatgtacgcgagcttgttgaccctcaacactcaaaacacatcggaatacacccagtggctcgtttattggtgcgtgttcgccgagttttgccagttcgactatctctttggctctatcaatggccttctgctgctgtacgtgcctctgaagaccgtctttctgctctacttggcccttccgcaaacttatggcgctcacaacttgtacgtgaagcatatccgcaaagtgcttgccgtgacgaacgtattggacaggatgaagaagatgttctgatcgagcagata

SEQ ID NO: 86949 - DNA, 618 bp, Heterodera glycines
  SCN-specific regions: Sequence locations=1-533,566-618
tcggatggtcttcttttcgttgcctttatgtaccgggcatcagccaaagcttttggagttccatttatccaacaacagtggcaaacacggaaatgttccagctgaaccagggagtcaatcccaaactgttgttggcattgaccgccattgtccaaggcgtgggccaagcaacatctggtttctttttcggcattttggacagtcggacacggcgttttggacgcaccaaaattgttggctttggtgccgctttgcaactgtgctcctttttgctggcctacctgaatttgccggcgcacgcaccgctcgaaaaaacatttgagcatggcattctgaactcgccaagcatcacgctcgcgttggttggtggttttttgctgagttttggcgatgcctgttggaacacgcaggtttttgccacactaattgccaaatatcccatcagagcgtcgcaagcatttgctgtctttaaattctttcagtcacttttatgctgtgctgcatttttctacgccacttcaatttctttgccatggcatgtgctcattttggccattggtttgttaatcggcttaattggctttttgcttgccgagcgaatggtcagacaaaatgatg

SEQ ID NO: 86950 - DNA, 595 bp, Heterodera glycines
  SCN-specific regions: Sequence locations=1-595
attggctggcacaagaagctatctaagaacacaatcggcacaaatcgccactgatggatcggtgacccataacggaacgagataaaccctaaaggtggaagataaatgcgtaagtgagcgatcttctgctgctatgcctcatacaaatgaacccaaaggaatcataacattgaatgacaagcaaaataagaaggaatcagctgggcgtaaataatttaaatacgacgattgaaggggaaggtgtattagagattatgcaagatggatctgggttcttacgttcctcagactatgattatttagctagtccagatgatgtgtatgtctctccctcacaaatcaaattatttaatttaaaaacaggggatacggctcatggagtgatacgagctcctaaagaaggggaaaagtattttgcccttttaaaggtagtttccatgaatggcataacggtagaagagggacgcaaccggattacctttgagcatcttgtaccgctttctcctaataaaaaattaaatatttccaatggggctacacaatattctacccgtattatggatcttttctctcctattgggaagggacaactcgg

SEQ ID NO: 86951 - DNA, 353 bp, Heterodera glycines
  SCN-specific regions: Sequence locations=1-133,155-353
ccctaatgatatcattaaatgcagcacatatcttagtcagcccaaacctaattctccgttcccaaaatatttttcacaaatttttgctatttaaacggaatccaattttgcaaatctttaaatcattgctcacaattaaataccaaaatatataatttatcttgaatgatggccaattcctctctgatgttgccaattttcactctgctcgccctgctcattgtgatccaattttacgccactgaccaaagctcaatcagtcgtgacctatcgcaattggatcgccaaattagtgataaaaagcaacgagcggaccaattgcgacaacaaattgcaagtgaaaagaacccggc

SEQ ID NO: 86952 - DNA, 346 bp, Heterodera glycines
  SCN-specific regions: Sequence locations=1-201,224-239,268-323
cgatgtgaccatcgctaatggctccccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaacccccaaaaaaaaaaaaaaaaaaaaaaa

SEQ ID NO: 86953 - DNA, 565 bp, Heterodera glycines
  SCN-specific regions: Sequence locations=1-36,60-115,137-304,333 -346,384-410,487-503,532-565
cagtttgagttttaaaagattcgaattttgcaaaagttgcacaatttttccatttttactgttcccaccccgccgctacccagtttttcaataatcagcagaacaaaatgagcgcaacagagcaacaacaaccacaatcacagaagcgggcacgccctgccgaggaaaacggcaacgatgatggcgcggtgttgacaaaaacgcagaaagtggacaacggcgatatacccgcagcaacagcaaataatgaagccagtgcgaacaacaacgtattaaaagccaaactgaccaacaatgaaaagcctggcggagcagcagcagcagctgatgaggagacggaagagcaagggcacgaggaagaggaggagagcgagggcgagtcgggcgccggcggagaggaggacgaccaggatgatgaggaagacgatgaagatggtgcagagggtgacgatgatgatgaagaaggcgatgatgatgacgaagatgccgagggggatgagggcggtgaagaggaggaagaggaagaatgagcttttcgcatctgttttaagctaactcttctggc

SEQ ID NO: 86954 - DNA, 706 bp, Heterodera glycines
  SCN-specific regions: Sequence locations=1-569,620-706
gtgaaaaagatgtcgagaaatctctgccggcacaagttgagcaaattcttcgcgtggacatgaccgctcaacagaaacaatattataaattggtgctgaccaggaactacgaggagctcagcaaaggcgtgaaaggcagcattaatgggttcatcaacataatgatggagctgaagaagagttgcaaccattgttgcttggtgcgtcaatatgacgaaattgaggaagaaccgcaggcgaggctgcagcaactgttgaagtcctccgggaaactcattttgcttgacaaattgctttgtcgacttcgcgagacggggcatcgggtgctcattttctcgcagatggtcatgatgttggacattttggaggagtacatgcggttacgccgatttcctactcaaagattagacgggtctatgcgttccgatttacgcaaacaagcacttgaccattttaatgctcctggctcacccgacttttgttttctcctttcaacacgcgccggtggattgggcattaatttggctactgcggacactgttataatatacgattcggactggaacccgcaaaatgacctgcaggcaatgagcagagctcacagaattgggcagaaaaaacaggtcaacatttatcgactggtcaccaaagggtctgtggaagaagagatcgttgaaagggccaaacagaaattagtgctcgacca

SEQ ID NO: 86955 - DNA, 592 bp, Heterodera glycines
  SCN-specific regions: Sequence locations=1-592
attggtgaaaatacgagcaatcgttgggttagttgtgacatacttggacaagtgttcgcctggccacgaaaatgaacagacgttggatttgcaatgacattttgatggatttgttcccattctttaaccgtcctcaactcggcctcaaattggcacttctctcacctcgtttcaatttgctggtggacgcgcatttcgatggcaaaagcgaattgacaatttggagacaaatcagaattcacaaaaatggacccaaaacacaactatccgtggatacggctaacaatgccgattcggtgccatttccgttgcctgaccgttcgctgcccaacaaaattcgctttcatttcctccgcattggatgtatcgatcattccgtcatcactttcctccgttccaatcagcaaatttttgacggaagaggcaccaatttgcgtctgtggctccgtccggacgccaatgattaccagccaatttgggatgctttcgtccgtgaaatttggccgattttcgtgccaaacattcgccgcttgggcattccaaaaggcgatcagctggacaatttgcttcgccgtacttcgcccacaattct

SEQ ID NO: 86956 - DNA, 450 bp, Heterodera glycines
  SCN-specific regions: Sequence locations=1-116,140-401,423-450
gaaagtcctcacgtgaccggccttaaacgagtgggtgcgctgtgtccattttggttcgcggctccagcaaattggtgttggacgaagccgagcgctctctgcacgacgcattgtgcgttattcgctgtttggtgaagaaacgcgcccttctgcccggcggcggtgcccccgaaatggaagtgtccgtccgcgtccgcgcagctgctcagacaaaacacggagccgaacagtattgctggaaggcatttgcggacgcactcgaagtggtgccatacactttggcagaaaacgcgggactgtcgcccatcgaaacagtgacggagatgcgcagtcagcacgcaatgggaaacaaagagcacggagtgaatgtgcgaatgggtgcaattacggacattcgcgaagaaaatgtggtgcagcctcttttggtcagttcgttcgccgtcaaacagg

SEQ ID NO: 86957 - DNA, 495 bp, Heterodera glycines
  SCN-specific regions: Sequence locations=1-495
gaaaagccgcaggaaatggccagaaacaaatcgactttaaagaattcgtactccaatcaaagcgggcttctgctgttgactaacatgcgggaagacaaatgaaatttcatggcgggcgaagcaaatgaccgatttggactaccggagagaaaagccaaccagagactggacaacgaaagtcgcagaaatggacgaacttcggatagaattgctgagtttgctgcgcgttgacgtcgattgtattttccgaagcgtaaagccaaacattgcggtttgttgtgctgcactccaaaggtcgtaccctgacagaatttacgccaccgatgaaacaggcttggactatttgccatgcctgcagatgatccacaaatgtgctttgagctcgcgcgcgagtcgccgccatttgcaccctttcgaaacggtcgacagtgaaattggtgggaaaatagacgagtcgcataagctgcagtattacctcgaggagtacagcccaat

SEQ ID NO: 86958 - DNA, 743 bp, Heterodera glycines
  SCN-specific regions: Sequence locations=1-160,182-229,251-265,287 -710,732-743
catcgcaaaccgttgagcggcgaaaatgccaagcgcaggaactgttggatttgttaacgaacgttcgctggtgtgggaagacgaggaaaagatgatctttctattcgactacgtcaaaggtgccgcttcacgtggagagatcataaccgggtggtgcttaagacgctgaaggaccgcggccaatggcgcgtcatccggcatcctttggtgctcaattttgtcaatgaaaagctgctctcctgtgccctgttttacgttgtgcacattttgctttactttttgttcttggcactgctcttctcctacgtgaatggtcctccatcggtggccaaaaaccttttggtgtccacaattttgttgttcttcgtgtttttcatgttggttaaagcggcgcttaaattgcaatttggcatcagtgccgtgtccgcctggtttctgatctcctacacatggtctctgatcacttacgccatcactttgctttacatttggagttggcacctgttcagcttcgacgactacaacgaggagcttaaacgcacaattggctggttcttgcccattgtggccacgttggcctcctggatcaactgcttgtatgtgttgcgcaaggcgccctgcggctcctacattttgatgatgtccaaaattctgttctcctttctcaataccaccatcatttggatcccaacccttgccacgttcgcgttcgccttcatgctgatcatgcgcgattcgggcac

SEQ ID NO: 86959 - DNA, 670 bp, Heterodera glycines
  SCN-specific regions: Sequence locations=1-670
cattgtctttcttaccaaaggccataactactttggtaaaacacaatgttcaaaggagatcccaaacacatcgtcgaccgtcctctgttgaaaagtgccacagaaacagtcgcaaagtttaagacactttttaatgtgacagaatggaggaatgtaaaggtgcccgaattggaccgcgcaacactaaaaacatttgtgcgagaacacttcggtaaagcggacgattttctcgagagcccacaaccgatcgattggaaggaaaatccaccgaaattgcaaaacattgcggacccagaattgaagacttttgcaaatcaactgcatgatctttggaaggaattgggcaaaaaaatgccagaatcggcgaaagaaaataagtcgacgctgatttatgttccgaacccttttgtggtgccgggaggccgtttccgcgagttttattattgggacgcttatttgatcgtgcggggactgctcgcttcaggaatgaccgaatcggtgaagcacatgtgtgacaattatgccgagatggtcaagaagtttggctttgtgcccaacggcggtcgcatttactacaacaaacgttcgcagccgccctttctcactttcatggtcaacgattattttgcggagaccggcgacacggaatacctcaagagcattctgccgg

SEQ ID NO: 86960 - DNA, 533 bp, Heterodera glycines
  SCN-specific regions: Sequence locations=1-533
taatttaaaaaaatgaggaaacttccattcttgctcttattttctgcttgttgctacttgcaacggaaggaagtatatttcgccgaaaaaacagaaagaaaaattcatcgagcagcgaacaaaaaacacaaagaagaaaccgagggtatggccgaagtcgcactttttcaaatggcaatggcatgtatggccaatcgaatggattttcaaatggccgatttggcggctccagtgtctattcaaatagcggccggtcgaatagctttccaaatggtggatttggcggctccagtggcttttcatcgatgggacataactcgggcggacttcacggctttgggtccggcccaccttctggaggctacggatacggaagcggttttggtggaagaaaatgaaaaaaagaccgaaagtgatcggcgagagaatgatttgtgctgttgccttttatgcatgcaaaatttaaatggaaaaacgcatttcaccagcagaacacttttttaaatcaaatcacagagaattaataaaaagaa

SEQ ID NO: 86961 - DNA, 429 bp, Heterodera glycines
  SCN-specific regions: Sequence locations=1-15,37-170,192-286,309-429
taaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacactaacttgctgtgaaaatgccggtcaatgaatcgaatcgtctgtcaccgattggacccgaccctcatcatca

SEQ ID NO: 86962 - DNA, 276 bp, Heterodera glycines
  SCN-specific regions: Sequence locations=1-276
gtgagggaagacaccgacgtacatcccgagcgaagggttctaaaatggactaccgatttatgcccgagcccaatttgccccgcctcaacatcgactcggattgggtgaaagatgcgaagcgaagcgtaaaaagggaactgtttttccatcaatgcgttgtccagttcggctaccctccgtcgttcgccatcgaaattatgaatgatgccaaaatggagacttttattcgccattacacctcttctggcaaaatgttgcctaatgattgcttttttc

SEQ ID NO: 86963 - DNA, 192 bp, Heterodera glycines
  SCN-specific regions: Sequence locations=1-70,94-192
atgttccactgaacaggtgccgcctatcagtccaacatgaacaacccccagcatgccccgccacaaccgtcgccgggcgccgcgccggccggcaacaccaccaccacttacgtgtacatggcggacgggggacagccccactgggggcctcggccgcaaaatgtcttttgctcgaactgtcgccaacagggg

SEQ ID NO: 86964 - DNA, 357 bp, Heterodera glycines
  SCN-specific regions: Sequence locations=1-70,99-357
cgaatccccccccccccttttttacttaaaacgcgtctttccattgtccgatgattctgcaatttccattcggggattttaatgttttgttgctgcttacaatcagcactgttcttttggccagatgtttaggcacaattgtacagtttgaagatgaattagaattgatggaaaacaccgggacggcggatgaatccgccgatggtccgttgggtgctttttgggaatggcatcggatggtcactggggctgacaaattcggctccacctcgcagcgaatgcttcatctgcgtccttctttgaaagtgccttccgtctccaagcgaattgccttcccttcgaccgccttcccaaatc

SEQ ID NO: 86965 - DNA, 97 bp, Heterodera glycines
  SCN-specific regions: Sequence locations=1-97
tggactcttttgtcgtcctaagaaaattaaaaaaaaagactaaatattatggagaatacaaaagaaaatgatggaaaaaccgagggacacttgttct

SEQ ID NO: 86966 - DNA, 691 bp, Heterodera glycines
  SCN-specific regions: Sequence locations=1-6,29-342,364-422,449-691
attttatttatgtttgtttcttattttaatcttttaaaatgccgaaacgaagaagagatgcttttatgggagaagacagtggccaaactgagggaagcagtggggggccttcagttgctgatcatcagcagcagaagaaattgcaagaaaaatgtgcaaagatggaaatggaactgaacgtcaccaaattggagctcgaaaatagggcacttaaagccgaattgaagcaaagagaagtgatggatgaactcaatgctctgaagaagaaagttgccaaaatggaagagcaaaaagaggctgctgaacaacgattctcacaatttcaaaatgagcagaaaaaaattctggaaataatcagtgaattggagaagcaacaaaaacagcagctgaacagaaacacgacaaaagctatttttgaacgattttcaaaaataaaaattgatcaaaatacgctattcgaaaaagtcagagcattggagaaagaacaggagaaaggaaaggtgcttttaaattttcgaaaaaattgttgggatgccatcgcttgtcccgaggggatcgaaattgttggcgataagaatttgactgtccatcataaggggatatataaatttataaaaggtcgacgtccccccgtcttcgcaaaacatccgatttcgttggacaattcgaccgacaatttttactttgaaat

SEQ ID NO: 86967 - DNA, 638 bp, Heterodera glycines
  SCN-specific regions: Sequence locations=1-22,53-294,318-318,341 -528,550-638
ttcttttatatacgctttatccaaaatttttttttaaattttacattaaaatgatccatttgcttacgcttacattattgctttttccacattggcattgtcaaagctgaataccgtcaattttaaaagcgatgacattgtgctgctagatgaaatccgaggtgtagcaggcaaccaaaaagaaaacaacgacaaaaacagcgagttggccaattgggcggtggaaaaaggatgcgaaacaattcaaagtttggacaaatatttagaaaatgacaaaattgatgaatacactgaggaaatgaaaaagtttggccaaattgttttgcaaatttgtaaacaaaaggaagtgacaaatgcccaactgatttcttccaacttctgctcaccagcctgagtttggtgaacagtgaaaattccatcaagcatgaaaatgccaaagaaagtttggcgctttctgattatttaattaatacaaatgcccctgttttggcacagcgccgacacagacgtggaattccatcaaaactcgtcaaattaggactgattttagcgctgtttgcaattggcacgaagaccgaaagtccgaaaatagtaatgcttgcttgctatcttggatgcatttactcactatatttttt

SEQ ID NO: 86968 - DNA, 280 bp, Heterodera glycines
  SCN-specific regions: Sequence locations=1-151,173-241,263-280
gctcaaacacctaaagacgtgatacaggagaaaatgaacaataagcttggtcgtgccttacgtgaaattcagttcaatacgctctctacttcaacgctcactaccatgggaccgggccatctgcatgggccaaactaaattgctgcttaatgttcctggagtgtcacaaaatgatactgatgctgaatattgtggcgtgtttcgagatgttgctgctatgaaactgaatggaatataggggatagtcgaaagctggttgtgattttgagggagcaatgag

SEQ ID NO: 86969 - DNA, 393 bp, Heterodera glycines
  SCN-specific regions: Sequence locations=1-393
tggattaattcgctttatcgttaaatgtgccgactccagcaactcatctgctcgctcgactctttctgcttcttgcgctttgcactgctctcgttagctctctcacggctgttgccccgccattcggccaattgtccgtttccggcaccaatttggtcggcgccaacggacaacccgtacagctgatcggcaactcactgttctggcaccaatggtacccgcagttttggaacgctgacacagtgaaggcactcaaatgcaattggaatgccaatgtcatccggggggccatgggcgtggacgagggcggctatctgagtgacgcgaacacggcttacaatctgatggtggcagtgatcgaagcggccatttccaatggcatttacgtgatcg

SEQ ID NO: 86970 - DNA, 374 bp, Heterodera glycines
  SCN-specific regions: Sequence locations=1-179,201-274,314-374
gcaggagaaacggcattatcggcacgtgcctgatgatgagacaactaaacgcgagtacttttgctgatcagtggacatagaaaatggccaaattcgattgcatgaattaggaaatggataaatgccatggcatcgccaaaattcaattattcccgctgaaaggcatggcaataagaaactctcacttctgctgtctctgattatagtgattgatatctgctgatagtatttgatcattccgatcaactcaaacatttctcttctcatttatgcctttatttttttaaataatgaaaataaaaataaaattattcattgtaatgttttttgagtttaatatttaataagcaaattgcagaataaaagtcgtcaaa

SEQ ID NO: 86971 - DNA, 678 bp, Heterodera glycines
  SCN-specific regions: Sequence locations=1-678
actccgtggaaatgaccttttacagccgcgtttttactccgtctttttgcttatgcaaattcggatgcagtcggaaaacgcgagaaatctgaaacaagcgatccgaatactgagaaatcgaaggctatacttggaaaaaaacagcaattagtggacacaaacgatgttcgaagtgaagtggttcgaaggaaggctgcacttaccttattaaaagctccgtttgtattgaaaaccaaacacaaaaatattcaaacacctgaggaacaatcatccgatgatacgcttgtgttcatgcgaattctcaaaagccttacattttttaatgttcaacttcttagacgtcttcaaatgctcgacgaaaagtgctttttgcacggttttgcccaattcgctcttcatttgagccaacgcgaacccggcaatttgcttttcgttagtttgttgcaagaaggcattttccatcggtactttgctaaacatggcgatctttttcatcatgacaatctgagtcgagcaaaggatgattggatttgtattttggcgcacatttttacggctaaaatattgccattttacgtcaatttacaagggacaaatgagtcaatgcctgtcttgcctcctcttgacgagtcaatcgaagcacacattgagaagcataatcgggaagtaaatgaactg

SEQ ID NO: 86972 - DNA, 689 bp, Heterodera glycines
  misc_feature (592)..(592): n is a, c, g, or t
  SCN-specific regions: Sequence locations=1-229,252-310,332-362,384 -612,635-649,675-689
atttgtaatcgaaaacatttctctttttttgtccaaaaaaaattaaaatgactaaaaccatttcatttttgccgtttttccttttggctgtcgttttcgttggcttcggaaatgccggcgtaattcattcacaattgaaaaaactcgaagagcgctatgtccatggacgagcacaatcaccgcaacatccctcctcatcatcaccagcagtgaaaccatcatcacccaaacattcttcttcatcttcttccgatgacgctgataatgaagaaaccgatggatgtgcgtgccctgctgaaaagccacaatcaccgcatcattcctcctcatcatcaccagtgatgccatcatcccccaaacattcttctttgccttcatcacccaaacatcattcttctgaggatgaaacggaagtgaagcaatcaccacctcatcatcattcatcttccgactcggaaaaagaagaacaaaaacttcatgcctgattcataggcaccagaaccagttggatttgaacagatgaatttgagaagtatcatctgctgacgacaaatagggaaactttttttcaaatattaccattttacgaatntccacctttttaacacacactttctttcttttatatcatagattaatgatatggaaatttttattctatcctttaaaaatgtgtcgtcttgaattgt

SEQ ID NO: 86973 - DNA, 507 bp, Heterodera glycines
  SCN-specific regions: Sequence locations=1-282,306-314,344-408,431-485
cagtgtgaagaaggctgttgaccagtgttcgtcgccaagaccgggcggacatcgctttggagacgtcttgagagcccgctgacaccttctcccaggaggcgcgaaaggccaacgaccagatgctgttcgtgatgaaggacaagaagctcaactcggaggacaaagtgcgcaaattggaggagtgggccaacactttgccggagaatgtgcgcggagagctgcgcgtgcgcgacttgcgcgagctgaagcagctggtgcacctgtacaacggactgacgcccgtcctgcaccagggcatccaaggcggcatctgaacggaggaagagaaagggaggaaagggggcgaccggactgatcggacggaccgaaagtgatcggtgatctgttgtcattgtgaacgaaaatgccgcattccattcctaatttatttaagtgggtattaaacacattaaaatgcattgcaaaatgaatttgttccatctcacaaaaaaaaaaaaaaaaaaaaaa

SEQ ID NO: 86974 - DNA, 693 bp, Heterodera glycines
  misc_feature (653)..(653): n is a, c, g, or t
  SCN-specific regions: Sequence locations=1-693
acatccgatgtatgtgaaggtgatacatccctacggcgaagtgttgcacgtcgactggaccaaacagtacaaagcattgaggggcaaaattggcattgcctttcccgggtacatgatccacgagtccggccaatggtccgacattcacaagaaatggtttttcttgccgagaagagcgtcaaacgacacttattccgaaacggaagatgagcacatgggcaccaatttattgctgatagccgacgaggactttgaacatattcaggtccgtcacattgggccccccggcgatggcttccgcggtttctccgccttccaatttttgccaaacaccgaagatgacatcatcgtcgcgataaagtcggaagagcgaggcggcaagccaatcgcctcctatttgttcgtcttccgtctcagtgatggccatgtgctgttggacgaccaaaagtttgacgggccctacaaattcgaaggggtcgtcgtgtactgacagagcaaattgggcaatattgttgaggagtcagagtttgttatttgtgtatttaaaaaagagcagacaaaacgccgtcggcggaggagaaaaagctgacaataaatattccatgaaattttttaattaaaggcatttggaaccactcgaaaacgcaactatntttttttgcttttttaattattttgcccacctcatttggc

SEQ ID NO: 86975 - DNA, 602 bp, Heterodera glycines
  SCN-specific regions: Sequence locations=1-578
acccgagctgatcgcgagaagcgccagacaaccgagctgatgaggagaaccgccaggtagacagtgctgatcgggagaagcgccaagacaaccgagctgatcgcgagaagcgccaagacaaccgagctgatgaggagaaccgccaggtagacagtgctgatcgggagaagcgccaagacaaccgagctgatcgggagaagcgccaagacaaccgggctgatcgggagaagcgccaagacaaccgggctgatcgggagaagcgccaagacaaccgggctgatcgggagaagcgccaagacaaccgagctgatcgcgagaagcgccaagacaaccgagctgatcgcgagaagcgccaagacaaccgagctgatcgcgagaagcgccaagacaaccgagctgatcgcgagaagcgccaagacaaccgagctgatcgcgagaagcgccaagacaaccgagcaataatgtattaagccattacggatgacattagattttccgacaagaaacgtctactatgaaaatgtttcaataatacaccgaaccttattatgtaaaataatcaaataaaattttaagataaaaaaaaaaaaaaaaaaaaaaaa

SEQ ID NO: 86976 - DNA, 670 bp, Heterodera glycines
  SCN-specific regions: Sequence locations=1-485,507-670
gttaaaatccgccggaactttgccctcgaattggcccgcctttatgtggcggaaacggtgttggccatcgaatatttgcactcgtgtggcattgtgcacagggatttaaagccggacaatttgctaatcacttccatgggacacataaaactgacggatttcggcctctccaaaattgggcttatgaatcggactactttggtgtcggaaggttatctgctacaggacgacacgcagcagttcaaggacaaccaactttgcggaacgcccgaatacatcgcaccggaagtgattttacgacagggatacggaaaaccggtggattggtgggcacttggcgtcattctctacgagtttttggttggaattgtgccttttatgggagatacgccggaggcgttatttgccaacataattaatgaagacgtggaatacccggagggggacgaggcattggattcggatgctgagtcgttgattcatcttttgctggagaaaaatccgctggaccgactcggcaccgtcggcggtgctccccaagtgtccgcgcatccgttctttgcaccactcgactttgacacaatcttgcggcagaaggccgagtttgtaccccaactcgagaatgacgaagacacttcctacttcgactcgcgctccgaccgttacaacc

SEQ ID NO: 86977 - DNA, 664 bp, Heterodera glycines
  misc_feature (663)..(663): n is a, c, g, or t
  SCN-specific regions: Sequence locations=1-286,355-664
gcatttctggttccgtcgacatggcaccgcggatgctgctgctattcagcatcggtttagtgatggcatttccgtctcgtcaatgccccgtgctctgatcaatcgtcaaccgccggtgatcagtgcttcgacgaaaaaaacgggccgcaaacgcatgtcagcttcgtcgagtgcctttgttcccgaagacgaggaagacgcaccggccgcctatcgcttgccatcgaatgcgatgggtgacgcacggggacagaagcggaaaaggtccgtctcttcatccagcagttcttcctccgtctcctcctccgattcttcttcttcctccggctcttccagctcgtcatccgcttcatcacatactccactgaaaaacgcaaaaccaaatgcatcagaacatccatcaaaaaggacgccgaatgagagggagaaaagcaacgacatgagcggaagtggtggcacgaccattagctgctcaactgtggaccaattggcgctcaaagtgacaaaggcggagcaacaggaagtaaatgcgcaaaacgtggcgcaaatggatgacgaaagtggacacaaacaattgagcaaaaatattgcgacaggagaaagaaaaaacgtcaaaactgaaaaagctccctgcaattcttcccgtttggccgatggggacana

SEQ ID NO: 86978 - DNA, 687 bp, Heterodera glycines
  SCN-specific regions: Sequence locations=1-510,585-640,662-687
gttgcttatcggacaagctgaaaaaactagttaactcgtaatatttgtttttaattactgggccgaatgttggaatggctaactgagcatggaaagcctctcagagtgaaggtgaccacgatggacgctgacctgaacgagctcagcattgagagggattcgctgggccaacatctgttcgacaccgtatgcaaaatcatcggccttcgggagatatggtattttgggttgtgcttcaccaaccgcaaaggcttcacctgttggcttcaaatggacaaaaggataaaagaccaaagcgtgccgaaacaggaggacggctcgctgcacttcctcttcctggtcaaattcttccccgagtcggtgaaggtcgagctgatccaggacctgacccggcatttgttctttctccaaattcgccagtccattctctccatggatttgtactgtccgtcggaggcggccattcttttggcttcctatgcggtccaggcactgtacggagacattggccaacaacaacagcagcagcaaccgcaacaacaacagcaggccgatcagcaacaacaacaacaacagcagcaacagttggatttggccaaactgttgccggtgtcggtgctgcaacaatacgaactgacggccgaaatgtgggaacagaaaatccgcaattggtgggccaacaacagc

SEQ ID NO: 86979 - DNA, 326 bp, Heterodera glycines
  SCN-specific regions: Sequence locations=1-296
cgccttataaaatccgggctgaagaaatgtacgatatttttggcaaatttggtgcaatacggcaaatacgaattgggaatacgcctgagtcacgtggtaccgcatttgttgtttacgaggacgtttttgatgcgaagaatgcctgtgatcacctcagtgggtttaacgtgtcgaaccgatatttggttgttctctactaccaagcgacgaaggcatggaaacggatggacacggacaaggctcgcgtaaaattggaggaagtgaaggaccgctacggattgggcggagacattgagaaaaaaaaaaaaaaaaaaaaaaaaaaaaaa

SEQ ID NO: 86980 - DNA, 627 bp, Heterodera glycines
  SCN-specific regions: Sequence locations=1-627
atctgactccaatctccacaaaatggcatttattcgtttgaaggacaagtcatcaaaaggataagcgccttcccccgccccgcaaatcattcgttccgacttttgggcttctccaaaagtgactgtctcatcagcattccctcttcctccctttgtcacatcataaaaccctctgatgagggcgtctcattctctgaaaattcggacagtttccatttgtttgccgaggttctcggctcagaaaatcaaattgccattctgagggatgagcaaacggatgaagaatttgtgcttaaaccatacagggacgacccctccaaacggtggatgctttgcctccaattgttgccaagtgcgacgataaaatggcaaacagtcagccaacaacaacagagcccggccaaagttgaatttcccgaagtcagttataagcaaagtgcgtcgactagaatttattggacggatcagcacggcattcagtcggatgtgcagagattgcaacgattacttaaaaggaccgacagatcggaacagttcaggcaggaattgagaagaattgcgacttatgcaaccgcgttgggttaccataattttgcgagtgtttttgcggaagtgatcgaacgaatg

SEQ ID NO: 86981 - DNA, 585 bp, Heterodera glycines
  SCN-specific regions: Sequence locations=1-585
atctattcgccgtttttcgtctctttgttcgattttctcttctgacaatgccttcaaaaatgacttttctgtatggcgtgccattgtttgtcggctgttgcaccattctttggatgttttgggaccgattcaaaaaaacaccaaaaccaccagcagaccaaatttgcctcgacaaaatgacagacaatcgaaaagaagcggcggaggaagaaatggcaaaagtggaggcaaaaatggaaaaagcaatctttatctctggtgactgttggctagccgtgttcgatttgcttccggcttatcaacttggcctcagaatttcgatgatcagccaccgttttaacatctacgtggacgaacacttcaaaacccgcaaatggggattggattttcttcgaattggaagcaaaattgacgagaatggcaccaaggagatggaaattgtcaattacgatggtgaagaattgccaattccgcaaaacgaagtgccacacaaagtcatcggattcgaatgcatcatcatctcattcatcgaccgaaatgccattgcttttctccgccgttttcgccaactcttcgccactcgtc

SEQ ID NO: 86982 - DNA, 121 bp, Heterodera glycines
  SCN-specific regions: Sequence locations=1-93,115-121
tatgagagtcgcgactctttcttcaacttaaagaaggagaaagtgatcgcaagaggaggaatttgctgatcactcccttaaactggcaaatgccctccctccgtttccctcccccgcccct

SEQ ID NO: 86983 - DNA, 594 bp, Heterodera glycines
  SCN-specific regions: Sequence locations=1-179,207-389,431-494,516-594
atcgtaattaactcgtcgtggctggtctcattgtccttctgctggacgaattgcttcagaaagggtatggacttggctcgggaatttcgctgtttatcgccacaaacatttgcgagaccatcgtttggaaggccttttcaccggcgacgatgaacacgggccgtggcacggaatttgagggggcgatcatcgcacttttccatctgttggccactcggaatgacaaagtccgtgcacttcgtgaagctttctaccgacagaatttgccaaatttgatgaatctgctggccactgttctagtttttgccgtcgtcatttatttccaaggttttcgtgtcgatttgcccataaaaagtgctcgctaccgcggccagcacagttcctatccgatcaagctgttctacaccagcaacatccccatcatcctccaatctgcgctcgtctccaacctttacgtgatctcacaaatgctggcggccaaattcggcggcaacattttggttaatttgctcgggacgtggtccgactcttccggcacatatcggagcttcccaaccggtggtatctgctattatctgtccccgcccgagtcgc

SEQ ID NO: 86984 - DNA, 531 bp, Heterodera glycines
  SCN-specific regions: Sequence locations=1-531
gtggaaagcagtggaaattgcttcgtttaaggcgaactatcggccgaattgcaccaagtcaaactctcaaatatggacagacgtgctttcgattcggcaccaaacaaagaatttactccccacgaattggaattgcgtccccatttgtccttcttggaacggtaccgagaggacccaaattcgaactcatgcatccgtttggaaaatgttcccaaaatggtttacgcggaacaactcgccgaatttctcggtgtccaattcgatgcgccatatgaaaacattgcgcggatgcaaaacggcgtcctttacattaatttggtaagcatttttttgcaaaatggcattttcaggaaacccttgagctcaactcgccttttgaggcggtcagcaccgtaaatggacaccaatttatgctgcagtcgtccaaggggcggaatccgtactgtgagacgtgtctgggcacaatttggcggcttgcgcagcactggcgaagatgcaaaagttgtggttatcgaacgcatgagaaataca

SEQ ID NO: 86985 - DNA, 614 bp, Heterodera glycines
  SCN-specific regions: Sequence locations=1-40,64-356,378-614
agtcggcgtcacttgcgaccgatgtgcgcccgagcgttaatttgtcgccccaaacccccaggggtgtttgcgctgcttctgctcaggcgtcacgcgcgtgtgcgaaagttcgcattggcgccgcaaccgagtcgagctcgattatgcgcgcggagaccgcgaccaattggaggcgaccacgtcggacgcgcacagtccgtacaagccgccgacgcaaccgcaggtgtacgatggttccatcagtttcaacgggttttatgaggcacgcggtcaaacactatactggagcttaccgcaaaagtttctgggcgacaaagtgaccgcctacggtggcaaactccgctacactttccgcttctccggcgccgggccgctcaacccggacgcggacgcgatcatccgcggcaacaacattcagctggaatatgtgagcaggcagcaagtgcacgcggaccggcccaatttggtggaggttccgatcactgagctcggctggcgccactccaacggcgtctccgcctcgcgcgagcagctcatgatggtgctggccgacctggacgcgcttctgatcaaaatgagttacatgcgcgagtgctcgcaagcgtcgcttgtct

SEQ ID NO: 86986 - DNA, 657 bp, Heterodera glycines
  SCN-specific regions: Sequence locations=1-657
gacttcttccgcacggtgctaacaccggtgatgcctcctatttcttgtccattctcttttcggctgtccacgtcttgaagcacccggagagccttcgtcggctgaagaacgtcgagttggcccgtagtcagtgcggtggagtgcatcagtcgtatcctttcgccgactttatgggctcgcaatcgactctgcaagactttgacgattccgacctcctcttacgcgtggcaattctcaacgaacacgaagggaccattgagtatcattctttccccattttgccaaaaatgactgtggcgaaactttgccgaatgattgcccaccaattttcggttaccaatcccgaagactatcgactctacctgatctttgacgattacgaatcgcctcccctcgagcccactcaaattcctcatttgctgcgcagtcaaatgaacgagacggaacggccacaccatttgttcgtctacaaacgggcggacgtgaacatttcgtacccggggcaagcggtcgctaactttttcgcctcaaacacgacggtgctgatgaatccgccgccattagttgtcacaaatatgaggaaccatcgatgaaaaaggacaaaagggtccgattgttcagattttgttgggcattttgttctcgccacatggtcct

SEQ ID NO: 86987 - DNA, 667 bp, Heterodera glycines
  SCN-specific regions: Sequence locations=1-667
caaccgggaatcgcattgacacttaccgattgcgttgagtggttcttcatcgacgacaacaccggcaaattcagcgaccgtttttccgatgatcagttctcattgttcgatgcgatccaccaacctcgtccgctggtcaagagcaacgtgcgagaaatcattgacatggcaaacaatcggcggcttactgttgcggaagcggtgcgtgcgaatgtcttgtgccaagacactggaagattcatcaatgtgcacggacacgctgagtcgctgcgtgatgcgcaccaactcaatatgattcaaaagccgcagactttggtcgaggtcattgagagtggctcgctggacaacgatggtcgtttcatcgatggtgtcatacctcgcactctgctcgaggcgatttgctcgggaatgctcgacccggatgtggcgcacatcaaagcgggaccaggcgatgagctgatttccatcggagaggcgctgaagcgaggccgattgacgccgaaaggagaaattgtgttgactctgggtgaagttggcatacacagaggagagaaaattaatttgttcatggcgcacgaacggggccttttgaccggccgtgttcgacacaccatcttcgatgtaaaaggagtgagaaatgctgcggatggttcaattatgagcttca

SEQ ID NO: 86988 - DNA, 660 bp, Heterodera glycines
  SCN-specific regions: Sequence locations=1-5,85-85,225-232,257 -267,289-365,387-660
gatttacgagtgatcggaagggcgaagtgctggtgaagggaccgtcggtgaccaaaggctattaccgcgacgcggaaaagaccgccgaattgttcgatgagaacggctttttgcacaccggagacattggccaattgttgccggatggacggttgaaaatcatcgaccggaagaagcacattttcaaattggcacagggcgaatatgtggcaccggagaaaatcgaaagtgtttatgtgcaatgcccacttgtccagcaagtttatgtggacggcgacagtttggaacgaaatttggtggcgatcgttgttccaccggagaaaaccctcaagcgattgtacaaggaattgcacggcacagcccaaaatggcgatttggagaagcgctttcaggaaatttgtacggacaaaaagattgtcgaagctgtgttgaaacaaatgcaacagatgggcaaagagcagaagctgagcagcattgagcaggtaaaggcaatttttctcgaggtggagccgttcagcgtagaaaatgggcttttgacgccgacactgaagtcgaagaggccccaacttcgacaaaataccgggaacaaatcgcggcactgtacagaacgggcgaaaagtgaacgaattgccattggaaagacggagaaaaatgcctcat

SEQ ID NO: 86989 - DNA, 622 bp, Heterodera glycines
  SCN-specific regions: Sequence locations=1-347,369-622
catcttttcgatctgtcgcgagcgaagtgggcttaaaacgttggatgcgttgtgcgttttcggttttccgcatttcacgccgcttcgtcagggcgaatggacctttcagcctgcctttgttgaccacctttactcctttgctgggcaacgccttccctcggtgggccactcaaaaaacggccaaccgacagacggagaatgccagggatggcccaaggcaattgccatggccaatgcttttaaaaatggaccaacatcggcgaagtcggggggatcaggaggagagcatcagcagcaacgacaaagagcggcaaaccgtcgacaaatgggcaaaaggggcgccgacaacggcgatggcaatggaaaagctgacggcaagatcgacgacgacgaagcgtccaccgtaatggaggcgaccataatgcaatgtcggaatgccatcggcaacatggtgcagagacgcccttgtgtggagccaacgctcgtcaaactgctcaaaatcattcacccattttacggaagtgagaaggaccacgaaagggcacgagctgtggatttcacagtgttgattctgcacatttattcggaaaatgcctccgactgttcgttgggcgttgccaat

SEQ ID NO: 86990 - DNA, 768 bp, Heterodera glycines
  misc_feature (732)..(732): n is a, c, g, or t
  SCN-specific regions: Sequence locations=1-245,267-768
caccgcgtgtctgaagttcgtaattacgcctttttcttctggcttccttattacttaacctataatataatgggctgagtcggaggcgaaccaattgtccatttggtatgacattggcggaattgtcggttctgtgcttggcggattggcttcagaccgactcggtcaccgcagtcccatcattctcctgatgcttgttttgtccgttccgttgttgttcatctactctggccttggttcctcgcgggttgagcacgttattggcatgtctttgctcggagtgaccatctcgggcccatacaatctcatcgttggcacaattgccattgatttgggttctcagcaagccttggccaacaatgctgaggccctgcctaccgtaactgggctcattgatggcattggctcggctggctccgcattgggccaactttttgtgccgttgattcaaaatgaacttggatggatttgggtcttccatttttttattttaatgaactttctttcatccatgtgccttatccgtcgtttcttccacgacgctcggctcatttccctttcgtttgctccgaggcaaaatggtcgtcggcaagagaacgagccgctgatttcgaataactgaactgaaattgctattgtatttaattcatataatgccaaatatactcttaagtcgccaaatgatgtaaattttgtttttgttgacttgttattttgcaacacattccatanaattgccacacattaaaaatttgaatagctttttga

SEQ ID NO: 86991 - DNA, 236 bp, Heterodera glycines
  SCN-specific regions: Sequence locations=1-58,95-193,215-236
tccttttcgcgtaaacaaaattttaatttatacttgctgagcaagtggatatttaagcggggtttccttttgcaattaattaattgtaattaattgatcgtctccccatggcttcttcactcaccattgaaaaacgctgcaaacttttcaacacaaaacaaatggaatgccaattcgatggaactgaagccggaaaatgtgctttttgtgtaaagcttccgtgtaaatttggatca

SEQ ID NO: 86992 - DNA, 479 bp, Heterodera glycines
  SCN-specific regions: Sequence locations=1-146,169-479
tttcctttctcgtccttccatttgccccccccctaaaatgccgttcaattgcgaatttgccggcggagtttgtgccgagatcggtcaagtgctcgccgtttggctcttccaatggatgttcatcgatttcgcctttgtcggcaccgctctgttccttctcctccttttgcatcgttcgctttggcctttggctctgttgtacttctgttggtactgttacgacttcaacacaccgaaaaaaggctcacggcatttccgttggcttcgaaatttgcacttgtggaaaagtgtggccgaatattttactgtggaaacggtcaaaacggcggaaattcccccggacaggaattacattttctctgctcacccccacggcgttttaagcatttcctcggcgttggcctttggcaccaatggcaccgacttccaaagactgtttcccggcatcgaatggcgcgtggccaccctccccatgaatt

SEQ ID NO: 86993 - DNA, 458 bp, Heterodera glycines
  SCN-specific regions: Sequence locations=1-458
acgcccatcccaaaaactgataaaaaaaatggcgttcctctcccgtctctccatccttccaaattcgccaatttcgctgcttgcagtttctttggccgttttggctttcgtcgctttggcatcggccaatccgccgacggcacgcgaaacggcgccaaatgcgcagcaaaacaatgccaattcagtggcaactggggaaattgcgaaaaatattgcggaaaagatggagcggatgaatgagttcattaaggcgaagaagttcatcgatgcacataatttggcatttgagaagggcgaagtgtcgttcaaagttgcgccaaaccatctgatgcattttacacctgcccaatataatcgaattcgcggcttgcaaatgcgcagcaaccgacaacggcacaacatggcaactctggcgggaaacagcagtactttgccggaaaagttggactggcgcgaga

SEQ ID NO: 86994 - DNA, 216 bp, Heterodera glycines
  SCN-specific regions: Sequence locations=1-216
acgaggacacaccgacttcaaattgaggtgtcaatccgcgcaacacggagtccgtccaattatattttcgtggccaaaaaactgcaaaagttgtaggacaactggcaattaatgtgccggaggatgggagcattgtgagcggcattttggtgcggcgaaatttcaattaccatttgttgcatccgaatgaactcagcgcttacactgacttggcca

SEQ ID NO: 86995 - DNA, 711 bp, Heterodera glycines
  SCN-specific regions: Sequence locations=1-711
tcaagaaaagtccccgattcgattgtttatcaaaatgactggcaaagaccaagtgaaaaatgaggaggaagaattggtggaactgaaggacgatgactcatcactgttccgttatgtgcaagacttgctggtgacgagtcagaaatgcggacaatcgccgaatgtgtttagtgctgatgcgaattctctgatttgggaaaacacttttacgctgatttattcggttaatgagaatgaggcggcagaatgcccaacggaggacacggaggaggctatgactaacaatttggacgagacaaatcctttggttgaacaggcattgaacgtgatcaaaatattacacgaactttctcgctcaattagcaacttcgaccaaattattggtgttgaagtcacttttccgactcttcctgaagaatcatttcatagtacaaaattgtcgcaaaaactttgccaagaactgactgatccattagtggtttctgcaaaggcgttgcctaattggtgcaactatttggtacacaatttcccatgtcttttttcgatggacatacgaacaagttttatgaacacgacagcttttgggacctcacgggcaattgcgtatttacaaaccgctttcaacatggcaggccttcgaagagatgaccattaccctgagtacagaataggacgagttaaacatgaacggataaaagtgcaccggtcgcc

SEQ ID NO: 86996 - DNA, 463 bp, Heterodera glycines
  SCN-specific regions: Sequence locations=1-256,279-463
ctcctctgtttaaagcccttttttaatcggaaatgaatccaacggttttttctttgttttagcggtgctctttcttgtcaaagtcgactttttacagtgcaaatacaatgaaccaatggcacgacaggtgctgcaaaagcatgcatcacaatttcagcagcattgtaaaaatgcccgcagaggaagtgccgtggccaaatgttgcagtgccatcagaagcataatgggccgattcacaagccaaaaaaaggcaatgaaccaaatgctggccaagtgtaaagcgggcacaacgccaagcgaagcacagcaaatgcgaagaaaattggaaggatcgaataaactgaaggattgtggccagtttaaaagccaaattcagcacaagttcagcgggttgaagcagtactgctacaatggggcagaaaatgcggaggaaaacgacgaatgatcagagagggagagagaa

SEQ ID NO: 86997 - DNA, 534 bp, Heterodera glycines
  misc_feature (49)..(49): n is a, c, g, or t
  SCN-specific regions: Sequence locations=1-510,532-534
gggcgcatttgctgaagagaaaggggacggacagaacggaattaatggncaaatcatccttacgaatgcgtggtaccaacccgagctgaattccatcactgtgcccgcctccatcctggcgcagcccttttttgacaccgaatggcccgaagcagtgatattcggcgcaatcggcgttgtgcttggccacgaactcagccacggctttgataaccacggggtccaatgggacgccgaaggtgcggccaacaaatggatggacgcgcattcgcaacgcgcattcgacagaatggccaaatgcgtggtggacgagtactcgcagctgtgcccattccctcccgatggcattgttcaacccgcgtgcattgacggagacaaaactcaggcggaaaacatcgccgacaacggaggtctccacgccgccttccgtgcctatcgctctgcgctcgaagtggacggaccaagcaaagcgttaccgggcaaattggtcggccgcttcaaccacgaccagctgttcttcctgttctttgctca

SEQ ID NO: 86998 - DNA, 272 bp, Heterodera glycines
  SCN-specific regions: Sequence locations=1-272
gcaggaagaagcgcacatggtggaagagcatagttggtcgaacgtactctcgaatcctgttcaaaatgtatcaacagcaaactgtttgagaaacacagtattgttgcctatggcctaaagacatatctctccgtggtcaattgggacggtctttcccctgagcattgttacattgcgccaatggcacattgtgcgagtcttgtgcagatggatgaggatgtgtatgaagagatgaaattgtggatgaagggattggtggcgatgtggcggga

SEQ ID NO: 86999 - DNA, 469 bp, Heterodera glycines
  SCN-specific regions: Sequence locations=1-469
gcaactttctaaatactttgactatgtcaaatttcggctacgaccagcagcaggtccactcctactatgtccagggggacaacccctacgatcagcatgcggatttggatgtgccgcaccgtcccaagaatcaacagccgtttaattcgcaacatttcgcggagcaaggcaaggccgggatgccgaagaacgacctgggctttaacgaccagacaattcgttcgcgttttgtgcgcaaggtgttcttcatcgtgggcattatgttgtccgttgtcactctgatgagcgcttttccgtttatgtgtcagccaatgatggagtttgttcaacagcatccagtatatgcgattgtggcatatctcatctttatcgtcgtttatctcgtgttgatgtgctgcggccatggaatccgtcgatcgttccccattaacatcattttgcttgccattttgactttttccattggctt

SEQ ID NO: 87000 - DNA, 568 bp, Heterodera glycines
  SCN-specific regions: Sequence locations=1-568
aatcggcgcatgacaacatggaagaatcggtggaaagcaacaacagcgaacaaataaacacaacaggaagttgaacagctaaaacagctcgaaaatcgggaggagggagccaaaaatgggcaacagacgaacgaaactgttgccattgaggaggaatggacaccgacaagtgaatgggtggagtcgtggaagaagaagttgccactgcagacgatcatgcgagtcttgcagattttggtgccgcaagtggagaaaatttgcattgacaaagggctcaccgatgaaagtgaaattctgaaattcctccaacatggaacacttgtcggacttcttcccgtccctcatccaatactcatccgaaaatacattgcgaattctgcaactaacaattggttcagaacatacctttggggattcgtttattgccgtaacatcgacccaccaatttggtttgacagcaacgtcactcttttcgaaattcagcgattgtgaaggaatgaaaatgaatggtttatgcactgacgaaaatgcatattaagaaaaaaaacctattgctgatcgagcagct

SEQ ID NO: 87001 - DNA, 625 bp, Heterodera glycines
  SCN-specific regions: Sequence locations=1-409,431-625
acaaagagcttaaatacaggacaatatcttacaaataaggacaaagggtaaccctgacttagaatcttttaaaatgactggcttgtccgaaaatgtggccttttcccgcttcgtctctgagtttggtggccgctgcaaagaactcaaaatcgctaatgaattcgccagggatccgagccgtgccaacaaatacacgcgaacgctcaaagacggaaagggcagctggcaattgtgcgtggacttctccaaaaacctcatcgacgacgacatttttcaccaactcatctcagtggctcgctttgctgaagttggacaatggcgcgacaaaatgttcaccggtgagcgcataaactttacggaggaccgaccagtgcttcatgttgctgcaaggaacacatcaatgacgccgatatttgtcaacaataatgacgttatgcccagcgtaatggcggtgctgacccagatgaagatgttttgcgacgacttgatcagtggccgatggaccggctggacaggcgaacgcatcaaggacgtggtcaacatcggaattggcggctcggatttgggcccgttgatggtgacggaagcactcaaaccgtaccaacaaggccctaatctgcatctc

SEQ ID NO: 87002 - DNA, 501 bp, Heterodera glycines
  SCN-specific regions: Sequence locations=1-475
cgcgaatgcgatattcgtatcgtaatggatgcgttaagcagtggaaaagcattgctttgtctgccgatgtttgccgaacagttttatgtgtcggaaaagctgcgacgcatgggcgctgcggttgtgcttgatccgcgcagtggcagtttcaccccggaggggatttccaaaagtatcggcgaagcattgacaaagcgtcatgccgttacatttccttcaaacgaagaatccctgaagcaaacaattttgaatgcattcaagaaacttgaatgattgcggtgtgtccgctgctgctgatcgcggttgtgacatcatacaatgtgccgcactgatcaaagagagattttcttttagtttttccatatgctttttctattttctatttgggtattagatgagtgattctatccgtttttcaatagtttatttcatatttcctgtttttttgtaaattctttatgtataaattgttgacaaacaaaaaaaaaaaaaaaaaaaaaa

SEQ ID NO: 87003 - DNA, 640 bp, Heterodera glycines
  SCN-specific regions: Sequence locations=1-409,431-640
gtgaaattgagcccggagaactttgaggatttggactgtgccgtttttgttgacaaccatccaaacgcaatggcattgtcagtgctcgtcacaatcgaaatgctgaatgcgatcaacagtttgtccgagaatcagtccattctgaagatgcccccgtggacaaacatttggctttgcgcggccatcgctctgtccatgtcgctgcactttctcatcctttacgtggacatcatggccaccatcttccaaattactcccctcaacttcaccgaatggatggccgtgctcaaattctctatccctgtcattttgttggatgaaattctcaaatttgtcgcccgacggatggaagcacatgggcgtgtgaaggcggactgaccgaccgaccgacgacggcccttctcacacatgccctaccgtactccaccgtactcttctcccctccctttggcccatttgttacgcttttgcttgggatgctttggatgttaacatgttccaattgctcgcccgttcatttttcctcgtttcttttgctgttcactttatccttcgtctcggcatattccctccgcctgctcattgtcctatccaatattttgcaatgctttgaccccctcttacgaccttttgttttcat

SEQ ID NO: 87004 - DNA, 513 bp, Heterodera glycines
  SCN-specific regions: Sequence locations=1-197,234-412,434-513
agatcgtgttttgatggaacctgaaagaataaagggcgactgccggatgaggaagaaaccgatcaccgccttccacgaagcgggacacgccatcgtcgcccatttctctgaccattcgaatcctttgcataaagtgaccatcattcccagaggcacttctctcggccatacatcgcaactgccggacaaggaccgtcaccaggaaacgaaagcacagcttctcgctcaattggacgtgacaatgggcggccgtgtggcggaagaattggtttttggccaggaacacatcagcacgggcgcaacttcggacttgcggcgcgccacaaaggtggcggaacgaatggtgaaattattcggaatgagtgaccgggccggacttcgcgacttcactgtggaaccgattgaatctgagcaaggcttttgtgtggaaaggggcccgagcaccagcgaaacgatcgaccgggaaattgaaaatctgttgcagcagagccacgaacgcgttaaggaactgtt

SEQ ID NO: 87005 - DNA, 492 bp, Heterodera glycines
  SCN-specific regions: Sequence locations=1-253,275-492
cacattgctggacaaactgaagagggaacaagcggaactcgaggcagaagcaggcggcgaagtgcaaaaggaaacggcggcgacaaaatcgggcactgtttcacccgaaaagaatgccgaaatggatgtccaagatgcactacgacgtaaaactcgaaaacgtgcagccaccgcttcatcgtccgtttcgtctgcgtcttcaccaactcgttctccaaagaggtccaatgccatggacacgtgcgaccgaatggaagcttcctcctcccatcggacagatgagtcccctccagccattaacctaaacgagtccaactcgctttcgcaccgccatttggctgaagaggccaatgcttcggttgcaggcgattcagcgacagagtccacaacaacagcatgcggcggcacttttggtcaaaaagggacggaggagagagttggacggactgctgaagatggactttggcaaacactcgcccttccagacttcgg

SEQ ID NO: 87006 - DNA, 419 bp, Heterodera glycines
  SCN-specific regions: Sequence locations=1-419
tttagaaaatttaacggaggataaggaggacgttgtatcttgcgcacaattgtggtaagcatccattgatggctcacatgacgaagaaagcttcgaatttcttaattggtgatttcaactctgttgactttgacaatatggcggatcaacttggcaaccatggatatgtttcgccttgcaacatgctcactgcattggtatacattatgcggctaaaagaatcaaacgaaagagattttctcgccttcaatccaactgaactcttcgtttcttcgttggtgttggcaaccaaataccttaacgatggcactttgcaggaatttgtttggaacgactaatgggcatcagtttcgggccttgcattacccaaactaaacgagttggaaattcgcctgctcacttctttacgttgggatgct

SEQ ID NO: 87007 - DNA, 387 bp, Heterodera glycines
  SCN-specific regions: Sequence locations=1-157,179-332,354-366
cggcgcgggagcgccgttgtttgtaccggagtatggccaagttcgtaccaggcgatggcgggccagaccttgtcgaaacacagaattggtacgactttttaacaaaaactccctctcgtacatcaactgggccatcgacgacaagcaggaagcgtcggcagcgctgcagaacacacagcccccagtcgggccggccgacgtgtgcagcaccgatcggctgaccaaatcgggcaaatttgtgcacgaccacctcatcggtgtaaaccagaagccggatggctgttaaacatcagaaaatggcaaatgatcggaatcgcgcgctcttttttttacttttctgggtcatttcatctttagcattaaacctaataaaaaaaaaaaaaaaaa

SEQ ID NO: 87008 - DNA, 684 bp, Heterodera glycines
  SCN-specific regions: Sequence locations=1-327,350-684
acagtggactttacgtttttcacttaaattggaaaatatggcacacataatagtggtgaataaattccaggatcggacaatgatccgtggcacgacattgggccaaaacatgtacaagattggcggagaagaagcagtcccggtcagggaagcacttgtgaataatatgcagcaaaagaatgccaaaacgtgtagagcagcagaagatgaaccaaaaaaagctgctattggaggcactggagatgaactggatttgttgagcttgctgatcaagggtgatcgaagcaaaacaatcggtgaggacgggttcgatttggagctgttcgaccaggacgacaacaacaacaacggcggggaagagcagggcgtgaataagggcaaaacgacgacggcaccgcagaaagccaagcgaacaccgtcccagccgaaggaatcgtcgttgagcaaagcgatgaaagagatggacttagaccggagcaagcaaacaccatcatcaacagaaaagccgccgtccagaaaaggttcccgtaagggagcacatctgctggagatgatggaccaagaaactgcagccccaaaaacgacccaagcgagaaaggggtccgttaagcggggcaattaacacactaattgcgtcttaatcattggccattgtgaaaaaaaaacaattttagcaaaaaaaaa

SEQ ID NO: 87009 - DNA, 656 bp, Heterodera glycines
  SCN-specific regions: Sequence locations=1-271,299-543,565-656
gtccgtcccttttttgggcgtttcctcgccaaattgtgcccgttcaccgatcgattggcaattttgtggacgaagtaccgaagaaacagaacgaagaagtccttgacgaggacatttttgaaaatattgggaaggaaaaggcggcgcaattgatggccgatttgggacttgcggaagagaaaaagacgggggcacagagtgcggaaaaagtggccgaagaacgaaccgaagcgcatggacagcaaagaatggggacggcaccgcgcaatttgagaaaagaaatgcagaagaaaaggcctcaacatcttgccattttgactgattccgaagaggaggcggaagaaacggaggagaaacctaacggaattgacacggcggtgttgggaaacggaggcgaagaaaagggacgaggggcgacggatttgtcagataaagcacaaccaccaccgaaatcgaaaggagtcgttggcatttcccatgccgaaaaatacattatgcgagtgaagcaaaaccgagaagatacgaaacagcagcaaaagacggagcaaaaagaagaaatgagaaaagggacggggaaagtgcaaaagcaggggagcagtgatgacgaagagccaaacgaatgggacaaactcagcggagcatcggcgaatgggggg

SEQ ID NO: 87010 - DNA, 539 bp, Heterodera glycines
  SCN-specific regions: Sequence locations=1-33,311-382,417-424,459 -501,526-539
tggggagtgcgacggcttcgttcatgctaatacgctaatttgctcactaattaccccaaataacaaaactgccccctgcatctcccaacaatggccaccaaatgccttccgctcgaacttctgtacgaaattgtgcctctcatccctgccgaaaatgccacaccgaatgcgctctcgtcctgtcggctgctgcacaaacttttgctgccacgtgtcatcaaatggaaagagataatgagtgaaaataccggcttccaaaagcaacttcttgaaatggtaaaggccctccatgaaaaagtcgccgtcattgaaaaaaagcgtcgccatcattgaaaaaaaacgtcgccgtcattgaaaaaaaagccaccgtcattgaaaaaaatgtcaccgtcattgaaaaagaagtcaccgtcattgaaaaaaatgtcaccgtcattgaaaaagaagtcaccgtcattaaaaaaaacaatcggcataaagggagaaacgacgggcgttgtggaacaacaatttcacatccgggagacggtgccgacgaa

SEQ ID NO: 87011 - DNA, 278 bp, Heterodera glycines
  SCN-specific regions: Sequence locations=1-278
gagcaattggatggaaccgttagtacaccggatcgtcagaaagccattaaaactttaacggcctgattcggacgtgttcgcttttcttctgacaaccaaagcgggtggtcttggtctgaatttaaccgccgcagacactgctatttttctcgattgggacttcaatccgcagaacgacaaacaagcggctgcacgatgccaccgcatcgggcaggacaaacctgttaaaatcattcgtctcgtggcaaaacatacggtggaggagctgataaagcaga

SEQ ID NO: 87012 - DNA, 501 bp, Heterodera glycines
  SCN-specific regions: Sequence locations=1-438,460-501
cccttgtcttcctttccctctatattacgctgcacactcgtcgtccaattgtgctgccatcagtttcattgccccccatggctgatgatgttggtcctcccgctccttccggtgccgtcgatgactttgcgcagcgcaccggccaattcttcgacttcatccgccagggaaacatcgaccgattgcgtgcgctgatcgattcgctgagcgtcgatgagctgaacaccttgctgcagatgagatacaacgaacaacaatttgcgctgctggtcgcagttatggaaggacaccccgaaattgctgcacttttgttggacaaaggcgcggacgtgcatcagaccaccgttggccgagtgaacaatgtgaccatgggtgagcaattcgccgttacgcccctgtggattgctgtcaatatgcgccacttggagatgcgccgcgtgctgatcgctcatggtgccgacgtggacttgggaagcgattcctcctttacaccgctactgc

SEQ ID NO: 87013 - DNA, 473 bp, Heterodera glycines
  SCN-specific regions: Sequence locations=1-48,70-450,472-473
ccgacattttttccatgtcatcggctaaatcgacgcctgatttttgcggttgggaggaaaaaccactttgggtgtcattgattgagaaggcacttgccaaagcttatgggaattatgccattctgcgagctggacgaactgtggaaggactttcaactctcacgggtcagccgacactttccattgaccttgaatatttggacatggaccaacagtcccggaccgccgacttggacatcgcttgggctaagctgataagtgcgagagaagcgcgctttctgatgggatgttcttgtggtgctggtaaacggactatggaagaggcggaattccaacgggttggactttcgtcccaacatgcctattcgctgttggatgttcgccaaaccaacgatgggcatcggtaacttgggaaacagacaaaatagactggtactgttgcgcaacccatggggagaaaactttgtttggct

SEQ ID NO: 87014 - DNA, 450 bp, Heterodera glycines
  misc_feature (423)..(423): n is a, c, g, or t
  SCN-specific regions: Sequence locations=1-32,54-426
cagcgtcggggccggtggtggacaatgtgagcgacaacgaagaagacacggacgaaatggacccaattacagcgtttttgagtgtccgggtctcgcaccaaccggtgatctcgaaatacaaaaccccaatttcgtgggcgctgagaagtcggcagccggcgaaacacgccgcacagaatgaagccaaggaattgttacccccttccaccctacatttattattgcgttccttcccaccaattcccttgtaaattaggcctcaaaatccccgtgaccgaccaaaacatccttttccccttccactgctctagtctgaacacttccgcacattccgaagttctgtccgattaaacattcctatttgagctattggatttgaatgtctacgctttggggggcttttcgataaacttgggcgcagtnaacaaaaaataaaaaaaaaaaaaaaaa

SEQ ID NO: 87015 - DNA, 572 bp, Heterodera glycines
  SCN-specific regions: Sequence locations=1-307,329-572
agatgactttgagttatgctaaggggttacccgacttcttaacaatcagttgcaaacttcttatctgccgaactccacgaagaaggttgaactgcaccaggaactgcttgttttggtatggaaatgttgtgagtacaaccagaaattcctttattatgtgctgaaaagcagcgatgtgcttgaacttctcgtcccaattttgttccatctcaatgattcgaggacggacccaactcggattggtttgattcatatgggcgttttcctaattcttcttttgagtggtgaaagaaatttcggtgtccgattgaataagcctttcacttcccgaggacttattgacgtgccaatttttaccggatctcatgccgatttgctgataattgttttccacaaattaatcactagcggaaatcacaaattgcagtcacttttcgattgtcttcttacattgtcgtgaatgtttctccttatctcaaatcgctatcgatggttactgctaataaattagtgcatttggccgaagcatttagcactccttggttcattttctcaactccaacaaatcacca

SEQ ID NO: 87016 - DNA, 491 bp, Heterodera glycines
  SCN-specific regions: Sequence locations=1-170,192-223,249-453,475-491
cattctcgcttctctgaagagttacaacccttcattgtttttgagaactgataagtttcgctcgagaaatgcgtgtggcaataaaaaaagcgaagtgagtctacaaattgatgaatttgacgaattttacaaacgatggatttcaaattatgagcaagagggagcggggaagagccacggagaggagaacagtgaacacgatgggaaggaggaaagtgaaagtggagacgaagaggaggagccaccacaaaacagccgaggacccgtgatcaaatgcccacggatgccaaagataagaatcaatttgaagcgacgtatttcaacaatttccatcgaaaaagcaaaggaatagacttcgcctaattctacagccaattcaacgccacagtgaatctcccttttgttgtttccattagatcattaccactaactacatcatttatccattttgtaaattaacaaagaaaacgaattaaagactggaaaaaaat

SEQ ID NO: 87017 - DNA, 502 bp, Heterodera glycines
  SCN-specific regions: Sequence locations=1-63,85-502
aacagcatgcaaatcgtgttttatcaatcggtgatgcttttctgtacaattctgcttggaaaatgtgcatgccggacgttgtggtggattggcaatacgaattgttcacccgtgtacagcttcaactggatagtgccgaacatgcattgacgggcgaaggagggcacgacttggattttctcatacgctttgtaattaatcggaggaatggcgagaaagtgctgcttgaattgctccagcgtgccattttgcacaaatctctgcaattttctcgaattacgcaaatattccgtcaaattcttccggaaattccaaccgaaaatgccgaatcatccgttacgaaggtcaaatggttgcctcatgcgatgcctttggtgccattgaccgtttcgcataacagtctcttgcgcaccgttttcgagccgttgtctcagcgcggtgacgaagtcgacaaacgaaatttggccaatttgatgatggaattcttcctgattctcaagca

SEQ ID NO: 87018 - DNA, 616 bp, Heterodera glycines
  SCN-specific regions: Sequence locations=1-487,509-616
atctttgacttttttcttctagttatgtgtctttccaattctgtcagaatgctgagccgcacttggatcgtcgcaatttgtttttatattttctttggcacgattttaccattctctgaagcaattcgtttttatgtggcttctaacgataagaaatgtctgaaggaagaaattcacaaaaatatcgtgttgacgggcgaatatgaattaagcgattctgttgggcacacaacgacagttcatgtcactgatactcgtggtcacactctgtacaagcgtgaaaacttcccagaggcccgtggaaaatttgcatttactgcggacgaatacgacattttcgaaatttgcttccaaatgcatggcccgactcaccaacaaaagttaaacagagaagtccatttggtgctaaaacatggagtggaggccaaaaactacgaagacttggccaaagcagaaaaactgaaacccctcgaggtggagctccgtcgtctggaggatttgtcggattcgattgtgcaggactttgcttacatgcgtcagcgggaggaagaaatgcgggacaccaatgaatcaaccaacagtcgtgtgctctacctcagcatcttctcaatgttgt

SEQ ID NO: 87019 - DNA, 150 bp, Heterodera glycines
  SCN-specific regions: Sequence locations=1-150
tgtttgccggaggaggaggattactttgtgtggtctgcaattgacccgggcattggcagcatcgctcattcactgaaacatttggacgacgaacgcaagctgttggaccgtttcgagcgttttgtgtgcaaaatgattgaacccgtcgct

SEQ ID NO: 87020 - DNA, 155 bp, Heterodera glycines
  SCN-specific regions: Sequence locations=1-60,83-133
attgaacaccgatgacagaatgctgaatgcttgggctccaattaaaaagctgaatcaataccaatcagaggaggaggaacacaaacaattgatgttcttccaactaaagtcgcaacacattgaaaaaaagcggaaacttttggaagaaattgatt

SEQ ID NO: 87021 - DNA, 660 bp, Heterodera glycines
  SCN-specific regions: Sequence locations=1-196,218-660
catatttgctgtttatgtactcatcaagcgtcattttcacttgtcatttgtgcaagcgtcggaatcccatcactttcgaatccatcgaccatctggaagcacattttgcacaacaacatttccaatgtttgccgtatgtttgtgagcaatgtccgcagtttgccagtggtctttaccctacagaaggcgcaattattgaacatatgaaattggtccatggctctgagagtgaatttgagtttaaaatcatcatccgtgaggacactgaagagaagcgggcaaaagtccgtgctgcacttgagcattgcgtccgtaattctggcgacgtggccacttcgtcgtccgctgccactacaacttcgaacaatgacagcacagcgattgaacttccacagacgcaacagcaagtgcaaacaacgcatcagcctcgcgttgtccaagtggttcctgcgccgacagttgttgtcaggacggaagtggtgcaacagacagcggaaaaacactcgggggcaaacaacacgagcaacggcgcggcattggcagaaggcggtgggagtggaacgacgacgacgaacacaagccgaaccaatcgaacatcatccggagggaacaagcgtaatgcatcagaagctgttggcgctggaaaaggaccgcccgttt

SEQ ID NO: 87022 - DNA, 672 bp, Heterodera glycines
  SCN-specific regions: Sequence locations=1-672
caactccgctcggcataaccgtgtacaatttggtcagcgaccaagtggcaaggcgtattggggcgggagagaatttgcgctttgttggcgttgcgttgtgtcgcgctgttcccggcgtaacggaaaaactgcaaggtgcagcaacaagtgtgaaggttgaggcggcggacaatccgaaccttcgcatcaacgaacccgacccaatgctggtgacttgtgcgcatcgtaagtttttactgtcacaaattcaataaaatgcaaaaatgaacttcaaaagtccaccaaattgtgtcccctccccatactgaagtgtccgaactcagctgtcctcgggcatgcccacccgtccctctccttataagtaatacatttgtacaatttcccttcccccaggcaacaatcgtttttatttgtttaccaatgtcgaaccgtacgcggaagaagcggatgggtccactcatagcagagacgtgtacaacgaaaagccgctaaaggaggacatgatcaccgcaatagaagaagaagcaccccaatcgaagctgtgcaacaaggcaattgtttacacaacatatggcgacattcacattgaactattcccggacaaaacgccaaggacggtggaaaatttctgtacacacgcacgacggggttattataacggacacgcctttc

SEQ ID NO: 87023 - DNA, 458 bp, Heterodera glycines
  SCN-specific regions: Sequence locations=1-173,198-458
tactcgttggacaccgttttgcttatgctctttccccgccatcggctggcgtcggaatggattttggcccatatctgaaattgaccgccattttcatcgtcctctctacttttgggctcggcttatcattggcccacatgaaaaaaatgctgcaaatcggcaaagaattggccaaacaaaacgaaacgacaaaaacagcgtcggccacttttgttggacaggacaatttgcgaacacttcgggcattcaccgggtgtcaggccggcctttccgtactttccatttatgtggccgcctcattagcatttatgaaattttggtatgtgcgtactcatctcgtccaggagttctcctgctctttgatggccattactttggccgttgtccaattttttgtgcttcgaatggccaatggcggcggattacttctgatcaaaggaattgttttggccaatgcg

SEQ ID NO: 87024 - DNA, 583 bp, Heterodera glycines
  SCN-specific regions: Sequence locations=1-583
gagcttcttccgcacggtgctaacaccggtgatgcctcctatttcttgtccattctcttttcggctgtccacgtcttgaagcacccggagagccttcgtcggctgaagaacgtcgagttggcccgtagtcagtgcggtggagtgcatcagtcgtatcctttcgccgactttatgggctcgcaatcgactctgcaagactttgacgattccgacctcctcttacgcgtggcaattctcaacgaacacgaagggaccattgagtatcattctttccccattttgccaaaaatgactgtggcgaaactttgccgaatgattgcccaccaattttcggttaccaatcccgaagactatcgactctacctgatctttgacgattacgaatcgcctcccctcgagcccactcaaattcctcatttgctgcgcagtcaaatgaacgagacggaacggccacaccatttgttcgtctacaaacgggcggacgtgaacatttcgtacccggggcaagcggtcgctaactttttcgcctcaaacacgacggtgctgatgaatccgccgccattagttgtcacaaatatgagga

SEQ ID NO: 87025 - DNA, 376 bp, Heterodera glycines
  SCN-specific regions: Sequence locations=1-146,168-321,343-376
gcgccgttgtttgtaccggagtatggccaagttcgtaccaggcgatggcgggccagaccttgtcgaaacacagaattggtacgactttttcaacaaaactccctctcgtcatcaactgggccatcgacgacaagcaggaagcgtcggcagcgctgcagaacacacagcccccagtcgggccggccgacgtgtgcagcaccgatcggctgaccaaatcgggcaaatttgtgcacgaccacctcatcggtgtaaaccagaagccggatggctgttaaacatcagaaaatggcaaatgatcggaatcgcgcgctcttttttttacttttctgggtcatttcatctttagcattaaaccaaacaaaaaaaaaaaaaaaaa

SEQ ID NO: 87026 - DNA, 537 bp, Heterodera glycines
  SCN-specific regions: Sequence locations=1-1,23-252,275-443,483-537
ctctgttaaagcccttttttaatcggaaatgaatccaacggttttttctttgttttagcggtgctctttcttgtcaaagtcgactttttacagtgcaaatacaatgaaccaatggcacgacaggtgctgcaaaagcatgcatcacaatttcagcagcattgtaaaaatgcccgcagaggaagtgccgtggccaaatgttgcagtgccatcagaagcataatgggccgattcacaagccaaaaaaaggcaatgaaccaaatgctggccaagtgtaaagcgggcacaacgccaagcgaagcacagcaaatgcgaagaaaattggaaggatcgaataaactgaaggattgtggccagtttaaaagccaaattcagcacaagttcagcgggttgaagcagtactgcaacaatggggcagaaaatgcggaggaaaacgacgaatgatcagagagggagagagaagaggagagagtagagagagagaggaacagcaaaattctaatcactagtgatcactgataattgccgattgattgaccg

SEQ ID NO: 87027 - DNA, 651 bp, Heterodera glycines
  SCN-specific regions: Sequence locations=1-574,606-651
gaatagcgccatttgcttaaatgccgtccgacatacatgaccggtgcgcgctgctctctattttttgcgtctccgatgattcgtccgtacaatgtgtataaaattgctgagcaaatggtcgaccaaagtcagaaggaaagtctcacccgtttcctggcacgggttatccccgtggaagagtcgtgccatgctaatttggacgaaattaagacattgttgtcagaaatggtcgtcaaacacttgaagggagagaagaaggacactccgccaacttacgcagtcgaattcaaagcgagcaacaccaaactgttgagcagacagcaaatttacgatttggttgcgcaactgatgaacgaactgtcaccggaaagtgccgtcaacctcacccagcctgatctgctcgtcattgtgcatactattcgcactgttacaatgctttcgattgtcgaaaattattaccaacgccgcaaattcgctttgaaattggcaacggagagcgaaccgaaagagaaaagcaacgaaaaacagaacacgacccatgaagagggagagacttgaaagaattagagatacggccacattccttattatttattttttgatttcattataccctctatcactttactctgtgagaaaaatttaattgtt

SEQ ID NO: 87028 - DNA, 634 bp, Heterodera glycines
  SCN-specific regions: Sequence locations=1-2,27-148,170-210,232 -374,398-634
tcttaattaaattaaatatattttttgccatgtcttctctgctgctctcctcttccaattgtgtttttggtctgttgcaatgcaatgccaaatttcccgtgctgcccgggcagtcagcaagtggttgctgtgatgtccaaatacattgacactttctcttctgctgctgacgagtctacagtatgctcaaccgctaaaagtactgtggatggaataaaaaatgaactgtcctctcgcggcggatgccaaaacggaggagaagcacaaattgtggatgaaatcgatcgacagctgaagaacattgcgaaaatggaaatcaattatgaggacgagtgcccgtacaatttgggctttgcccgtgccatgttcgacttggccgctgctgctgctggccatgcggggaacggcacagaatggcaatacatgaaagtacaatttgagcaggaaagccaagcaatcaaagcaattggacaagaaaagaactttgaagttacggatgtgcacattggagtcccaagcaaaggggtttctgcacatcaaaatgtgccgagtccgagccatgtgattgccaaccctggccaacacagttcggttggccaaggaaagaaagaagaaccgttgtcatcggacttcg

SEQ ID NO: 87029 - DNA, 249 bp, Heterodera glycines
  SCN-specific regions: Sequence locations=1-221
acacggaacggagaaaagtgccaaaagggaacgatggaccaattggagtataatgccggagggattggcacagtcgcaacagaaaatgagacaaaagtggtggcatcagccgacactcaaagggggacacccctcagggcaattagcatgataatgccagcaattgttgccattttgaatcatctgcataggacgttaccaaacatgaaggatttatagcgaaaaaaaaaaaaaaaaaaaaaaaaaaaa

SEQ ID NO: 87030 - DNA, 371 bp, Heterodera glycines
  SCN-specific regions: Sequence locations=1-105,129-347
caaccggagcggcgactcgacacggacgcggcgaccaaaccgaggcgaccgttgcgacaacgacgacgaatgcggcgactaacaccgaggcgaccgctgcgactactccggcgacggcgacaaccgcggatatggcattggattagcatcatggcacaacaacagaaaaaggatatcaaattgtcatttatccgattgatcatttgaattgtacatttggtttcgttgatacctatgttgcctatcatcatgtgtcaatcaatatccgatcacttgaattcaatcaatgtccgatcactggaattgtatgtattggtaatatgcgtttaaactaatcaaacttttcgaaaaaaaaaaaaaaaaaaaaaaaa

SEQ ID NO: 87031 - DNA, 710 bp, Heterodera glycines
  SCN-specific regions: Sequence locations=22-214,252-254,425-630,652 -710
acatttcttcttcttctggtcccacccctccacacccgaaccgcttcagtgcccaacgcaacgcaatggccacttacctattcctcgctgcagctgccttcggagcgggaatttactgttggaagacgtaccttggcccgatgctcgaccaaccgaagagcgacgacgaggagaagcccaagccggaaggaggcgaagaagcgacgaccgccggcgaggaggagaagaaggctggcagcaagggcgacaagcacaagaagaaggacaagaagggcgaaggcgcagcagcagcaccagcggcggacaaaaaggaggagaagcgcaaggacaaacacaaatccaaggagtcggggaagagcgacgacagcaaagcgggcaagaaggacaagcacgggaagaaggacaagaagggcaagaagaaggacaccaccgatgcatccaccgtggacgaagccctgggagaacagagcgcagcggagacgagccaagcagagcaatagccaggccgtgatgcgtgcaaatgacagtgttcgacgacgatgtctcgcgacacccacacatatcccttcgatcattcccgtcccttccgattgctgtgttttgtctgttccaatgcttcctaaatgttccccttgtgaacagtgatccttccttatgtgatctgaacatatatatgttgtatgcccattaatatattatgcttcgcttgt

SEQ ID NO: 87032 - DNA, 422 bp, Heterodera glycines
  misc_feature (134)..(135): n is a, c, g, or t
  misc_feature (149)..(150): n is a, c, g, or t
  misc_feature (218)..(218): n is a, c, g, or t
  misc_feature (220)..(220): n is a, c, g, or t
  misc_feature (311)..(311): n is a, c, g, or t
  SCN-specific regions: Sequence locations=1-422
cactaaacggacgatgcgcagacgcgtcaatgaggtaattgacgagtttcgtctggaagagtgtcgccctgagctcgttggattcagcggagtcgaaaagagcattaagggaggagagacgcgtccctctctgnncgcctccgaatggnngaacaacccacaaataaaaaaacgcccctcctccgaccacgggcctcttcttttcaatggcggacagngngatcagcgtaatgcgtgccctggctttgtctggccggactctcactcgcaccatcgttcagccgcccttggacatttactggatggccgcnggaaataatgcgcgattgactcgtgacgaattgtttcgggcggttgaacgtctcagagaatccattcttctcatggacactgaaagagcccgattccgtcgttcgaacggg

SEQ ID NO: 87033 - DNA, 616 bp, Heterodera glycines
  misc_feature (564)..(564): n is a, c, g, or t
  SCN-specific regions: Sequence locations=1-415,439-616
catccgaagggcatccatccgaacgtacggagacaccattcattcactgattgaacggcatcactactcgggcccctttctgcccggcttttgcctcgtcgccgcttcgtccgtgccgcgctttttgctcggccaattgccttctgtcgggcttaacttcattgaccattgcgttggaaatcagcccgaactgcaaatggagtctgtggcccagtggtacgagcgtgtgctgcttttccaccgcttttggtccgtcgacgattcggtcattcacacggattactccgcactccgttccattgtaatgtcaaaccgcgaggaaaccgtaaaaatgccgatcaacgagccggccaagtcacgcaaagcggtctcacagattcaggagtacgtggattactacggcggcgcgggtgttcagcacattgctctgaacacttcggacattgttcacgccatccaatcgctgcgcgcccgcggcttggagtttctgagcatcccggacagttactacgcgtctctgaagcagcggctgagcgacgcgggcgtggagttgaaggaggactnggagaaactgagggagctgaagattctggtcgattttgacgagcagggctat

SEQ ID NO: 87034 - DNA, 590 bp, Heterodera glycines
  SCN-specific regions: Sequence locations=1-590
gtggaaaatgctcgctttttgtttgttgtaaattttgccattttcccctattgctttgttcccccgtcctccaatggtcgtccctctccaatccattctccccgccattatttccgtcgcttattatctgttcgtgttcttttttgccgaagtcagtcgcaagttggtcgacctgagtctgaagaagtttttgctcgtccacctgttcctcatcgaactgattgccactgctcaaatgtgcacttgcgtttatgagaatgccatcatcatcaaacattacggtccttccggcttcttcctcgtcgtcacttttctccaaatcgccggtgcctttttcaaccgcggcgctttcgtttctccgctcgctcccattgaactgtttttgcgcggaaaaatggacaccgaaaagtttttggcaattttgctgtcgcaaactttgggcggttactcggcatttcgactagccaattccctctggtattactcgcaatcgtactcgacggatcaccaccaattttacgacagtctcccgtgcgctctctcttacaaagtgcctttctattgtgcccttctgttcgagctgttcggct

SEQ ID NO: 87035 - DNA, 294 bp, Heterodera glycines
  SCN-specific regions: Sequence locations=1-36,60-259,292-294
gagtcgcagtccgagccgttcgcctctcgaaagcatcgtcgttctcgctcccgctctcgcgatcgcaaaccttctcgtcgttcgcgaagtcgtgaccgccgtcgtcattgaaacggaagaaatagagatgagattgattcagagaaggaagttgatcaagattttgctgttcaaaggttcttgctgttcgctccatctttaaatgttggatgtccatcactgtaacccatttcatttcacattataaaatatttctgggaaaaaaaaaaaaaaaaaaaaaaaaaaaaaaaataa

SEQ ID NO: 87036 - DNA, 593 bp, Heterodera glycines
  SCN-specific regions: Sequence locations=1-56,78-458,480-593
ggttatcgtcgacattttttccatgtcatcggctaaatcgacgcctgatttttgcggttgggaggaaaaaccactttgggtgtcattgattgagaaggcacttgccaaagcttatgggaattatgccattctgcgagctggacgaactgtggaaggactttcaactctcacgggtcagccgacactttccattgaccttgaatatttggacatggaccaacagtcccggaccgccgacttggacatcgcttgggctaagctgataagtgcgagagaagcgcgctttctgatgggatgttcttgtggtgctggtaaacggactatggaagaggcggaattccaacgggttggactttcgccccaacatgcctattcgctgttggatgttcgccaaaccaacgatgggcatcggtaacttgggaaacagacaaaatagactggtactgttgcgcaacccatggggagaaaactttgtttggcgcggcgaattcagcagcgaatggcttggttggactcaccagctgagaagggaactcgccgcggatgccgtgtttggtccgggcacattttggatgccttttgaacaatttgtg

SEQ ID NO: 87037 - DNA, 646 bp, Heterodera glycines
  SCN-specific regions: Sequence locations=1-646
taacgaaagttcggatattttcttaaaagtttatgaaattgctgataaaaattaaggaccttttcaagaacaatgcatttcctactctggaaaaattgttcggagatgcaaaagctttgttcgtaacacaacgcctttattggattatgacattggcagtttgccaaaacgcgtcaaattcattggtggcattgatctgatgcagcccgatcacaaggatgctttaccgcaagtttttgggcaaccaaaaccggtgatcgtgttcagcatgagttctttactagaaccatccaaaatgccattggacaaatttaagacggttattcaaggacttggaatgtgtgaaaaggaagtgatttggaaatatgcgaaacaggaggatcatggtcggatgtcactcttgcaaaagcatgctcctaatgtgcatcttgtggagcattacgatcaagccacagttattggcaataaaaagacggaattggtgatcagcgaatgcgatattcgtatcgtaatggatgcgttaagcagtggaaaagcattgctttgtctgccgatgtttgccgaacagttttatgtgtcggaaaagctgcgacgcatgggcgctgcggttgtgcttgatccgcgcagtggcagtttcaccccggag

SEQ ID NO: 87038 - DNA, 629 bp, Heterodera glycines
  SCN-specific regions: Sequence locations=1-515,545-629
ttgtgcgtcggagcagctgccggactgaccccatccactccaaggcatcatccattgcgacatcgccgccagaaattgtctctactcgaacggcgtggtaaaaatctcggacttcggcatggcgcacagaggaccagtgaataaaatggagcccaatgcgcgcgtccccgtcaaatggctgtcaccggatgcactcgccgagcgctgcttcaccgcgaagagcgacacgtgggcctacggagtgatgtgctgggagatcttcaccaacggagaagtgccgtactcacaaatggcgggaagcgacgtggcggtatcgctgatcaacggacagaggctcgacttcccaagagatgcaccgtcaaaatttgtcgagttcatcttgcagcacatttgggatgcggagacgagcggcagatactcaatggctgcggtccacgactggctgaagcgacacacgtaaggagcctagtggtgaacggattcaaagccatcagaagagccagccgaagcaaacgtcattgtgtgtgtgtatatatatgtgataaccctatgcttgttgtatttttacatattgcttactcattgttgtataactactattatgatatgtataaatgactgatgtcctg

SEQ ID NO: 87039 - DNA, 595 bp, Heterodera glycines
  SCN-specific regions: Sequence locations=1-319,344-375,397-595
agacatgaacgactcgttggtgcaccagcgcgaagacaggcagttacaaacagtgagaacactttatacgcgacgaaacgactcattggccgccgctttgatgaccctgaagtgcagaaggacataaaagttgtgccgtacaaaattgtgaaggcgtctaatggcgatgcttggcttgaagctcaaggaaagttgtattcgccttctcagatcggcgcttttgttttgatgaagatgaaggagacggctgaaagttttttgggcacttccgttgcgaattctgtcgtcacagtcccggcgtatttcaatgactcacaaagacaggcaacgaaagatgctggaaaaattgctggactgcatgttcttcgcgtgataaatgaaccgactgcagctgccttggcttatggtcttgataaggcggaagacaaagtcattgccgtttatgacctcggaggcgggacgttcgatatttcgattttggagatccaaaaaggcgtctttgaagttaaatccaccaacggcgacactttccttggcggggggactttgacaatgtgcttgtgcatcaccttgtcgccgaattcaaacgcgaaca

SEQ ID NO: 87040 - DNA, 609 bp, Heterodera glycines
  misc_feature (508)..(508): n is a, c, g, or t
  SCN-specific regions: Sequence locations=1-1,26-241,263-609
ctattattttttgtattatttttcaatgccgcaattaattttgtcagttcacatcgcattgtcggttattatcagggcatacgtccattgacaaatgatcaagccaagaagttgacccatcttatcctggcattttcaacccctgactctcaaggcaatttgagtccattgagctctgtgcttaaacaagcgctaaaagcgggtaaatccgctaatggtgcgctcaaagtgatgattgccattggaggaggtggccttgatccggccatatttacttcgttagcatcaaacagtggcacacgtaaaagctttattaataacattgtttcttatctgaaaaccaatgagctggacggttgcgacatcgactgggagttcccaacttccagtgacaaggcaatctttgtgacatttctgcgcgacttaaaaaaggcgatggcacccagcggcgctgtgcttagcatggcatcggcagcaagtgccttctatttggaccctggttacgatntgccaggcattgagagtgccgtcgatttcattaacgtgatgtgctatgactattatggaagctggaccaaaacatcgactgggccaaactcgccactgttt

SEQ ID NO: 87041 - DNA, 547 bp, Heterodera glycines
  SCN-specific regions: Sequence locations=1-2,43-547
tctcttctcctctccgtcttcttttccctcctcctcattcttccgtccgatgctcttcacttggccggctttaccatcccaaaaatttttgtcaattttcttggcgatgaaagacttcagttcgtctattccatttgcgccgcactttgctcaccgctttcattcattccgcattttttttcctttgttttgttggccttggtttaagcattgatcagcccgtcttctcccatagtccgaataatttcatccaatggctttcactgttttctttgcttatcgtggcagcttcaatcgcaattttgtcattttgtcgaagtaataattacgaacgccatccgttggttcacacattgagaaatttaagtgatgcccgaaattggcaaacattggccagggaaattgacgacgaagtccgtgctcctttgctcttcactattttgtacaaagattgttctcgcgttttggtcacacgcctttggctgataaaagttacaaattacgcaattcaattggctccaatttccgattcgcaatttctcgtaat

SEQ ID NO: 87042 - DNA, 615 bp, Heterodera glycines
  SCN-specific regions: Sequence locations=1-581,603-615
ttttaagagttgcacaacgttatttttcgagcagtcgtaaacaaacggaacaatatttggaacgacaggccaacgaccaatactcgaggcgggccagagaacactcataccgtgcaaggagtgcctttaaactcatgcaaatcaatgacaaaatgcacttcatcaggccgggtaccaataataattgactcgttgcgattgacgcgggtgcaggttcatttctgttactcttttctgttgaaactcgctctttgcccatcgcccggctcgtggtgccaagtgctcagcgagttgattttccctaacaatttcgcaccaaaaaaaagaaccaaagcggatgaaagaacggacgaatgtccgtttgatggaactgagcaacgccaaggatatattttgggcgtcgaccttcttgtccggccactccttttccttctatcgcatttcctccgttttatttcgcccctttcagacaataagtccaattgaaaatgttgatttactgtgcaaagccgacttcaccagaagagccactcagacagaaatcagacggcgttttgaatggccgaatggtcgatttgctgctcagtgacatggcaccgaatccgaccggcgaat

SEQ ID NO: 87043 - DNA, 270 bp, Heterodera glycines
  misc_feature (253)..(253): n is a, c, g, or t
  SCN-specific regions: Sequence locations=1-270
cgaaagacaccaaaggaaaatttattcatatcgaacagaagaacgaattgttgaacgactgggaagtgtggacgaaggcattggagaaagtgttcccagcagaagagaaaaaaggagtggaaagattgtaaataaataaaaaaaacatttgtctgtaaatacgaccaaattggtatatttatttgtaaatataaccaacgtatgattgttgtttattacatcgttgtcttttaatgcaaaagtctcttcagtnactaaaaaaaaaaaaaa

SEQ ID NO: 87044 - DNA, 577 bp, Heterodera glycines
  SCN-specific regions: Sequence locations=1-53,75-301,323-577
catttaaaaatgtcaaacaacgaaaatgaaaatgtgatgaatggagaagccgtgggaggggtggaaatcaaagtggaagccaatgaagaagtgaacacggaatcgcaggaggacggagaggaggcgattattccccagttcagcaaagagcaaatggaacgttcggtgatgtgctgcttatacgaaggcgaaattgtcaatgcgccttggcatttgatggcacagtcaaagacattcatgcaaatgtgggaaagtctcgacatggaagaaaaaacgcaagaagattttacggatttcgtttttccgctcaatgacatcaccagcgactgttttcagcagattctcgcttggatgcgcgaacatcacaaccttcccgagccaattgtcaaggaggacccggtgacgcaggaacgcatttggttcaaattcaccgattgggagcgccaattcttcgacgtcgactttgaaagggtcaaggagtactttttggcttccaactttttggacattcgttcattgtacctctactgtgcccaggaatgcgctcgttgcataatggacaaatcggcagaagata

SEQ ID NO: 87045 - DNA, 529 bp, Heterodera glycines
  misc_feature (501)..(501): n is a, c, g, or t
  misc_feature (504)..(504): n is a, c, g, or t
  misc_feature (507)..(507): n is a, c, g, or t
  SCN-specific regions: Sequence locations=1-501
caaaagcgtcgttccataacgtcacacacatcatatccctcatgaccactccagcaaacgcggcgagggcccggagtgccaaggcgaagctgcgcgatgccaagcggaggatggttgcagttggacgcgcaggatacacaagaaaagcgcagcggggcgatcgtcttgccatttgtatgaccaacgtgagcgccatcacgcggacgacgctcggctgcacccatccgttccatcgccgctgcttgtatcgctggatccgctaccacaccaattgccccgtgtgccgctacaacttcgcccgcaccattccgcgcggtgagcgtaaccaaccgctgtaagatgccatgtgttgtgatcgccgtacgatgtcatttgtgtgatcatatttgtatcccattgttcggttatgcgtatgtatttgtacaatggaatgtatgttcttatatgtactctgtatgtacagtatgtataatactcgtcagtaaaatactctccttgttnaanaanaaaataaaaaaaaaaaaaaaaa

SEQ ID NO: 87046 - DNA, 603 bp, Heterodera glycines
  SCN-specific regions: Sequence locations=1-109,131-326,366-426,453 -464,486-496,523-603
caaaattccgaattcttggcccccaaaaagttcgaaagtcgtaactccattatatatttataaattcttcgactgattttgtgaagcccattaattaagttgaaaccacggcacataatttttgaaaaaagtatcgttttcctttttttcagaaatttaacggggagggcaaagaattgccaaattgggcaaacgaatcagtaattgaacgcatttggcaactcaacgacctttcatccaattacctttacaagacaacaaaattggtccgttttcgagccggtgttctcttcaccgaaattttacaacggatgaaaaatgtgcagcagcagcagcggtctgctgctgctggtggtggtggtgacaataataattatgatggtcgacaacgtgtccaagcctattcagcgcatgacacaacgcgtgaataattaataaataattaattattagggctgccaaaaatatgtacaaaaaagtggtcaaaatatgtacataaatatgtaagaaaaatcccgaaatatgtgtacaaaaaaccccgaatatgtaccaaataattaagtaaaatttttttaatggttattattttttggaaaaaaaatt

SEQ ID NO: 87047 - DNA, 694 bp, Heterodera glycines
  misc_feature (395)..(395): n is a, c, g, or t
  SCN-specific regions: Sequence locations=1-694
tcaaacacaacgaccaaatttgttccacatcaattgaggatcggtcattcgcagccgcccccaccctttgggcatgtcctcgcgaggcctccgatgatgcttccccccgcgggctcttctgtggtcatcgaatcgggaccaactctttacgttcagccaccagccacattattttcgaacaatggaaaggcggatatgccgatgagtttcagctcaagttccacttcgactttgcattcgcagccattcaaaactttggctttaccttccgatgttgagcttttagcagcgaaaaagcaagcaacaaaagcgcatgagaacagttatttgggggctgttcctcgcggtgagaaaaagatgaaacgatttgtgaggagttgtgggggacaggtgtngggaggactcatccatggccgagtgggacccaaatgattttcgaattttttgtggtgaccttggtaacgaagtttctgacgaattacttgccaaggcttttcggaaatacccaagcttccagaaagcgaaggtggtccgtgacagcaggacgaacaaatccaaaggctttgggttcgtctccttcaaacaccaagacgactttattcgtgcaatgaaagaaatggacgggaaatacgtcgggaacagaccaataaaattacgaaagagcaattggaaggaacgcaatttggacatcgtc

SEQ ID NO: 87048 - DNA, 696 bp, Heterodera glycines
  SCN-specific regions: Sequence locations=1-74,96-633,659-696
ggtcttaaaatctgcgaattaaaattttgtggaatgtctacgacaaaaagacaatcataatttaacgaatacccttgttaacaaagaaaaggcttctattgttcaggagtcatcatttgtcactcctggcatttttcgtcgtcgtaaaatgctcacaggcagacaactgaatgatgaaggaaacattgaagctaaggaaaaaagcgcggatttcaaatggtcaattgaccaaatcgcaaagatacaacccattgaatttgatgagactgaggagttttcattgccacctgaaaattgggacccttgtgcaaaattcaagactccacaatttgaaaatattgatcacttttggactcacaacagcttaattgctccttcaccgggactattcgccacagcctctgctttacgtcgtgttcaaccgtccgccaattctccaaccacctcaccgtttcagctcgctctttctcctttcggttcgggtccttcctgctcctgattgcattgccgcagatatggatgacggggagggattcgtgttcatggaaatgcgcaaggagggcccttccgttgaccttgttgaagaatgaccattgactgtgagaataactggtgtccgataaatgaccaaacaaatatttaaaaaaattaaaatattgtgcattatgttattatgcagttaatacagtatggtca

SEQ ID NO: 87049 - DNA, 598 bp, Heterodera glycines
  SCN-specific regions: Sequence locations=1-598
gccgaattttacgctaggacttgccgcaattgcagcagtgtcccatttgcttaattccggacagcatgtcatcgtgtcgggggattgtaacggcggcacgaaaaattatttcgacaaaatttgtgtgccgcatcatggcttggagctgagttttgtggatttgacgcgattggaaaacttggagaatgaatttaagcccaacacaaaaatggttttgtttgaaacaccctcaaatccgcttctaaaaatcgtcgacattgaagcggtgtgccgtatggttcgagcacgctcaaaagattgtgtcgtcgttgttgataatacgttcatgacaccgtactttcaacgcccgttggaacttggcgccgatgttacggtgcaatcgctcaccaaatacatcaacggacacaccgatgtgctgatgggcaccgtagttaccaacaaggagcagcttgatcagcacatatacgcccagcaaatttatgctggcgccgttccgtccgcctttgatgcctttttggtgcttcgtggcatcaaaacgctcccattgcgaatgcgccagcacatggaaaatgcgctggcaattggacgatggcttgag

SEQ ID NO: 87050 - DNA, 354 bp, Heterodera glycines
  SCN-specific regions: Sequence locations=1-354
caaattcgaagtccttagaagcgacaggaggccggccgatttgcgatgtcatgtcgccgaatattcgcaatgattgaacgtcgtcgacgatcggcggataacgccgaacattcgctggatcaactgttcaaatcgcatttgatttggctgaatgagcagcaactgtatgagctgaagcaaatgaaagggtccggaaagggacggacggaaatgcagcagagagtgatggaatggtacggacagttggaggggcaagataagcagaaagcgcgagaacacccgcgggacggatgccgggacatattggcacaagtgttgggcaaagaaaaggctgaccaactgaagcaattgaga

SEQ ID NO: 87051 - DNA, 427 bp, Heterodera glycines
  SCN-specific regions: Sequence locations=1-406
aagagcggaagagagaagtggcggaggaactcggagagcatctaatttaaagaaaccgagaacacgaacgtcataaaatctacgaacacgaacaaaacttcaaagcacttttggttgattcgattttttctaccgatctcagttggcacgacggtcgaaaactgatgcgatttcctcccggtaccagaactgtgatttgctggaaaaggatgtcaaggagcgcctgttcaaagagcctgtgcgcgaattggagaggaagagacgcgacgtgtttttccaactttcggatgagcatcaggacatcacttttacaactcgttggcattcagcacaaaagatcattgctgaagatgagcgtcttggtaaatcgaagatggatgatcagaaattggaacaggactacagagaatggatggacagacgacgg

SEQ ID NO: 87052 - DNA, 607 bp, Heterodera glycines
  SCN-specific regions: Sequence locations=1-607
cctgcatcggcccggcactgctcagagttccgcccgtttatactcaacagaagggcagtgccgtgccgtccttcgcttcatcttccgtaccgtatgcccaacaacaacaacgacagtacccccaaaacagcgttcagtcttcgccccactcgcactcattgtcagcagcctatgtatatccacaaccccttttcgtgccctcctcctcctcgccaccgttccaacctctccaaattcgaccccagcaaagtgccgccgcaattcccagcgttcggcaatcctccgtcccccgaggggatgactttgaccgggcgaatgcctcgccaaaaaacaaaattccaccggcagtgtgcgcagttttctccgttttggaagtgctttttggcgtcgtctcactgttcgtgggttcgttcgtgcccaaatgctttgagtctctccaaattcgcccgtcccattcgcaggtgcgctcaatgcgaatccgtacaattgtctcatccaacccaacgtgcccatttatttgatcctttccggcatccttttgatcatcaatggagcggcacgccttttcctaagcctttctgcttctccgactgactcgacaaagaga

SEQ ID NO: 87053 - DNA, 339 bp, Heterodera glycines
  misc_feature (28)..(28): n is a, c, g, or t
  SCN-specific regions: Sequence locations=1-339
cattcccttctactgtaacgtgctcggnaatgcggctgctcaagcaattggacttccctgagggaaaattctcgctctttttcatgggctacaaagatttggacgaaatcccttcggacgatgcggcccaaaagaaattcgccctctcaacccattcgaccatcgaactcactcacaattgggaacatggtacggacttcaagggctatcacaacggaaactcggaaccgcgtggattcggtcacattggcattgctgtgcccgacgtggactcggcttgcgcgcggtttgagcaattgggcgtaaagtttgtcgaaaaaccgaacgatgggcgcatga

SEQ ID NO: 87054 - DNA, 671 bp, Heterodera glycines
  SCN-specific regions: Sequence locations=1-671
gctcgacaagatgaaaaagtgcaccgctgccactctgtccgacgttttggccaatttgcacagcgtgaaaaagccggaggcattgcgcaccgtcgaaatgctcaaaatggcgtccattcggttgggcatgtccccggcgaggacaatggccgtggccgagaaattgtacacccggggaaacaccagttacccccgcacggagacgtccgcctaccatgacgagtttgagtttgagcgtgttttgtccgcgttggaacggtcgccaacatttgcccgcattgttcggcagattcgctccgatggcaaattgctgcccgaaaatgggacaaacaaaggcgaccatccgccaatcactccgctacgttcattttgtctagatggaggtgcgaaaaatcaactcaagtcggccgttaaccgaaaaaatgaagtggacaagtggttgtacgaagatgcgcatgcgctttacgaacaaattgcgtaccattttctcgccacgcttatgcgcccgtgcaaatacatgctcaaaagtgtgattttcgacattggcggtgagcaatttctgtgccaatctcgaaaggtggaggatgccggcttcaccgaagtgctcagttggttggccgtcccggaaagcaacacaaatgcgatggacgcactttccaagctttcaattg

SEQ ID NO: 87055 - DNA, 500 bp, Heterodera glycines
  SCN-specific regions: Sequence locations=1-199,223-254,345-368,494-500
taattcgcacgagcgctccgatggacaatcgccttcgttttgcacaagaaatcaaagattccattcgcgattgttacccacaactttttatcgatgcaccgatcccgacgaaagaggacatagaaaaactgagagacagtctgaatctgagcgaccaagtgttggtctgtgacaaagacgaggaagtggatgatggcgagcacgaggaggacggcgaagaagcggcgatggacaaagacaacgcgaatgaggacgaagaagaagacggagaggaggatggggaagacgaagaagaaaaggaagaagaagacgtggagaaggaggaggaggaagaagaggaggaaacggaacagcagtcgaccgccaacgacgaagaagaagcagaggaagtgataggcgagggggaagaagacgaagaggaggaagagacagaacaggcggctgagaagatggaggccagaaaatacccggaagaggaggaggacgaagatgaattctct

SEQ ID NO: 87056 - DNA, 646 bp, Heterodera glycines
  SCN-specific regions: Sequence locations=1-646
caaatgacaattttggatcagcaagaggaggaagtgatcgtcggctctgatgacagtcacatgattgtctcaaatattccgcatcgcgcacacaatgtttgtggcgtcttaaacaagcataccatctttgtggcgccggcagacgactcactgaagcgtgactttggcatttactatctgttcaacatcaatgaccctcaaacgaaatattttgcttggtttgtgcggccagatgctccgaagaaaagtgctattgagacgtttcttgcccactacgaagtcatcaagaacgcggagggtgacgtgcacattccgagcttaatggctgccagaccgattaagaagtttcacttcggcatggacattattcaacagagtgagcatgacgctgactggagacgtccggttatgattctgaagatgcccgcccattgtgtgtttttggtcgcagtgcgtactctgtcgcccaccgcaagtgctccgagttggctcgcattagcagtcggctatggcttggtgaatgcgctgaactcattgcatgagaagggattcatccatcgttttgtgacgccgtggaatttcatggttccgatgccattcaccatggacaacattaccaaaaagatgattatcatggacttgagtt

SEQ ID NO: 87057 - DNA, 629 bp, Heterodera glycines
  SCN-specific regions: Sequence locations=1-118,140-629
cgctggacgaccttttctggtccttcggtttcgccttcgccactttaattccccgccggtggcatttggcgccgaatgagcgcaaagagccgcacattgtggcatatgcaacggcacagagcgggtctctttcgcacaattccatcagagcaacgagccaataagggaaagtcggtcccactctgtccgctgtcttcttccgattccaacgacgttttttcgcccgaccgttttgtccaccgaatttacgcccttctggacataatccaagaagctgttgcggtcaatatttttgcccttcactttttgatgccaaacattgccaaattcggagtgccgaatttcagcttcaccgaattttattcgcgtagccaattgttcttgcacgacagcatcgacaggctcgggttgccggtgacaactgctgctgacattttcggagtcggcgcccattgcaaaacgccaaaagattcttccgccctttccgccaaaatcaaacagtttttggaggacccgagctcaaaaggcacaatttatatcgccttcggttctcacatcgattggaaatttgcgccacggaaatttttggacgattttgtcaccgtttttcgaaaactgccccaatatcg

SEQ ID NO: 87058 - DNA, 178 bp, Heterodera glycines
  SCN-specific regions: Sequence locations=31-178
tgtccggggctgcacgcgcgctacactggcaaaatcagcgcgcttgttcttccccgaaaggggtcggtcaaccggcgaaaatctgccgtgattgggatcggacattgcaattattgtccgtgaactactaattccttgtcggggctagtcatcaactcgctctgaatacgtccctttt

SEQ ID NO: 87059 - DNA, 363 bp, Heterodera glycines
  SCN-specific regions: Sequence locations=1-305,327-363
acggaacgaggaggagctcactcgatgattcgcccgccttgtcgctgacgtgggtgtgcgtggcactgtttgtggtactcgatgtcatcggtcttacggcacctagccagagtgatcctttattcgtcctgggcgcctttggtggggccgcgtccttctagggcaccatcggtgcgggtgtctggtgggtctccttggcctcccagcggagggctcgtgtcttggatgaccgtctcgattgcgaactcgacatcgaggacgatgccaggggcaatgaccggcgtgagccgccggctgtctagtctgtcgccatgatcgacgatatccgacgcagaaccgtactgggtgcttcaatgacagcga

SEQ ID NO: 87060 - DNA, 490 bp, Heterodera glycines
  SCN-specific regions: Sequence locations=1-22,44-215,237-490
catggaagtttgccgcttcaactcattattttattcgttttaacgttgcaaatttcaactcagtcgccagaaatttcagtgccttctgatgttcaaattttgtcagcagtccgaaacgtagatttgaccactcaaattgtcaaggttaaaactgactttgagttgaaaaatggaagaaacgaggaattgagcagttttgtacatgccgtgtcggctgaggaggctgcaagactttcttggatgtccgcttatgagagcggcaaagaatcgggcaaattacggatttctcgtgttagagtcaaaggggtctcatcggacatggttttccacaaaattgagtttctcgatttgttaatgtccggttccaatatcaaactttcggtggattatgctcttacggaatatttggtgccctctcctaaggacattttgcagtcagaaaaccagctggtcatcttttccggtactgctaatgttctcagcgcctacc

SEQ ID NO: 87061 - DNA, 400 bp, Heterodera glycines
  SCN-specific regions: Sequence locations=1-400
ctcggtgccttcggacttactgagcccgacccgggtcgaacccggctgggatggagacgaaggcggagtgggacgagcgcaacagttgtcaggctgagcggctctaagtcgtggatcagcaactcttcggcggccgacctgttcattgtgtgggcccgaagtccaaagctcggtcatgccgtcaaaggttttatcttcgaacgtggcgccaaaggactaagtacacccaaaattgagggcaaactttcgcttcggacttcgatcacagggcaaattgtgatggacgaagtgccggttccggaagcgaatttgctgcccggtgcccagggactcagtgggccgttcggctgtttgaacagtgcgcggcttggcatcagtcggggggcgctcggcgcggccg

SEQ ID NO: 87062 - DNA, 641 bp, Heterodera glycines
  SCN-specific regions: Sequence locations=1-218,240-607
ataaaatcgtccgtggcttttacggttggcttctccgttccttggattggattaaccggcaaattttacaccgactctctctctctgctcataatcgcgaggacatgataatcgaaaagtttccatcatatcgtcaccctggactgctccagcgtttgaacgaattgaaacggatctataccgtttacaacggcggagtgttcatcttgttcacaattccttatcgatattatgaggactacgcgtccatcactgtcaaccaagcagttaacgacatcaacgccatggacaagacgggcgttttgcagaatctgaagattgcgtacatcgaatgcaatgtcggatattggcacgagtgggacacgacgaagaaagagccgaaatccatcttcaaaactgacgagacgttgggcctgcgacaattgccgacgctgctcgaatattcactgacccaaggacgccatgtggaggggcgaagagtggacttggacgaacaattcttgagcgtggagtacgtcattaatttctttctgaagcgccagttaaatctgttctgatgcggtgctatgcccaattaactgtgatagttctgtgatatgaacatgtgttgcatatatgtaatatatattatgtatttaatc

SEQ ID NO: 87063 - DNA, 284 bp, Heterodera glycines
  SCN-specific regions: Sequence locations=1-284
tcccttgccgctatttctaagctcggaatttgggtttttgagatcgctactctaacaactcattgtcgataatatcttccaaaacataatttatgcttcgtccgcatcatgaactcgcaatatctctaagtggttgtggctttctttgttcttaccatattggggcgatgatttgttttcaaaagcatgccaattctctcctctctcgtgttaacttttattgtggtgcgtccgctggtgccctaatcgcctctttgctcgttttatcgcctcattcactggaa

SEQ ID NO: 87064 - DNA, 355 bp, Heterodera glycines
  misc_feature (67)..(67): n is a, c, g, or t
  misc_feature (163)..(163): n is a, c, g, or t
  misc_feature (165)..(165): n is a, c, g, or t
  misc_feature (184)..(184): n is a, c, g, or t
  SCN-specific regions: Sequence locations=1-13,52-334
tgagccatcaacgctgccccttctttttctcgcttccccttcatggaaaagaaaaacactgtgaccnaaattgtgcctccttcaatgctttcgaaaccgcttcttcttgaatcattcaaaccacagccatcgccgatagggacaaacactccctccctaaggngnccgcactgtttttgctgcncccacttcgatctgggcccccaacgatgatgacatgtacaagccgaagcagtccgaccagctggaacagccgaagcaagcggagcgaccagcagcagcgcacggcttgctggccgacgacgacttttacaacccgaagcaatacactgaacagaaggctggcggtggtggt

SEQ ID NO: 87065 - DNA, 604 bp, Heterodera glycines
  SCN-specific regions: Sequence locations=1-200,224-466,488-604
ggaaagctaaggcattggaaactgatcgatgaaaaaaaacgaatattcgatggtaaaagaccaaatgatcggtcagacaaagccaaggaagggataatgatcaagaaaaaccgaaggctatttcaactgattttatgaagccaaaggaagagactaatgatcagaattagtcttaacgatcggaactgatcatataaagccaaaggaagatgctgccaatacttcggtgaagtctaaagcagtgattattgatctgggcgatcccaaagagaataatgtcaacgatcggaagaagacaactacggatgataaagcgccaaaagtgatgccattcgcccaaactgagaaatcattgcacaaaatcaatgaccaaattgatcagcggatcaagccgagagaagaaaaccgggaccacattaagcaaagccgtgccaacactgagcatccattgcccggccaacggatcaagcccacaaaattcagaaagccattcgatccgttatcaacagtggccgacactttggagcggacaatgcttggcgatgatgatcgtgatcagcgccaggaaaaatcacgattcgagactggtgtcgggaacgtgaac

SEQ ID NO: 87066 - DNA, 562 bp, Heterodera glycines
  SCN-specific regions: Sequence locations=1-562
ccttttaaaagacgccgaacatcttcgatctcctcaaggaacacctcttttttaaaggccctaaatagaacacatcttttcgattagaagcggcggttggttccgattctttgcacgacatgtctcttcgttttgaagaaagtacaaattcattggaagagaacgaactctcctcccttgacggtgttgtcgttttttaaggaatggacgcttttactggaacgacttcgggcgttttgaaaggtctttgcttttccaattcttcatttctcaattatcgaactgcgcaactttcttcgtctgccgatttttccatttgttccgtctccgatgagcaaaatcagccgaccaaagcgttgccttccgcggtgaccgcaatgagtttcagcggggcggatcagatggaagttttggtcgggcgcgagaatggccgcgtcgaccatttcaattctttgactgaccaattcaatgcgctttttgctttaccacagccttccgaactcaaaggaattcatcgcatcgacggtgatcggattctgactgctgaagaatgtggcactct

SEQ ID NO: 87067 - DNA, 315 bp, Heterodera glycines
  SCN-specific regions: Sequence locations=1-82,105-315
tcacgaatgaggaggaaatgagccaagtcagaacagaaatgccgaagaacaaagggacgacgtgtgcaaattggaagcaatgaaaaagaaaggggagaaggaaatcgggaaaagtgtctggatggaagtggggtggcgagaggagctttgccggtgccaaaaatgctttattttgtccgaagacttgggctgttcgttcctgctcgagcccgatgacacactcgcgcactttgaacaacaaaaccgagaaaacgcgtcccaaaacgacggggcccaagacatttaccaaatggtggtggaggagacgaacgaaca

SEQ ID NO: 87068 - DNA, 549 bp, Heterodera glycines
  SCN-specific regions: Sequence locations=1-82,104-549
caaattgcggatttgaatctgttgcaattgctcggctccggcaccgccgccggactcaactacggcgtgtttcggcacaaagaaatcactgaaaaaccacagaccttgcttatctacgatgtgggttcaaccaagaccctggtgaccattgtccaatttcttctcgtcaacgattccaatgagggtggcagcagttatccgcaggtggagaccatcggagttgggtatgaccgtgcgcttggcgggcaccatttgacactgcgtttgcgcgaccatctcgtcaaggagttcaagaagcagaatgcctcccttaacgctgacatctcggctaatccgcaggccatggccaaactgttgaaggaggccgaccgtgtcaaacaggttctgtccgcgaatgcggaagcgtttgcgcaagtggagtgtgtgtttgaggaccgcgacttccgcgtcaaagtcactcgggacgagttggaggcgatgttccgcgactttgaacagcgtcacatggaacccatcaatgttgctttgacaatggcacaactgacgctg

SEQ ID NO: 87069 - DNA, 366 bp, Heterodera glycines
  SCN-specific regions: Sequence locations=1-68,90-331
cactaccgccatttcttttgcaataacggcgttttccgaacttgttggtaaagtgctacgttttatacgagccggctttgatactcattactttcttgatttgtggccttattctctggcccttatctcaatttggctttacccaattgtgtatcgttctttaaatttgttcaacaaaatgatgaacacaaaaacggtggaccgtatggacagaatgccaaagtgatcaatcaacagtatgccaaagtggtgccaatgccattgccaaatgccgaaatgattggataattgcattcttttatatggaatatggataaattagggcgatcacaaaaaacgaaaaaaaaaaaaaaaaaaaaaaaaaaa

SEQ ID NO: 87070 - DNA, 623 bp, Heterodera glycines
  SCN-specific regions: Sequence locations=1-72,94-557,579-589,611-623
cgcccattctcttatagccatggtttgcttggtgatggctgtcctaatggaaatggcaaattcaaaggctgtcaaaaaagacaacaaaaaaggagcagtggcggcatcaccagcaaaaggaaaatcatcgccaaaaggaggcaaaagcccagcaaaaggaaaagcggcaaaaaaattgaaacctaaaaaggatgctaaaggcattaaagctaaaaaagcaaagccagcaaagaaaagcaaagcggcaaaagcagtaaagggagcgcctaagacagtcaaaaaactcgcaattgccaaaacagcagcgcaagtgaaagaaataaagtcaccagccaagccaatggttctaaaagcagtgccgccccaccaaatgcatttaatgaatgagaaagttcaaactgctgtgtctccacccgcccatgctcgttcacttgcgaccgttccttacagtacaccgatggcagccgaccgtaactcactgccatcgtacacttcggatggcaccaatttggacatggcccatgagaatgatgattatcagaattattactacggaacggaagacagcagcagagaatttgatgcatcggcggaggaggaggatgaactgtatgaggaggggg

SEQ ID NO: 87071 - DNA, 539 bp, Heterodera glycines
  misc_feature (15)..(15): n is a, c, g, or t
  SCN-specific regions: Sequence locations=1-120,142-331,354-539
gaatggacgacgaanactctcatcaagcgaatatggaacgattgagagaggacgaagatgaaaaaattggtctgatggacattaaacgggaaataaaagccgaactcaatgaagcgattggtcgccaaacggaagatggcgaaacggagccaaaggcggagagagatcgctcgatgaaaagcgacagagatatggagcgcaagaagaagagcaagcggacttcgcgagaccgaagccggtcgaagtcgcgggaacgcaaacgatcacgcgaacgccgacgaagtcgctcgcggtcgaaggaacgccaccgcgagagagagcgaagccgagaaaaggaaaggggcgaaaagaggtcgaaagtgaagagcaacaaatattgggatgtgccacccgctggctacgaacacatgagcccgaaggagtacaaagaactccaagtagtggtcgtccattagaattgcgcaagggtgctgaatcgatggattttttagcatttagctaccggcgccctccctcgggccaccctccaatcgtctgtt

SEQ ID NO: 87072 - DNA, 253 bp, Heterodera glycines
  SCN-specific regions: Sequence locations=1-1,26-38,60-60,82-253
aagcattttgatggacaaaatggcaaattaattggcaatgacatctacgagtcattggaatcattggtttcatttatttctaaaaatggctttggtctcataaacgacgaacggagaacaaaatttgttcaggcaattcaagaaatagaacaaattgttaagaaatggaatttttttcgaaaattattgtcatgggttcctaccaattgggcgcactcaccaaacaatcagacatcgatgccatttgtgttgt

SEQ ID NO: 87073 - DNA, 361 bp, Heterodera glycines
  SCN-specific regions: Sequence locations=1-9,31-361
tcatcaaacgaagaaacacaacaccaaaaacgcgccagcggcgagactgagaagaaacgcggaacaggcggagaaggaacggaaggggaagcgggaggagacaatttccaagcgacgcgggatggtttggaacagcaaagacgcgtcgaccagcagcacattggagcaaatgtcctccttttccgctgggacggttattgtcagcaatggcaccaaggccaatgcgaaaccaaccgatcaaacacatgcaaatgttggctctggccggcccggctccgttcagcgactcgccggaggcgattgccattcgcgacgcggtcgactacacgcaaaagatcacgctggaaatggcatacaacaa

SEQ ID NO: 87074 - DNA, 184 bp, Heterodera glycines
  misc_feature (76)..(76): n is a, c, g, or t
  misc_feature (83)..(83): n is a, c, g, or t
  SCN-specific regions: Sequence locations=1-11,34-184
accctcccctttctctttttcattgctcaaaatgacttctcccattgcttatgaccaattgcgagaaatgacgcgncaatttncctctcaaaaggcgtcagtgccgtggaaacaaatgccattttccagggaaaatttggcaccgaaaattctccgactctttgcacgatttacaaatggcgaa

SEQ ID NO: 87075 - DNA, 636 bp, Heterodera glycines
  SCN-specific regions: Sequence locations=1-636
caaatgacaattttggatcagcaagaggaggaagtgatcgtcggctctgatggcagtcacatgattgtctcaaatattccgcatcgcgcacacaatgtttgtggcgtcttaaacaagcataccatcattgtggcgccggcagacgactcactgaagcgtgactttggcatttacgaactgttcaacatcaatgaccctcaaacgaaatattttgcttggtttgtgcggccagatgctccgaagaaaagtgctattgagacgtttcttgcccactacgaagtcatcaagaacgcggagggtgacgtgcacattccgagcttaatggctgccagaccgattaagaagtttcacttcggcatggacattattcaacagagtgagcatgacgctgactggagacgtccggttatgattctgaagatgcccgcccattgtgtgtttttggtcgcagtgcgtactctgtcgcccaccgcaagtgctccgagttggctcgcattagcagtcggctatggcttggtgaatgcactgaactcattgcatgagaagggattcatccatcgttttgtgacgccgtggaatttcatggttctgatgccattcaccatggacaacattaccaaaaagatgattatcatg

SEQ ID NO: 87076 - DNA, 559 bp, Heterodera glycines
  misc_feature (171)..(171): n is a, c, g, or t
  SCN-specific regions: Sequence locations=1-334,356-559
cggaagaaccaccgaattcattggagttgcaatttcaaagcattttgtatggagaaatgaaagtgatcagagcaaaagccaaaggcacagaaggactttttgaactgaattctgacacacatcttttagagtgagagaaatcacaatgaaaaaacgacagaatggagaaancctcgcttaatttgcacgtcattttattggggagaatgaacgaaggttgcttactggatgcagaacatttaaattcccaacaaaatgggcacggatcccctcggggagttcatcattttccctaatggcaaagccgagagagatttgcgagctcgccgataattgtttctttgatgtacaagaattgaaaaaaaaaaatcaagcatcgggaagctttctccccggtggatcttgcacattctgctgatgtcagtggaaagggcgacccgtgcagtttcctcactgaaaattacgaagtgcgatgggcgtccgacagccacacagccaacgttaatcttgcgatgaaacaaaaggccaaaagtggaaaatggtggtcagctgtggggat

SEQ ID NO: 87077 - DNA, 534 bp, Heterodera glycines
  misc_feature (59)..(59): n is a, c, g, or t
  SCN-specific regions: Sequence locations=1-17,39-404,426-534
catttgacacgggatgcgatgtgtgggaagggcgtggacaggcatcttttcgccttgtncgttgtcatgcgccatttggaagagagttcaccgttcttcgacaagattttcccgcctcaatattttttttcaacttcacaaaccccactcaaccaattcgattccgagcaggatggctcctccatggcacagaaattttttctggtgagtgctggcggcggttttggcccggtcactgacgcgggttacggagtttcgtacatcgttgcgggcgaagaccaaatttctttccacatttcgtcaaagaaaagcgctactaacacgagttcaattcgttttcgggaggatttgaagaagactttgctcgaaatgaaacaattgctaacagttgaacagagaatgacatgaacacaatcggaagggttttcaggcaaacgatgataatatgcagataatctcatcactcctccccatcccttgtcaatatgatagctcctcacaattaattacctcctcgactccctactgtatatt

SEQ ID NO: 87078 - DNA, 555 bp, Heterodera glycines
  SCN-specific regions: Sequence locations=1-3,26-330,352-368,390-555
taatcttctctgtttctctctacatatcccaaaattgttccccaatgctgcaagctcatcagtaccaacttcggcaaggtcatcgtcgcgtttctgctcgcagcattttggcccatttcggtttcgaattctcgaacgactaccgacttggctgcggacattacagtaaagtgtacaaaggctatttcaaggaagcgcaacgcacttttgccatcaaagtcaccgacttggaaagcgtttccgagaagttcaagcaaaagtttctgccacgtgagctggaagtttggcgggaattggaccacccgaacctcgtctatttgtacaaagatttccagtggaacaattatcagttcgcagtgatggaattggttgttggtggtgacttgctttcgttcctccaaaaatgtggccacgtcagcgaaacgacctgtcacaattggatgctccaaattgttgctgctttggattatctccaccgtaagggaatcgctcatcgcgatctgaagctggaaaacgtccttctttgtgaaaacggcgtcatcaaagtcactgact

SEQ ID NO: 87079 - DNA, 477 bp, Heterodera glycines
  SCN-specific regions: Sequence locations=1-35,57-477
cagttcgccctccattctccgacacggcctcgtctcccccattccttcacttcctcaatggcacaacaacagtttcttatgacagtgatcaggaattggagtttccgttgtcattggttcgcgatgacggagtcatttacgccactcagctgagtgtgtcttacacgagaccacgggaacaacatttcaggacgggaattcaaggaacacaaccgaacagctagccggggaggacctttatttggttggatgttccgttctgttttctatccattgttattctcaatccatttgtcttaagttttcttccttatttattacagcatttacacttgcatagtttcataaatgtcattctaaatctattcaataattattttcaactaatgataatatatggtgtcgattccttctgtgtctgtcattgtttatccgttatcttgtctgaaaacacgaataaatctcgttgtcgcccct

SEQ ID NO: 87080 - DNA, 388 bp, Heterodera glycines
  SCN-specific regions: Sequence locations=1-105,127-388
actgagtcggtggccgacgatctgctaatttgggccgctttttgttccaatgaaaaatcaaaatgccgacattgagcactctgtccactcattacgaattggaccaaaaccttttcaaaaacttttcattgcgcgagttttgtgccgcgattcacagtttctacggaatttgtttttccaacattctcgatcacttcaaaaagcgattcaacattttgcaatttgcgaggcatccgccccatttctttgtcggcctcaatccagcatggctttacgaattcgttgtgctgctcgaaactaccggatcaaatggccctatcttggacaacgattccgaaatggacgacaacgatcgattcattgcgaacacgcaactgccacttttgtc

SEQ ID NO: 87081 - DNA, 441 bp, Heterodera glycines
  SCN-specific regions: Sequence locations=1-70,104-272,306-337
ttttaattaataattatccttttccaaaaacctttaaaatgcgcgccattctcttcctggccatggtttgcttggtgatggctgttattcttgagacagccaactcaaaggcagtgaaaaataagaaaggaacagttgcaacgccagcaaaaggaaaagcggcgccgaaaggagcagcgaaaggaggaattaaaaaagacgcaaaatcaaagggaaaaggaaaaaaggacgcctaaggcaaaaaggacataaaggctaacccatccaaagggaaaggagtgcctaaaaatgacaaaaaatccccagcggcaaaagccaatgacaaaaagagcccattcaaaccaatggcagcagtgaaagccgtgccaaaggcggcggagaatgctcagaagggaccgtcgagtgcggaagtggtggcggaggaaaacaacttggacactg

SEQ ID NO: 87082 - DNA, 484 bp, Heterodera glycines
  SCN-specific regions: Sequence locations=1-70,94-484
cgctgcggtgaagacttgtctctttttgggtgcttacatcggtggattcactttcaccgggtctttgatggcctatggaaaattgcagggtcttcttggcagcgcgccgactcttcttcccgccttttatatgcttaattttgcacttctcagtgccaatgtcgccgccctcggtccttatctgacaacggacagcttggccatgggattgtccatgctcggcactacgtctttgctctcctctctgatgggcgtcaccctaacaatggcaatcggaggtgctgacatgcccgtagtgatcacggcgttaaactcgtacagcggttgggctctctgtgctgagggattaatgctcaacaacaatttgctgaccattgtcggtgcgctcattggccgctctggtgcccttttgtcccacattatgtgcaaagcaatgaatcggacgctgttcaatgtcattttgggcggcgttggcacaaaatcg

SEQ ID NO: 87083 - DNA, 681 bp, Heterodera glycines
  SCN-specific regions: Sequence locations=1-681
ttttgcctattttgaggacgctcggaagttgtacgaaacacgtatgaaaaatgcctcaaatggcaacaatgaggccgattgtcgtataaagaatttggaaaaagagctgaaggtgctgaagcgacagctgagtgcgttgggcgaccttctcgaccagtttttggacacttcgttggccatgcgcgaacggactctgttaatggagggcgaattggggcgacgattggaacgattggaagcgcaaaatgtgcagctgagggcaaatttggcggcgatggggcaacagacgcacaaaaacggggacaacgaacagaggaatgaagcggagcaaactattgaaacgatacatttcgacgaactttcgatttccgacggagttccgcttcaacaaaatgtccaacagcagccgcaaccaccgaatgtcagcaattgccctgtaaatgatgaggggggcgacggggacggaattggcgacgaattggcccattttttggccggtcttccgcccgtggatgaattagggcaattggtgctgaacaagttcaaatactcgtgcgaatttgcccaacttctctacaccggcggaggccatgtggactcggtgttctgcaatattttcagcggatatccgcccactttcttcgaagaattgatcgagtacgccctcacaacgcatcgtcc

SEQ ID NO: 87084 - DNA, 458 bp, Heterodera glycines
  SCN-specific regions: Sequence locations=1-458
cccttggaagaaatgttcagctcttccatttgtttgctctctttttggcctcctccgttttggccgtgcttataattggcattaaaatggacggaccgacggaggcaaaatgtgtcgcccctccaaacgccgcggggccaatgggacttttgcttttaccgtcgtgaaacaatcggcggcttttgaaaagggaaaagcgccctctggcgaaagtaagccaaagccggggcagaagccgagcggagaacggcgaaagagggacgttttggggcacgccggcggatacgtcggaggatgggaccatcccattgactcgacacttgattgggcaaagagtcagtggaatgatgccaattggctcgccgatgttgtcaacagaaacggatgggaaaacaccggcactccaaccggcggacgatgaatcagtgaattgtgccgaccaaggaatgaaagacggc

SEQ ID NO: 87085 - DNA, 647 bp, Heterodera glycines
  SCN-specific regions: Sequence locations=1-17,40-49,72-474,496-647
ctccctatattcttccccggtcattttgttgctgcaaaaatgtcttcaggacttctttggcgtgccgtgcttctgttggtcgattgtgcctccattctttggttctttttggaccatgccaaaaaacgacggcgccctcgcgaaaaagaaatctttatctgcgccgattgttggcttttggtgttcgactttcttgcgccttctcaacttggcctcgaaattgcactgatcagccgtcgatttgacctccgagtggatgaacatttcaagacacgcaagtggatgttgaacaaacaattgctaatccaatggaaaactgtcggaaatggccccaagcaaatgcaaattgacgatgccgatggaaatccattgccaatcccgcgaaatccgttgccaaacaaagtcatcggattcagacgcattacgatcatttacatcgatcaaaatgtcatcgcatttctccgccgttttcactgtcttttccccatttgctcaatattcttggacattaccatggtcaatgatcgcattttggactactttttgctccatatttggccaatgttccgcgattccatgcgttttatgattttgaataccaacgcttttcaccgtatgcgccaatgggccccgtcatcactcagcga

SEQ ID NO: 87086 - DNA, 599 bp, Heterodera glycines
  misc_feature (275)..(275): n is a, c, g, or t
  SCN-specific regions: Sequence locations=1-599
cacagcagcaggacgtgccgtcctcgttcttttcgtcggccttcatcagtcgccgccaaacagcaacaacggaggcggtggtttctcctcattcaccaccacaaccaccaaatactctatcttcgttgtgaatgcggtggtgatgtacgtcggtgtacgagccatttccctcctcctggcaaagggcatcttttttccctggaaacaattgcacacagcccgttcatggacattttccaaaatttggccgtctcactgtgcaacgaaggtcgttntttgctgttcaacgccatcgccaatcagttgcgttacccgaattcacacacgcattacttcagttgtacgctgctttacctgttcttgggtgccaattccaagcacattcaggagcagatcactcgtattctttttgaacgtttggttgctctccgtccgcacccgtggggtttgttgatcacattcatcgaactgatccgcctccagcgttacgggtcttggaagcacgaatctgtttattgtgccacagaaattgaacgtttgttcctcagcgctgctaatccttgcagcgccagcggcccgaaagtcatcactcaaacggg

SEQ ID NO: 87087 - DNA, 564 bp, Heterodera glycines
  SCN-specific regions: Sequence locations=1-145,167-212,234-564
ccctcgtccgcttctattattgcctcccttctcttcctcttcggctgttgtcgtgcggatggaaatgttgtgcctctgtcgagcctcaattgtgccacgaaggacggaggaatcgatggcttcaattttgtggacgacggtctgatcttggattcctcatctgtcaccgctgtccctcctgacctgcccctcatctgttttcagaagaacggaaaggaggacttgatcttcaaactctttgtgcgcgatggaggatgcgtctcaaaggccaatttcttcaccaacggtcaaccgtgtacactcggagagtcggaggacgtgactgagtcggataagtgtccgggcgagggcggcacctccaactgcacatcccacgaagtcacctgtccgggcatcggaatggcgaaggtcgcggaggagtccaatggtcacgccttcaaagtcaacctggccaatctcaccaaacttaccaatccgtgcgcgcaatggaaggcacattttggcggtgttcatcaagtgctgaagggttcttccagcggagagaagtgcgcgagtgcaggattc

SEQ ID NO: 87088 - DNA, 390 bp, Heterodera glycines
  SCN-specific regions: Sequence locations=1-226,248-390
caccgtcggaaacccgtcgtcccaacccaacaaggagatgtgtcggtcggacctcgcttgccggccgttcgtcacggcgtcggcggcctcaggcagtgggaaactgtcgccgaagatgtcgaaggctgctgctccacgacgtttgcggacgggccgaagtgtctttttaagttcgtcgcctcaacccccgacgcgtccattcgtcgcggagtgcgcggcctcctgcggggatttatgcggggaggagcagcaaagtgttgtcatcatcgccgcttccgacgccatcagcgtcagcgctcttccgctcataaagcctccaccggaatgtctcttctcggcctcgagttgtgcgttctctgagtgggaaaagtgtgccgcgtcggaaggtgc

SEQ ID NO: 87089 - DNA, 539 bp, Heterodera glycines
  SCN-specific regions: Sequence locations=1-437,466-539
gccccgcgccttggccccgctccatcgatcgccggcaatttgacgtttgaatcagcaagcgaacgaagcacaaggaatttcactcgtcatattttgacacacattgttttgtccatccatcttagcattccaacagcagaaaaacagcaatggcatatgcaacaaaatattacgactatcagattgccgttgtttttgccattttactcggcggtcttttactcctcgcgttggtagtcacagccatttattacatttgtgtggtcaatatgcggggcaaaaagggcggcattacgcgcgttccttccggcagaagtacagtaaggacgaggatgaatccgcaacagtactcgccgtctgctcaaccgcaaatattccatcaacagtacccacagtattcgccgtacggtgggatggaagggatgagcagccaacaaacgcagcagcagcaacaacaacaacacccattccaagcgcaaaattatgagcaggcgggggtcagagtgagggaaatgcaaccggagtatttccaacagcag

SEQ ID NO: 87090 - DNA, 411 bp, Heterodera glycines
  SCN-specific regions: Sequence locations=1-177,199-411
atcgtcgtcacaattcaccgtccgtcagaaggaatgtgccagaaatttgagcgggaccgtcttttgaagttactcgaacggacgcaaaaggatgtccagcgcctgacgaccgccaaccaacagctcaccaccgccaaccaacagctcaccaccgccaaccaacagctcacgacaactaaccaacaacagcagaacacaatcaaccaccagcagcaaaacatccaacaactccaaaacttattggccggtcagcaaccgcttgttccatcgtttgcccccggggtttttgctgaacaacagcagcatcatcatgcgccagcggactttctcggcgaccagcatgcgctcggcggccagaatccacacgcggcaccttttggccccgactttttcggcggtcagcccgaaaat

SEQ ID NO: 87091 - DNA, 466 bp, Heterodera glycines
  SCN-specific regions: Sequence locations=1-207,229-442
cagatgcttttgcctgtgccttcggttgggacatttgcgagggttccttttgttacacttcttcgacttcaaaatgtgactaacagtggtcactttttgctccgtcgcggttgtttcggcagtgaatccccgcatattcggtacaacaacgagttgaagccgttcacttcgctgaacgaatgctttttgattttgtggaaagacatcgaatatttattgggcatttgtgcggacagcgatttttgcaatgtttgcaattattggagcgaattggcagccgaaaagtcggcggccgttggcattatgcgggcgggaggagagaacactttgaggggaaaaaagttgctgatgggcacggcggcacttttgccacttttggcactttattttattgacaaaatcatttaacaaaaaccaatttagataataaagcattcatattaaaaagaaaaaaaaaaaaaaaaaa

SEQ ID NO: 87092 - DNA, 556 bp, Heterodera glycines
  misc_feature (388)..(388): n is a, c, g, or t
  SCN-specific regions: Sequence locations=1-211,233-519,542-556
ctagagaaacggacggaaaagcctgtccagtgcaggcatttgcggagtctgttgtcagagaaatggagaaagggagtgaagtgatgaaaagcgagactgttagagctaggaatgaaatcggagatttctcggcggaacagaggaggaaaagaacagagagtttgaggagattgctcctttttcaaagaaatttgcgctaattttctaaagcgaataaacaaggaaacacaaaaaggaaaagttctgatcagccaaaaaagcagcgatttaaacaacagatcgaaagcatttgcaatgaagaaagacgaatgtcgaggagcagaagcatcacaccgaggagagagaagaccacttacaaacaaatgattcctaaagcatttgtcatgtntttgtcggtttacggcgaacgaatggacgcaaaaaaatgccaatctattgacgcaccacactttttgtctggcccaaatggaacaacaaacttgattgatggaccaaaagcgcacactgaaaaagcgccattggaaatgggggagctgctgaattcgctgaacgatgc

SEQ ID NO: 87093 - DNA, 545 bp, Heterodera glycines
  SCN-specific regions: Sequence locations=1-9,31-279,302-461,483-545
atccgaaaaaatgccaaacattttcaaaatccttctgattgtgcttttttccgtcgtctcattccgtctctcggcttctactggtgacaaaaaaactgctaatgatgggagtggaaacaactcatcctctgggattggtacgaagatcaaaagaattgtcaccgctggactgtcctcccttccctggcgacgggtgttgcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttcttctatcctctcttatttattagtttctcaaaacaaatttcttccacaactttttaaactat

SEQ ID NO: 87094 - DNA, 666 bp, Heterodera glycines
  SCN-specific regions: Sequence locations=1-310,332-666
cgtgatgaccgatgcttgtgcttgtggactaacggaaaaacattcaaaagttcgcttacatttgccattggaattgcagtgtgagctgctttctgcgcttccctttgagcatgccgctcgtctgcttttgctttccaaagcgattgccaaaaattgcaattccctcgtgcaaaagcaaacgaaagggtggaatgcgttttccgaaaaatgtgtcgacaaacttatgaaattctttcaccctttcgtcctcccaagattggaaagtattgaaacggaacaccattcatttgttcattcagcagcgcatcaggaagaaaaattgctcaaagaggaaattcgactttctcgtgcccaactgtcccctttggttggtgccaatttggtgcggcgtttggaaaagtgtggcacggccggcgaggcgatgaccgaactgttgaacagcgtcgttaaaatgtaccacatcattgaaatgtataagaagcgaaggaaagaattggacgagcgattcaacgaagtcaaacgaatggcggatgcaattaagcccgacttcgtcccgcgtgacattccgccccgaatttgtcccaccgccaccgtttggtccgctgaacgccttcgactcgattacaccgaacatttgcattctttgcgcgttcggttgcgccaaat

SEQ ID NO: 87095 - DNA, 630 bp, Heterodera glycines
  SCN-specific regions: Sequence locations=1-630
cctccgcttccgtcgtccgcagcagtcgtcctcttccgccccgttcggcgcgcccttccacagtcgtcgatggcatccgccggttggcttcccccgggcgccaccgttggctgtggtggaccaccacagcagcagcagcagcagacgatatcaatgatgatgatgcatcaacaacaacagaacggcatcatggtcaacgggaacggcactgtggtcggcattggccacctgcaacagcaacagcagtaccaccaattcatcgccgccaacccggggatggttggcgccacttcgttgccccaggacctggagaatgtgaacgcgatgccgtttgaccagagcctgttggacctgaacgactacgaaattgcgccggacggacagttcgatttcccgtgaacgcgggccacgacgacggcggcggcgaacgcgcgcggattttggatggacgggagagataatgaattaattattaattacccactgatatgtgtgtctcttctgttctccccgttttttgttttgttttgtttcatttttgtggagaaacacggcgcagcacaacaacaaatggccattcgacaggaaaccgcagaaaactatctacctacctaccgtatattcatttgt

SEQ ID NO: 87096 - DNA, 624 bp, Heterodera glycines
  SCN-specific regions: Sequence locations=1-226,248-440,462-509,531-624
catccgagagttagaatctccagatgagcactccctggttttattcaatccgcttcgttcttgctttcgtcctactagagatgaattgtttcgggcggttgaacgtctcagagaatccattcttctcatggacactgaaagagcccgattccgtcgttcgaacggggctttgctacggatgatcgtgcgattgtcaggtggcatcccgccaaattttaatcatgctcattttgctgctgctgcacagccggtcgtcaatgtgactgcggttctcgccaatgccaatcccactgggcagaattaccaacgccttctgaatttgaacgccgatttgacggagaccatcgcccgtttaactgtagaaatttcccaattgggatatatgaatgagcaattgacggaacaacttgaacatctcacggaagtgcctccgaatgcgaattttaatctggatgatgttgtgtttcatccgcccctcgaccaacagcacgaagtgcctccgaatgcgaattttaatctggatgatgttgtgtttcatccgcccctcgaccaacagcacgaagtgcctccgaacccgaattttaatccggctttgcttgagtttgatgatgttgggcttcagcc

SEQ ID NO: 87097 - DNA, 580 bp, Heterodera glycines
  SCN-specific regions: Sequence locations=1-258,280-580
tccgctgcatattcatcgtcaaattgtgctgccgacattttctttgacttccaatgtctgatgatgttgctcctcccgctccttccggtgccgtcgatgactttgcgcagcgcatcagccaattctttttcttcatccacggcggaaacatcgaccgattgcgtgcgctgatcggttctctgagcgccgatgagctgaacaccttgctgcagatgaacgacccgcgcaacggacaacaatttgcactgctgatcgcaattatgaaaggacacacagaaattgctgcacttttgttggagaaaggcgcggacgtgcatcagaccaccgttcgccaagtgaaccatgtgaacatggccgttacgcccctgtgggttgctgtcaatatgcgccagttggagatgtgccgtgtgctgatcgctcatggggccaacgtggacttgggaagtgacgcctccttgacgccgctactgctcgcatgtgacaaaggcagcacagaaatcgtcacccttctcgtggagaatggcgccgacgtcaatctcggggacagcgaaggaatgatgccgttaatggtcatttgccg

SEQ ID NO: 87098 - DNA, 574 bp, Heterodera glycines
  SCN-specific regions: Sequence locations=1-57,90-151,174-462,484-574
aattgagcgattggaggaggaaatcatccatctgagggccattcttcagacttagcgatattggaatatttttaaatattcattatatggatccactctttaaaatggtctctaaatggaaatgacaatccaaatatatttccgcttttgccaatttccttccatttattttttcaaattgcataatgtctcctttccctccgagtgccaccgatctcttcagtcttctggatgccatcgacaaattaaaacatttaaagcggactggttgggttctcgtcggcatttcggagcccgagacagtcgcttcccatatgtatcggatggcaactgtggcaatgactttgtccgcgcaccgaactgatttggacgtcaacaaatgcattcgaatggcattggtccacgacataggcgaagcgattattggggatattaccccccactgcggcgtatcgaatgaagaaaaattcaaaattgaaaaagacgctgctgagactatttcgaattggttgcccgaaacggtgggcgacgaatggaaaaacctatggagagaatacgacgagggaaaaagcgc

SEQ ID NO: 87099 - DNA, 610 bp, Heterodera glycines
  SCN-specific regions: Sequence locations=1-445,467-610
ggtttccctatgaatatgtttatccggagcaacttttatacatggaacaactgaagaaagtgttggatgcgccagtaagcagttgggagtgttttcgggccattgtttgcttgaaatgccttccggaactggcaaaactgtttctctactggcgcttgtcgttgcttatatgagaaagtatccggaaagactccacaagctgatttattgctcacggacaattcctgagatagagaaatgtgtcgaagagcttaaaaggctgtttcgctattataccaatgtcaccggatccgcccccgatttccttgccctcactctctccgctcgtaaaaatctgtgcatcaataaatccgtcgtcagttttcggtatggttcggccgtcgacggagcttgtcaacgtttgacggcgagttacgttcgggcgaaaaggcggctgaatccgaaccttccctgttgttcctttttcgaaaaatttgacgagaaaagggacatgactttgccgaagggtgtttacaatttgtcagacttgcgggggtggggcaaagagcacggcatgtgtccgtatttcgtcgcgcggcacttggtaaatcgtgccgacatcatcgtctat

SEQ ID NO: 87100 - DNA, 206 bp, Heterodera glycines
  SCN-specific regions: Sequence locations=36-46,73-73,150-151,178-206
aagtcccgcaacgagcgcaacccttgtccttagttgctacgcaagagcactctaaggagactgccggtgacataccggaggaaggtggggatgacgtcaagtcctcatggcccttatgggtagggcttcacacgtcatacaatggtcggagcagagggttgccaacccgcgagggggagctaatcccagaaaaccgatcgtagtcc

SEQ ID NO: 87101 - DNA, 147 bp, Heterodera glycines
  SCN-specific regions: Sequence locations=1-147
ctaagtgtcttgggctgacataaagcgcaacaatgtcttctgacgaatcgacgacttcttctgccagtgctgtgagcgttcagctgcgtgaagtgcccatcaaagacttcaatgacgtgcttccggtgctgcagaaaacgctcaacc

SEQ ID NO: 87102 - DNA, 590 bp, Heterodera glycines
  misc_feature (589)..(589): n is a, c, g, or t
  SCN-specific regions: Sequence locations=1-370,394-492,516-517,563-590
caattggtggcccgtcctgaacagtttgacgtcatggtaatgcccaatttgtacggcagcattgtggacaatttggcggccgggttggtcggcggtgcgggcgtggtcaacggcgagtcggtgggctccgactacgtgatctttcagcctggcgcacggcacacattcaaagaggcgtttggaaaacaaattgccaacccaaccgcgatgattttgtgctgtgccaacatgctcaaccatctccatttgaacagttacggcacggcactgcgacacgctgtggagaaagtgctcaaagagggaaaagtgcgcacccgcgacttgggaggctttgccaacaccagcgattttgccagtgaggtcattgccaatttccaaatgtgaaacgaatgattgttgcgcgacagaaatgtgaatgatggcacaacatgccgaaaaacaaaataattattagaaaagatttttattggtttgtttttttcttgttattctgatctcattatcatcatcatcattctgttgttgttgttaattttgttattgttgttgttgttgttgtcgtaagaatataataggcatagcaaaaaana

SEQ ID NO: 87103 - DNA, 755 bp, Heterodera glycines
  misc_feature (649)..(649): n is a, c, g, or t
  misc_feature (657)..(657): n is a, c, g, or t
  SCN-specific regions: Sequence locations=1-755
ggctcttctgcgtccttaagattaaaatatacctaatggcttagcagtgagagctttggaaggtaaaattgcagttgtgactggtgcttctcgtggtattggacgagggattgcgcttcaacttggtcaagctggtgctacggtttatgtcactggacgagctcctgccgcttcgtactctctgattgagaagggacttccatctttggaacaaacagcgaaggaaatcaaaagtcgtggaggagaagctcatcctgtgtattgtgaccacgcgaactctgacgacgttcgccgtttgtttaagcgcgttgaggaagaacagaacggccgactgcacattttggtgaacaatgcctattccggagtgcctagtctgattgaaaatgccgggaaaaagttttgggaatgcgaaccggagttttgggatgacatcaacgaggttgggctgcgcaacgtgtacttctgttcaacgcttgccgctcgtctgatggttccgcatgaggatggccttattgtgcacatcagttcggctgggggacttcaataccttttctcggttccttacggagttggcaaagcggcggttgaccgaatggcatccgacatgggactcgaactcaaatctcgcggagtggcagtgatctcactntggcctgnttttgttcaaacggaaattacgacgatgggagaaaatgcggaacaatttgcttctgccgctcgcatgtcaatggatgcattcaatgcggcattgaaaa

SEQ ID NO: 87104 - DNA, 703 bp, Heterodera glycines
  SCN-specific regions: Sequence locations=1-369,391-703
tcccccgcgctgtttaagcgccgcgtgcgcgcgttggccaatgctttccgaatgtaattatgggagacgagcgcccgatgaaaagtgacggggagggcatgatggaagcggtgttggactgttttgagcgattggacacgccaaaacgcaaatgggaatatgtcactttgttgcaaaaccacgacacggcaatcaaaacgcgtgttcaaatggcacaaattttcgcttggatggacggagcaaacgatgttcaagttttagtgccaccgcctggacgagttgacaaaattaaagcaatggattggagttttgaggcattgaatttgttcaaaaatgccacccgtaattctgctgttgcgggatccgcttctgcccatggctttccagcacatttggaactggcaaaagggggttttcatgcgagtttgacccgtgccatggtccaattcattcgattggagctgaacctgaccgaacttgtccgacgaatgaatctgattggattcggacgggacgaaatcatgctgatcactttgcactcggctgatcagctgaacgcgccgggcggctttacgcagacatgcttcaggcagaagaatggcagagacacccgtttcttgaccagggaggctctatgggctccgcacgcgttttgcccctcgcacaaatggcggcacgccgtttgcatttttggcgtcgaaga

SEQ ID NO: 87105 - DNA, 676 bp, Heterodera glycines
  misc_feature (16)..(16): n is a, c, g, or t
  SCN-specific regions: Sequence locations=1-248,270-676
tgccgcgcgcggtcgntccatgcgccagcgaagcgtccgcgcggttttcttccgtttgtgcgcttttgcacgcgttcgctgtagtaccgtctgaactgcaattatactgatcgaagaacgcttggacagtgcgcataaaagggacaaagcggcagaatttgtgatggaaaaagcgaagaaagagggcgaaaaggcgccaatccatccgtttaaaatgagcggacattgtgacggagaggccgtagaaaaggaggaggaggagtacggtagcaaacagctgatcccttgtgctccgtacgctcgtctgttgctcttcggcacgccctctgccattcaaagtgcgcaattggctcagctccgtgcgctcgtccccggcgcgcaactggccgtggccaactgtcggcctggcctggacacggacgaagcggtggaggaggaaattgttgccctgggggcaagccatctggtatttgtccatggggcagacggagaaacgcgcgacgcgtgggaagcgggcggaccggcgaatttgcgggagaatgtgcgcgtcaacctgttcagcccgtggcttctctccaacatttgtgaccgttttggcattgtgttcgtcgaatttgatggggagggcaaaaactgttgcaattcgaatgggaaagtgccgacaaatgctgacgcc

SEQ ID NO: 87106 - DNA, 642 bp, Heterodera glycines
  SCN-specific regions: Sequence locations=1-247,269-642
caccgcgtgtctgaagttcgtaattacgcctttttcttctggcttccttattacttaacctataaatatcaatgggctgagtcggaagcgaaccaattgtccatttggtatgacattggcggaattgtcggttctgtgcttggcggattggcttcagaccgactcggtcaccgcagtcccatcattctcctgatgcttgttttgtccgttccgttgttgttcatctactctggccttggttcctcgcgggttgagcacgttattggcatgtctttgctcggagtgaccatctcgggcccatacaatctcatcgttggcacaattgccattgatttgggttctcagcaagccttggccaacaatgctgaggccctgtctaccgtaactgggctcattgatggcattggctcggctggctccgcattgggccaactttttgtgccgttgattcaaaatgaacttggatggatttgggtcttccatttttttattttaatgaactttctttcatccatgtgccttatccgtcgtttcttccacgacgctcggctcatttccctttcgtttgctccgaggcaaaatggtcgtcggcaagagaacgagccgctgatttcgaataactgaactgaaattgctattgta

SEQ ID NO: 87107 - DNA, 623 bp, Heterodera glycines
  SCN-specific regions: Sequence locations=1-623
catgaacattctgctgaagtctgttctattcatctctcttctgtcactgtttggtgattgcatgaaaaactcagatcaaattggagtcaaaagaaaatcagcaggaataagaattgaggaaccaaatgatgtaaaaggcaaaggaaaagtcgtcgaaacaagcagaaaaggcaaagaaaaagtcggcgaaaaaataagcgttatgaacacagctgaacgcattgaaaaaatggaccttgcccaagacaaagctaaaatggatatagacaccaatggcaaacccaaacaaaatgaggaaaatgctcctccaaaatatgttttcatttggagcggtaacaatgagaagaagaaccttgaggttgacctcagagtgatccgtcactccaaaaaaactcagcgaattattccatgccaaaagtgatcaatccgtcaatgcaaaacacggaaagcaggaagcattaccggttccgaaacaggaagctgaaaaaatactgaaggaagtggaagaatggtacgcacatcacaaaaatgataaacataaaaacgctccagtttttgtgttcaagtgtaaagacaatgtcagtctggtgataaatgttcatcttgatgcagtccggctttcc

SEQ ID NO: 87108 - DNA, 583 bp, Heterodera glycines
  SCN-specific regions: Sequence locations=1-289,312-373,396-583
gatacattcccgtcgatttacttgtgtacaatcatttatttgtctatgatggtggaattctcctacagagaagagaagacggtgttcaaagaggtgcgcacgtcgttcgactgatcggttacggacgcgtgaactgtacggacggacggcgtgtcaagtactggttgggagtgaattcctggaacacatcttggggagaaaatggcggcttcttccgtatcaaacggggcgaaaatgtgtttggcattgaatcgcgtgacatcagttttgggcgagtcgagttgccatgagacgaagacgaagaggagagagacaaaatacggcacaaatttctagcaaatcccaggctttacgaaaagggaataaaacgggctttttaaaatggggcaaggaattaacgaaaaaataccattaggtggtaaataaactatatttgacaattcctggccctgttaaagcatttaccatctgactaattttccattcccagtcaaatgtttactaaacatgtaaaattcatcgccttcatttttttgtccattacttttgacaaggaaataaacgattttctgtaaaaaaaaat

SEQ ID NO: 87109 - DNA, 414 bp, Heterodera glycines
  SCN-specific regions: Sequence locations=1-414
ggattaattcgctttatcgttaaatgtgccgactccagcaactcatctgctcgctcgactctttctgctttttgcgctttgcactgctttcgttagctctctcactgctgttgccccgccattcggccaattgtccgtttccggcaccaatttggtcggcgccaacggacaacccgtacagctgatcggcaactcactgttctggcaccaatggtacccgcagttttggaacgctgacacagtgaaggcactcaaatgcaattggaatgccaatgtcatccggggggccatgggcgtggacgagggcggctatctgagtgacgcgaacacggcttacaatctgatggtggcagtgatcgaagcggccatttccaatggcatttacgtgatagtcgattggcatgcccacaatcc

SEQ ID NO: 87110 - DNA, 726 bp, Heterodera glycines
  SCN-specific regions: Sequence locations=1-185,207-207,237-243,267-726
gtggaaaattgctcttggtaaattagttggcatgcaattattacttctcttggagtttgaaaatcctttgatattctcattagatattttctgcgacaaacaattggcattggattacgccatattgttttgcacaaatccaaccgtttcgtccgatgctgagaatcggctgtcaattcgtttgtattttgccaaaattatggcaatttttacgaaaattttcaattttattaaaacgagtacagaaaaagaaaacaagcaaaaatatttgcttgtatttgttgaaatttggaacaaaatttgtccgcgtattcatacagaactccaacagaatgacatttcatcgactgttggcatactgtacaacatttggcggggaattgcatcccgatacaatcaaattccgcttggaatttttcaaggttatgagccaattagggtattatcgtcagataacggcttactgttactggatgaaaaaggcacctacagttctaatgtgatccgtgctgaacttttgaggaccatgtggtgaatatgttgcgactgtatgagcaacagagcgaaggaaattcgttcggccttttgttgcgccgttgcaaattggatggcattgcgtataagcatttgatgagagcgttttttgacgacaaatttgcaaatggaaacgaattcgaaaaattacgagcgaaatatcccaagcttaaagaattgtttcgtttcgat

SEQ ID NO: 87111 - DNA, 662 bp, Heterodera glycines
  SCN-specific regions: Sequence locations=1-241,266-378,400-662
ttccaagaaaacgaaattacgaacgcgaaagggaggcggacgcaaaggaccgacacgaagaaagggcagaactggaggagataagaaggtcccttttggaagaggaagtggtcagcaaaaaggaaggggacggcgaagaagcagacgaaagtggggacacttctggcagaatggacattgccgacgaacaaaaggcggaatgggagaccgttggcgagacggcggcgatggtttctgggcctgttcctcctcctccccttcccagcgaggaaccgaccccagcccaagttgaaagtccgacgccagtgaagaaaaccatcgtgacgacgttacaacagaagcaagtggtgccgttgtcgaaactcaacggagtgttccaagaggaagaggaggatgaagtcgatacgttgcatcagatcaagaaaaagataaagcccttcgaaataacgcgagaggatcgattacaatcgatgacaccggaagaacgcaagaagctgatcaaggaccttatcacgcggattcccaccgacaaagccaaacttttctcttttgaagtgtgttgggaattcgtggacgaaaatctgatggaacagcgagtgaggccgtgggtgaacaagataatttgcgaatacattggggaggatgaacaatcgctggtcgct

SEQ ID NO: 87112 - DNA, 672 bp, Heterodera glycines
  SCN-specific regions: Sequence locations=1-494,516-672
cacttgcttttctgatggaccctcccgatctatccgagactcagccgaccattccgaaaaggggccaccaccaccggcgtcgcgtggatatctccgcctcgcgtttgccccgcgctgtgctcgtccgcatctttgggcatttgagtgtggctgagttgggtgctgtttctctcgtttgttgcagttggaaattcatcgtcgactcaaatgacttcgatctgtgggctcgccatgctcgtgctcagctgccggagagcgcgctgtccgacccgtatttgtttgtcaacacttcctcccacagggaaatgttgagggcatttaaacacgcctggaatccatcggactgttctcgaaatgcttttgtccgcaccaatggtttcaccgtccatcggcaacccattgcacagagtacggatggaattcggggcaaagttggcgtttcgagcggggcgcactgttgggaattttgctgggaaggcccactcggaactaccgctgttgttggagtggcgacaaagttgccgaaatgcatgacttaggggagttgtgccaatgttttgtgccttaagacatgccgcgttgcattgtcccggctatttgccgttaattggcagcgacgaccaaagctggggatggaatttggtgaacaatacaattgcgcacaacggcgaa

SEQ ID NO: 87113 - DNA, 708 bp, Heterodera glycines
  misc_feature (651)..(651): n is a, c, g, or t
  SCN-specific regions: Sequence locations=1-251,273-708
ataaaattgtcccctcaccgaaacccggaaaattccctaaaactcctacaacaaataatatgaaatacttgccgccggaacttttggacgaaatgactttttacatatatcctaaccaaaattgttcgagaattctgacttcttcctggttactcatggaatttttgaggcctcatatcgaaagatggaaaaaaatatttaaaatactgcttaacgagttgatcgatctgcacaaactctgtaaggaagaaatcccttggcgcacatttaccgccctggcagaaaaggacaaaaactgcaatgcctttgttgccgcgttactggaactggttaaagaggacgcttatgcatctatcgacggatctggctcgaatgcgttgctcatccgtctccgcgaactttacccaagtgttattgaaactcttgcgtggactggccttcaaacactcaatgccgaactttttccatcaacacagcgtatggtgcaagcacttcgcgagttaattgaaacgacgggactttattttggagccgttcccaaggcgtcctcatcaaaggaacatttttaccattctgtggcttgcgttggcgatgttccgccgaacgttgatgaccatcctccgccacagcttaagataattgatgctggtngtcagtcgacttcctcatcaacggctcccattccgaaaccgctggacaaatcgatga

SEQ ID NO: 87114 - DNA, 733 bp, Heterodera glycines
  SCN-specific regions: Sequence locations=1-249,275-354,377-733
tagcgtttggggtagtgaacgatatcccacgcaagaatgggcactcatcggcgagtttgaggcattggacaatcgcgaagtgcagctattcaatgtgctggaacacacttcgtacgccaaattcgttaagttggaactgctcactcactatgggtcggagcattactgcacactgagcactttccgtatgtacggcacctcaatggttgacgaatacgaagcggaaactgtggtggcggttgacgccatgcaacaacagcaacaccaacaacagatggactcggtgttcggccgcacattctccacacttccgtccacaaattcagcagcggtgaatgaagctgtggtggccacgggtggggaggaggaaaacagacagaacaacggcacaataacggaaaagacaccgctgacgacagtggtaattcacaggccgaccgaacagccagatgttttgcgacgctgtcgcaagtgcccatatgaaatggcgtcgcaatgtgattggttttgccacgtattctttggccatcatcagaatcaacggacgacagagatgacaaaagcgacggactcttcctctccatccgctactttgcctctggctaaggtatcttcctcactgctcatggaatttctcaaccgaatttcgcccagtcgttccgcaatttgcgcagcttcttcaatttctcgactcaaaacatgcgaattgaatgggaagaatgggaacaaccag

SEQ ID NO: 87115 - DNA, 616 bp, Heterodera glycines
  misc_feature (593)..(595): n is a, c, g, or t
  SCN-specific regions: Sequence locations=1-374,398-438,460-595
gttcgtaaattccgtgcccttacaataagacgaggacactttccgcgtcgaacttctcgtcctcccgtgcattgtgctggcgctgtttgtcaacgccgatttcactgcgttggaagttttgtggaccttcagcatttaccttgaggctgtcgcgattttgccccaacttttcatgcttcaaaaacgcggcgaggcggagacaatcactgcccattatctgtttctgcttggcatttaccgcgctttatacattttcaattgggtctatcgctattacactgaggcgttctacgacccaattgtgatcgtttcgggcattgttcaaactgttctgtacgccgatttcttctatctttacgtcactcgagtggtcaaagatggggccaaattggaattgcccatttgagtgatcaaagattggacgtgatgagtaatcgatccccttttcttggcctttttagttgggtgttccatttgaaaatttgatgtcccttcattcctttattttgtcctttaccattttctttcgacaatttgcctttgggttttttgttatatttttattctttctgtgaataaatggcttttgggcnnnaaaaaaaaaaaaaaaaaaaaa

SEQ ID NO: 87116 - DNA, 664 bp, Heterodera glycines
  SCN-specific regions: Sequence locations=1-664
taaaaatgggaaaagccaacgaagaaagtctcttcagaaccatcggatgttgaggttttacatcttgtccttatctgaacaattaatttcgcgggctgaagtcgatcctgagatttgtgtagttcaaattgcggacacttccgtaaactctgttgttgatcatttagtgactgagacttactcaacgacggaatgcgcctcacctttgcgaaccaatccaacgtttttgaccaatgtttgcagaataaacatttcatccaaaggacaacaaaagattttcttctgtgatttgaatgagcctttgctcaatgtaatcaatgaattcgctgaaaggacgaatgtcgacccgaaacgcgtgaatttgtacacaaaacaatacaaacgctgtgatccgaaggacacgccgaggacattgggactatcggaaaaatgcgatgaaattgaattggacgcatttgaggacctcgaagagaatgaagggaaaaggctcgcacttaaataccaaacgaagggacagaggccgaccatagtacgcgttttgccggatgcaacattcgcttcactgaaggagctattttgcactgaccatgcgttggatcctgccaagacgcgcttccttttgggttcaattgaaatgatcgctgatgatgaaacgcctaattcg

SEQ ID NO: 87117 - DNA, 607 bp, Heterodera glycines
  SCN-specific regions: Sequence locations=1-37,59-192,214-308,331 -490,513-528,557-607
ataacgcggcacagtataaatataaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaaggtcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaa

SEQ ID NO: 87118 - DNA, 614 bp, Heterodera glycines
  SCN-specific regions: Sequence locations=1-470,531-614
tggtgatggaaatgcactcaatgctgtttattttcctatggaatggaaatggcaaaaaggcatttatgcctggttttaagcttctaaggcaatatttaaaaaaaccctttaaagcggccaaaataaccgctaaaaagagcaacatatctctcaaattgattatttttggtaaaaataaaaaaattcatgaattttttcccgttgttaagcccctttttaatttagggaaaagtcagggccattatgctggtgaatccgcaaaatccggaggccggctacttttccctggacgaaattcggccggtcgtccactgggccctgagtcgcaatttgttcgtgcttttggacgaaatttacgatttgtccatttacgacgaggacagcgaatgtccgtttcgaagtgcggtcgaactgttcgaagacgaacgcagccgacagaagctgatttggctgtggggaccgagcaaggcaaaagcaaaaaaatagaaagggaaaagggaacggaggagaaaaaaaaatgagaaaaaaaagggacaaagggccaacaaaacggacaaagggccaacaaaacggacaaagggccaacaaaaaggacaaagggctaacaacagtca

SEQ ID NO: 87119 - DNA, 600 bp, Heterodera glycines
  misc_feature (22)..(22): n is a, c, g, or t
  SCN-specific regions: Sequence locations=1-90,112-172,205-600
catttcgaagtgcacccgctgncaacacttttaaacgggcctcgacaaaacaagcaaattcttcaccaacacaccgatgaatagcggcgtcagcccaactccgttcctttcgctccgctgtgtgtgctcagtgctggtgctgctcatctgtgcgttcgatgtgtcactggcagcaaaagacaaggagaagaatggcaaagaagaaccaggaggccaatttaatacgctcagcatcattttgctgattccgctggtcatcgtcaccggcgcgttcgtctacctgctgtttatgaagccaaagagcgaaggaaccggcgatgacgacggagaaggggacgcggacgtggagaagggaccaaccgaagagacgaaaacggagcctcgaattgaatctccagcaactcttttgggcgtgacagtgccgttggagcaagacgaagaagagcagaaaaaggacgacgagggtggcgaccaaaccgcggagaagaaggaagaggacgcggtgacagcggacgaacaaccgaaagaaggcgccgcggaggcagcggaagcggagaaaagtgcgacaaaggaggagacgaccgaggacacggaggaaac

SEQ ID NO: 87120 - DNA, 629 bp, Heterodera glycines
  SCN-specific regions: Sequence locations=1-146,180-203,255-273,355 -355,414-431,468-487,555-629
gaaggtaattgtaaactaccaagatttatttttgctgaatcattccaacaatggtgaagcatatccgtggtcgtccattgggacaagtgcgtattggctttggtgatgccgaccccctttgggactagagaatgaaaagtacaaagtgctgtgccgaagcattcatgtttccaaggcagctctgtacattggttacatgcggttgttggtctccttagtgtccagtctcttttttgcgtaccaatacatgatggccgtcactggccaattgtcctccgaccattggattaaccaagtgactgctcgctttatgtcacaggcaatgatgtccatctgtttgcaagtgattgtcgtcgtacttatggtccacggtgtgaaggctgagaagaagtccttgttgcttccttttattgtgtatgctgcgatcgcagttttggctggttcgatcaaggttatgagtgatttggtgtatttggacacgagcgtctacaaaaacaatgaggcggagagtcgagccgccaaagtgcaatttctcactaatctgttgcgcactgtgctccaggcctggtgtctgtctgttgtttggcgttgctatggttacctgaccgaaaaaaagtggcacgtcagat

SEQ ID NO: 87121 - DNA, 557 bp, Heterodera glycines
  SCN-specific regions: Sequence locations=1-339,364-469,548-557
acgaattctacgaagaacgcattcggaataccaatgggagaaagtgcgcattttcactgcttggttgtcggcggatgactatcccaagtttctgtcctgtgccgaccttggagtttctcttcatacgtcgacctcgggatttgatttaccgatgaaagtcgtggatatgctcggcagcggtgtccccgtgttggccaagaactttcccgccatcggtgaactcatcgatggaaccaatgggctcctctttgatacgcctgaagaattggaaaatcttttggccgacctttcgcttggatttcctggaaattcgaagcttactgatctcaccaaaaatgtcaaggaagaggcaaagaagaacgattggactaaaaattgggacgatgttgtctggccgcattttgagaatttgtagacacgcacataacgggaccaatttgacacatgcccagtgactttcttcaatgactatttatttatttttttatttcatgagaaatcaaaattataatgtttttgttttatatattttgaaagataaatttttgacttctaaa

SEQ ID NO: 87122 - DNA, 415 bp, Heterodera glycines
  SCN-specific regions: Sequence locations=1-415
acccggggacgcacgccattccctttactatttaacctcttcattcgcgacttcgtctcttggcaaccaaaaccaaagatttgccccatcaatttgaatgctgtaaatacgaagagccctcctttggatgttacacttgtcatctcctcctctatttaatgttcggaaatcgttgaccacttcatttctctccgagctccgaacttatgatgtgtggcgctgcgaagacggaaacgaatgtgcaagtggctgttgtgaatgtgaactcgggcgtcattggggccaatgggaacggcgtgttattggcggaaagggaaaccgactcgcgaaatggcgccgaatttacaccaaactttgacaacactcaccagggcaatttgttgccctcctcgttttctgcctgcggtgcttccac

SEQ ID NO: 87123 - DNA, 732 bp, Heterodera glycines
  SCN-specific regions: Sequence locations=1-732
gtggattttatttacaacctttaccaaaaaacgaaaatggcccataaaaggaagcgacaaaacaggatgcgccgtgttcataacaaattccgacttggtcgaccagtgttcgttcccgcttgaccagctgccactgaacacactcgtcattatcgcctcacaactcccgttcaaggacttcaagcgggtcggcatgatttccaagcagttcaaccgagctcaacgaatgaccaggttcagcagaaagcacgtctcggtcgacctgttgcgcaagctgttcccggacgaagtgcccgacacggacgtggacaacagcaacaacgacggcactgagcgtagcgttggcatgctggaggtgatggacccgctgcgtcagcacctgcgaagttcgccgcccagaaacatccgtgaagtggacatgagcaagttcagcacgttccgcgagtcgcactttgtcgaactgttccgttcaatcagcaacggcagagaactgctcacggaagtacgacggctcaatgtgcagaagtgtgtgatcgagttgcgcgacatggaatttttggcccaactgatgcccaaagtgtggtacattcgctgctccgcccaaacgcttgtcattccggaagacattgatcagtccaaattggcactcagcgtggaacagatgcgccaattgcacgccaagctggacaagttcgactacgtggcgaggaagtgcaccaaaaaacacctgtg

SEQ ID NO: 87124 - DNA, 603 bp, Heterodera glycines
  SCN-specific regions: Sequence locations=1-603
gtgattcgctttgtccttccctttagatggcttttcccgattttgcagccggcgcaatggaaaattggggattggtcacctaccgggagaagtatttgctgtacagccccgaactttacacggcgcaacagaaacaagcggttgcatcggttgttgcgcacgaattggcacaccaatggttcggcaatttggtcactatgcgttggtggagtgatctgtggttgaacgaaggcttcgccactcttatggagtatctcggcacgaatgcgattagcgacggaatgttccgcatggacgactatttcctcgtcgaggctctcgactcggcattcgaccgcgactcgcgtgccacttcccacccgctgtttttcgaaatccgaaaagcagaagatgtgaccgaagcattcgattcaatcacttacagcaaaggtgcatccgttctgagaatgatccgcgcagtgatgggcgaagagcacttcaagaaggggctcaatgtttgtacaaattgaggggtctgaagaaaatgttttggcgcaatgcgacggcactttgaaattggacccattggcagtgccttttggcattttgtcggctctttcagat

SEQ ID NO: 87125 - DNA, 611 bp, Heterodera glycines
  SCN-specific regions: Sequence locations=1-106,130-345,367-423,447 -516,545-611
gccacatattattgttattatatcttgctcatcgtctgcaactttaatccacgcagcgacgtgcccggcgcaacaatggcaagagaggactacggcttcgatgcaacggcggcggcagcggcggagcagtctcggccttcggcaaccacttcaacgccatattggcagcacgactccttggacatcgcccttcaagccatcatccggaaggtcaggcaatcgcctgtccaccgcttcacggatgagatcaccgacgaggaactccaacaactctgcatggcggcaacggacgtcttcagaatgcagccgacgctcgtcaggattcagccgccggtcgtcgtcgtgggcgacatccatggacaattcacggacctgcagaggatcttcgacacgcatggctaccctccagagcagcagtacgtcttcctgggcgactacgtcgaccgaggcccccagtcactggaaacaattgttcttctcttctgctacaaggtcaaatacccggcgaacttcatgctgctgcgcgggaaccacgagtgcgccaacatcaacagagtgtatggcttcttcgatgagttcatcaaccgctacaagcgtccggatccctgccg

SEQ ID NO: 87126 - DNA, 218 bp, Heterodera glycines
  SCN-specific regions: Sequence locations=1-136,160-218
aaaagtttccgcccctagcgatgagctcgtcaacaaactgcatgtccgaatactgcgcacgacttcgcgagctgttcaacgcacacaaagtgaagcatggcggacttggccacgacgtgcagtcggaaattgcgtgaaattggcaaatgaaaggccacaaaaattataagctcaattttcgaatctaaaggacaacagtgcactcaaatacaatatta

SEQ ID NO: 87127 - DNA, 624 bp, Heterodera glycines
  SCN-specific regions: Sequence locations=1-624
caaaagctcggcactccgacgtggacgagatcatacatttgcgcaaccggcttacatgcgtgacccgttgcgtgccgaccttctcgcgggctccaaactgaaggaggtgaagaagacggactacaaccagtgcaagtccatgctgctcgacctgttcgacggcacgcgcgtgattttggtgggcgaaacgcgggaccgaagcggacgcaagcggttgatctcctgctttcaactgtaccgacaaagcagagccgcggcatatttcggcatgttcgctgtccatccctttttccaagcgtccggacttggcaagcgattgttgactgttgctgaacgctatgcccgtattgtgtggggcagtgacgagatgcatttggatgttggcgggagtttggccgaattaaagttgggcatgggacgactgcagagatactacaagcggcgcgggttcctatcaaccggcattcttcgccccttcaatggggctgtggcgcgcttcatcacggtagaccgaaacgatctgtggattgagctgatggtcaaggacatacgtggagcattggatgacatcggcggagatccagagaaacggatgaaaagagtgaacagtcgggggagattggc

SEQ ID NO: 87128 - DNA, 542 bp, Heterodera glycines
  misc_feature (536)..(536): n is a, c, g, or t
  SCN-specific regions: Sequence locations=1-395,417-483,525-542
cccttctactgtaacgtgctcggaatgcggctgctcaagcaattggacttccctgagggaaaattctcgctctttttcatgggctacaaagatttggacgaaatcccttcggacgatgcggcccaaaagaaattcgccctctcaacccattcgaccatcgaactcactcacaattgggaacatggtacggacttcaagggctatcacaacggaaactcggaaccgcgtggattcggtcacattggcattgctgtgcccgacgtggactcggcttgcgcgcggtttgagcaattgggcgtaaagtttgtcgaaaaaccgaacgaggggcgcatgagaggcttggcattcatcacggacccggacggctattggattgagattttcaatccaaacaacatgtgaaaaacgaacccaaaagattgagaattggattttcccattggcgaagcaatcaatttcgaaaaatcacaatagagcctagacattatttatttttttatttttataatcgaataaatatttatgacttgtaaaanaaaaaa

SEQ ID NO: 87129 - DNA, 365 bp, Heterodera glycines
  SCN-specific regions: Sequence locations=1-25,56-112,137-217,255 -262,294-294,318-365
ccagtttgaggacaatggttgccgccaatctgaagctttccctgatttttgtggccggcttttgcctgctgttcatcgccgactccgatgccgggaagtcgtgcaaaccgggagaaaagggaccgccaggccctccagggaagccgggaaacaaggggaagcccggcgtgtgcaagcccaaatatgaaacaacttccaagtacggtacgactacttccaagtacgacaccaccacttccaagtacggtacaacaacacccgaatacgatacgacaacatccaaatacgatacaacgacttccaaatacgacacaacaacttccgactacggtacgacaacttccaaatacgatacaaccacttcc

SEQ ID NO: 87130 - DNA, 627 bp, Heterodera glycines
  SCN-specific regions: Sequence locations=1-123,157-458,480-627
gtgcaaacacgcttgtgcaatggccatgcaaatgttggtcatgtacacgcccatcaacagttacgaaggttcggaccaacttctgtttccgctctatcgttcagacttacatttgttcagacaaaagccccaagaatttttggcaaatgccttgctgtcaaacacggatgtagtccatacgcatcccatggaattgttgccgagcactgaccgcagcataaacaataacaacaacccgtacacgttgatgatgaagcgcatttcgacaccaccaattttcgatgaggaggcaattgatggcgaagcgttaaatgcgcggaccgaacaaaaggaggaggaacaaaatttgttgcgggctggacgaaacattgaagaggtgactgctccaaaaatgtatgcgcgtcatcttggcgatttgggaggaacgatgtttcgcttcggatgaattgttgttatatttttcatgttcaaaacaacacagcgcaacggtgaaaaataaatgatgaacaattaccgacaaaattttgaatttcctttcgatctctttggcacaaacacccaaaaaatgtgtgtgaaaacataataaatttcattgaatttttctttgaaaatcgaataaatttgtgc

SEQ ID NO: 87131 - DNA, 725 bp, Heterodera glycines
  SCN-specific regions: Sequence locations=1-485,507-691,713-725
aaggcgtcttgcataaaactcttttgcgtaaatgcccgacctcttttccacactgtcaacgtgttgctctgctcgacctttctggaatggtcacttcgtacggtgcgccatgcgaaagcgacgaccgaattttgaaagcactgcaaattctcgtctattttatacccgaaacgcataagcaatgtttggaatgtttgctgatccatttgaaaagagtgtcggctcattccgacaaaaacaaaatggacgagtccaacctcggcctgctcttttcttcctacgtttttccagtccaacaacagaaatacgaatcaattgaaaaggcaaaagacgaaattgcgcagttttgtcgtttgtttcccgttttactcaaacattgcgacgcgctgtttaaactgcccgctgagctcgtgcagactttcgacgcttctctaatgaaaagggcccttgagcagcagaattgcggggacctcacaatcagcagcactccctccttcgctttctctcctctgttgccaactccaaatcgaaacacaaaaactccgagaagagacgaagacgacgcggaagtcgccattgtgcactcgtgctcaaagagagtggcgacgcccaaccaaaacaccaccgatttggaagtggcgaagttggcggcgaacatcgcatcgatggatgaaggctcggccaggtcgcggctgttgaacaaaatgatgactgtgcagcgccag

SEQ ID NO: 87132 - DNA, 703 bp, Heterodera glycines
  SCN-specific regions: Sequence locations=1-37,62-96,118-317,339-703
taaattttcgggctttacttgcatttacaggaacttaagcattttgatggacaaaatggcaaattaattggtaatgacagcgacgagtcattggaatcattggtttcatttatttctaaaaatggctttggtctcataaacgacgaacggagaacaaaaattgatcaggcaattcaagaaatagaacaaattgttaagaaatggaatcgcaaagcgaaaattattgtcatgggttcctaccaattgggcgcactcaccaaacaatcagacatcgatgccatttgtgttgtgcccgaattacgcacttggagagcggcaaaattttttgggaaggcaaagtgccaaattcaatggaacgggttcagaaggtgcgcggatgattcactgttttgccacttttgtttggcggcccaagtaacggggctcaatcggatccaagacgcgtgggtgccgctgattaaattcaaattcgaaatcgacccgaaaacttccgtcgattttgacattggactagaaacatttgcaatccatgacgacatttttaaatccgaagagccaataaaatacgaacaatgcgacgcattgtcagcgaaaatggccaacgaaattggacaattagcgaatcggaggagggcatttattacgaggggtggagactatgaggaactgatggaaatgaacagcgagcgggagaagctgagaa

SEQ ID NO: 87133 - DNA, 757 bp, Heterodera glycines
  SCN-specific regions: Sequence locations=1-335,358-661,683-757
gtgggaaaatcgttctgtattttttgcacttttctactccaatttatttacaaaattgaaaggtttttcttctaaaatgcatttgatcactgatttgaattatgatcgatcggtcattcttaattaatcatttcttctgtggctgatcactctttttgttgtattgtccgtcactcacattcattgttagaagaagacggcccatttgtgatgctttgtccggcttcttgttcttccatttctttcgatggcggagacaatggcctaaattcgtacgtttcagacctctcacagtccaggaaaaaaatatggatttccatgtaaatgatagccctaattattacacaaatgccttttttaattgctcacccaatgcaaagaatttccacactgaaattgttccgaaaaaggatgcacaaacgaaaaattggtacgacgagggccgaaattgaaattgaaaattgcaatgtgcgcattcccgaacttgttcaaagtcatctgaaacttattcgacaaatacgcgagaatgtggtcgcccccgtggacacaattggctgccatgcgttggccgacaaatgcgcagacccaaaaacgtatcgtttccagattttggtggcacttatgctctccagtcaaaccaaagaccaagtgacggcagaggcgatggagaggttaaaaaaggaaggctgcaccgtggacaatttcatcggaattgcagacaaacggctcgagcagttgctgaaccctgttggctttt

SEQ ID NO: 87134 - DNA, 580 bp, Heterodera glycines
  SCN-specific regions: Sequence locations=1-25,48-252,274-537
catttgaagaacggagacgcggacaaggaggaacagcgcaaagtttttcgtgcacaaattgaactagctaaagaattgcagttgcccctaaacgtgcattctcgttcggctggtacgcctgtaattgaatggttggccgcgcatggggcgcaaaatgtgctgttgcacgccttcagtggcaatgtggaaaatgctcaaaagggcatcgaaaagggcttcttcttttccattcctccatcctttgctctctcaaaagaaaaggaagcactgatccagaaaatcccgttgagtaaactttgtttggagagcgattcgcccgtgcttgggccagttgccgaggagcgaaatgaacccaaaaacattaaactcagtgccgagttcatcgccagaattaagaatgtttccacggacgaagttatccgagtgacaactgagaatgcgaagaaattgtttccgaaattgaaaatttgatggaatacatatacctagtcaacttgttctttcatttgaattttattgaataaaaatttgggtactaaaaaaaaaaaagaaaaaaaaaaaaaaagaaaaaaaaaaaaac

SEQ ID NO: 87135 - DNA, 533 bp, Heterodera glycines
  SCN-specific regions: Sequence locations=1-207,229-345,369-506
agtgcgcattgagggaagagcactgcaactgttggatgtcgagcaattatgtggggaattggaggagatcaccggactgaggcctcttccccaccgaccgttcgtcgaaaatttcgtcaaagcattttatttgccgtttggagagcttcaaaattggatggtgaatcatacagagtacagcctaagccaaacgagcgcaattttaaatgcagcggctggggcggcggcgaacagctcgtcctccgtcgcgacgaactccagaaaagcgaccatgtcgcgcatcatggccaatctgttgggcgcgagcggaattggggaaggcggcaactctcttttccaatgaataattccaatttattgtttaatttcacatcatttcaatccctttcatcttcgcatttaataagtcacgcaaaagaacactcacattttgtaattctaacaaatcccagttttgtttgtatatattgaatgttgttaattgtgataaaaaaaggcttaaatttaaaaaaaaaaaaaaaaaaaaaaaaaaa

SEQ ID NO: 87136 - DNA, 368 bp, Heterodera glycines
  misc_feature (260)..(260): n is a, c, g, or t
  SCN-specific regions: Sequence locations=1-368
ttcgtctttctgccttttgctggccacaacacaacatttccctaacgaccttcgaccgactacgacacgacgcgtacgatgaacgaggaatactgcttctctacttcgactgttgttgcacagagctgggcccaaacaaacttccgaccagtggacgagcaaccgaacagccttgtggacacgctcatcgccaaactttcgcgcacgactttcgagcagttcacttccgaagtcagtgctcaagacattcacaagctttngcgaatgtcaccgtcggtgttctccagcaacagtcaatgctcatccatctgcagcctcctgtggtcctttgcggcgacattcccatggccaatttcgggacttgctga

SEQ ID NO: 87137 - DNA, 684 bp, Heterodera glycines
  SCN-specific regions: Sequence locations=1-319,341-684
caatttagatgaaagaatcattcaccgttggcgccaagtgcccccaattgaccaccaattgccccctcgactttggcattgtgccgctctcctcccgcccgatacgttgttgttttacggtgggatgaatgaggtgccctcccgcgattcgcccttcgtccgcactttgctcgtccgtcgtctctgtcctccgacccttcgccatttgtcgctgaacgctttggccttccaaattgtgattcgctggtcacaggaaatgaacgcgcgcaaaatggcgggtgccccggaaagtgcggccgggacacttggccgaagaatgaattctgaatcggattccgatctgctcaatttcgtctcgcgcacttttttcgctcatctgccaaattcgctccactttcatctcaccgttttgttgaccatccgaaaacactcaaaggcattgaatttaatgggcgccggtggggcgaacattccgcgcgtcccttcgccgatgccatcgcattggaatttgccgcccatccctttgcaattccatttgctccatttggtggacggaaggaatttggccggaggcaacgaggaaagcggcggcgaaaatgaaatttccactttctcgcgtcccccactcattgccctttctcccaaatcgcaacggcgtgcgttggcggatgaaataactgcgct

SEQ ID NO: 87138 - DNA, 617 bp, Heterodera glycines
  misc_feature (598)..(598): n is a, c, g, or t
  misc_feature (608)..(608): n is a, c, g, or t
  misc_feature (613)..(613): n is a, c, g, or t
  SCN-specific regions: Sequence locations=1-6,29-161,183-545,568-617
catcataaaataaaacaatgaacaaatttgtgggcatatttgccgctgttttgctccaatttgtttcgccattttcggcattttcccgcgtgccaacgacgaccaccgaacgaccgataatttatgacccaaaagaaatggtggaaatcgaagtgaatttggtgaacaacaccaacaacaactgcacaaatgatgttcttcgaaaataccgtgtggagatcactaattatgtgttctttttggtgtgcgatttgaaaattcgagtccaattgccggaaggggcaactttggagaatgtcgtcaacctgaaaccgttcaatggcaccaccgatcaattcatttttcccgattccttgcgctacctttacgtttccaaaacgctcgaagccgaactgagcgtcaaaggcggcgagggggagccgaaaatcactgttttggatgcaaaggccgctttttcgccgaagaaatgccgaatttcgaaattttaatggcaatttaaagaaaggacgaaaatgaaaggagaaataggatagaaaacgtaataatttctaaagggatttgtatcaataaatatggaataaatgttgatgaaccgaanaaaaaaaaanacaanaaaa

SEQ ID NO: 87139 - DNA, 224 bp, Heterodera glycines
  SCN-specific regions: Sequence locations=1-142,164-224
ttcctgctattttttgataatgggtcgaccaggcgttatccgatgaaaaaaacagcaaagaatacaaaccaagcccaaaaaatagaacgattgtcctttgacactgatcagacgcctcttcaaacaccaaaggacagcaggaaaaacaagaatatgaacaaaaagccatccaattcgatgttggaggaacagccaacaacatggaaagagcaaatgttgaagat

SEQ ID NO: 87140 - DNA, 612 bp, Heterodera glycines
  SCN-specific regions: Sequence locations=1-37,59-192,214-490,513 -528,557-612
ataacgcggcacagtataaatataaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaatcgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctatgcaatttgaaatgggggcaaatcgattagaaaaaatgagggcacacctacgcgaacttgctgagaaaatgccggtcaatgaatcgaagcgtctgtcaccgagtggacccgaccctcatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaacccct

SEQ ID NO: 87141 - DNA, 676 bp, Heterodera glycines
  SCN-specific regions: Sequence locations=1-41,63-419,442-676
cagtccttaagttaatttggtaaaataaacatcttattaatatatttgttttgtataaagcattatggacatttctcgacttcgaaggatttgtgccatttacgcttccgattggattaacggatatccattcagtttggcggtgattaagaaggcattggagtcaaaattaaatgtgtgctcattattgttccttcatctccggagggatctgcccgatactctcaaaaataacccaaaattcgtcgcgttggaatgttttggtttcgattcattagaggcaattcgcaaaagattggcaaaggaagacatttcgcgcgaatctttggtgttcatcgactcgcttcccgttctgatcgagcagttctcgctgccctccacctcgtggttcctcacccaaattgccgaactgtccgcctgcgttttggcattggttcacagctcagaatccgaagatgaccaaaacagcgaagattggcgacgaattgaatcaattgcgtcgactgttttcgagcttagggcgagggataaacacacattgtgccgaacgaagaccaaaaaaaggaatggcaccgcagaagagaagcttgaacaattctccatcgaagaagactattccatcactttttctccatttgattattcttctgatcggactgacgacaaattcgtcgag

SEQ ID NO: 87142 - DNA, 573 bp, Heterodera glycines
  SCN-specific regions: Sequence locations=1-69,234-277,323-350,446 -497,550-573
cagttgaattttattttttttttttgtgtacataaaaacgctgcgccgaaatctatatataagtgacttttttcatttttttttttaagtttttcttatttttctattttttaatataatttttaggtgtaaaaaaaaatatttttttttttctccttatatatttttttttatttaatgaataaatttttaatattacagttgaattttatttttttttttattttttttttgggtacataaaaacgctgcgccagaaatctatatataaagtgacttttttcatttttttttttaagtttttcttatttttctattttttaatataatttttaggggtaaaaaaaaaatattttttttttttttttccttatatatttttttttatttaatgaataaatttttaatattacaggggaattttattttttttttatttttttttgggggacataaaaaccctgcgccaaaaatttatttttaaagggacttttttcatttttttttttttaaagttttcttattttcctattttttaaaataatttttggggggaaaaaaaaaacccaaaaa

SEQ ID NO: 87143 - DNA, 695 bp, Heterodera glycines
  SCN-specific regions: Sequence locations=1-672,694-695
gtggttgctcttcaccctgccgtgactccattcttagaaaacgcacttcttttatcgcttcttaattggccttgagattgcgccttctccttccatcccttctcgtcgtattgcgagcctttcgatggctatttaaaatttgatggtgaatcgatttgcttctcgggttgggtccaactgccccaaggaatgttcaaacatcgcaaaaggggttgggctgttgtgcggaacaacacattctcaatcagccaagacgacgaaagtcgtactccgttctttgggccggttgaattgtccaagtgcgtttttcttggcaaagagtcagattccgaatctgtggtggtatttatactccgtgatttgtcaaagagaagcaaaaatcagaaacatttgctgaattcttcgggcgaacttaacactgtccgcttcacacctgaggagaatcacgagttttggctgtctctcatggcgaagtgctgttccccacgaaatgatctcttcggagagaaattgccgatggtcgaatgttgcgggaggctgtgggtgaagcaggggatcagtgggcattggaacgagggatgggcctttgtgcacggacactctttgacctattgggtgcaggcgccgaatgccattgcggaggtggacattcgaaaaatatttttggtcaagcaaaacgacattccctcctccga

SEQ ID NO: 87144 - DNA, 658 bp, Heterodera glycines
  SCN-specific regions: Sequence locations=1-658
aaatttgtctgcgtcgaataaaaagattctaatgaagtgccactctgttcggaagtgattctttaccatggcctaagcaagctccaatacgacatgtacagggccattctgagcagcaatcgatctttctttgccaaaaacatgcgcacagagaaacaggcgcgacagtctctgatgtcaactttggtgcaactttgtaagtgctgtgaccatccttatttgtttcgaggaatcgaaaaggaaccatttgaggagggagaacatttggtcaacgacagcggaaaggcattgattctggacagactgttggcctatttgcacaaaaagggtcatcgtgtcctcatttttacgcaaatgcaacgcttcctggacattgtgtacgacatcatgagtcttcgaggatacatctgtgagcaattggatggaaccgttagtcaaccggatcgtcagaaagccattcaaaactttcaacggcctgattcggacgtgttcgcttttcttctgacaaccaaagcgggtggtcttggtctgaatttaaccgccgcagacactgctatttttctcgattgggacttcaatccgcagaacgacaaacaagcggctgcacgatgccaccgcatcgggcaggacaaacctgttaaaatcattcgtctcgtgg

SEQ ID NO: 87145 - DNA, 618 bp, Heterodera glycines
  SCN-specific regions: Sequence locations=1-60,82-618
gtgcaagacatgtacgtctggtgataaatgttcatcttgatgcagtccggctttccaggagttgtcaaatatgcttgaagatactgccgacgaaggatatccgaagccaatcccgagtccagttcagaatttcaaaagtgacatcatgctaaaactgattaaattgtgtgaagaatacaagtacaaattcgatggcctaaagaaaacaactgatgtgccaactggagaagtcgcggaggcatcggcttcaaatgtccaagagggtgacgttggggaggcatcggcttcaaaggtcaaggctggaacaattgcggaggaaatccaaaaattcgttcctccgccacacattatgcaatgggacgtgaaaacggaccttgagatggttcgggccgccgacttttataacatcaatcgtttgatcaacgatgattacattgacaatgtgtacgaaatcgtaaaagtcaaatggatcaatggcaaaacgccgcaggaaattcgcaagggattcggcgtcgaagagccgtacccgccgggacatccggaatgggcacgagttgagaaggagaacgagtgggaagaatcggacgaggaacgtgaggcacgccatgcaaaggaacg

SEQ ID NO: 87146 - DNA, 722 bp, Heterodera glycines
  SCN-specific regions: Sequence locations=1-722
gatttttgctattgacagaataacaataatccggctaactaaaatgatcacaattaccatgccaatttgtcgatctggctgtgcaatgacgtttggatggacattctgccgttgtttgaccgtcctcagctcggcctcaaattggcaatgctttcgccccgtttcgatgctcttgtggacatccatttcgatgccaaaacggaattgacgctttggagaccaatcgcaattcgcaacgacggtggcacagacacagctacgccagaattacgtgtgtttatcgacgatgcctacaattccgtgccatttccattgcccgacgcccattcgccgccgatgccaaacaacattcgttttaaggaccttcgaattaattgcattgaccattccgtgatcgcatttcttagtgccaatcaactcattttccagaagggcaccaatttgcgtctgtcgcttccttttggtacattcaacactaatgtcaagcaaatttgggatgattttgcgcgtcaaatttggcccatttttgcaccaaccattcgccactttggctttccgaacggccatcatctggacatgttgcttcgtctcgtttcgccgacaattctcacggatgatcagatcaacatccattcaatcgattccggtcgtcagtttcccgaaccgattggtgatgatcattttgatgggccaacaattacaaattttgatggatcaattgt

SEQ ID NO: 87147 - DNA, 707 bp, Heterodera glycines
  SCN-specific regions: Sequence locations=1-707
cactttttgcctattttgaggatgctcggaagttgtacgaaacacgtatgaaaaatgcctcaaatggcaacaatgaggccgattgtcgtataaagaatttggaaaaagagctgaaggtgctgaagcgacagctgagtgcgttgggcgaccttctcgaccagtttttggacacttcgttggccatgcgcgaacggacgctgcgaatggagggcgaattggggcgacgattggaacgattggaagcgcaaaatgtgcagctgagggcaaatttggcggcgatggggcaacagacgcacaaaaacggggacaacgaacagaggaatgaagcggagcaaactattgaaacgatacatttcgacgaactttcgatttccgacggagttccgcttcaacaaaatgtccaacagcagccgcaaccaccgaatgtcagcaattgccctgtaaatgatgaggggggcgacggggacggaattggcgacgaattggcccattttttggccggtcttccgcccgtggatgaattagggcaattggtgctgaacaagttcaaatactcgtgcgaatttgcccaacttctctacaccggcggaggccatgtggactcggtgttctgcaatattttcagcggatatccgcccactttcttcgaagaattgatcgagtacgccctcacaacgcatcgtcctgatgcgttaatccgtcgcatt

SEQ ID NO: 87148 - DNA, 388 bp, Heterodera glycines
  SCN-specific regions: Sequence locations=1-114,139-363
tccaccgaacctgacatatggaagaattagccaggaggaagtggacaaaattctttgggaagtcactgccggcgaattgggcaaagcgccagcggcggtgcgggacgaactcggagaaaagaaaaggcaaaaagaagcagcgattgccacggcgaatgcattcattgctgaacaaatgggctccaactcagtgacgcattgatttttagcaaattatgaattgtttccattcaattccaacattttatgtgtatattatcgaccaacaaattttctttggttggtttttgatactttttttaacaatgattcagaatatcctatcagaaaggctattttactcatttttataaaatacataggaaaaaaaaaaaaaaaaaaaaaaaaa

SEQ ID NO: 87149 - DNA, 708 bp, Heterodera glycines
  SCN-specific regions: Sequence locations=132-132,201-408,430-708
atcgcaaagcttttcccgacggtgagaaaggtcgtctgtatgtatcggctgctctccaaagtcgaccaataccccgaggcgtcccgaatcgttttcgaccgcacagacgtggccaagccgacgctgtccctttctggagtgtccgagtatttcttgaacattaaattagaaaaaactgaacgcgaaggcaattggagtcagcggccgctccgtctcgagcagaaaaaatacgcggcgcaagacgcgcactgtctgaatcggatcttcagaattgtggcatcgaaattgaaaagattgaaggacaatgaacttgccaaggagttgaaacggcactcactgatcgatttcaacgaagaaaaggcaaagccaacgatggcaattccgctgctcagcggacaattggtgcgagtgaaggaaggcgaggaggacttcattttgaacgtgcaaaaagccgccgtggaaattgagcgatcagccaacggagtgttggacggcttcagaaccattggagatgtccgcttcatcgtcgactcgatgcttttcgggttgggcaaacgtttacgcaagtgcggcttcgacacgcgaatgattggcgaccgtgaacaaattgtcgagttttgcaagcagtcgaaggacgaaaaatctgtggtgttaagcgccggcaaaggacataaacagctcgccctccaaatgccagacaatgaagtg

SEQ ID NO: 87150 - DNA, 624 bp, Heterodera glycines
  SCN-specific regions: Sequence locations=1-35,57-190,212-306,329 -488,511-526,555-624
gcggcacagtaacaaaatattaaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgccaccgctggactgctcttcacttccctggcgacgggtggggcggaagcgactgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgaccctcatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaacccctgaaaaaaaaaacca

SEQ ID NO: 87151 - DNA, 434 bp, Heterodera glycines
  SCN-specific regions: Sequence locations=1-226,249-310,332-409
ctctcttccggtgcaggctcaaatcatcgcaaccggcgccgcaatcaccaaaagataggctgtagcccgcacgacggcccacaacgcgatcaacgcggccttgggacgcgacgtcgccagctttcgactgaaccagaccgtctgcaccgacaggaaccagaccgccccgcctgtcatcacgaccagtcccgcgacattgggcaggtcaggtcgctgcaggatcgctccacccagagagatgaagacggcgcatggggccgccagataacactgggcatagaatggcggctgaagggcctgacgactgatctgcttgccctgtcggtgcagaagacttgtggccgccacaagcggaatgaggctgaacatcaacgaccgaaacagcgccagattctcctgcgagtcgagcaaaaaaaataaaaaaaaaaaaaaaa

SEQ ID NO: 87152 - DNA, 653 bp, Heterodera glycines
  SCN-specific regions: Sequence locations=1-131,153-609,631-653
ccccggatgctttccgtctggttagacttggcgcccaaatgtgccatcgccgaggcgatcgcctcgggcaccggcacaactgttggcggtactgctcgcacttcggctagcaaaaggggaggcaaagctgcagcagcagcggcggctgccgccgctgttgcaacacaaccacacgacccgaacagagaaatgcgtgacgcgttcaaacggctggacagggcgtatttcttctcctcctactcgcaaatgatttcgcgcatcactcactcggacgccgccacatatgccctgttgaaggaaatgttgtccgaattgatcgtccactttccccaccggtgtttgtggctttctcagtccatcgtccgctccacgcgggtcgccgtccgttcaaagcgttgcctggagatttttgaacttgccaagaaaaaagcgcggagcaacaatgacaacaacgctgctgttgttgacctgaatttgctgatccaacaatacgactatttgaccaccttgctgatcggcattgcggagactcaaattgtgcagcagcgactcagcgggctgagtatggcccgcttcttccccaacattgtggacttcttcgagaacggcacgatgcgcggcggcgtcagcactcgtggcaccggtcgattgcc

SEQ ID NO: 87153 - DNA, 123 bp, Heterodera glycines
  SCN-specific regions: Sequence locations=1-123
ttattttgtgctctcacgcaaaaactttgcagaagatggcctgtttttttggatccaacctttctcgcggacggcacaacggcattgaccatgacaagttggacaacggatggacagatactt

SEQ ID NO: 87154 - DNA, 725 bp, Heterodera glycines
  SCN-specific regions: Sequence locations=1-56,77-113,149-725
atatattaattcttcctgcatattattgccgctgctgttctccatccgtccgtgccatcaaatcaaatcaaatcaacggcagctgagcacaggcagaagtgtgcacaaattgacgacacaacaaacaacaaaactgggcactgcacaatcaaaagcatcatcttcatcatcggaagaaggagaagcaaaagtgacgcagaaggaggagccgacaactgacaaacagcagcaacaaacaagcaaagcgagcggagcaacaccagcaacagcaggatcaagcagttcaggcaccaccgcggcaacgcatggaacaaatcgacactttcaccgaccaaatttggctggacacgttggcatggcttggacgtgaagagatcggctggcactttgcgctggtcaatgcccgcttcgccgccctggtggacacgcagttgcagcagaggcgatggtacttgacggagttgcacatcaataagcgcaggtcgagagggagcggcgcagaagtgatggtcttgaacagcgaaggcgccttcttctcattgccattggcaaccatctgattacggaatttcgcgcttggcaagcgatggcacggcacatttggcccctgttgaggaacggacttcgcacgctggtcagcctgaagcgcaaacaactggcactgatgcgcaaacacgtgtcgccaaccgtcctcttcgactgtccgaaccttgtcgaaatcatca

SEQ ID NO: 87155 - DNA, 653 bp, Heterodera glycines
  SCN-specific regions: Sequence locations=1-378,400-549,571-653
aaggatctttgcttaaataaacaaagactgtaaatcaaattgacaactttcttatcaattacaaattgttggagaattgtatcatggacagtgaagtggaagatgcgaatgcgactcttttcgttgttggcgatatcggacgcagtcctcgcatgggttaccacgcctactctctggcccggcagggggcgtatgtgaatttggtcggttacatggacaatcagccccatggagatgtttttggcgaacaaataaatttcgtcgcacttccaaagccgccgatttcttcgtcttctgacaatcctttccgtcgctttctgatccgtttggtcaagatggtttggcttctctttgctattccatacgccttttttgtgctttgtcgtggccataggcaccgtcagcttattatggtgcaaaatcctcccggaattcctgcaatgatcgtttgctacttgttggcaaagattcgtttcgctactttcgtcgtcgattggcacaattattcgagttcaatgctcgacaactcgtggatttcttatttggtcggtttgatcgaaggatttttcggtcgaagggcttcgtttaacttttgtgtgtccaatgcgatgaaaaatgacttggaacgccgctggggtgtgaatgctatcacc

SEQ ID NO: 87156 - DNA, 571 bp, Heterodera glycines
  SCN-specific regions: Sequence locations=1-259,281-296,318-402,424 -456,480-571
tctctctactaactgttgcacatcccaattttagtttcttccttagtaagtaggcttggtgcacaatgcgcacttttctgttatagccgtagtcgggttgatgttggccgtcatcttggagaatgtaaatgcgacagggaaaaattcgccgacaaaggaacttatacatgagcaaggtaacctacagaaccatgctaccggacaatcgccgccagacagtccaaaccataaaaatgaccatgaaaatgagattagtaacctacagaaccgtgctaccggacaatcgccgccagacagtacaaaacgggaaacagaacataaaattgagaaaggaaaaccgtcgccagacagtccaaagtatgatgagcaaggtaaccaacagaaaaatgctaccggttgccaaattttgtaatcattagccttaaaatggtgaagaaactgtgtggaacgatgatgccaaccatgaacaaacccaaagctgttgtagtagatgtagaaaaaaactgtggtatcatcacgctattattgttgtgtaaaaaacgatccgtttttacctcttttcgggaaaaaa

SEQ ID NO: 87157 - DNA, 714 bp, Heterodera glycines
  SCN-specific regions: Sequence locations=1-183,205-714
tagcgcttttttgaatgaattctagcaattggatgatcttaattcttgccttaatcagctattacgaacaattaaggaggacacgagtgaattccctccgtctgaccttcttgatgagattaaacaatgcttggattttctcgccaactcgccaaaaatactcgcaaaacaacgagccgaatacatttccctttcctggcctgctgaccttcgcgtcgtgcttaacaggctcttgcgcactttcaatatcccggaggaatatgtcaaattatgcttcgaactgagcaattgtgcggcacaaagtttgggcgccgattggctaaaatcgtcggataagcaattcctgcgtctgttggccagtctctccagtggtcgtcttcgcattttgttggataaacctgaggagattgacatggctcagctcatcgcctgtcttcagctccaggaatatttttgcggctgtgttgaggatgaacagatttggatgagcgacgatgatgccactttcgtttccaaatgctgtcaagaagcagcagcctttgtctgttcttacacagccgcttgtgcccatcaattgtccgacatcacttcgcgaatggatcttttctttgtcctttatcgtttcatttgtgctttccttagcatcggcggacatgaaataattgacgtcaaattgctaaccgatgcattgcccatacttaccgatgtctgcgg

SEQ ID NO: 87158 - DNA, 292 bp, Heterodera glycines
  SCN-specific regions: Sequence locations=1-23,47-232
cgatgtctttttgtattgtttcttaataatttacacattttaataacccttctcttccacttttgttttagaactgttcgtttaaattaaccttttacccttccgggtaattcaacgggtataaatattctcaacttcatttttttcgttttgttcagaattgtcattttcatttaatatgaattttttctggcttgaatttgatttggtaaagattaaatcttttaaaattaaaaaaaaaaaaaaaaaaaaaaaaaaaaaaaagaaaaaaaaaaaaaaaaaaaaaaaaaaa

SEQ ID NO: 87159 - DNA, 525 bp, Heterodera glycines
  misc_feature (500)..(502): n is a, c, g, or t
  SCN-specific regions: Sequence locations=1-112,136-317,339-376,406-525
atgtcaaaccgcgaggaaaccgtaaaaatggccgataacgagtccggccaagtcacgcaaagcggtctcacagattcaggagtacgtggattactacggcggcgcgggtgttcagcacattgctctgaacacttcggacattgttcacgccatccaatcgctgcgcgcccgcggcttggagtttctgagcatcccggacagttactacgcgtccctgaagcagcggctgagcgacgcgggcgtggagttgaaggaggacttggagaaactgagggagctgaagattctggtcgattttgacgagcagggctatttgctccaaatattttcaaagccatgccaagaccgccccacccttttcctggaaatcatccaacggcacaaccaccagggctttggcgccggcaacctcaaagcgttattcgaaagcatcgaggcggaacagaacgaacgtggcaatttgttctacaaagacgtggcggtgggaggggaaaaaatcnnnttacaaaaaaacaaaaaataaaa

SEQ ID NO: 87160 - DNA, 503 bp, Heterodera glycines
  SCN-specific regions: Sequence locations=1-152,179-503
aagtgatatggtcggctcaggcggcgtaggcaaatcggcactgacacttcagtttttgtacgacgagtttgtggagaattacgaaccgaccaaagcagatgctcacagaaagcaagttgtgttggacagggaatattgtgcggtcgacattttggacacggcgggacaggaggactattcggcgataagggacaattactatcggtcgggagaaggtttcatctgcgtcttctccatcaccgatttggattcctttgatcaactcgtcgaatttcgggagcaaattttgcgtgtcaaaaatgccgacccaaatgtttgcattttgttagtcggtaacaagtctgatttggacgcggaaaggaaagtgcctttggagcaagcgcaacaacgtgccgaactttggggctgtcctttcgtggagacttcggcaaaaacacgcgaaaatgtggacaaggtcttttatgacatcatgagggaaaaaaaaaagaaaccaaataataaat

SEQ ID NO: 87161 - DNA, 535 bp, Heterodera glycines
  SCN-specific regions: Sequence locations=1-31,53-154,176-217,241 -419,441-508
tttcggcgagggtcgcgagacggtgcttgtccttcagacaggacattttggaggatggagcggacgaagtattgatcaacccaaacatgttagagaacgaacggcataaattgaacgtggaacggcgcaaaaagaaggaccactacaacccgtatgaggaggaggtggacgagttcggacaggtcaaaaaacagcaaatgctttccaaatacgacgaaggcattgacggggagaaggaacgcgacacattccgacttgatgagagtggacagtacgacttggacgcggagaccgccgagctggaaacacggcgtcagctgatgatgctcaacaaaaagtttgagtcgttagaaagcaccaaatacacattggccaacgaatttcacaccgaggaagaaatgatcgcattttcgtcgtccgaagaaaaagggagggaaaagcacgcggaaaagaaaggcattgaaagccgacgatttggagacggaaacgacggaagaaacggaggaggaaaaaaaaaaaaaaaaaaaaaaaaaaa

SEQ ID NO: 87162 - DNA, 734 bp, Heterodera glycines
  misc_feature (665)..(665): n is a, c, g, or t
  SCN-specific regions: Sequence locations=1-480,502-734
acccaagccggacataaaacggaaaggcacgcattgagcgggccggcggtgctgtggccatgaagtcgggcattttccgtgtgatttggaagcgtccaatgcgaggccatcgtggcccggtccggcgttccaccgccactgaaaacattccttttttggctgtcgctcgttcattgggcgacttttggtcattgaatcccatcagcaatgaatacattgttagccccgaacctgacgtggatgtgtttgaactgaagcacaccgacgattttgtcgtcgtggcaaccgatggtctcacaacagtggttggtgttcgtgcaattattgaagcgttgcgtgaagctgaacaacgctcaaaacatttcacctgcaacggaaaggaatcgccatcggtggacgaaaataattgtgaccaactcattgacattgaccagttcgacgtcgacttgccgttgaatcaagcgcagtgtctgctgcaatatgccttcaagcgatggagcactctccgcgcggataacatcagcataatttgtgtcaaactcaacgccaacgaagtgccaaccgatcggaatattgttgtgaatgatgaacagagtctcaatgtgtgcgaagcgattgctgaacaaccgatggcaattcttgtcaccgacaatggcacacaactnttacgtacaaacgcagtccgtctccaataccttggagcgatggataaatgcgtgaaaacttcgtctcaa

SEQ ID NO: 87163 - DNA, 664 bp, Heterodera glycines
  SCN-specific regions: Sequence locations=1-4,241-246,407-500,522-664
gtggagaaaggaaggaaacagcggagagaagagatggcgaagttggaggtgcaagtgcgccactgtttctgctgcggccttacgcccggctccgtcctcgtcgggctgtacactttgtttctctatgctttgttgaccgggttggccgcttgggcactgtcggacacggctttaaacggtgacaagccgatttatgaggactgcgaattggaagtccagggaaactcctcgggtgatgcagataacaaaaagttgaaaatccatggcggacagactacaattcaatttgaagatacttcttcctatcactgctcgatcggcatgtacactgaagagatgaaatggtcgtacggcaatcgttacgttctgttggtgatcgctctgtgcctgtacatcccgctgatctttgcctccatccttctgttggcgggtgtcagtctctcctccaaatggctgctgatgccttggcttattctgcttcctttggacatccttcgtggccttttctcctctctcttcatttttctgttcagtcaaagtgatttggcacgcattgccaccggcattttcttccttggcctccaattattccatgatttccctgtggattatcattttggccaagttccaacgcattcattacagaaaacatggcaacgccttt

SEQ ID NO: 87164 - DNA, 440 bp, Heterodera glycines
  SCN-specific regions: Sequence locations=1-34,64-130,175-304,335 -347,369-418
atctggttgatcctgcctgaactgatgtgttcattctaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaa

SEQ ID NO: 87165 - DNA, 185 bp, Heterodera glycines
  SCN-specific regions: Sequence locations=1-185
tacagtgcgccttgcgaaagcgacgaccgaattttgaaaggactgggaatgctcgtatattttctacccgaaacacataagctatgtatggaatgtttgctgatccatttgaaaagagtgtgagatcattccgacaaaaacagaatggactagtgcaacctcggcctgctcttttcttcctacgt

SEQ ID NO: 87166 - DNA, 514 bp, Heterodera glycines
  SCN-specific regions: Sequence locations=1-31,53-375,397-427
tattctccttaacgaaacacctaacaacttttggaaacccaaacattcgttcattcattcatcgcaaaatgcaagctgccaacaggcgccccatttgtctgatctgcttgaagaaaatgacccaagtccgtcaggtgcgcaccatctgtgaccacgtgttccactacgtctgcttccaccgttggctcaaatatcgtctgttttgccccgtctgtctgctcaactttcgcacggaattgtatcattcgggaaacgccgtgtttgagggcgcgtacgacgatggacacgttgtgctcatacctgatggtgaacaaagcaacagtggataagtgatcggcactcatctccaattgtgatcggacaaaagcgatatctaattttgtattgtacataaataggttattcggacaataaaactgtaatgtgcaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 87167 - DNA, 681 bp, Heterodera glycines
  misc_feature (673)..(673): n is a, c, g, or t
  SCN-specific regions: Sequence locations=1-376,398-681
aagatgatggacggattcggctacacaaccccgccaatatgaatggaccgtggccggggtggatgggattcgaatgctgtgcgaagaggtgaatgcaatgttcggcaaacgctttttggctggcagtgaaataacggtgatttcgttgcgcgcaaatgtttcggaagcgcaacaaatgacgacgacaaccgcaacatcggaagaggaggaggacaaaacgggaacagagaacactgacaatgaaaggagtgcaccgacgatggctcgcgctgatttgatagttcccagctatgagttcgtacgtgtggcaaatgcgctgtgttcagcgctgagagcggccaaattctgggccgattttgtggacccgcgcaacggtcggccctaccgaaggcgaaagaatcggcgcccggccgaaccgtcgctgggccaacagtcgctggtgttggaatgggacccgcagaacacattcaacggcctgcacatcaccaatggtggtgttggtggcacaactgcttgtggtggtaatgatgatgcatcaacagcggcggagaatgccgaaaacgatgatggaccaacatgcaaaatcattgaacgagccgattggacagcgagcgatttttgtggccaattgtttacagactgtccaccaaactctgatgaaatgcaacaaatnttgtcttc

SEQ ID NO: 87168 - DNA, 723 bp, Heterodera glycines
  SCN-specific regions: Sequence locations=1-181,203-400,423-723
agtcgacggcacttcctctgctgccgctgttcgtgacccctcaacagtgtcaacggaattggcacattcgatcgatgaaggggcggaagggagcggtgaagcagtggcagttgctgaacagccttcccatctggccatcttgagttcaactgttaaactgatgggcacccgtcggatggtcttcttttcgttgccttttatgtacacgggcatcatccaaagcttttggagttccatttatccaacaacagtggcaaacacggaaatgttccagctgaaccagggagtcaatcccaaactgttgttggcattgaccgccattgtccaaggcgtgggccaagcaacatctggtttctttttcggcattttggacagtcggacacggcgttttggacgcaccaaaattgttggctttggtgctgctttgcaactgtgctcctttttgctggcctacctgaatttgccggcgcacgcaccgctcgaaaaaacatttgagcatggcattctgaactcgccaagcatcacgctcgcgttggttggtggtttttgctgagttttggcgatgcctgttggaacacgcaggtttttgccacactaattgccaaatatcccatcatagcgtcgcaagcatttgctgtctttaaattctttcagtcacttttatgctgtgctgcatttttctacgccacttcaatttctttgccatggcatgtgctcattttg

SEQ ID NO: 87169 - DNA, 617 bp, Heterodera glycines
  misc_feature (592)..(594): n is a, c, g, or t
  misc_feature (597)..(597): n is a, c, g, or t
  SCN-specific regions: Sequence locations=1-16,38-171,193-287,310 -469,492-507,536-594
ataaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgaccctcatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaaccccgnnnaanaaaaaaaaaaaaaaaaaaaa

SEQ ID NO: 87170 - DNA, 794 bp, Heterodera glycines
  SCN-specific regions: Sequence locations=1-794
tgggagggagccgagcgcggaggggacaagggcgaatgtgtgccggatcgggagttcggatcgacggccgaggccaatggcagggctatcacgcgctgatcagttccgtccagctgtttcgttttggtggcgaagtgaatgcgggccaaagaattggcgtggcacgagatttggaatgtgccgggacgcggcccaagccgaggggcgacgaaaatttcgtgcgcatggaactcttccgagaggacaaacccatcgacccaacccatcatctgatcgactgcatgtgcaccggccaaatttgcgagacaaatcgcgcaaatgccctcgagggactcccatttaaatttgacagccgtttcaacggagtgcgcgggtgggaaatcgtttgtccgaatgttcggcccgaagagccgaattcgtcgggcgaatcgcctgaacaaagtgacgacagacaaacaatgagtcccaaaatttacagtcccatcgaaggcgaagtgatcggtcgcgtgcggctgagtgcgtcgagcaactcgcaaagctattcgggctgtgccaacgaaggaatatttgtagttggcacgggaaaatggacggactacgaagtgcgcatttacaacgcgcgattccgcgaatccctcgcgcttggcaagcagcacatcgaacagggacagcacattggccatcgcttggactgtgccggggagggatgtggtccaatcggtgttcatggatgtgcgtttccagggaatcgtcgtcgacgtcagtgaagcgatcagtgcccacaactgcaagca

SEQ ID NO: 87171 - DNA, 166 bp, Heterodera glycines
  SCN-specific regions: Sequence locations=1-3,25-25,54-166
ttatgtaaaataatttgtggcattcattatttattatatttttctttatttttgtaattgagtccggcaaaatccgaccgaatttcgaagaaatatttggcaacggatggaacaaaaaagagagaaaagaaattatgataaaaattgaacaaaatgaaaaccagtg

SEQ ID NO: 87172 - DNA, 535 bp, Heterodera glycines
  SCN-specific regions: Sequence locations=1-16,38-171,193-287,310 -470,493-507
ataaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgtttagttttcagattttattctatcctcttttgtttattagtttttcaaaacaaatttcttc

SEQ ID NO: 87173 - DNA, 657 bp, Heterodera glycines
  SCN-specific regions: Sequence locations=1-350,372-657
gtggaggaaaagaagaaaatgttgcctttgcccattggcaatcctgcgggaaatgaacccgagaaatgggacatgaatcaggtggttccaccaatttcactggcaacaacatataagcagcaatttgctggaatgcccaaaggtcatgattacgcacgaggcggcaatcccacccgtgatgtgctacaacaaagcattgccgcgctggaaaatgctcgtcactgtcgcgtgttcagctccggactttcagccacagcagcaatggcaaattggcttcattctggcgaccacattattgcgtcggatgatggctatggtggcactcaacgctattttcggcaaatctctgtccagcatcatggcatggaattgagctttgttgatttaacgaaattgtcaaacttggagaaggaatttaagccgaatacgaagatggtgtggtttgaaacaccctcaaatcctcttctgaaagtgatagacattgaagcagtgtgtcgtgcagttcagtcacgatcaaaagaatgcattattgtagtcgacaacacgtttatgacaccgtactttcaacgtccgttggaacttggcgctgatgttgtgatgcattcgttgaccaagtacatcaacgggcacaccgatgtgctgatgggtgccatggtg

SEQ ID NO: 87174 - DNA, 600 bp, Heterodera glycines
  SCN-specific regions: Sequence locations=1-600
tttcggagatctaccgttcctgatgtcattctgttcgggattccgcttcctctcggtaccgtgaccattctttgcatcgatctcggcaccgacatggtcccagcaattagtttggcttatgaagaggccgagtcggacatcatgaaacgcctgccacgtgatccggttcgagacaaattagtaaatgagcgtcttatttcattggcctacggacaaattgggatgattcaagcctcggctggtttctttacgtacttttggataatggctgacaacggttttcttccaaaggacctttaccaattgcgtgcgcaatgggattctcgtgggattaacaatctcgtggacagttacggacaagaatggacttacatggaccgaaagattctcgaacacacttgtcaaaccgcttattttgtgtcaattgtgattgtgcaatgggctgatctgatcatttcgaagactcgtcggaattccattgtccagcaaggcatgtccaattgggtgttgaacatcggcttggtcttcgagactttgttggctgttttcctctgctactgtccgggtttggacaaaggtcttcgtatgtacggactgcgg

SEQ ID NO: 87175 - DNA, 652 bp, Heterodera glycines
  SCN-specific regions: Sequence locations=1-652
gcgttttatttttttgcgtaggatggcagaggatggtgttctaaaatcggtgatcggacttcgcattgaacgggtggcagagctggacggggttgcaaagttttccccagacaaacgcatcgccaaattgccatggcgtcttgaagtacggaaaagtgcgggcggaggacagcactcgccgcccactttggctgtttatgtttggtgcaattgggccaacaaatcgcagtgttggcgctgcaaggccatcgtcaaatttgtcatcaaatcacgcgagttggattttgtccgcaactttgagcacattttctgcgctcgtcagccatttgtgaattggacacgtctgttggagtccaccgcagcgaacagtctgagacgggccgaggacacactcgaaatcgaggcacagatcagtgtcaccgaaatcgtcggatacggagttccaccaaaggaggaccaactgttcgtcaatggaagggcatttgacgtgaacaaatatctcctcgccgcccattcgccgtattttcgtgccttctttttccacgacaattttcgcgagtaccaaacgcagacattcaccatcaacgacagcgctgtggacgccgagctgttcggcatgatgttggagtgtgtgtaccccgagtgcggaaaa

SEQ ID NO: 87176 - DNA, 602 bp, Heterodera glycines
  SCN-specific regions: Sequence locations=1-525,553-580
tttcacgctcgcttggtacccggctgccgaatttttggaatttgaacgaatcaacaaagcgtattcgttcaacgtcccagccttttctgtggacacttcgacaacggatgggccgaagtacacacaaattatgaacgcactgtcggaacaattgcaacagcacgtggccaaggcgaatttgctgatttctctcaacgagaaaatcccgcaattcgatgttgaagttggggaaatgatgcgcattgcaattggccgtacgcaattgctgctgaacaaacggatgaagcaatttcgggaacatttgagccgtcatttgaaaccaattcctggccaaaaagtgaccaaattgaacgatttgcacgctctttgggtgcttatcgacatgcaattggatgacatccgatccattttcaactccatcgagcagttccgtcttcgctgttgggctgtcgctgaaccaaaggccgccgcgactgccgcttctggcaattaattaatcctcagtctttcatcatcatcgcatatttttgtttttaaagtgccttcaatttttgaaatgtattgaactttttactagtacaaatggaatggaatataaatct

SEQ ID NO: 87177 - DNA, 710 bp, Heterodera glycines
  SCN-specific regions: Sequence locations=1-227,249-370,406-452,474 -554,577-710
tgaaattcgaggaagatcggtctctgattggatcattgaacaactcaaaataacacattatgagaacattggcaaacatagaacttttactgttccaaagagtgaatttttacatgacacggttttccgggttgacctgttctcctgtgggattgcgctttgtggaatcgaattttcagggcattttgctggcaactatgaccttctctcatttgatgcgattattactgacattctttcaaatgaggaaattcttatgcagaacattcttgttgattttgttgataacatttatccaacggccactgattctctgctgatttctaatgctgaaaacaaaaagcacaatgaaacggatggctgtgctttttctgtttctccctccaaatcattgtctaatcttttgcttgacgacagtccgtcggatgaaagcgccgatgaacgcgatgatcagactgacttttgtgggcagcgtcagcagattggtgacactcacagtcattcgtcatttgttgccgaagttgtcgattcccttcagggggctttggaggacggttttttgagagagaatgaaaaggcgaaactgagtggggatttgctgaacaaaataaaattggaagtcaatgcctccaaattggcctacaatattcccgcagaagaagtgccgggccttctcttcactgcttttcttagtctccctggcgttgtcg

SEQ ID NO: 87178 - DNA, 609 bp, Heterodera glycines
  SCN-specific regions: Sequence locations=1-3,25-298,321-439,480-609
taagtttgcactgatctgtttacggaggtgatgaaaaaggttgatgagtctggtgaaaagggagagccggcagtgaagaaaatgattattgagcattgcaagtctgtcaaaggtgtggatgataagaaagaaaaattgtgcttctttattggcgctcatcctgactcgtccacttcagtcctgggcgatattgcgaaaccattgagcttccataaaccgccgaataaagtatgctctcaactcaaggaaagggattctcagatctgcgcactgaaatatgataagccaattgattgggacagtttggtgctggagaaaatgcgtgtcaaacagctcaaggaacttttgcttaaattgggcgattcctgcaagggttgtacggagaaggtggactacattacgcggatcaatgagctcaaaccgaagccgaaaggagaactttgattgtttttgttttgttgcttgtttgtttatttgttgtaactgtgacaacaacattgtttttgggttttctaagttattttacctgtttttttcattctgtgttgtattactgtttttgctttactacatttatggcattttttccatttttgtaaaattgttatt

SEQ ID NO: 87179 - DNA, 596 bp, Heterodera glycines
  SCN-specific regions: Sequence locations=1-596
gtgttctttggtggttgagaatttgatttaaaactgtaaaagaatgacggagaatcgccgcgcggcacgtgaaattcagcgacaacagcagaaacagcagtcgttgctgaagaaaattgatttttgctcgtccaatgtgttcgattctacaaaaagttggcatttccccatacggcgccgcccgacgctttcatcacattcaaaagcatttgcataaggtacattgatcatactgtcgtggcctttctgcaccgcattcgtcgcctcttccgtcactcggccattgcccttaaaatggtcatttggccgcagtccgtccgcgcatggcacgtcatggcccagcaaatttggcccctggcggcgtccaatgtgtgccagctgagcgtggacagttatgtgttctcccgtctccgtgagttcgtttcgccgtccgtcctccgcgactgtgccaaccttcgccaaattgagtcggacggactgttccctgaaggcccacccgacgaccatccgcacgcgtcggatggccaagcgttggccaaatggctgcacacgccgcgcgcggacggcaagccgaaactgctaaatgtggaggcgat

SEQ ID NO: 87180 - DNA, 411 bp, Heterodera glycines
  SCN-specific regions: Sequence locations=1-411
ggaaattggcattctgctatatccaaatatcttctcatattttgctttggcaactgatttatgttgccatttccaatccaaccactgaagaattatccaaaaatgaagatggaggtggaaatgctgacgatatacaaatgttggtggaagaggcaattgatatggcacaaaatctttcaatgatagtttcgcccaaggcactcgtcggaagacgtgacacggctgaaattgtcgcattttctcttttcccgtcgcctttcccgcgccaactttttgaacaagcgaaaaatgtgcagatggattttaatttgttatattttcgcatatcaaatgactacaaatttttggtagaaacctatgaataactggcaaaaacgaacgaacaaatccgaatgcatttgcaaattttga

SEQ ID NO: 87181 - DNA, 560 bp, Heterodera glycines
  SCN-specific regions: Sequence locations=1-29,284-560
tcttccttctgctgctgctgtcgggacgaaacgggccaaaccaaattcaaagtgccagtgcgacggtttcgttcaatgctaatcagctaatttgctcactaattaccccaaataacaaaactgccccctgcatctcccaacaatggccaccaaatgccttccgctcgaacttctgtacgaaattgtgcctctcatccctgccgaaaatgccacaccgaatgcgctctcgtcctgtcggctgctgcacaaacttttgctgccacgtgtcatcaaatggaaagagtccattcctttcactggacaaagcaaatactgccacaactttcggcctctttcacttgttcacaacatcgagtgcagtttccgcgtcatcactgtgtttgttgatggacaggaggaggcgagtgaaacgtttactggccgtctcactaggaatgcgtgagtgaggaaggcccaacaaatgctgtatcagtgtgcggagaaataaaaaaaagctccttggacatacttatttaacttatttgttctttttctgataaaaccgtgtaactttcaaaaaa

SEQ ID NO: 87182 - DNA, 654 bp, Heterodera glycines
  SCN-specific regions: Sequence locations=1-654
ggaagcggccattaccagacgccctgaacaacgatggctggggccacagaaacgaaaagtgcgctggacactctcagcagcgaattggactccgttttgaccacaacaaaggattttgagaaccaagcaatttccgacgcggaacgttccaacgaagtcgcgaaaaaagcgactctctccgaagcgactgcaaattcactgcaggaaaagctgagtgactcggacacaaaacttacggaagcattggcccaactcagtcaattgatttgcgtttgttttgtcgaaattttatttttattttaggttccttagacaatgtggacgatgcgcaattggacaccgtggagaaactgctgaaagaagcggaaaatcgtttcgattcgagcggcaacgaagtgaaaatgcgagaacggatcatacaagcggagaccaaagcggtgaagcagaagagggaaatcgatacattggcaaaagaattggagaatttgcgtcaaatcagagattcattgccgactcgctgctacaattatgtaaatttggaacaggagggacaacgatgaaaaggagcaattgggccagaatggacggttcatcacaagtggaataatcccggcttttttaaacacattccccgtcagaagcaattttttttgt

SEQ ID NO: 87183 - DNA, 655 bp, Heterodera glycines
  SCN-specific regions: Sequence locations=1-71,93-307,329-655
tatttttctttgctttatttgtgccgaatgtcttccgtttttctgcccaaattcttttcttcgtcctattgcttttctctttgggcttctttcatcactctctgagtcataccgaagcaccaacgaattcgttgtcccaaattatttgctttttttgtttgactgtgcctttggtttgcttttttaccattcttttgtggccagcagaccacgtcgaaaaagggcaacactttaacaaaaaaggaagaattttcatctccgccgattgttggctttcagtgtttgaattgcttccgtcgcgtcaacttggccttggcattgctctgatcagccatcgctttgactgttatgtagatgaacacttcagaactcgtcgatgggcgttggaatatgtgcaaatttggcgcaaaaagaaaaagaatggcacaaagaaaatgcaaatcttcaaaggccgtgggggaccaatggaaattccgcaaaaatcgatgccaaagaaagtcattggattccaataccttctgataagttacatcgaccgaaatgtcatcgaatttctgcgccgtttctcttcggcttttgcaaattgtggaaattatttgattattcaaataaataatgatcgtcttttggagttatctctgcgcaacatttggcc

SEQ ID NO: 87184 - DNA, 460 bp, Heterodera glycines
  misc_feature (456)..(456): n is a, c, g, or t
  SCN-specific regions: Sequence locations=1-410,434-460
ccggcctggggccccaaaggcgggcgttcgcgtttggcaccacgagcccaacaaaatcaaaaagtttgagcagacggcggagttgaaccaggcacatggcggacgcgtgttggcactttgtcaaagtccgtgcggagagtacgtaatcgccgcaaaccaagacgaagtgctcaggatttggcacgtttggaagatggacgaatcgatgcgaaaacagacgcaggaaagtgtaacggcaaatgcgaggaaacagcttcagggcgccgctggaaatatcattcgatgaaagcaccaaaattacctatttattttaaccctttcgttctctgcctcactattttttcaatattttagcatttcattaggattgttttttgtttttacgtattcaacttaacttttatactatctttcatttatttgtgtttttcatgcataaaacaaaaagtgcaaaanataa

SEQ ID NO: 87185 - DNA, 433 bp, Heterodera glycines
  SCN-specific regions: Sequence locations=1-433
catgaacattctgctgaagtctgttctattcatctctcttctgtcactgtttggtgattgcatgaaaaactcagatcaaattggagtcaaaagaaaatcagcaggaataagaattgaggaaccaaatgatgtaaaaggcaaaggaaaagtcgttgaaacaagcagaaaaggcaaagaaaaagtcggcgaaaaaataagcgttatgaacacagctgaacgcattgaaaaaatggaccttgcccaagacaaagctaaaatggaaatagacaatatagacaccaatgccaaacccaaacaaaatgaggataaaggcgttatgaacacagctgaacgcattgaaaaaatggaccttgcccaagacaaagctaaaatggatatagacaccaatggcaaacccaaacaaaatgaggaaaatgctcctccaaaatatgtt

SEQ ID NO: 87186 - DNA, 189 bp, Heterodera glycines
  SCN-specific regions: Sequence locations=1-29,131-133,161-189
ccacccttgtccttagttgctacgcaagagcactctaaggagactgccggtgacaaaccggaggaaggtggggatgacgtcaagtcctcatggcccttatgggtagggcttcacacgtcatacaatggtcttaacagagggttgccaacccgcgagggggagctaatcccacaaatcttttcttagtcc

SEQ ID NO: 87187 - DNA, 649 bp, Heterodera glycines
  SCN-specific regions: Sequence locations=1-361,383-649
cgggaaaagggcttacgctttggtcacaacgcgggaatcagtggcaacgagagttgggacgattggctgattccaaaggactacgaagatgttttccaggtgaacactctcggcacaattcgcgtcactcacgcattcaaacgactcgtaaagcgcgagagggagtcccgaattgtgattatggccagctcctgcggccgcgtggcactgccaacgctcggcccttacagtgtgtccaaattcgctgttgaggcgtacgccgacataattcgcactgaactgattcttttcggtgtcaaagtggcagtgatcgaacccggctttttccgcactccgatcacaaatttggatcgtggcaatgccattttggaaaaaatttgggcgcgactgccggagattactaagcaggaatacgggcccaacttctacaaattctgccaaaattacctcctctttttcctcaatccgaccaggctgaacccaccggaaatggttgttgatgcgtattggcacgctattagctcagcgtggccccggaggcgccgtcaagttggcttggacatgcactttttctattggcccgtgtcaatgctttgtgctgaatttcaggacttgttcttcctgctcagcactttcatcttcagaattc

SEQ ID NO: 87188 - DNA, 669 bp, Heterodera glycines
  SCN-specific regions: Sequence locations=1-52,74-404,426-669
gtgtggaaggagtacgagagcgaaagactgccccgccaacttttgccgctgccaatgccatcccctttgaccatggatggcactgccgcagttcctggcacgtctcagcagccgcctttcggcacggccactgacatggcgcacttctccaacgcattgcaactgcgacaacttcaactgttgcagcttcagaaacaacagcaggcggcacaggtcaaaaaaaatttgtcatttttggtgcaacaacagcagacggttcggtcgggagagatcggctacttcacgcaagtgatgggccaattgactgttgcgtacaacaacgaccccatctacaaactctgcttccaagtgccgggaatgcaggccaagaccgcctacagaatcttccagatcaagcagttcctcagctatttcatcaacctgatccctgccgaggaccttggcgagatgaacagcgcaaatgcatttgccaattatttcaacggaattttgcagaacgccatcaaagaaaaacagtctcaagaatctgtagaggagaaggccatgattactctggccactaccatcgaaattgcaaggtcccatcagcgatgtcaagcgggaattctgttcatccaacagacgttccccgaagttatgcaacatttgaatcattcccagtgatcaaaa

SEQ ID NO: 87189 - DNA, 602 bp, Heterodera glycines
  SCN-specific regions: Sequence locations=1-602
tgggtgttcgtcttcgtcctgctcttcgcccgttgcttctcccatcggcggatgccaccttttcattgcgcggctttgcctgtgccaagaaagatgccgcagtgcacggcggcacgttcactgttattggagataaacggcttcgtgttgatccatcgcaactgacaactaaagaaggcaaagcaaaaatcgatgcgcttcgtttggacgctgcggacaaacgcttggttatgtcggtgctcttcccaaatggcggcggcatcaattgcaaatcgtccttcctttctcgtgttcaaatgccagacggttgtgacgttgatgagagagttgttgccctcgagggacgtgcgggtcaagatcgcttcggagagaactgtggccaaggcaaatgtgcctttctgaatgtctcctgcaactttcttcaaatgactccggtcgaaggcttgccgaatgcgcgtcatttcacaatgtctttgtggaaaaacatctcggatgatgacgatttgcttcagtgcgaatggaaagcatttattgacgatgtcgtggttcttctgaacaaggcggaaagcggtgctgaattgttggttgagcagtgttggcaa

SEQ ID NO: 87190 - DNA, 651 bp, Heterodera glycines
  SCN-specific regions: Sequence locations=1-302,324-651
taattaattcctgcgtattattgcggctgctgttctctgtccgtgccatcatcaaatcaaatcaacgaaagctgagccatcggaagtgtgcacaaatcgactaccaaacgaaactgggcaccacaaatcaacaaaatcatcattatcatcagcagtaaaagtggtgcagaaggaaacgcatggaccaaatcggcggcactttcagcgaccaaatttggctcgacacattggcgtggattggacgtggcgaggtcggatggcacttggcgctggtcaacgcccgcttcgccgccctggtgaacatgcagctgcagcagaggcggtggtgtttggaggagtttcacatcagtgagcggaagccgaaacggactggcgccgaagtgttgagcttggcaaacaacggctcctacttctcgttgccattggccacctcaccgttgccggacagtgtcatcggattcaacggcacattcaacatttggtatttggacgcagaagtgatcaattttctgcaacgatttcggcgcctcttcaacacgtacatctcgctgaagttcaccattccgataacagaatttcgcgcttggcaagccgtggcacctcacatttggcccttgctgaagaacgggctcggcacgttggtcaacgtga

SEQ ID NO: 87191 - DNA, 619 bp, Heterodera glycines
  SCN-specific regions: Sequence locations=1-540,564-619
ttgccaagagctttccgcggtggacaatacattgatgaacaaatgaaagcgcatgactttgagaagaactgtgaacgttccacacatgctcaactgaaagatcgcgaagaagcgcttaaccgcatggagaagcgaaatgacgaaatgggcagcaaagtgcgacgactcaaggacaaattgaacgatcgacaagcgctagcgggggatgagaaaagaaatgtcgaacgcattgacaaaattttgttgggggcacagtgcgaagatgacgaatgcaagaaattgtttgcccaggaagaggaaaaccgcaagcgattggacaacaacattgtgaactcaccggaacgcatcatcgaagagctgtccaacatggaggtcgaagtggaggacatccgtcgcaaaaatgatcaagcagtgcaaaacgaccgaaagttggagagggaatacggcgaacaacgcgtgaccagccaatgcgcggagagtctgatcaacggcatgcaacaattggagatgatgcaggaacaaatggtggagatgcgggcgaaggaagaagagcgacgaaagcaaatggacgacttggaaatgacccgcaaaaatttggtggccgaaattgaagtgttgg

SEQ ID NO: 87192 - DNA, 563 bp, Heterodera glycines
  SCN-specific regions: Sequence locations=1-187,210-395,452-563
cagcagaattgagcagtattttgcagcagacgcatcagcagcaacagcttcaaaatgctggcgttccattgctcggtcttcccgcccaactgctcgcatcaggcatagagaactcgaacattcttcaaccaaatgctctgcgtatggtgcccggcacccaatacgccataatggatggacctggcggagcacagaatttgattctgcttgccaccgccgctagtggacaaatgaacgcgttggccaacattgagcagcaacaacatcataatggcggcgatggtgcaacaacagccagtgctgctgcacatgccgcgatgcaatttgttggacagccgccagacatgcgcagtttgatgaccaatggactgattggtgccaacatttttcacaaccaacaataactgcaacaacaacagcaacgtcaccaccaccagcaacaacaacaacagaggccgacaacagtggccatgaaaatggagtcagttgatggattgaggcgaatgaggtggaataaagctgatgatgacacttcacgccgattgcaacaggagaagaaatcg

SEQ ID NO: 87193 - DNA, 488 bp, Heterodera glycines
  SCN-specific regions: Sequence locations=1-488
cagtcgcttctcgacggcactgtccattaatcgtcgactcgctaaaagatttgcaaacaatccaagaacaacatttgtgggcacaacgtgaagaaaaattgtacaattaaattgcgatggaatttctgatgagaaggaacgccagacaaatgaggacaaagcgattttggagcggattgaccagattgcgcacgagcaacaaagcactttgatctgtgccggtttgcctctgttcaaaagttcggacgacgcgagcgatttgcgcattcaaatggcactcatccaattcattctttcgctgggttcaatttacagggattgaacggccaccaaacaatacgaagggattgggagttccctcccaagcacatttttaataaattggatgaattattcaatcgtttcttcaatagatattatttattgtagtatttgaggagccacacttttgtttaaattgacgtgataaatatttcgatgccaaaatt

SEQ ID NO: 87194 - DNA, 290 bp, Heterodera glycines
  SCN-specific regions: Sequence locations=1-265
cctcccggactccaattggcggggacgtcgaaatcaccggcattcaaatcttctgaaaggatttagaaaactggcgaatgaattgaatgacgatcattcgttgtgatggatgggtgttccgttttaattaatctgacaaaaattagtctctccgggcgatgattgtccatctgtgaattgctgctgttcccaaccgtccgacttttcttccccccccatttctaaaattctaatccctctgccttccctttagtggtgctaaaccaaaaaaaaaaaaaaaaaaaaaaaaa

SEQ ID NO: 87195 - DNA, 583 bp, Heterodera glycines
  SCN-specific regions: Sequence locations=1-12,35-135,157-197,219 -361,385-583
acatatttttttgcctgtcttctctgctgctctccatcttcccaattgtgtttttggtctgttgcaatgcaatgccaaatttcccgtgctgcccgggcagtcagcaagtggttgctgtgatgtccatttacattgacactttctcttctgctgctgacgagtctacagtatgctttttcgctaaaagtactgtggatggaataaaaaatgaactgtcctctcgcggcggatgccaaaacggaggagaagcacaaattgtggatgaaatcgatcgacagctgaagaatattgcaaaaatggagatcaattatgaggacgagtgcccgtacaatttgggctttgcccgtgccatgttcgacttggccgctgctgctgctggccatgcgggcaacggcacagaatggcaatacatgaaagtacaatttgagcaggaaagccaagcaatcaaagcaattggacaagaaaagaactttgaagttacggatgtgcattttggagtcccaagcaaaggggtttctgcacatcaaaatgtgccgagtccgagccatgtgattgccaatcctggccaacacagttcggttgg

SEQ ID NO: 87196 - DNA, 396 bp, Heterodera glycines
  SCN-specific regions: Sequence locations=1-396
ttatttgaaaaatattttgcgcaaattttttttatttttgtccgaaatgaaactcctttttaccccaatgtttttttctgtattcttaaacaattcttctcctgctgctggtccaacatgtaaatggaggaagagatcgagtgcaagagattcaagaggaagagggtggctacagtagtagtggcggcaacggtaccgaaacaccaacaaaaaaataaagcagtgaaacaatggcagcaagcacggttcaaaattatgcaggaaaagattgtcgaataccttggtggattagcgaaagcaacaagaaagagtaaatatgtgcacaagcttgtggatgacatccagtacacaacaccagaaccgtttgaaggcactgtgaccagaagaactgagaaa

SEQ ID NO: 87197 - DNA, 573 bp, Heterodera glycines
  SCN-specific regions: Sequence locations=1-204,231-280,302-435,458-573
cacgaaggttgtgactaagggtcgcgcgtgtacatcgacgacggattgctgtcgctcattgtggaagaaattttgggcgacgacgccgccatactgtgcaaagttgaaaacggagggaaattgggcagtcgcaagggcgtcaatttgccaggaatatcggtcgatttgccagctgtttccgagaaggacatcaaagacctgcgttttggtgttgagcagggcgtcgacatcattttcgcctcgttcattcgaaacgccaatggcatccgcaccatccgagaagtgctgggcgaggcgggcaaaaacatcaaaatcatcgcaaaaatcgagaaccaggaaggtgtggacaatgtggacgaaatcattgcggcgtcggacggcgtgatggtcgcccgtggcgacttgggcatcgaaatcccggcccagaaggtatttctggcgcagaagatgatgatcgcaaagtgcaacatggccgggaagccggtcatcaccgccacccaaatgcttgagtcgatggtgaacaagccgagaccgactcgtgccgaggtcagtgacgtggcgaacgcagtgctg

SEQ ID NO: 87198 - DNA, 626 bp, Heterodera glycines
  SCN-specific regions: Sequence locations=1-196,335-404,428-626
gtatttgtgtgaggtacgacagtgcgactcgcaaaagacggaagagtgctggatgaaactgttcgacgcactgaccgcgttggatgacgaggaccgttacgataacatgcgacagtattgctcggccaacaaatcatggatcagatactgtagcaacatggcaatgtgtgatgacattgataaagtcattgtgttcaaaaagaagacggaagaagatgaagtgataatagaagaagacgaggaggaaaaggaagatgataatgaaaaagaaaaagcacaaataaaggaaagagaagaagcaaaagggaaagagaaaaaaacaaaacaaggaaaaagcagtgacaaaaagccgatgcaaaatgaagtctcaagtgaaaagattgctaagccaaaaaaatcatcaacaaagccaccatctgctgctggtgtcaaaaagaagccgaataaagaagtaccaccaattaaccttatggatgaaccgtatgttggacaaccgcaagcgctacagtattcggtgtcaaacattggatacggtaatcaaatacaggaaccgtatacaactcagcgaaatgattcgctcatgtatacaactgggtcaccaatgctaccgcattcgatgtcatcta

SEQ ID NO: 87199 - DNA, 582 bp, Heterodera glycines
  SCN-specific regions: Sequence locations=1-37,59-192,214-308,331 -490,513-528,557-582
ataacgcggcacagtataaatataaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgtt

SEQ ID NO: 87200 - DNA, 595 bp, Heterodera glycines
  SCN-specific regions: Sequence locations=1-33,55-595
cagagaaaaattttactttttctattaacttgcttattattaaattaatataaagaagtcttctgtatacgcccgaatatgaacgtttccttgtcactcaacggactcggggaaatgccattggtgccaattgctgatttgaatggcaccaaaaagtacacggcgggggaggtggaatgccgtaacaaattggccgctctttatcgcctcatcgaccatttccgctggagccagtcaatatacaatcacattacgtttcgtctgcctgggagcgacaatgaaatcctgatcaacccgcttggcatgctatatcgcgagatcactgcgagctcatttgccaagatcagcgttgacggatgcgtcattgatccgggatcaacacctttgggcatcaaccaggctggctacgtcctgcacagtgccatccacgcggcgcgtcatgacgtgaactgtgtgctgcacttgcacaccgcgtccgcagccgcagtttcggcaatgaaatgcggacttttgcccatcatccaagaagcaatgattttgggtccggtggcataccatgaatatcgtggcattctaacggatgtacaagaacgga

SEQ ID NO: 87201 - DNA, 268 bp, Heterodera glycines
  SCN-specific regions: Sequence locations=1-243
tccattggatgttttggtcgtcgaaattagcacatatatcacttgcgaaggaggtgatttggaattgaaacggaaactgcaggaagaagaacgtcaggcgcagcaaataagccaatcggctgttattagcgcccctccgagctccgttgacgattttgataaagagcaacagttaaaactcgatgcaaaggctttatcaaacactgaggaagccattgaacttcaaaaacaagctgagagagcaaaaaaaaaaaaaaaaaaaaaaaaa

SEQ ID NO: 87202 - DNA, 631 bp, Heterodera glycines
  misc_feature (630)..(630): n is a, c, g, or t
  SCN-specific regions: Sequence locations=1-227,264-308,332-523,545-631
cgtttttaattacccatcaatcaaaaaatgtgccaatgtttggattgtgaccagcaccaacagcagcacaattgttgttctccaacccagcagcagcgtcgtcggttcactgttgtgccggttaaggaaggcaaagatttgtccaagatggcacaaaatcggcaaataaaatttatcatattccgactctgatagcagcagcagtgatgaagaagcatcttcattttcattatcatcatcagcaacaacaacaataacatcagccataaagtttaacaggcaaagattgtcgttaattttacggaatgccaaaaagtttgaaatgccaaaaaatgcggcatttggcgcgggtcgcgtcgtgcattttgcggacagttgcggacaaccgttggcatcgtttcggctcattccgagctggcgagaggacagcatttcagtggaacaatgaaaaatatggacaaattggaggaaaatgagaaaaaaaaccaaaaatttttgagatcgagtttatttaatcctattgttttctttgtatgatttaatccaattttcgaatttatttaatccaatttttctttctttgtattatttaatccaattttctttgtcaattaaaatatttttaaaaana

SEQ ID NO: 87203 - DNA, 452 bp, Heterodera glycines
  SCN-specific regions: Sequence locations=1-320
ctgtgttatctgtccctccccaatcgtagtgatattattttcccattgtgttgtccctccccttttaagttgtgctccgcccttttaagctttgatcattcatccaacgcaacaattcgattctcctgtacaaattttgatcagtttctttcgtccgatgtcctctctgatttgattacttatgctccaatcgaaaaccctcccattttccatccgattttttttatttgacgcaaatttttagaatttatttttttttgtgttttcttttgacattcacaatttatgtcacaatcagcagaaaattttttgacattttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaa

SEQ ID NO: 87204 - DNA, 607 bp, Heterodera glycines
  SCN-specific regions: Sequence locations=1-607
atttatttacttccacctttgttcggcaacgaccaagcagtcgaaacaaccgacgcagaagtaagcgcaacggcaccagtcaaacgacacagtgacaacaccattcattccttcattatttatcgcaacaacagcagcgacgcatgggccaaatcaatgtatgcgacgacgtttggttggacacattggcatggatcaatcgtgtagaagtcggcatgaagttcgcgctggtcaatgttcggttaaacgctttggcggacaaacatttcaagcagaggaagtggtgcttcggcgagtttcatatctgtgagcggatgacggaagaatcgggcgcagaaatcatgacatcgatcgacggctccgacttcagcacgttgccactgcccaccactccgttgccggacagtgtcgtcggcttccgatcaatttccatttggtgcatcaatgaagaggtcgtcaattttctgcgcacaattcgccgtctccttaccaaagacattgcgctggaattctccactttcttcacggaatatcgcagttggaaagtgatggcacaacacatttggccactgttgaaagatgggatcagcaccttgtgcctgaagaa

SEQ ID NO: 87205 - DNA, 599 bp, Heterodera glycines
  SCN-specific regions: Sequence locations=1-503,525-599
aacggaaaatgataatgttttcttcattgataggcatttttgccgttactcaagcgcagcagaggcagaattgtttctatctcaagtgtagcaggacgcgtttcagtgccgggcggggcgccatatgccgtggccaaatatggggttgaagcatacatggatgcgatcaggcttgagctgcaatgttggggaatcggctgtagcatattggagccaggcatgttccgcaccaaattggtaatttctccttattaatgatgaacattaatgccataaatcgcacacttggctatattccaaaattaaaataaggaatattcaaaaaataggatttattgaaattgtcgttcttaatttacaggttacgcgacctacaaaatgacaaattggcatttctaatttgtttctttaaaaaaatcagataaatgccgatgcaatgacggcacgggtggacagagcatggcaaaaaatgaaacccgaaataaaagaggaatatggcgaaaattttaagaacaaatttgttgcttcatggaacaaacttttccaggaactcgcttcagatcggctggaccatgttgtggatgcgtatttccatgcgg

SEQ ID NO: 87206 - DNA, 439 bp, Heterodera glycines
  SCN-specific regions: Sequence locations=1-51,73-303
ataaaaatttttctctcaagtagcatgtctcctatgagggagcgtgtataagtttatttaataattaacaattaaacatattaaggattatgcaacattcagatttaaaaaaggtattcagatttaaaaaaggtatagcgcttttattattgctttctacaacaatgctcgcatgtaatgcttctaaagaacgctgccgatcagaaaaacagcaaggatatatgcagaaaaataaaataaaaatacaaaaaacaagtaaagcagcacaagaaagaaaagaagcagcaaaagcaaaagcagcggaaagaagaaaagaagaagtaaaaagaaaaaaagaagaaaaaggaataataaaaggagcagaaagaagaaaagaagcagtagcaatagcagaagtagaaagaaaagaagcatgaaaaaaaaagaaaaaaaaaaaaaa

SEQ ID NO: 87207 - DNA, 347 bp, Heterodera glycines
  SCN-specific regions: Sequence locations=1-239,262-347
tttgtgtaaaatccgatcctcgcccgcctagaaccacaacacctctaaaaagcgaaagtagaagcaactcgatgttgaagttgatgagaatgttgctggctttgatagacaagaagcatcttcgccagttgccgtctaaacatttcgacacttttcttgggcaattgcacccccaacggcgccactttcccgtgaaagaggcaaaaaaaatgaagaaataatagaaagcggaaatgaggaggaaagggacgaacaggaagaagcagataaagagcaaaatgatcaaattcaaattggacgaaaaattgaggaaaccgaacggcagcaaaagacgaaagtgggcggag

SEQ ID NO: 87208 - DNA, 634 bp, Heterodera glycines
  SCN-specific regions: Sequence locations=1-634
cattctgctgaagtctgttctattcatctctcttctgtcactgtttggtgattgcatgaaaaactcagatcaaattggagtcaaaagaaaatcagcaggaataagaattgaggaaccaaatgatgtaaaaggcaaaggaaaagtcgtcgaaacaagcagaaaaggcaaagaaaaagtcggcgaaaaaataagcgttatgaacacagctgaacgcattgaaaaaatggaccttgcccaagacaaagctaaaatggaaatagacaatatagacaccaatgccaaacccaaacaaaatgaggataaaggcgttatgaacacagctgaacgcattgaaaaaatggaccttgcccaagacaaagctaaaatggatatagacaccaatggcaaacccaaacaaaatgaggaaaatgctcctccaaaatatgttttcatttggagcggtaacaatgagaagaagaaccttgaggttgacctcagagtgatccgtcactccaaaaaactcagcgaattattccatgccaaaagtgatcaatccgtcaatgcaaaacacggaaagcaggaagcattaccggttccgaaacaggaagctaaaaaaatgctgaaggaagtggaagaatggtacgcacatcacaaa

SEQ ID NO: 87209 - DNA, 694 bp, Heterodera glycines
  SCN-specific regions: Sequence locations=1-51,73-422,445-588,610-694
catttgttaaacacccaatcgtcgctgtctcgggagggaccggcgccacatatttgttgtacacttacattatgaaaatccaagccggccacagatatgaaatcggtgaccaaaccggcaaaacgtacattgttacgggagcgacgtcgggaattggtaaaacgatagcgacggaattggcaatgaaaaacgccgaagttgtgatggcatgcagaaacagaaacaaatgtttggaagtgcggcgtgacattgtgctgaatacgaggaacaaaaaggtcttttgtcgaatgtgcgatttgtcagacatggaaagtgtgcacgaatttgtgcggaaaatgaccaaaggaaaatacgacttcaaaaaaattgatggagttattttgaacgcggccaccaaaagcaaaaagtacagcaccaacaaagacggagtggagacgaacttggccaccaatcatttgggctccttccttctcgttggccttttgcttcagaagctgctcgaccaggacggacaatcgcgcattgtttttgtcgggacggacatagcgacgaaaaacagtctaaaattggagcttgacaaattgaatactgccaaatacacaaataaatttctccgttccaccgaaaaattagacatcgaaaaatgcaaatacgacatgcatggagcatacaaattttcaaaactaacgcagct

SEQ ID NO: 87210 - DNA, 582 bp, Heterodera glycines
  SCN-specific regions: Sequence locations=1-154,176-582
ttctgaaaaacacgcgtccaaacggtgcacatttccggggagtattacgagcacaaactgtgcattccgatgcattctttggccttctcggaacgttcggacgaattcttcgacatttgggacgtaaatgaaagtgtcatttacgccgtaaagacagcggaggaaaggggaagggcaaaatggctgcaaaggctgaccaaaattacccttttatacgagcagaaaatggcggagtcggcgcaggagggaattcccatggaaccgttcccgccgtggcacagcaaaaacaacgactcgtctgctactaacaataagtcttcgcggcctcagtcttggacgacgacaagctcatcggaagacggcggcgcgggaacggcgccctccgccgccggcgttttgtccgaccgttcgtcgaccgcgtcttcctattcgacgactgttgaagagaaatgtgcgcaaagccaaggagaaaattcagcagaaaagaacggaggaagggacactcagaaaaagaaaaggacggaagataaaccgactaacagcagaggaagagaagcacagcaaaaggacgacggatgagag

SEQ ID NO: 87211 - DNA, 605 bp, Heterodera glycines
  SCN-specific regions: Sequence locations=1-84,109-297,320-605
tggatgcgcatattcattagtacctgcccgccttggggcacatttggccgactccttcgggagtcactctcccttcggacgaagaactccatctcgtcaacaccacggggcatcccaagggccgaattcacaaagccatgccaaacattgagcaaacagcagtacccaaccaaatgcattggacagcctacacaaaattgtagtggaaaaaaacgaccggcggaagcctacaaattgtgctcaaatccattctgtgtgcgatggcaccgctgcttcgaattgggctgtttgcagttgatatttttgccatcatcggatctcatttttatgcccatctttcgtctgactcaagcctatctgttatcaccaagtccccagactttaacgacgccgctgaatttgtcgcaacattcaaatccatgacggatgcaagtgccgacgttcttgataagatttccaacattggaaacggcgcctttactctcctcaagtttgcgggcccaataggccaaatggtacacattggtctatccatcggattgaagcagcaagactcgcccgagctccgtgcaatacaggccttacagagacaaatcaccgaacag

SEQ ID NO: 87212 - DNA, 594 bp, Heterodera glycines
  SCN-specific regions: Sequence locations=1-594
agaaaatgtcggacagaatgatgttgagcaattgcgatcttgcacaaattttgctgaacgagtctcaattagcgaaccgtcggatggcgctgaaacagtcggccggtggacgcaatgtccgtccaagggaatgccaaccgccttcacggatgacgcatctgtggccggtgaatttggcatggaagcggcaaatgttggccaatttgggaagatctccaaagaatgtccgctgagtgttggcgaaaagattggcttacgagtagcgatcagagtgcagcagaagccgcagactttttactttctcttcctttacttcgatcagaacggccgttcccgtcagtttcgcttttccgcccgagtccgtcccctctcgcgcattttcgatgccgaccattgcgtacttagcgggtccatcggcttgtcaatgctcacgcttcgctgtttgccgttcaattctcacgaaagcgatgcaacagcaaaggcaacgacagcggtgacattgaccaaattggacttgctcagactttccgtcaaagtgacggatggaaatgcgcggacaaatgtgcgacgagtggaaaacgaaccaatccaatt

SEQ ID NO: 87213 - DNA, 649 bp, Heterodera glycines
  SCN-specific regions: Sequence locations=1-18,40-42,66-363,385-649
ttttattggctgaccgacctttcccttcctttgctgtttcggcacttccttttcactcctttttgctgcaactcaccagtaatgagcagcagccatcgcgagaccggcaggagtccaagaagtgtgctgatgcgccagtacgaaatgctgctgcaaaactcgaacgacaacagcggattccgtgcctggttcgacaataacaatctcttcaaatggcgcattctaatcgacgggccgccgggaacgccttacgcgggatgcaaactcacggcactgctccatttcccggcttcgtacccaaatgatccaccgacaatgaccttcctcaccgacattcttcatccgaacattgaccagagtggcaaagtctgcatcagcattcttcatgcgccgggcattgatccgcttggccatgagcagccgtccgagcgttggaatcccaaccgttccgtggagtccattttggtgtcgatccaagtgctgctggcagagccgaatttcaacagtcctgccaatgtggatgctgccattttgttccgcaacgatccggcacaatacaggaaggaagtgcgacggcgcgtggagagggcatcagcatcgacaccgcgagcgatgtcgtcatcaacaccaccgccggtagcgcagccgt

SEQ ID NO: 87214 - DNA, 427 bp, Heterodera glycines
  SCN-specific regions: Sequence locations=1-193,215-401
ttgcataatttattcaacgaaaatgtcttttgcctatggaaagtccattcagcagaatggtggtcccaaccgtgtcacattcattctgcgaaaaggtgcaattttcttcactgggatggttgttggaacagtcgttgtttttaaggcatttaagccaacgcgtcccttcgacgaagcggcagaacgtggcaaaagggagctgttggagaaatacacggaggagtacaacgcgttgcaggaagagctgaggcaggcggaagagcagcagcggaacggagggatgtcgaagaggcggaagcgagaaaggcttagccgatgacaataataatgatcaatttgggtggaagggttgtaaatcctctgaagtaggatcacattgctaattaaacattttgaattccaaaaaaaaaaaacaaaaaaaaaaaaa

SEQ ID NO: 87215 - DNA, 356 bp, Heterodera glycines
  SCN-specific regions: Sequence locations=1-356
cggttggtctttatcgcggctattctctgtcttcttggatctctagttgcaacgcgactattccagaagttgcgtttcgccgaaaaggcgggcgtctggcctgggccttcatgggagccatcgccaccggagcgaccatctggtgcacccatttcgtggccatgatcgcctatcagccgggcgtggacgtcacctatgaacccggtctgaccggcgtgtccctaggcatcgccatctgcggaagcgccctggccctgtggttcggttcgcgccagatgcggttcgcggcgcccattggcggcgtcctgttcggtctggcggtcaccctgatgcactatatcggcatgaaggccttt

SEQ ID NO: 87216 - DNA, 604 bp, Heterodera glycines
  SCN-specific regions: Sequence locations=1-304,326-580,602-604
gggtttctcctttctggcggcatgacacagttccggcccttatatccgtgtcactgacattgcgcctgggggtggtgtggcgagggacggacgaattcgaattggcgatgtgattctgaaggtgaacaacacggacaccgtcgacgtgccgcaccaagtggctgtgaatgcgttgaaagttgcgggcagtgtggtccgattactcatcaaacgaccaaagacttcccaagcgagtgcgtttcgtccctcctcggccgaaccgctctcgcgcggcagtcccccggagggtttcggtttcggtcccccaccgcccgtccccacccatcagcagtcatttggagaaagtgaggccgtgaaagagttggagcaaatgccgggagtaaggcgaatggatttgatcaaagtggagtcggacggaatacacaagggattgggcttcagcatcgccggaggaaccggaaaccagcactatccgggcgatgacggaatttttgtgacgcgaataatcaaaggaacgccagcttattacgacggccgactccaaaaaggggaccaaattttggcagtggacaataccatctttaaaaatgtttctcatcagttt

SEQ ID NO: 87217 - DNA, 607 bp, Heterodera glycines
  SCN-specific regions: Sequence locations=1-84,106-332,354-607
tttattttgcgtctttcttaccctttgttcgaatttaaaaatgtcaaacaacgaaaatgaaaatgtgatgaatggagaagccgtgggaggggtggaaatcaaagtggaagccaatgaagaagtgaacacggaatcgcaggaggacggagaggaggcgaaaattccccagttcagcaaagagcaaatggaacgttcggtgatgtgctgcacaaacgaaggcgaaattgtcaatgcgccttggcatttgatggcacagtcaaagacattcatgcaaatgtgggaaagtctcgacatggaagaaaaaacgcaagaagattttacggatttcgtttttccgctcaatgacatcaccagcgactgttttcagcagattctcgcttggatgcgcgaacatcacaaccttcccgagccaattgtcaaggaggacccggtgacgcaggaacgcatttggttcaaattcaccgattgggagcgccaattcttcgacgtcgactttgaaagggtcaaggagtactttttggcttccaactttttggacattcgttcattgtacctctactgtgcccaggaatgcgctcgttgcataatggacaaatcggcagaagat

SEQ ID NO: 87218 - DNA, 597 bp, Heterodera glycines
  SCN-specific regions: Sequence locations=1-597
ttttttgatgtttaattttttttatttctttgctcataaaaatgttttgctgctcaattttcttcttttttcttttataggaagtttctgtgcattgaaagcaacaacccatttgaatttttcaccgattgtcagtgaactcgcgctgaaaattgttgaagaatgtttggatgaatacggacaattggtcgaaactcgaccattcataaaaagaatttcgagccccgaaacgtcgcccgattcggaaatggaaaatgatgagcaaaatgaattcaaatatttgtgggtcgtttttcacagtttgctcaaaaaagttttgttgcataacaccacaaaaaattacgtacaaattgcaatgagttgcaaaaaatggtcaaaaaacgatggaaaggaatctttcttgtcccctttttgcgactttgtcaaatgctttacctttgtgaaatggctttttgtgcaactgaaaaggacgtcgaaattggacacttcggagttggaaagggcccaagaaatgtttaggacgatgagatcagcttacaaaattggacgagaagaagcaattcaaacggggaaaaatgggttaaatgccgaaagatt

SEQ ID NO: 87219 - DNA, 595 bp, Heterodera glycines
  SCN-specific regions: Sequence locations=1-530,554-595
gtgggtcgtggagaaaatcttatcttaacttctgctactgactcttaccagacggagggaactatatcaaagaggaaatgctccagagagaggttttttgtgagtgtcttggtggcgaacgtgtttcggtccgtgcttcgcttatgtttcagagccaaacctttgccaatatgtggaagtctttgaacgtggacaccaatgagttgcctgacgattttgtcttcccgatgacgagtgttgcagttccggtctttaaaaagattatcaattggatggagagtcacgtcggacagcaagtgcctgagtttgaagaggacccaaatactcgcgaacgcaaatggttcgtccagactgacttcgaaaaggattttttcaaggtcgaagttgaagagttggttgactttctgaatgctagcaactttctcaatttgcaatctctctatcgtcattcgtgtcaggctatggctgctttgcccaaggaccgctctcctgaggaaattcgtgatctgcttgggattgaggacgatctgactgaggagcaaaaggcggaaattcgtcgcaaaaatgtttggtgcaactattgagagttcagaag

SEQ ID NO: 87220 - DNA, 695 bp, Heterodera glycines
  misc_feature (679)..(679): n is a, c, g, or t
  SCN-specific regions: Sequence locations=1-100,122-695
tctctcttattcttccttatcccccggtcactttgttgctgcaaatgtcttcagaaattctttggtctactgtttttcttctattggtcgattgtgccaccattcttttttggttcttttttggccatgtcaaaaaacgacgacgcccacataaaaacgaaatctttatctgcggcgactgttggcttttggtgttcgattttcttgcgccttctcaactcggcctcgaaattgcactggtcaaccgccgctttaactgcatcgtcgacgaacacttcaagacacgcaaatggaaattgggctgcatgcgaatttgccacaaaattggagaaaatggcactaagcaattgcaaattgtcaattccgatgcaaagccattgccaattccgcaaaatccgttgcccaacaaagtcctcggattcagacacattcagatctattacatcgatcaaaatgtcatcgcatttctccgccgttttcaccgtcgtattttcgatgtttgttcaatggttttgtacattcacacagacaatgaccgcattttggactactttttgctcaacatttggccaatgtttcgtcattcaatgcgtctgatgaatttgaattccatctctttacgccgtctgcgccaattggccggcccgtcactgctcagcgattgtccatcacttcgctntgtctcttttaatgaa

SEQ ID NO: 87221 - DNA, 690 bp, Heterodera glycines
  SCN-specific regions: Sequence locations=1-38,60-207,229-615,638 -647,669-690
ttctggactttggcacaaatttggcaaaatattcatctcactctactgtagagcaactgcttggactcgggcaccaacgaactgttcatgtcccatggacgacgaaagcggcgcaacattggtggccaacaactgttggcacaacagcaacaacatgagcagcaaacggaggagacactgtccgccatcattcgcgtgttggccgagggtgaacatgaggaggaggtggaacgcttttacaaccgaacagcgagcagtatcagcaacatcgatggtggtccatcagtgccattctcttacaaaattgccggaaatggaacgcaacaccgacaaaaccaccggcgcaaaaaccatcgccaagaagtgcagcgggaaagcatcagccctggctatgtgtgcttgtccgactcgtggttcatctctacagtggtctccatgtccatggtctgtctgatgttgtccgcgctgatcgtcatttggggctgccattcgttgcggaaaagcaacgcgccgccggaggctaatggggccaaatgccaaaaatgctaattgagggaatgccaaattaacaaagtgtaccaatgccaaacaaagacactgtttcaaaatgattccaaatttatttttttatatttttgtccatcaactttattttctttacaatttttaatatgtattaaatggaaacaa

SEQ ID NO: 87222 - DNA, 480 bp, Heterodera glycines
  SCN-specific regions: Sequence locations=1-480
tgtttgcgatgggctccctcaagtggaccgacttggtgttctgatcgacttgaatggtgatttgttgtccgcctggagcaacatgaagcgcaaagggactgacgccatttcttcactgttattggcccgagtgagggcccgtttttcatcattgcctgaccaacagcagccgctttggatggtgttttaaatgctcgaaattgccaaaatgcgagtcgacacggaaagcaaacgacaaacgctggaagagccaaaagtaacggaaggaaattgcgagacgaaaaacagcccacgcaaaaaggaggacggccggatcagcagcgagttccaattgcacgaacatttcagcaaaatcactgtgcacgacggtgcttttggtgcgccaattagctccacgagacaccaaaaacttttgcaaaaatgcaacaacatcgcctcacactcacaagcgcccacacccacaccaaatggcatgacctc

SEQ ID NO: 87223 - DNA, 533 bp, Heterodera glycines
  SCN-specific regions: Sequence locations=1-143,170-533
tttttcttccgatattttccccgatcattttgttgctgcaaatgccttcaaaaattcgttggcgtgccgtgcctcttctgttggtcgattgtggtgcctccattctttggttcttttttgaccgtgtcaaaaaacggcgacgccctcccaaaaaagaaatctttatctgcgccgattgttggcttttggtgttcgatttccttgcgccttctcaagttggcctcgaaattgcactgatcagccgtcgatttgacttctacgtggatgaacatttcaaaacgcgcaaatggatgttgaacaaacaattgctaattacatggaaaattgtcggaaatggccccaagcaaatgcaaattgacgatgccgatggaaatccattgccaatcccgcgaaatccgttgccgaacaaagtcatcggattcagacgcattcagatcatttacatcgatcaaaatgtcatcgaatttctccaccgttttcaccgtcttttcggcacttgtgcaacagctttggacattaccactgaaaatgtt

SEQ ID NO: 87224 - DNA, 368 bp, Heterodera glycines
  SCN-specific regions: Sequence locations=1-227,250-368
agcataagaagagaagaaggactaacagcgcctgccgccgacgcaccaacctggtgaaaagagagagaaggccaaggatcgcaagaagcaccggtccattaatggaggagcgaaaagcagctgaagccggtctcggaaggacaaggatatgttctaatccgccaagaaggatgagagcggcgccgctgcgacaaaggagcagccgagcgcggagacgaacgaaacaaccggagacgcacctgccgccaccgaagaagcgcccaatgaagaacaggcgatcgcggagacgaaggaaacaaccggagacgcacctgccgccgccgaagaagcgcccatagaagaacaggaatgaccggccggcgacttat

SEQ ID NO: 87225 - DNA, 588 bp, Heterodera glycines
  SCN-specific regions: Sequence locations=1-39,61-588
tggctgctttctcgtccttcgctttgtcctcccttctccacttttcctcctttccctttcgtcctttgtgttttgtcactttcgcccccattttcctccgttccttcaaaaagcgtcggttgaacaacgtcgtcagtacaacagaatcgtgaccagccaaaacgacaccaaagcacaaatcaacagcaatgtgcagaattgggcttcaaatgcgggagttgcgagcgattacaacaatttcacatcggagcagcagcagcggtctcaacaattccatgacgcagtctccggcaatttgacaggccaagcgctgcaattattcaacaacctctggagcattcgtcagaatgatcaaatcactcgccttgccgagtgccagcaaattcgtgccgctttgaatgccaccggacgggaccacgtccttcaccttctcgtccccattcctcctccatctattgttggccctccgccttccggatgttttcctcggcctccttactcgaagccatttggcgggggatttgggccaaagtccggcggagcagccattccgggaagaggaggaccacagacaccggagagaagaat

SEQ ID NO: 87226 - DNA, 683 bp, Heterodera glycines
  SCN-specific regions: Sequence locations=1-98,145-145,167-339,405-683
ccgtgacgcattgacactggactacggcttgggacgcatacgccgaagacggtccaattatggagcgatgtcaccgaccaagagtgtccaggaagtgcaacccgtggcattgtcttggcacggtctcaccgctgtccatgccaagtcgggacggaaaattcttgacaatgtgcccggtatggccgacgctggccaactcgtggcactgatgggcgccagcggggcgggtaaaacaacgctgctgaacacgttactcaaccgaaatctgaagagtctgagcgtggagggccaagtgctggtcaacggacattccctgggccggtccatcacttacgtcagcgggtacgtgcaacaggacgacttgttcatgggcacgctgacggtgaaggagcatctgatggcgcaggcacagcttcgcatggtcggacactccaaacggacgatgcgcagacgcgtcaatgagatcattgatgagcttggcctgcaagagtgtcgccatgcgcgcattggattcagtggggtcaaaaagggcatttcgggtggtgaggcgcgtcgtttgctgttcgcctccgaattgttgaacaacccacaaatcatttttgccgatgaaccgaccacgggcctcgactcgtcaatggcggaaagtgtgatcagcgtaatgcgtgccctgaccttgtccggcc

SEQ ID NO: 87227 - DNA, 633 bp, Heterodera glycines
  SCN-specific regions: Sequence locations=1-294,317-633
caatatggcacacataatagtggtgaataaattccaggatcggacaatgatccgtggcacgacattgggccaaaacatgtacaagattggcggagaagaagcagtcccggtcagggaagcacttgtgatatatatgcagcaaaagaacgccaaaacgtgtagagcagcagaatatgttccaaaaaaagctgctattggatgcactggagatgaactggatttgttgagcttgctgatcaagggtgatcgaagcaaaacaatcggtgaggacgggttcgatttggagctgttcgaccaggacgacaacaacaacaacgacggggaagagcagggcgtgaataagggcaaaacgacgacggcaccgcagaaagccaagcgaacaccgtcccagccgaaggaatcgtcgttgagcaaagcgatgaaagagatggacttagaccggagcaagcaaacaccatcatcaacagaaaagccgccgtccagaaaaggttcccgtaagggagcacatctgctggagatgatggaccaagaaactgcagccccaaaaacgacccaagcgagaaaggggtccgttaagcggggcaattaacacactaattgcgtcttaatcattggccattgtgaaaaaaaaac

SEQ ID NO: 87228 - DNA, 361 bp, Heterodera glycines
  SCN-specific regions: Sequence locations=1-361
cctggacgcctgtggagcgttgaagcgagaagcgaacacagcaaagcattgttcaggcgagccttggcattgaacagaatgggactgaaaggacgggcgagggattacgcgagtcgatgcgcaaaattagtgggaggaggggacagcggattgaaggaactgctggacacactccgagacgaaaacgatgccccactgattgacctcaccgtttttcatcgttcagaagcactgcaatcgcagcgattgttgaccaaaaaaggaatcattttatgcaagggaaaatgctaaacaaataactgtgtcaatactttatgtgatcaaataaattccattttgattgtttgataataaatgtggt

SEQ ID NO: 87229 - DNA, 619 bp, Heterodera glycines
  SCN-specific regions: Sequence locations=1-340,374-591,615-619
ttgagaaaatgctctttttcccattgccactgttttgctcggtgtcttcgttggctcccttcaggggaaacccaccgaacaaaatgccgaaattaagccggcagcacccctcgaggcaactcgcaacgaaatcaaagacacgccgcaacgcacagagaacaaagaaatttcgcgcagcgaaatcaacgaaatcaaagagactccgcgcaacgaattcaaaacggcgccaatcactgagagccgtgaaagaccgttcattaaaagcgaaatcatccgcgacatcagctccgcaatgaacttcttgaacgagcaaatccgggagtactcggaacgaaccaaggacagagaggaattcaagggcatcattgaggccagaaacaaactcgagacggccatcaaaccattgcacggagtgatggagtccgacatggcttcttcgagcctggagacgtcgatgaccaactcggccaacatcgcccgacaagccctggaggagttgcccgtgaaacaggtccgacaaatggaacaaattgcggaggagggaaagagcaaaacggtggaggagcatgagagggcactgcgcgagtacgcggagaagaacagcgaaagtgtgaagaat

SEQ ID NO: 87230 - DNA, 298 bp, Heterodera glycines
  SCN-specific regions: Sequence locations=1-230,252-298
catcctcgtccctccgcttcaatgcaaatgctccgttcactgctcttcgctgccgcgttcgcttcactgctcatcaattgctacgaggcgcggacgatacgcctggccaacattttcttatgtgccaatagcggtttcacagtcgaagaaagcctcacttttttcgaggcgaacaacattgaagtcaaaggcgaagatatatcaaacacacagacggagccagtgcccattgtgctggtgacagcgaatgtggagttcgacgtggtgttccacactaacagcaaggactgcaaggagc

SEQ ID NO: 87231 - DNA, 610 bp, Heterodera glycines
  SCN-specific regions: Sequence locations=1-4,27-68,99-418,440-610
ggacggaattggaaatttttggaaaacattgaactccgaagtgtgctatccacatggaccaacaacaagccgctgccgctgctgctgctgctgctgctagcgggatttcctctggttttttgcgcactataatttcgctcaaaggcagtcagtctcaactttcgctgctcatattcttttgttgggaagcgacgatctcatcgctcttttcgatctcagcggtgcgtacaaccgctactgtggtgttaagaagccgcgagaggacctcgcctcgtttttgccacatgtttgtgccggttcgcacataaacaaaaaggcggattcgcaatgttctcttcggaaactgatcgaagacccgccaataatgggacgagaaataaacaatttgaatgccagccaaatggtcggatttaaattgacaccagaggacacagttctttaggcccaattcccaacgccaatcgcttcttcgatttgccggagcaaccgacgagcagcaccaccagcacaacgacggcatttctgtcccactcaacatctgcgccacaatttgagtccggggccaaaaccaccgacgaacgccgacagcgaaagcgcgtcaaacggtcat

SEQ ID NO: 87232 - DNA, 567 bp, Heterodera glycines
  misc_feature (14)..(14): n is a, c, g, or t
  SCN-specific regions: Sequence locations=1-38,138-218,240-246,291 -365,388-438,481-528,555-567
tcgaaatatttttntaaaaaaaaccatttaacattccgaaaattattgaatttttttttattaagcaacaaaaaatttataaaaaaattaaaattaaatttttaattatattttaagttaaaaaattattttaaaatggaaattggcattgcacgttctttgcaattgcttcttattttagtgctgctcatcagtgctttatacctttatttggtatgaaatttttaaatatccaattaattcacctaatttttaatttgaaaaattcatttaaattaattcaaaattttcggccgtgcctgactggtggatttacgcaatcccatgcattgtgggcggtgttttgaacgtttttccgcactccggttgtccattttggcgcttttttgccagtgcattaattgttctcggcacaattgagacgtatgtaatttggacatttttatttaatttaaaaattaataaacaaaaaaaattttagccttttcctcgtttggtccatacggtaagaaatcttttggtaatctattttaacaaataaaatattttctaaattgtgcaattatt

SEQ ID NO: 87233 - DNA, 607 bp, Heterodera glycines
  SCN-specific regions: Sequence locations=1-364,386-607
tcattcccttgccgacaattcccgtgttttcctatggatttggccctctttcattgtaaaatgatcgacactttggtcatccttcacaggttgaatgggctacaacaccctccgttttgctcatcgcctgtcattttggcgtcgtttcgttcgactccgatgccaacactttcccttgggtcttccatcacccaaaacctttcaatcgcttctaatcatttggccactttcgcatacgatggacactttgttttcgttatcaatgctttcaatgggacattgaaaactgaacctttgcgtttttcggaacgacaaaaggaagtcgttgccgtgggcgaaggagggaatgttttgttcgttggcatctccgaacggggcgctctttccgtgcttacgccaaactcaccccaaacaattggtcactctgccgaactccccaaacagaagggcaccgccttttcacatttaatggcagctaatgggcggacaacaaaaaggagcggagaacaatcggaagaaaggggaggacggacgaaccacgcggttgttctgctggaaatgccgtccataaaacaattcattgatggccccgcgcattcgcttccgc

SEQ ID NO: 87234 - DNA, 419 bp, Heterodera glycines
  SCN-specific regions: Sequence locations=1-419
accttccaattcttgctcttattttctgcttgttgctacttacaacggaaggaagtatattctcgccgaaaaaaacagaaagaaaaattcatcgagcagcgaacaaaaaacacaaagaagaaaccgagggtatggccgaagtcgcactttttcaaatggcaatggcatgtatggccaatctaatggattttcaaatggccgatttggcggctccagtgtctattcaaatagcggccggtcgaatagctttccaaatggtggatttggcggctccagtggcttttcatcgatgggacataactcgggcggactccacggctttgggtccggcccaccttctggaggctacggatacggaagcggttttggtggaagaaaatgaaaaaaagaccgaaagtgatcggcgagagaatgattcg

SEQ ID NO: 87235 - DNA, 468 bp, Heterodera glycines
  SCN-specific regions: Sequence locations=1-119,141-468
aaccctacctttatctgaccaacgaagcaatggaaaagacggagaaggagcacaaagaaaaggattccgctgaagccaattcggacacgaccaatgccaattcgttggacaaagaaaagcagccatctgcacccatccaattgggcaacaagcgcaaattgggagacggagtgattattgacaacggcgaagaataccttatgaagctgagcacgcacaactcggaggaaccagttgacaatggaaatgtatcatacgtctcttcgttctcgtcccgctcctccacgactactatgtcttccgttgaggacgaggaggacagtggcaccaacgcgggtgacgacggttggatggtggtgaagaaggagtcgttcaagaagttgtgcgacttctacgagaagcgtcgtcgcgtggagtgcggcggtggcaccgtcgccgctgacccattcgcggaacaattggaacgcg

SEQ ID NO: 87236 - DNA, 663 bp, Heterodera glycines
  SCN-specific regions: Sequence locations=1-663
gtgattgatgaagcgggtcttatacccccactttacggacgcattcgaaattggatcggcgccaaaaaggattggcccaatccgccgttgccactgcccaagaacagaactggcgtttccatccaaaatgtttttgccgttaaattgggcgatttcatcgctctgaccaattcgagttcgctgagttcttcggacagtcgccagcggtgcattcactcctccgatgggccgttgaattttgaggcgttttaccgggaccatggctttgtttggtacagcgcatctctcgagacggacggaaaaacattggaagtgcctgaacttcgcgaccacgcttatgtctttttggatgggatatttcagggcaatttgagtgtcaatgacaaaacggggggacagatgaaaatggaactgaaaggaggcggaaaaaggggacagagaatggacattttggtggaaaacatcggccgacttacgtaccctctgaccaaaacggaccccaaaggacttttctcgccacctttcatcgatggcaaagtgatcagcaaacgatggattcagtgcggggtgaatttggacaatgtttacgccgaaatcgaaaagcgaatggccaagtcaaaaaatcgaaaagagcccaccgacacaattcgttctgcgcttctc

SEQ ID NO: 87237 - DNA, 522 bp, Heterodera glycines
  SCN-specific regions: Sequence locations=1-57,80-98,121-522
gacggaaccgccgcacgtgctattcgtcatttgggtgtgccaccgtctgcaccactggtggccgaggttgacaagtcactgcaacaatcggcaaaaactagcaacaacgacaacaacaaagccaccgcaaccagtaacaacggaaatggaagtggaaatgctgcgcaacaaccgcagcactcacaaccattgcatggaggcgtggactatctgttgggcattggccaaagcgttcagcgtgcgttgatgaattttggtattgaatgcgatgcggaagtgcgtgacgaacgcggcattgtgcgtggcgctgtgccatttcgtctgccgacccaaaagagtgacaccaacgggacaaccaatggcaaaacgaacggtggcattgaaacgcaaccgaaaaagacgacggaaaaaacttctgccttttgccctttcgttgtgaatcaggcgcctgttaaggaaggcattcttcaacgccctcagtggtgctccaccaattcttcgcgcgggtcgaatgcaaatccg

SEQ ID NO: 87238 - DNA, 536 bp, Heterodera glycines
  SCN-specific regions: Sequence locations=1-11,33-166,188-282,305 -464,487-502,531-536
cgatccgaaaaaatgccaaacattttcaaaatccttctgattgtgcttttggccgtcgtctcattccgtctctcggcttctactggtgacaaaaaaactgctaatgatgggagtggaaacaactcatcatttgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagagcacacctacgcgaacttgctgagaaaatgccggtcaatgaatcgaagcgtctgtcaccgagtggacccgacccacatcatcattagggccatggatggatccaacggaggaagaaagaatggatgcttagttttcagattttattctatcctcttttatttattagtttttcaaaacaaatttcttccacaac

SEQ ID NO: 87239 - DNA, 160 bp, Heterodera glycines
  SCN-specific regions: Sequence locations=1-160
gcgccgcagggacacgaaatggaagacaagaattgaaagcgaaagccgtggcggaagagacacgcacaacgaacagggcaaaactgagacaaacgtcgcacagagcgaaaaggacgggccgtttatccgaccgaaagggaccgactgatcggcccgaacg

SEQ ID NO: 87240 - DNA, 312 bp, Heterodera glycines
  SCN-specific regions: Sequence locations=1-312
aggagatgccatcgtccagcgggtcggaaaagggtaatggacgctttggcgttcgtggcgaggaagaagtgaagggaggaaaagaaattgctagcaagacacttaatattcaatcgaagcgtttttatttggacgtcaagcaaaatgatcgtggacgtttcgtcaacttggtcgtggttgctatgaatggtcgaatgaatcgtttgttcatgtcaatgcgaatttgcaagaatattaaggaattgttggggaagtttgaggggcacgtgccagcgtccgaggaagtgaatgggaaagcggagaatgtgacca

SEQ ID NO: 87241 - DNA, 384 bp, Heterodera glycines
  SCN-specific regions: Sequence locations=1-384
gattgtggctttaacagcccggataactcggaccgagaatggatgacgatgttcgagcgatgcgtcaacaagcacatccaattcatcatgctggtggatgaaaagcgcaaggacacccatcggactgctcaagctgtcggaggcaatgcacaaagtcaccacgcattttgtgacgctggagaaagcgaatgacgttgtgcggaagaaccagcgccaaacgctggagaacatcctgaacaagctgaacatgaagaactttggcctcaactacgtgccggtgatggagccgtcggcgtgccgtcgcttttcgctcgaaaacggaaatgtgcttgtgatcggctacgatgtcaaccatcctgctcccatgccgcaacagacccgtcg

SEQ ID NO: 87242 - DNA, 589 bp, Heterodera glycines
  SCN-specific regions: Sequence locations=1-508,530-589
gaccttgcagccctccccacggtgacgacgttcctcgtgccgagccatgcccatcgcgaccgtgtggtgacgatctcgtcgcctgaaaactcgaactttattcagtgcgcccctagctatgcattccgcaagacgggtgttcttgaaatcgccaacttcgagcctcgttgggagcaaatgctgtacacgcttttcctggcggaaggctggatcgtgaatgcccctgaccacgaaggtcccgagagcgctttctcggctggccgctttggtggtcacatggtgcttgactcgatgcgcgctgcgaacaactttaagccgctccaactctcgaagcgccctatgcacattggtcacggctactcgggtggctcgacgcccaacggctgggctgcgagtctgcacgagacgtacgccaacgagctgaacgtggtgggctggtcgctgggtggctcaatgactgacccgctgtacacgctcaactccctcgacggtaaacctacttcgtcgctggtggtggccggtgccattggcttgatggacgcctacagggacgaagtcggcaacctgcccgatgacgatgtctggaccg

SEQ ID NO: 87243 - DNA, 363 bp, Heterodera glycines
  SCN-specific regions: Sequence locations=1-270,292-336
gcacgaattggcgaggcacgagttgcaaagcttaaccatttgatggaaatttgcacgagagaggaaaatttggagaggtcaaagcgcttggcgcaggccggcggctattcttttgacgccaatgcgtcggtgccgacaacattcagcttcagctgatcgaagagagagaaagaattctaatccattcattcgtttgtctttgatcactttgggtgtaaaataattccattatgccttttacaccgcaccacttttgaataccgctcaatgttccaattatttttatttttcgatgaatggttcgactgttgaaatttgattatattgttgacaatgaaaaaaaaaaaaaaaaaaaaaaaaaaa

SEQ ID NO: 87244 - DNA, 669 bp, Heterodera glycines
  SCN-specific regions: Sequence locations=1-142,165-167,338-550,572-669
acaaccgcttcagtgcgcaacgcaacgcaatggccacttacctattcatcgccgctgctgccttcggagcaggaatttactgttggaaggcgtacctcggcccgatgctcgaccaaccgaagagcgacgacgaggagaagaaggctggcagcaagggcgacaagcacaagaagaaggacaagaagggcgaaggcgcagcagcagcaccagcggcggacaaaaaggaggagaagcgcaaggacaaacaccgatcgaaggaggcggggaagagcgacgacagcaaagcgggcaagaaggacaagcacgggaagaaggacaagaagggcaagaagaaggacaccgccgatgcatccaccgtggacgaagcgctgggagaacagagcacagcggagacgagccaagcagaggaatagccaggccctgctgcgtgcaaatgacagtgttcgacgacgacgtctcgcgacaccaacacacccgtcccttgctttcgaccattcccttcccatccgattgctgtgttttgtctgttccaatgcttcctaaatgttccccttgtgaacagtgatccttcctcatgtgacctgaatatgtatatattgtatacccattaatatattgtgcttcgcttgttcgatatttgtgaaatctcattcatattcatcgtcattg

SEQ ID NO: 87245 - DNA, 678 bp, Heterodera glycines
  SCN-specific regions: Sequence locations=1-3,26-678
ttttaggtggtgacattgctggagtggccgagacaccgtcgaatcagtgaacgatggcaaaactgctgcttggcatatgcaccgttatttgcagaaattgcagggctaccaaattgaacgagtgccaaagttaccgctctttcacacgccaatcgactacgttgatttgtcagtgcagctttgcggacttcgttttgaacatccgtttgggttggcttccgctccgccgaccaccaccggtgcaatgtgtcgccgagcgtttgagcagggctgggcctttgtgttgaccaaaacttttgggatggacaaggacttggtgacaaatgtttcgcctcgaattgttcgtgggacgaccagtggtccaatattcggcccagggcagggctcctttctcaacattgaattgatttcggagaaatcagctgagtattggctgacttgcgtgaaggaattaaaacgtgatttttcacaaaaaattgtaattgcatcaatcatggcatcgtttaaccaacaagattgggaatttttggcatcccgttctgaagaagcagacgctgatgctttggaacttaatttgtcgtgtcctcatgggatgggcgaacgtggcatgggccttgcctgtggccaaaatcccgagatggtcaaacaaatttcggaatgggtccgttcagcagtcaa

SEQ ID NO: 87246 - DNA, 601 bp, Heterodera glycines
  SCN-specific regions: Sequence locations=1-239,261-554,577-601
ctggagctgaatggcgacaaccttttcgccgttctttatgcggctaaaaaatatggcgttgttgggctcgtgaaggcgtgtgttaactacccaaaattggacccgaccaatgtgttccttgtgctagcacaagctcgcttttatgaggaggaggacctttcacggcgttgttgggaatacattgacctttttgtgggcgctgtgcttttctccaaagaatttttgcaaatggagcataaattgttgtgtgaaattttggaccgtgatcagctgatcatcagcggtgaaattgtcatttggaatgcggtacttcgttggtccgatgaacaacttcgccaaaagggcaaagaatgttcggtggaaaatcgtcgcaaaatgctcggcccagcattctttaaagttcgaattccgctcatcccaatgcaggactttgcggaaaaacttgttccgtccggcatgttgaacaaggacgagctgatcagcgtgtatctgttccattcgcatccggcccgagcgctccctgaactctaccctctacagtttcccacccaacgacgggcacagcccaaatcgcaccgtgaacagctacaaaagccgacca

SEQ ID NO: 87247 - DNA, 100 bp, Heterodera glycines
  SCN-specific regions: Sequence locations=1-100
cagaagagcaaaaggcaaacgaaggctgtgacccgggggagaaggagcgcaaggaacgtgagagtttgatcgaggaagcgtacgctttgtcacaagaggg

SEQ ID NO: 87248 - DNA, 474 bp, Heterodera glycines
  SCN-specific regions: Sequence locations=1-113,135-474
atcctctaagaattcacatcctctcagaaaatggcttcatctttctgctcctcaatcatttccatcgtcgcaattgtctgtttgctgtgcaaatgctgcttttcggcaccccatccatgctgtcctggcagccaacatgttgtttcgatgatgaaagatcacaccggcacattctccgcttcgatgccaaagtcttcgctttgtctgagtgccgaaagagtcgccgctgcggtggaaaaccaactgaaaacaatttggtgccctggcaatggtggtcaaacactcatcaacgagatcaacgcagctcaatcatcatctgatgagtgtgctcgctctctcggcttcatccgtgccatgttcgaaattgccgcttccgccgcttcccatgccggtgccaacgccgaattggccaatttggctgtccagctccgagaacaagttggcacaattgacaccaactgtgctgcgctgggc

SEQ ID NO: 87249 - DNA, 530 bp, Heterodera glycines
  SCN-specific regions: Sequence locations=1-530
acaacgatgttaagcgaaaccgtgaaaatcggatttatcggagccgggaaaatggcacaggcattggcgagaggacttatcaattcggggcgttatccagcagagaatttgatggcgagttgtccaaagacagatgagtcactattggagcaatgcaaaaaattggggattggaacgactattgacaacacgagaatcgctcgagagaatgacgtcatcattttggcggtcaaaccgatgaatattagcaaagtgacgtccgaaattgcacccaatttccgaagggagcatttgctaatttcaattgccttagggattacacttcgctacatcgaacaacttttgccttcaaagtcccgcgttgttcgcgtgatgccgaataccaccgccgttgtcggggccggtgcctcggcttattccatgggctcggcgtgccaagatggcgactcaaaggtggtccaagatttgctctccaccgttggatattctgttgaggtgcccgaaattcacttggacccaatcaccggatt

SEQ ID NO: 87250 - DNA, 460 bp, Heterodera glycines
  SCN-specific regions: Sequence locations=1-460
gctctcttctttttgcttccgactttggagaagacgacgacgaaaagtcaattgattggccaacaaaagctgactcatgacttgaagaaaatgatctgcaacgacattttggtggacattttcccttattttgaccgtcctcagctcggactcaaattggcacatgctttcaccacgttttgaagcgctggtggacaaatattttgacggcaaatccgaactgacactttggcgtacgatctccgctcacatggacacggaggcggggaaagcgcaactttatgccaacaatacggttacatttccgctgcccgagcgtccgttgccgagaaaaattcgcttccaagccttggaaatattgtacatcgaccactctgtcatcgaatttctgtgtgccaacaatcaaattttcgacaacaaaggcaccaacttggtgttcaaattgtcatcgtatttggcc

SEQ ID NO: 87251 - DNA, 644 bp, Heterodera glycines
  SCN-specific regions: Sequence locations=1-219,241-273,295-365,387 -395,421-508,533-644
gaaaagcgtaagaaactgctcaaagcacagcttaagtcggcgaaaatggtcgtgccaccggcgcctcaaattccgaaaaaaatcgccgaagagcacaaaaagaatggcacccaaccacaaaaggaagagtcgaagaaggacattgggaagaagaagcagccgcagatggcagagcgaagagagtcaagtggctatagtggcaagaggggaagaggcagtgggatgagcagagagagcagcaagagagcccaagggaacagccgaaagaggggcagagagaggagcagagaaagcagcggcgacaaaggcagaaagacaatgcgacgttcgtcgcgaagtcgctcggtgaaacggcgcaggcgcgactcttcctcctcctcctactcgtccacttctcgctcccgttctcgctcccgctcctatcgccgcagtccaaagcgatcgcccgccagggatcgctgccgcgacagaacaaggcgttcaacttcgaattcctctcgctcgtcttcatcctcttccgcctcgtcctcttcacagtattcttcgtccgaacggtcacactctcagtcgcgttctttcaccagcgaccgggacgaggaggaggagcgcattcgcgatcgaatcatcgcacgaacgctttccac

SEQ ID NO: 87252 - DNA, 348 bp, Heterodera glycines
  SCN-specific regions: Sequence locations=1-81,104-210,233-348
atagctcaaaaataatcccccgtaaagcgaacacaatatgagaatgacccaagacgcaaatttgagcactttttgtgcccttttcactttccttctgattgttgaaggaactttctgtatttttggcattggcagcagtgacaatgacacaacgacgactattatctcagggagggggagggacatcgacgacgactgctaaaccaaacggaggagggacggcgcactgacgaaaaccattccgatgactcatcaattcgcggcaaagcgcgcgagaatcgacggcaaacgaaccaacagcatcatcagccgaacttggagtttttgcccgtatgtgctaccggacag

SEQ ID NO: 87253 - DNA, 367 bp, Heterodera glycines
  SCN-specific regions: Sequence locations=1-297,324-339
tagctttattggcagagaaagaaggcggaaatgaggagcggaaacagcgggcggaagagttgcgcaagcgcacaaccgaattgttggcaaagattaagcggagtcgggaagagaaaatttccctgattgaacgtgctgattcattagacgtggaactgaacaattttcacacctcaattgaggaactcattgatcagattgatcaggtgaccagcgaaattgatcgacgcgttgagttccatgccacatgcgatgcctaattaagaattcccatcattttgtttccacaattttgcctttttaatttataatttaaaaaaaaacgaaaattaatgtttgaaaaaaaaaaaaaaaaaaaaaaaaaaaa

SEQ ID NO: 87254 - DNA, 521 bp, Heterodera glycines
  SCN-specific regions: Sequence locations=1-128,150-162,184-521
accgggacaaaaattgaccttaaaatgcttcttctacgtcaactttgccttctgttgttcgctgtgttttatttgattgatgcgcgaactcaatccgtcgcggtgaaaggacgtctgctgtgtggtacggcaccggcacgaaatgttcgggttaaactgtacgatgaagacgctggtgtcgacccggatgaccaacttgatgccggatattctgacccaaatggcaactttcaactttctggccatacctcagagctgacggacatcgacgttgtttttaaggtctaccacgactgtgacgatgggattaagcccggctcgcgcaagttgaagttcaaaattccgaattcatatgtcacggacagtgcgacgccaaagaaaacgtttgacatcggtgtgctcaacttggagactgtgttcaaggacgaggaacgcgagctgatcgtgaccatgaagaaggagcggagaagccaccgttaccaagactttttggacattttgccatgaaaaagtttcgagat

SEQ ID NO: 87255 - DNA, 274 bp, Heterodera glycines
  misc_feature (31)..(31): n is a, c, g, or t
  SCN-specific regions: Sequence locations=1-114,136-274
tccccccatcgccggatgccctcattttggnaagcacaggccgatttcgcattgaatttgatgcgcgaactgtccaagaacggcaattcgtgcattgtttcgccgttttctgtcgccatcgctctgtccatggtttatgtgggcgccaaggaaaagacgggcaaagaaatgggccaactgctggcaaaaggcgcgcccgaggcggaaatgcacaaatattttggagctttgctcaacgccatcaaaaatgggcagaacaattacacatttggag

SEQ ID NO: 87256 - DNA, 479 bp, Heterodera glycines
  SCN-specific regions: Sequence locations=1-107,130-479
gtggaggcggttgttcatgagtttattgtaactggggagcaccgcgagcagaacgacagcgagttcgtccaccgtcagttcttgcgccgtgtgctcattccggagggcatccaaaaggagagcatcaagtgcgagctggacggcggtcgtttgctcatcagcggaaccaaaacggctggcaaaggcggacgtaccattccaattgaaatgaagaaggcggccgtggaacagcagagaagacggaagaggcggagaagcgcaagagaaaagagcaggtccaaaggagccatcgtcaaaaagaaaacggttacgaaaggcggtaaaaatacaactcaaacggaaaagaacaaagagccaagcgacaaaagaactcattttgaacgccagggaggttattccttttggtgaccgcgtcgatgctcccccgacatttaccagtgaattggctcgaacaattcgacctcttcatgaacgggcag

SEQ ID NO: 87257 - DNA, 576 bp, Heterodera glycines
  SCN-specific regions: Sequence locations=1-447,501-512,534-576
agaaaatgcccctcggcaaagggccttatgtgcgaatgccattacggagaaaagggccaagacatgggcaatgaaccatttgtgcttctgcccatcccaaatggattaatgtgcaaattggggcaatttgatgtgaacggaattggcagtttgttggagggcaaatgcctgcacaatgaccattactgcttcatggccagatgcaacaaaggcaataagtatttcaaaactgaatggggttgcgctgttagtcaagaccgtgttagcattaaccaacaaattggggaaactgtcaaggccgtggtggcctgtgaagcaatgtttggccaaaaggacgtggctttttcaaacgaaaacttcacaattgatatgttggatgtggaaacgagcacgacgaccacgacgacgacgaccagacaattggaagttattaccacggcacaaccaaccacaactaccagcagcagcaccaccaccaccaccaccaccaccactaccacgaagccaacaattgaggaatcaacaaactcaacgaatgggggaaacatcgtatgtgtgcaccacacgtctatttct

SEQ ID NO: 87258 - DNA, 242 bp, Heterodera glycines
  SCN-specific regions: Sequence locations=29-242
tactgttggcttctccggagcagacatcactgagatctgtcaacgcgcttgcaaactcgccattcgcgagtccattgagaaggctgttgccatcgaaaaagatcgccaggccaaggaacagcgtggcgaggaagttatggacgtggccgaggatccggtgccgcagctgactcgcaaacattttgaggatgctatgaagtttgctcgtcgcagtgtttccgacaatgacatccgcaagtacc

SEQ ID NO: 87259 - DNA, 617 bp, Heterodera glycines
  SCN-specific regions: Sequence locations=1-74,96-117,139-254,276 -505,527-578,600-617
tgtttttgctgttgtgtcaatggtgttctgtcattgctctgctgattttcggcataatttgcctttgttttggcgttttctctctcatttttgtgcccaaattggtcaacaaagcgatcagagaaaatgtttttgttggtcggtttccaaacggaagtgataatttcgcaatggaacagtacagagacccgatttacgacgtaaagatgcagatttgggtcttttctgtgcaaaaccctaacgaaattgtgaataaaggagaaaaagcgaatgtgacggagttgggtccgttcacttacgatattcgaatgcacaaaaacaatgtgaagtttggctccaatgactcgcgactgttctaccgaaatgtcaagtccttcttcttcaacccccatttgtcctgttccgagtgcaatttgtcctcttcggtggtcgtccccaacataattttccaaaaacttgtgcatgcttgtggcaacaacacctttctcatcccattcattgagccttttttgatgaataaggaaaaggtgtttgtcagtgtcacattggacgaactgctcttccaaggctatgaagacaaatttgtcaatgacatctgctcaaatccattaacgaaa

SEQ ID NO: 87260 - DNA, 473 bp, Heterodera glycines
  misc_feature (416)..(416): n is a, c, g, or t
  misc_feature (460)..(460): n is a, c, g, or t
  SCN-specific regions: Sequence locations=1-473
tcaaaagcgtcgtaccataacgtcacacacatcataaccctcattctcggcgagggcccggagtgccaaggcgaagctgcgcgatgccaagcggaggagggcggcagttggacgcgcaggtctacaagaaaagcgcagcggggcgagcgatgtgccatcagcatgactcctccgatcgccatcacgcggactattctcggctgcacccatccgttccatcgccgctgcttgtatcgctggatccgctaccacaccaattgccccgtgtgccgctacaacttcacccgcactattccgcgccgtaactaaccgctgtaagatgccatgtgttgtgatcgccatacgatgtcatttgttgtgatcatatttgtatcccattgttaggttatgcgtatgtatttgtacaatggaatgtntgctcttatatgcattctgtatgtctatataatactcgtcagtnaataaaatacgtt

SEQ ID NO: 87261 - DNA, 593 bp, Heterodera glycines
  SCN-specific regions: Sequence locations=1-364,386-593
tcggatttgttgaagaggaaggcagggagaccatattggacaatcatcggcaaattcaccaaaatcgacgggccccctcaatttgcggctcaaaagctttggattgtccgccaaaatcccactatatatgtgcgctgaaggcgactaagctcagtctgaagaacttttccctttccgtcgccgctttcactttgctcaaagtgttcaactctctcagcagatcaaacaccaaaacgccaagggttgtttcttcaaataaaagcatcagaaaactgtttgaacttctccgagtgccaactttcatcggcactttgccgttgctttgtcagttttcccagtgcttttgtgcccacttcttcccaacaaaaagtgtcaccatttgtcggccaattggcgtcggaatcagcgcaactgttgcaatggcatttctgtggcccaacaacactttggcactgtacgcattttggaaaatggttgagtttgctttttttcggttggccgatgtcggcactttgcccgttttgccgtgggccgatgcccttctcttctccgtgctctcctcctatttgctcggccttgcggtgctggaacca

SEQ ID NO: 87262 - DNA, 574 bp, Heterodera glycines
  SCN-specific regions: Sequence locations=1-574
caatttggtacgattttcctgctcatcctcccgattcgtctgcatcttccgacttcaatgagccgaggacacatcgccaagcgctgttcgccgcccaagaccctctggtgggcaatctcatttggtttccgatggtggcacgggagtacgaggcgtgccgggattgtgttggcatcatcgacatgacctgcttcgccaagttcgacatcagtggccctgacgtggttccattgctgcaaaagctctgttctgctaacattgaccgtgcggtcggaaccacaatttacaccggaatgcataatgaacagggcggttatgtgtccgatgcaacggtcagccgaatgggcaatgattcgtatttcatcgtggctcccactgttcaacaagttcggttggccctttggattcaacgttgggcagacgagtgggcgatggacgtgcggttacaggacgtgacgaacaacttcatcgctttggacatcgttgggcccgcgtcgcgtgatttgatgcgggcattgaccagcgaaagcgtcactccgcacgactttccctcatttgcctttcggactatcca

SEQ ID NO: 87263 - DNA, 615 bp, Heterodera glycines
  SCN-specific regions: Sequence locations=1-88,117-615
tcccgggcaacgacgcagcagtcgaaacaaccgacgcagaagtgggcgcatcggcaccagtcaaacggcacagtgacaacaccattatttatcatcagcaacagcaacagcagcgacgcatgggccatttcaatctctgcgacgacgtttggttggacacattggcatggatcattctcttataagtcggcatgaagttctcgctggtcaatgctcggttcaacactttggtggacaggcatttcgagcagaggaagtggtgctttggcgagtttcacatctgtgagcggatgacggaagaatcgggcgcagaaatcatgacatcgatcgacggctccgacttcagcacgtcgccattgcccaccactccgctgccggacagtgtcgtcggcttccaatcaatctccatttggtacatcaacgaagaggtcatcaattttctgtgcacaattcgccgtctcctcgccgaagacattgcgctggaattttccacttacttcacagaatatcgcagttggaaagtgatggcacgacacatttggccgctgttgcgggatgggatcagcactttgttcctgaagaagtgtgacttggccatgctccgtaaacacgtgt

SEQ ID NO: 87264 - DNA, 549 bp, Heterodera glycines
  SCN-specific regions: Sequence locations=1-280,302-549
caactgaaaattccttctcaaaaccaatgtttggcgggttgccctgccgatggcctggctatcggatctctttgaagccgcataatggcctttatctttggcaaaattgtcctcggacatttttacgcctcgtctctccaaagaacaggtgcgcaattgctcaaaattgccatttgagtaccgaatggatttggttaaacgaattgtgaattgtctgatcgaaattgccccaggagaaaacattgatgggtggcgttgtggcggaagcatttctttacaattgttggcccaaaaacttctcacggccgacgaccggcgaatgttggccaaccaggacaaaggacttcagactttcttacgcaatcaacaccaaattttctgtgtcatcaaaggcattgtttcaatgcgaaaatggagcactgtaaacgaagaattcgcacggaaaagtggaggaaagcccccgcggagccattgctttttccaccgattgcatcccgacggttgtccgttggaagcgcacatttgttcgtacaagccttaatattacat

SEQ ID NO: 87265 - DNA, 464 bp, Heterodera glycines
  SCN-specific regions: Sequence locations=1-148,180-464
atagcccggcagcaatcaccacaagcaataataacgaagagaatggcggcacaacgattcgtcaaaaaaatgccaccaaaaccagcaatggcattttgccgccaaaaacgccgaaagaaatgaggctgattgttggcacaacagtgccacaaaagagccaacaacaacaaccattgaaaggaaatagcagcgcaattagcaaagcgcttacttctccggcgcctaaaaagaaagatgatgagtcatcgatattgcctttttaccgtctccaacattcaaaatcattgccagtggaccggacaccgacaccaacaaatgaacaagaagaaaatgtaacgagcaatataaagatagccaaaaaaattaatgtcacagctgacgggaactgtttgtttcgttcatttgccgtctcattgtatgggcgtgacgatggatttgagcacaaacggttgcgcaaacaagcg

SEQ ID NO: 87266 - DNA, 466 bp, Heterodera glycines
  SCN-specific regions: Sequence locations=1-466
ctctctaaaaaatgtccttggttgtggtcaagataaatgatcagccttgtttagcggtgattgccacaaatttcactcattcattttgcgggtcgggcatcgtcaattcgctgaaactaaacgtgattgttttaaacgacgcaccaacggtcacaacgagtgaagggacaccgtactaactccttggccaggctctctttcaattggagttcggcccgtggcacagcgatggctttacaccgcttttaatcgcttacgattgtcctgccgatatgctaattggtcaggatctgatcaacgaaatcagtgcgacattgccaataaaattcgaataccacaaaaactcggtgaatgttgggggtacccgagtttcaatgcttgatccgatggccgccgaagagaaattcttttccgtgcgcgtggttgatccgcgaactaacgaggaaattggactggagacatggaa

SEQ ID NO: 87267 - DNA, 493 bp, Heterodera glycines
  SCN-specific regions: Sequence locations=1-366,389-493
caagctgatacaagcgatgtgcaactacgcgtccaaagcacgccgacccgggctcagtgaaaagatcgcttcaattggacgcgaacatttacaagcggttgaggcggaacagcagcgaaaaaaagcagcaacagcagagcgcaaatttaaattatggcaattccattttataccatcggagggtggaaaatggagctaaggatgggactgaaaggaccgtcgctgatacggtggccccaaatgtgaacaaaatgttggtaccgaagcgaaaagtcactgctgacgcattgttggattctttacgggcagaagacggagccaaaaagcataaacaaaatgccaaaatgtgtccccctccgccgtcggtgccatcatctttgtcctcctcatctgccactctttcttccgcgctttgggaccatgaaaatgatgagaatgcaattgttgtcatcgacaataacacctctaccactgcgcaatcgcaagatgccag

SEQ ID NO: 87268 - DNA, 439 bp, Heterodera glycines
  SCN-specific regions: Sequence locations=1-21,52-337,359-439
tcgtcccgacttcctaatgcaagttcatcaccaccaccaccacaagagccaccatcaacgccacaaacgttcttattcttccgcccgccatgtgttgatcaatttcggcttccaatttccgcatgatttcaaacttggcagtggtcgttacagcaaagtgtacaaaggattttaccgcgaagcaaatcgttattttgcaatcaaaattaccgacttggaagccgtttctgacagattcaagcataagtttgtgccccgtgaactcaaagtctggcgcgagttgagtcacccgaaccacgtccgtttgtacaaggatttcatgaagaatgactttctgttcgagatcatcgacttggctgttggcggtgatatggtgggtcaaagttaaagtttggtgcgttgtccataccttctttcagctcaattatttgcggaacca

SEQ ID NO: 87269 - DNA, 603 bp, Heterodera glycines
  SCN-specific regions: Sequence locations=1-603
ttattgcgcctaattttatttgtgacgtcggcatttgtacatattacgacagttcgtcgtcgactgctgcgtattattatttgttgtcttcaccacacactcgtcaagctgctggttgagcgcaatgtccaagagacggcttcgacaggaactccaggacatggtgaagaacccattgcctgatggatgcactgcacggccacttgatcaacggaccatgaacagctggacggtaaccatccgaggccgggccggcacaccgtacgcaaacggcaacttccaactgagcatggcatttccgagggactacccgttcaaagcgccgcaagtcacgttcaccacgcgcatcttccacccgaacatcgacacacggggcaaagtgtgtctggacattctgcaaacgcactgggcaccgacgctgaccatcgaaaaagttgtgatctccatcatcgttctgctgaatgacccgaacccggacaactcgcctatcaatgcgcaagctgccagtttgtaccggactgaccgtgcggagttcaacagacgcgcccgtgagatgacgctcgcctatgcacgatgagatgatcagcacgtctttctgattcc

SEQ ID NO: 87270 - DNA, 664 bp, Heterodera glycines
  SCN-specific regions: Sequence locations=1-388,410-664
tgaacaccttccgtctatctcgatatttggcaacttctgcgttttccaaagctcgctatggtttccggccttccggtggagcaggacaatatgcatttcgctttaaagaagcttttgctgcgcgtcaggttgcgccggctcttcgtgaacgccttctcggccctaccactggcaaaccatttatcgtcggaacttacgcacttgccggggcttcagtttttggcattggaatgttgtgctactacggacttaccacgactgtcgacagcgctgctgttcgttccaatttatggcctgattatgttcgtcagagacttcagtcgacctacgcttatttggctggtagccttgccttgactgcgggtgctggagtggctgctgcccgtagtcctggaattttggctcttaccagcgctccatcacttctggtttggtttggttctctcgctgctattattggttctggtatcgttgttcaaaaaatcgactaccatggcaactcggctgccgaacatttggcttggttggctcattgtggcattcttggtgcagttgtggctcccctttgttttgttggtggacccgcccttatgcgagccgtttggtgtacggctggacttgttggacgtctatccgccactgcgatctgcgctccatctgacaa

SEQ ID NO: 87271 - DNA, 576 bp, Heterodera glycines
  SCN-specific regions: Sequence locations=1-576
caatttgagcaccgtatgtcacccgacagtgtccgatcgctggaggtcaacggcgatgtggtgttgcaccgtgtcaatttggtgaacatggcgcaaccagcgtccgcaccagcaccaacattgcaaccgatggctccggcaccacagtttggccaaccgatgtatccgttttcgccttcccaaccatttggctatgcggcaccgcctccggatgttggcttttcgccttccattggcggcggtcattatccctcaatgccaccgtatccatccgcttcagtgccgcagccgaatgctcctgccgacgcatcacaatggcaccagccagattatggcacgcccaagccaaatgctacatatccgccatatggccaccattgagatgctgtgccaaaatgaaacgggcaatggatgaattttaccgtgataaaaaatgagtgtggggaaattagagtccgtaatttttaaaaatcggggatgggattgggtatcaggccgggatgtgatttaaaatccaatttttgtccgggaaaatccacacgtcctatcccatccgggccctattactcataattg

SEQ ID NO: 87272 - DNA, 506 bp, Heterodera glycines
  SCN-specific regions: Sequence locations=1-506
attctcaaaagcgtcgttccataacgtcacacacatcataaccctcatgaccactccagcaaacgcggcgagggcccggagtgccaaggcgaagctgcgcgatgccaagcggaggagggtttcagttggacgcgcaggatacacaagaaaagcgcagcggggcgagctagtgccatttgtatgaccaacgtgatcgccatcacgcggacgacgctcggctgcacccatccgttccatcgccgctgcttgtatcgctggatccgctaccacaccaattgccccgtgtgccgctacaacttcgcccgcaccattccgcgcggtgagcgtaaccaaccgctgtaagatgccatgtgttgtgatcgccgtacgatgtcatttgtgtgatcatatttgtatcccattgttcggttatgcgtatgtctttgtacaatggaatgtatgttcttatatgtactctgtatgtacagtatgtataatactcgtcagtaaaatactctccttaaagg

SEQ ID NO: 87273 - DNA, 630 bp, Heterodera glycines
  misc_feature (433)..(433): n is a, c, g, or t
  SCN-specific regions: Sequence locations=1-34,57-353,376-630
taataaataagtttttttgttcaaaatgagcaactttatatttgtttcctttttaactgcagcgttttttagctcaggcctcgctctaccggctccttatgatgctgaatcggtggtatcttttgttttaaatgttccactactttcagctgacgcaaatgttgaagcatctcctcccaatgaaagtgatgctgtttttgagatacaagctccatcaattccggtaccaattgaacatcaaactgctgctgacattactcatccaactgaaactggcaatgagtcttctattgcatcatcatcatccacgccgaaaagtgagcagacgccaaaaaaagtgatgaacatgaaaagcgcgctggaaggcgcggcggccaacgtgtacggggggcttccgttagacaagcagcccaagacgatcgctgaagcggcngcaaaagcaaagcagacgcccgccaaacttccggctgactacgacgtgaaccgcgtggcggaacgcgcagcagcccgtgtgtacgggtggcttccggaagacaagcagcctaaggcgatctatgacgcggcggagaatgcaaagaacacgcccaaaccgccgggcgactacgacgtggagcgcgtggcgcaaaatgc

SEQ ID NO: 87274 - DNA, 530 bp, Heterodera glycines
  SCN-specific regions: Sequence locations=1-3,26-330,352-368,390-530
taatcttctctgtttctctctacatatcccaaaattgttccccaatgctgcaagctcatcagtaccaacttcggcaaggtcatcgtcgcgtttctgctcgcagcattttggcccatttcggtttcgaattctcgaacgactaccgacttggctgcggacattacagtaaagtgtacaaaggctatttcaaggaagcgcaacgcacttttgccatcaaagtcaccgacttggaaagcgtttccgagaagttcaagcaaaagtttctgccacgtgagctggaagtttggcgggaattggaccacccgaacctcgtctatttgtacaaagatttccagtggaacaattatcagttcgcagtgatggaattggttgttggtggtgacttgctttcgttcctccaaaaatgtggccacgtcagcgaaacgacctgtcacaattggatgctccaaattgttgctgctttggattatctccaccgtaagggaatcgctcatcgcgatctgaagctggaaaacgtccttctttgtgaa

SEQ ID NO: 87275 - DNA, 137 bp, Heterodera glycines
  SCN-specific regions: Sequence locations=1-137
gcgacgggtggggcggaagcgatagggcgaaccggtgctcagggaggaaatgccgccggattggtgccatcgcatgtgaccaatcgctcactggctccaccacctcctactgtgcaattggaaatgggggcaaatcg

SEQ ID NO: 87276 - DNA, 670 bp, Heterodera glycines
  SCN-specific regions: Sequence locations=1-670
ttttctccctatactttccggtcactttgttgctgcaaatgtcttcagcacaaattcttttgtgtgccatgtttcttctgctgttggtcgtttgtgccatcattctttggatcctttttgaccatgtcaaaaaacgactacgccctcacaaagaaatctttatctgtggcgattgttggcttttggtgttcgattttcttgcgccttctcaactcggccttgaaattgcgctggtcaaccgccgctttaactgcatcgtcgacgaacacttcaaaacgcgcaaatggaaattgggcggaatacgaatttgccacaaaattggagagaatggcaccaatcaaatgcaaattgtcaattccgatggaaatccattgccaatcccgcaaaatccgttgtcgaacaaagtcatcggattccgaggcattcagatcaattacatcgaccaaaatgccgtcgcttttctccgccgttttcgccgtattttcgccttttcttcaatatacttggtcatcactgaaaatgtttgcgtttcggaatttgttttgctcaacgttttgccaatgctccgcgactccattgttgtgatgatgttgaatactatcgcttttcgccgtttccgccaattggccccgtcaatgctcaacgattgtccatctcttcacactgtcat

SEQ ID NO: 87277 - DNA, 670 bp, Heterodera glycines
  SCN-specific regions: Sequence locations=1-131,154-670
ataaaatgcttaatttccccgtcaaattatcgccatttttcttgtttcattctcagtttcgccatatttttctacgacctctttcctcttctgttaaatcggcgaacaaattccgaaaagatgttaggataacaactgaaaaggacaaaaacaacatcaccagcggttctgccacttcttctccctctgatgataattttgcacattttgttggcgctcgtctctctttgaccgtcgacccaaaatttgctgctgtcgaacttatttcacgcgacagttttgacgggacttcttcaaaaccgcttcgaattccgttggtttggcttcgcgatcactgccgaagcaatgcgtcatataattcacgcacaaatcagcgccggtccgactgcacaaatttatttgccggagcaactcttgcggatgattgttatccaatccattttgacgccgacaggcaaaggctgacattgagttgggctgatggacatgaaagtgcatttggagtccgggaactgctcagttgggcaatgttctcacaaaagcattatggcgaagaatgggaggccggcgcggaatgtccgtcgcgttcgctttgggacgccagaaggttgcgtgaagtgccctccgtgtccagttcagaattcgacttcgctctattcgctcgtctttt

SEQ ID NO: 87278 - DNA, 647 bp, Heterodera glycines
  SCN-specific regions: Sequence locations=1-188,218-329,359-647
ataataagggcaatttcagaataaatgtaaaaaaattgctacaaatttctggaaaaaaatttttctcattcagtacaaaagtctatgattcttaagttatagctaataaaaacatataacttatttgttaacataaacaaatagcgatttcaaaaaattaataattattctgttctgagatttatttgtttgtttttcatgaaaaattttcaaatttatgtaaagcaacaaatttatttcgatatggcgccaaaaacgaataaaacgataatttaaaattgtataagtttaaaagcaaattattttaccgatgaatttaatttattcgcatttaatcaaaaaataaaattttaatattcccataaacataaaacagaacaaaaattcataccaaaagcatatgtactgcaaacaaaaaaccagctcggcaccccttttaaggccatagccatcgcaaaagtgttttcttctggccaatgccttcccccgccgaatttatcgtttccatcgcttccgctgccttttccctcatcatttcgtcaaatttcttttgaatttccttttgtttgaccttttccgcctttttttgtccaattgtttttccattttttaatttgtcccatttcttcggcttctttgatttgttg

SEQ ID NO: 87279 - DNA, 704 bp, Heterodera glycines
  SCN-specific regions: Sequence locations=1-317,339-424,446-704
aggcgatgcaggcttcttctcggagtgcgtgtcctcgtggaaaaaaggcgccggtcgagaagagaaccaagcgatgctgagccggtcactcttgaccttgtgcagttgagaacgcagaccattttcattcagcagacggtcacaatcaaaactcattctcaactgatccttttgtttcaaattgagcacggtctcttcacggggttcacctcccatccgcacctcgtccaaattttgaattcgtccgtccatttccaagccgggccccgcgtcagtttctccgccgttcattttgtgctttccaatctgacgaaggaagaagcaatcgtttacactgtcgctttgatcgaacccgacaatccgtactcccccaccgatttggctccaattgcaatcactgccaattatcaccagctcactctcgggcagttaattgcactgcccgacaatttggactttgtcagtacgagtgccgaaatggattccctcgactctttattgaaacgcgcgccacggcaccgtcgaagcaaaaagcaccgacggagcagaggacatcaccacgccgaacaccagcatcaacgggggggatgtgttcggagggggaagccgaccaaaatggacaatttgcttcatctggaccccacgcgaagtcatttctgacgcgactcgattctgcgcattcgccgggctctccaaattcgcgg

SEQ ID NO: 87280 - DNA, 683 bp, Heterodera glycines
  SCN-specific regions: Sequence locations=1-683
caccgcgggttgctgctgcccccgtcgctgttgaatttagtcaacccatatgcgatcaccgccgccattcccaccgagcggcgctgaccaacaatcgccatccaatcagcagacattttttgtctcttctgccgcacagtcactcaacgcgggcaaacagccggacaaaatgcctttcttacacaaattctacgaatattacacgttgggatgcatcagcatgcgcactgagagtttggcattgtgtgtggctgtccaatttctgctgaccaatgccttccttatttggctgtctctgcagggatggcacccgtattggcgtttggcactgccggcggtgttcaacgcgggcgcttcgctgtcactgatttacgcctggtgggcggacaagtccagctacagcttgctgttcctcattgtcaatggtttgtccatttgcgcgttggcactttctctctttgcgttgctcctcgccgagacggacccggctctgctgaagcagttgatcaacaacaacgacgagacggagacggaacagcaccagtgggacaattacgcatatgaagaaaaaacagtggtgaagacgaaggacggctctgagcatgagcacgtgcgccaaaatacaattgcgactgcgtggcgccactacgctcggcggttggagctgagcggttggctgcgcg

SEQ ID NO: 87281 - DNA, 281 bp, Heterodera glycines
  SCN-specific regions: Sequence locations=1-117,139-201,223-281
aggagacggggccgttaagacaacaggagggcaaactgctgattgccgacttggacaagaagcagcgaaaaagagggaacaccaaaagggacgccattcctaagaaaggggcgaaacggagaaagggaggagaggaggcaaagcatgacgaagatggagggggaaggaacagcgatggtgagtcatccgccggtggaagtcaatgaacgaacaaacgaagaaccatcattgcgcttttgttgttgttatgtttattaaggaacaaataaatttataacaca

SEQ ID NO: 87282 - DNA, 472 bp, Heterodera glycines
  SCN-specific regions: Sequence locations=1-196,218-327,349-368,429-472
agcgttatttgatggacacgaaccgtgctggcacattgataggcgaggatcagtttggcaaccggtacttcgaagacacacttatttcgtgccccggaatcgctacgtcgtctacgccgagagggtttggctcgactacgacgcctcgcaaatcccgcccgaatggcaccgctggttgcaccacatttgcgacaaaccgccgaccgttgagccgccgccggagcgcaagaaatggatgttggaacatgagccgaacaattcgattgtaatgagcaaaaaatacgtgccctattcgaccacacgcccaaaagtggagggatgggtgccggggaggaagagaagcgaagaggggacgcactgagtgagggcgaaggaatgggacgaatgatcgacggacggacaaaagacaaacggacgaacgaacgcaccaccaacccattcagttgtaatatttgtgagaggacaaggaata

SEQ ID NO: 87283 - DNA, 561 bp, Heterodera glycines
  misc_feature (29)..(29): n is a, c, g, or t
  SCN-specific regions: Sequence locations=1-561
aggcattgaccgatgcgctcatcgctggnacacgttaatctaaacagaaaacgctggtgtccaaagttgagcgttcagaaacgaccggcaaactgactgtccatatgacggacgaaagcaaattggaggatgtagacaaactgatttgggcaattggacgtgacccgttgacagctgagctgaacttggccgatgttggggtcaagctaatagctggcgactacatcaaagtggacgattaccaaaacacgaccaaggagggcatttacgcggttggcgacgtctgcacaccgaaattcgaactgacgccagttgcaattgccgctggtcgccgtttggcccatcgtttgttcaacaaggaagcggagaaccgtctcacctacgaaaacattcccactgttgtgtttagtcatccgccgcttgccacaacgggcctcagtgaaaaggaggcagtggagcgcttcgggcgtgaccaggtgaagacgtacaatgccggcttcacgaacatgtactttgccatgactcaacacaaagagaaaacccacatgaaaatcgtgtgcc

SEQ ID NO: 87284 - DNA, 487 bp, Heterodera glycines
  SCN-specific regions: Sequence locations=1-413,436-487
tgaagggaatttacggacatttgacgggcttcagacaaaggaggggcgtgccggaatggggccttcttcatgaagcagaaaatcacaacgcttgcggcacttttgctctttttcatgctctgacgaataacaccgaccgaattgacattggaaacggcgtcttctatgattggtttaaggcggcaaaacaactcaatgttgaacaacgctcggaccttttggcaaacgattcggagttggctcatttgcatgaacactgtgctttgagggaatcggagacagatgtcccaaggaatgttgctcaccacttcatctcatactttacacatggaggacgtcttttcgaatttgactcgggacaggaatttccgcgcgactgtggaccttccagcgaggagactcttttaactgatgctgggaagatttgcaaagagctaatgggccaattggaggacatttcatgcaatgcaattgcactctgtgccaa

SEQ ID NO: 87285 - DNA, 621 bp, Heterodera glycines
  SCN-specific regions: Sequence locations=1-453,476-621
gattagtatttgagttgtcttaattttaaaatgacgaagaaacaagtcaccatcgttggttctggaaattggggcacggcaattgctcgaattgtgggcaaaacagtgcaaatgcataactcagaatttgatgactcggcggtcaaaatgtgggtctttgaagaggtggttgaaggacgcaaacttagcgaaattatcaacgagaaacacgaaaatgtgaaatatttgcccggaaagaaacttcccactaatgttatcgctgtcactgatgttgtcgaggcttcaaaaaacgcggatgttctcattttcatcatccctcaccaattcttgcacaaagtttgcgaacagctcaaaggaaacatcaaaaagagcgcaatcgcaatttcgctgattaagggcttggccacttttcacgaaaaagacattgggctgcgactgatctctaatgaaatcgcgacctctcttggcattgacacttccgtgctaatgggtgctaatctcgcgaacgaagtggcagaagaccacttttgtgaagcaactattggaaccaaaaacccacagcatggaaatgaattgaagaagttgtttcacaccgacaatttccgaataaatgtggtcgaa

SEQ ID NO: 87286 - DNA, 364 bp, Heterodera glycines
  SCN-specific regions: Sequence locations=1-18,42-309
tcgactcgaaaaacttgaaatttttgctttccaaatacctcccaaaaatgtttgccccaaaatttttgcttgctttactggtctgtgttgcttttgccattggaacaaagcatggaaaaacggcacgcaaaatggcaaagaacaatgtggcaaaggacgagctcgaacaggctttctccccattggtgcccgttgaacttgcgcagaagaagttcgagcgtcgcattgaccagatggagaagcagctttcagaagtgatcaacagtgttcgtggagactgcatgccgaagaaaggagatgacgaagaggaagaagaagaagaaaaaaagtgaagatggaaaaaaaaaaaaaaaaaaaaaaaaaa

SEQ ID NO: 87287 - DNA, 372 bp, Heterodera glycines
  SCN-specific regions: Sequence locations=1-372
gtgagatgagtgtgctcgcagtctcggcttcgtccgtgccatgttcgaaattgccgcttccgccgcttcccatgccggtgccaacgccgatttggctgtccagttccgagaacaagttggcacaattgacagcaattgtgccgcgttgggcattcatgttgggcaaatcagcttggatgcccccaggggagaccatccgcaagtgcatgactctgagagtgtgcttagtaaccctggcaccagcgggtctcacaagcgcttttaagtgaatttcgtagattcgatgatgtcatcatttgttgattgatatgcaatagaaattatcttattcgaaaataattattcatctcttttattaaatgaatgtgatgc

SEQ ID NO: 87288 - DNA, 628 bp, Heterodera glycines
  SCN-specific regions: Sequence locations=1-459,482-628
ttattgacctgtttttggagacggaacagaacgaacagcagcagctgacggagcaatgccaaaacgagggcgaagcaatgctaagcaaaacggcacttcagagagtagcaaagcggtgcactttggaagagattacgtcgcagcttttgatgtttctgcttgccggcttcgacacaagcgcaaatacgctgagtttggtttgccacgcgttggcccttcacgcggaagtgcaagagaaagtccaagaggaaattgactcggtgtgcttcgacgaggacccaacttatgagcagctgagccaattgaaatacaccgaagcggtggtcaaagaaacgctgcgccttttgcccattgcgacgaatgttatgaatcgaacgtgctgccaaaccacgacattgggcgacataaccgtggagaagggcaccgtcgtgatgtgcgatattctttcgctgcaccacgacaaaaccgtgtggggagaggacgcggacgaatttcgaccagaaaggtggctcgaagcagggcatcaattgccgccgttttacgcgttcggcggcggtccgcgcatttgcattggcatgcgattcgcaatgattgaggagaaattggcattggtccgaattttgcgcaa

SEQ ID NO: 87289 - DNA, 259 bp, Heterodera glycines
  SCN-specific regions: Sequence locations=1-151,174-194,255-259
cgctcctccgaagcaccaaagctatgacgattgaggcatcgatgttcgatatgggcttgggttgtgtggcatggtgggaaccgcagtgcgcaagtgaattgaaacaggaagcaaatgatccaagcgaagatgaatagtaacaaacgaattgaagattttgttattgttttatttgttctaacggattcttttttaaaaaaaaaaaaaaaaaaaaaaaaaaaaaaacaaaaaaaaaaaaaaaaaaaaaaaaaaaagtcct

SEQ ID NO: 87290 - DNA, 621 bp, Heterodera glycines
  SCN-specific regions: Sequence locations=1-621
tcaaattggagagtatgtgcgtgacctttgcgcaggtttacggcactttggcactgacaatgctttctgcaatccttggcattgtggtcaacgcggtgatggacttctcgtcgttgctgccaatcttttcgctgatggaactcggcttcttgatcgcccttatggtcaccaatccgtcgcaccaaaatgagaacaaacgtttgggcttcatgtacgcttttgcctttttgtttggctgtgaggttggcccgttgattgagtatgtgggcatcgatgatccgaccattgtattcaacgcgatcttcgtcaccatgctcgtcttcggctccttcaccatgtccgcgttgtacgccgattcgaccaaataccttcacttgggaggtatcctctcatctgcactgttttgcatgctgatcgtcctgcttttcgccccgtacactccgttcgtccgctcgttcatgctctgggccgggttggcgatcaattcggcatttgtgctctacgacactcagctgattgtggagagatgccgccgtggtgacaacgattacatttggcacacggtcatgctgttccaagaccttgcctacatcttccgctacgtgctcattcttttgaagg

SEQ ID NO: 87291 - DNA, 268 bp, Heterodera glycines
  misc_feature (206)..(207): n is a, c, g, or t
  misc_feature (233)..(234): n is a, c, g, or t
  misc_feature (254)..(254): n is a, c, g, or t
  SCN-specific regions: Sequence locations=1-268
gtgattgcagtgcgcgggagattcggcagggttgtggcagagttacgtcacaagatccgcattcagttcgcaaatgttgaacaactcacaaaacatcgaggaattgcggcataacactgagggctttgccaaagcgcttggcttttcgtcgactgcgcaccaccgaatttcttccaaaatggccgggagtccccaaactgtccgcnngtctttgtcgacgaaaactttccagnngcgctttcgtcccgtgtttnttctcccgactcga

SEQ ID NO: 87292 - DNA, 537 bp, Heterodera glycines
  misc_feature (27)..(27): n is a, c, g, or t
  misc_feature (487)..(487): n is a, c, g, or t
  SCN-specific regions: Sequence locations=1-537
ggaagctgcagaacaaaatggccaagncttcagaagcttggctcaacaaagtgccaaggggcttcagagcctgttcaacaaaatgccaaagcatcagagcctgcaatccagcaacaaaaggccaatgcgcaacaaaatgccaaagcatcagagcctgcaatccagcaacaaaaggccaatgcgcaacaaaatgccaaagcatcagagcctgcaatccagcaacaaaatgccaaagcatccgaagctgcagaacaaaatgccaaagcttcagagcttgctcaacaaagtgccaaggcttcagagcctgttcaacaaaatgccaaagcatcagagcctgcaatccagcaacaaaatgccaatgcacaacaaaatgccaaaatggagaacataacttcaaaagatgcgccaaatgtcaaaagtgataacagcattaacaaacagtctatgaatggctctgatacaaatgagaaaaatgccatggaaacanaatttgttgtgccaagctctattgagtcacgggttattgagcctgttcga

SEQ ID NO: 87293 - DNA, 532 bp, Heterodera glycines
  SCN-specific regions: Sequence locations=1-211,233-348,371-467,489-532
gcctttccttattctattattttattagatttaccacaaatggctaaaataaaaataaagtggggtaccaaagaacttaatgttgacgccaatcccgaagaacctcccctattgctcaaggcgcaactattcgggttgacaaatgttccacctgaacgacaaaagttgatagttaagggcaagacgatatctgacgaagcatggaacggaatcaaaataaaagatggaactgttataatgcttattggaagcactgaatcgatgttgataaaggcagaaaatgctgagtcgtccggccatacaaattcgacagagacggaaccgcgccaacagttccccattggtctacgaaatttgggcaacacttgttacatgaactcgagtttgcagtgtttgaagattgtgccggaatttgaaaccgccttgaagcaatacaatcccaaccaatctgttgacgggtcgaaccaacgcataaaactcttcaccaattctatgaagaagctctacaacgagatgaatgttttggcgaagg

SEQ ID NO: 87294 - DNA, 514 bp, Heterodera glycines
  SCN-specific regions: Sequence locations=1-514
gatgtaaacgccgaactcccgccggacttcgaatggtatcaaaatcaaatagcgggtcatcttccctctgttatacgtaatggcgtaaggcaaattggcattttgcacgaacgtggccgaaccgatgtaattctgaagttggttcaggagggaattcgcggccaacgtgagataggattttaccgacggatcgcagcaatttgtgagggccaagggatcaattgcgaagaaacggacgaagtggagggcacactgctgaaggagttggccatgttcatcccccgattttacggatgccgacagattttattggacgaaaatggtccaccgaaggaattcattcaattggaagatgtcactgagaaattcaaatgcccctgcataatggatgtaaagatgggccgcgtttcggccgacccattggccagtgaggagaaaagaatggccgaagaagtgaagtcgccgttgcagaagaaaattggatttcgtatactcgggcacagagtacaaaatg

SEQ ID NO: 87295 - DNA, 548 bp, Heterodera glycines
  SCN-specific regions: Sequence locations=1-397,419-458,480-548
attatggaacgttgtcgtagctgtaactgtgccgttgaattgggtgcctcccccgatgttctgatggtgttcagttgtcccgattgtcgtcttaagttttgtcgtttgtgtgacgagccatggcaagacgaacacaagggcgtcagctgcgagcagttcgccaagaaacagaaccgcgaacgattgttggaaaagcgtctgtctgaagctgtggtgcactgttgtgccaagtgcaaaatgtccttcgtgaagcatgacggttgtaacaaagtcacttgcccttgtggcgccactcattgttacatttgtcgtcaaaataatattacatacgcccacttctgcgcttgtttgcaagaaaaagctccgaaacatccgttcaaatgtgcgaagtgtggcaaaagctgtcttttgtggcaaaacagcgtaacggtggagaaacaacagatggacaacattcggaaggagatggtggaggaggaaaaacgggagaaggcgaagcaaaaacgtcccaccaccggcaacactccgaatgcgaacaaaaagaaatt

SEQ ID NO: 87296 - DNA, 344 bp, Heterodera glycines
  SCN-specific regions: Sequence locations=1-270,292-320
agtttgagcaagattgtgaaagaatggctgcgcacaaaacatttatcatcaaacgaaagttggccaagggctgccaaacaaaatcgtccgcttccccactgggctcgaatgaagacgggcaatcgcattcgctacaacgcaaagcgtcgtcactggcgcagaaccaaactgaagttgtgagcgatggacgccgagaaaggaaaagcgaaaacatcggaagacggcggacggacgatgattttcgacttttttgtttgttcatggagttaattttcatacatttttgtgtggactattgttggtaaaattgttgaatttgcaaaaaaaaaaaaaaaaaaaaaaaa

SEQ ID NO: 87297 - DNA, 624 bp, Heterodera glycines
  SCN-specific regions: Sequence locations=1-354,380-624
attttttttgttgccgaaatgagcacggaacgctattccttctctctaccaccttcagtccctcggggaagttgatgcaaattgagtatgcgttgaatgccgtcaagggcagtgcgccatctgttggcacccgagcaaaagattgcgttgtgttcgccaccgaaaacaaacactccgtcctcacacagcccgtcagcaaaatctccaagttgtccgaccatattgcatgcgtgtacagtgggatgggcccggatgcacaacttctcgtgaagaaagcgcggaaaattgcgatggattaccaagtgctgtacggctatgaaattcccgtgcctcaactcgtttcccgggtggctgcggtcatgcaggaatacacacagtcgggtggtgttcgtccgtttggcgtttcattgctcattggcggatgggacagtgaaaagggggcgcttctttttcaagccgatccggcgggttcctattttgggtggaaaagcacggcgatcggcaaaaacgaccaattggccaagaaattgttggagaagcggtacaatgaagacattgagaaggtggacgcgatacacatggctctgcttgcaatgcgcgagacttacgacgttgccatgactg

SEQ ID NO: 87298 - DNA, 673 bp, Heterodera glycines
  SCN-specific regions: Sequence locations=1-16,38-395,425-433,455-673
tttcttttgccctttgtgacacacaaataaattgaaaaaattggtgagacctgtgctgattgaacccaaaatgaaccgccgacgttggatttgtggtgacgtttggatggacattctgccatcttttgaccatgctcaacttggcctcaaaatggcattgctttccgaccgtttcgatgttttggtggacaaacatttcgatggcaaaacgacgggattcacaatttggagacgtatcagaattcgcaaggacaaaggaccaaaagcaaaagtgtctgtgcggatcgatggcaaatttgtggattttccatttcctgacaatccgctgcccaacaaaattcgctttaagaaccttcagattcgctacattaactattccgtgatcaaatttctccgttccaacaagccaatttgggacagaaatggcaccaaattggaagtgtttgtgcctttatatatgaccgacgtcaagctcatttgggatgtttttacccgcgaaatttggcctatttttgcgaaaagcattcgtcatttgagctttcataatgccgatgctttggacaatttgcgtcgtcgcacttcaccaacgattctcaccgattccattcaattgaattcaatctgttcctatggtctgttccccgatggaattgctgacgatggaccaaatgca

SEQ ID NO: 87299 - DNA, 517 bp, Heterodera glycines
  SCN-specific regions: Sequence locations=1-384,406-517
ggacggaagtgcgacgagtgatacgcgacagcgaatgcgccgattcggaaagacatatttgtgctcatattctcgactgtgcatagatgccaagttgcgttgcaacggcgaagacaattgtggcgaaaacgacgacagtgacgaggcgcattgctcccgaattgaggccctcgcctctcccaccacaattgtcgtcgcttacatcgtttcgggcatcattttcttcttcattttgtctctgttctgttttctgttcaagtcaaagctcgaaaagaaaaataacgcaaaaggggaagagaaacgaagtcggagagagagggaaaagcggaagagagcgcagagaaagcggagggaggggcgaaagagtgggcggaaggcggagggcgaagcgcagagacagacagcgcgacaacccagcagacagccgaggccacgcagaacggtggcggacggacacaaattgtccggcatttacggaggcgtgggcggcactcagtcggtgttcggcagaagaggg

SEQ ID NO: 87300 - DNA, 523 bp, Heterodera glycines
  misc_feature (472)..(472): n is a, c, g, or t
  SCN-specific regions: Sequence locations=1-251,273-318,341-523
ccagtttgagaaattcctctaaacatggcattattgtccattttttgtctgttgttggcactttgccccgttttgtccattaattccaccggccatttccttcacatcaccgacgtacacattgacccgaattatgacctcagcggagacccccaaaaatggtgccatgggagcggcgacagcagaaacaaatcgccaaagttgggagtgttcggcgaccacaactgcgactcgccaatggcattgttagaatttatgttgaaagaagcaaaggccaaagtaccaaatccaaacttgatcatttggacaggcgactcactgccacacgacaaatacgacaaaaaggtgttatttgacatattgcaaaaggtgaccaatgcgataagtgcccaattccccgacgccgttcttctgcccgtgctgggcaaccacgactcggcacctggcaattcgttcactgaccatcccgcanaacagcaaatttacgagaaaatgttcataatatggaagcaatggattggcc

SEQ ID NO: 87301 - DNA, 577 bp, Heterodera glycines
  SCN-specific regions: Sequence locations=1-234,257-577
gtggcgttttgtgctaaacgaacagaagaaattcccggatgcaaccggcgacctgaccactcttctgaccagtctgttgaccgctgtcaaagcgatctcttcggctgtccgcaaggcgggattggcacaattgtacggagttgcgggaaatgtaaatgtgcaaggggaagacgtgaagaaattggatgtgctgagcaacgaactgatgattaacatgttgaagtcgtcatacaccgtttccactttggtttctgaagagaacgaacaggtcattgaggtggaagtgagcggcacccaaggcaaatacatcgccacgttcgacccgctggacgggtcatcgaacatcgactgtttggtgtccatcggaaccatcttcggcatcttcagaaaggcgagcaacacttccaccaaggaggaggacactctgcagacaggacggaaaatggtagctgcggggtacgcattgtacgggtcggccactatggtggtgctgtcgaccccgggccgtgtcgatgggttcactttggacccgagcattggcgaatttattctcacaaatccggcgatgcgagtgccg

SEQ ID NO: 87302 - DNA, 398 bp, Heterodera glycines
  SCN-specific regions: Sequence locations=1-50,72-178,200-398
agccggcgtccgggctgagctggaacgcgactataccttttaaggagggcatcaaaccgatgtgggaggacaaaggcaatttggacggtggtcgttggcttgtgctggtggacaaacagaagcgccagaccaagttggacatgtactggcaggagatgatgatgtgcatgattggggaacagtttgagaaatggagtgaccacatttgcggtgcggtggtcaacattcgtcaaaagggtgacaaagtttcgttgtggacgcgcgacgcgaaggatgacagcgccaacatgcaaattgggcacattctgaatgccaaactgaacattccggacaccgaaaatttgcgctacgaagtgcacgcggagtactcggcacgcacgggcagtgcggtgaaatcg

SEQ ID NO: 87303 - DNA, 617 bp, Heterodera glycines
  SCN-specific regions: Sequence locations=1-617
atttccctatttgtaccagtacatttattgtgcctaattttatttgtgacgtcggcatttgtacatattacgacagttcgtcgtcgactgctgcatattattatttgttgtcttcatcacacactcgtcaagctgctggttgagcgcaatgtccaagagacggcttcgacaggaactcaaggacatggagaagaacccattgcctgagggatgcactgcacggccacttgatcaacggaccatgaccccctggacggttaccatccgaggccgggccggcacaccgtacgaaaacggcaacttccaactgagcatggcatttccgagggactacccgttcaaagcgccgcaagtcacgttcaccacgcgcatcttccacccgaacatcgacacacggggcaaagtgtgtctggacattctgcaaacgcactgggcaccgacgctgaccatcgaaaaagttgtgatctccatcatcgttctgctgaatgacccgaacccggacaactcgcctatcaatgcgcaagctgccagtttgtaccggactgaccgtgcggagttcaacagacgcgcccgtgagatgacgctcgcctatgcatggaggagatgatcagcacgtc

SEQ ID NO: 87304 - DNA, 576 bp, Heterodera glycines
  SCN-specific regions: Sequence locations=1-452,486-576
acaagaaaatctttcgtccatcgattgacagatcagctgggaaggaggacattgtgataatttcgccatttttttaccgattggaaataattaaatgtttgaacaggattattgcgatgtgatcaatcacttccccgcccccttctgtttgctcgctttctttcttcgggtttcctcttattcgagtttgtaagtgatctgctcgaattgttcccacggtttctcccaaatcgttaccaaaaaagtctgaaaaattagctaatttacagtaatgatttgcacagtgtcacctttcgcgctgtctgatcatcctccgttgcacagtttgcgtggtcagccaagtttgactgcttcgaggggattaatcatccttttttgattattccattaaataatcctttcccattcccttaatgggccggccgttcattctttttgagaaaaattttaggttttaaatataaaaaataaaaatatttattattggaagggaactgctgaacttgggttgctgaatttgccctttcacttacattcttcgaacagttcgaccttccgaccttaatgcgcaattgg

SEQ ID NO: 87305 - DNA, 597 bp, Heterodera glycines
  SCN-specific regions: Sequence locations=1-597
cactgaattttggcgatggcagtggcttttgcgctttgaaaacgctgattctgcaggacaatccgatcagtcggtgggaatcgctggacggattggcccgtctccccgctttggccaaactcattctccgaggcgctccgctgcccggcgcccgcggcgcggacagtcgcgagatgatcatcgccaaactgccccaaattactgatttggaccgttgcgatgtgtcgccggtggcacgacgttccgccgaattgctttttttgagccgattcggtgccgaccccgtcccggccgaacaccgcgcggcgatcgcacggctggcgaccatttactccatttcaaatgatggcgacccctccagcgccgtttccgtccctcgccctgcccagcccttctccaccattcactccaaaaaggtccgacttgagcacgcgggtcgcagcatggagcgcagtctgtcccttgcgctgcccatccacaaagtcgtcggtttgggcgcccgactgttcggttttgctcccgacacattaacaggggtcgaacttcgacgagcggaccccgcgtatccgtccgaattgctttgtcgcaccagggaca

SEQ ID NO: 87306 - DNA, 360 bp, Heterodera glycines
  SCN-specific regions: Sequence locations=1-53,80-337
attctctctctctctctccctcttttaatgtcttttccaattacaacaggtgagtgtttgtgtttgtttgttgttctctgacctgactgtgactgacataatttattttttcttttctctccctctatttttcaatttttgctctttttctctgtctctgtactattttcataatttacgtgcgctctctccccccttactcttccttttgcatttacacaaaattcaagttgtgatcactttttatgtgttctctatcacacaagccttctcctcaatatagaagatttttacatcaagctaagaaaagccatttttcaaaatttgaggtcaaattaaaaaaaaaaaaaaaaaaaaaaa

SEQ ID NO: 87307 - DNA, 529 bp, Heterodera glycines
  misc_feature (425)..(425): n is a, c, g, or t
  misc_feature (472)..(472): n is a, c, g, or t
  SCN-specific regions: Sequence locations=1-480,502-529
gattctttagaatagaatttttagttttgaaaatgtccaaggagctgaaaattacaagagaagacgagcttcttctccaggacttttcatccgctgtttcgaaaaagggcactttgattttctatgggatttccgcatttgtcggcctaacacctgtttatctcttttatggagcacatcaaatggaaattgccgattcgtggttcatttggcttgctgctgcaattggcgtggcttaccttttagcccagtcttacaagaacatgaagcatgtgttgaagcatcaaatcgtaattaaacgtggtgacgccattgcccgtgagatgaaccgaattctgtcggatgacaaaaagatgtccaagaaggaaaaggacgaacgcattttgtggaaaaagaacgaagtgggcgactacgaggcgactctntttgccattttctacaacaatttgctctttttcgtgctgctcgtctntctctcattcttcattctctactccatttcgcccatcttcaactgtcttgtctcgat

SEQ ID NO: 87308 - DNA, 483 bp, Heterodera glycines
  SCN-specific regions: Sequence locations=1-107,145-157,180-483
attccttctctcattcttctccctatattttccggtcatttgttgctgcaaatgtcttcagaaattctttggtctaccgtgactcttctgttggtcgattgtgccaccattcttttttggttctttttggacaatgccaaaaaacgacgacgccctcacaaaaaagaaatctttatctgcggcgattgttggcttttggtgttcgattttcttgcgccttctcaacttggccttggaattgcactgattagccgccgctttgacttttacgtggacgaacacttcaagacacgcaaatggaaattgaacaaacaatttcttattcaatgggacattcaagaaaatgggacgaagaaaatgcaaattgtcaattccgatggaaatccattgccaatcccgcaaaatccgttgccgaacaaagtcatcggattcagacacattcagatcatttacatcgatcaaaatgtcatcacttttctccgc

SEQ ID NO: 87309 - DNA, 435 bp, Heterodera glycines
  SCN-specific regions: Sequence locations=1-435
gagaattgaattttccgacttaaaaaattggagggcgaagcgacggcgaacaatcggaaggcgaaactgattttcttcttcgagtggtccatcgacgtcaatttcattgcaactgtttctggttccgaaactgagtacaaaggaagtgtggaaattctgaatttgagcgatgagaacgaggcgcacgaaattgagatttccgtgcacattgaaacggcgggcccacatgaaaacgaaattcggcacattctctccaccgatgggctctcattcgtccgttccaaagtgggcacttacgtgcgcgagttgaaggaggagttcagcaaagggatcattttgccggtggacagcaaaggcgccattcgttcgcaggcggtgacaacgcaagggaaaacggtggtggacaagaggcgctttcagaatgatatcattcag

SEQ ID NO: 87310 - DNA, 485 bp, Heterodera glycines
  SCN-specific regions: Sequence locations=1-239,272-462
atttgttcctcggggattacgttgaccgtggcaagcaagcctggagaccatttgtttgctcctcgcttacaaaatcaaataccctgagaatttctttcttctccgtggcaatcatgaatgtgcttcaatcaaccgaatttatgtgcttctacgacgaatgcaaacggaggttttctatcaagttatggaagacattcaccgattgtttcaactgtctaccaattgctgctttaatcggcgagaaaatcttctgttgtcatggaggattgtctcccgatttacaaaatatggaacaaatccgcagaattatgcgaccgacggacgtcccggacaccggacttttgtgtgatcttctctggtctgacccggacaaatatgtgcaaggatggggcgaaaatgaccgtggcgtttcattcacttttggcccggacgtggtagcaaagttcttgaaccgacacgacttggacttgatctgccgtgcacat

SEQ ID NO: 87311 - DNA, 562 bp, Heterodera glycines
  misc_feature (2)..(2): n is a, c, g, or t
  SCN-specific regions: Sequence locations=1-562
anctggctgtgtaatgacgtttggatggacattctgccgttttttgaccgtcctcagctcggcctcaaattggcaatgctttcgccccgtttcgatgctcttgtggacatccatttcgatggcaaaacggaattgacgctttggagaccaatcgcaattcgcaacagtgccgcagcagtgccagaattacatgtgtttttcgacggtgccaacaattccgtgccatttccattgcccgacgtccattcgccgccgatgccaaacaacattcgttttaaggaccttcgaattaattgcattgaccattccgtgatcgcatttcttcgtgccaatcaactcattttccagaagggcaccaatttgcgtctgtcggttccttttggtccattcaacattgatgatgtgcagccaattttggatgattttgcgcgtcaaatttggcccatttttgcgtcaaccattcgccatttttggtttcccgattgccgtattttggacacattgcttcgtctcgtttcgccgacaattctcacggatgatcagatcaacatccattcaatca

SEQ ID NO: 87312 - DNA, 433 bp, Heterodera glycines
  misc_feature (84)..(84): n is a, c, g, or t
  SCN-specific regions: Sequence locations=1-433
attaagcttttgcttcttttaaatttactttgacttcaataaagaagaaaaatggcttcatctggctttagcgtctatgttggncaacattccgtacaacgcaactgaagcggacattggcaatttgtttagtcagtgcggagtggtcaccaatgttcgcattgtgtacgaccgcgagaccaatcgcccaaagggctttggcttctgtgaattccaggaccaacaaggagctcagaatgcggttacaaatctgaacggagccgagctcaatgggcgtgcctgcgtgtcaattggaccaacaaataagaaggttgtgcttgaactggacggatgatgatggatggattgtcatttttgaggatcgttttgacaattttcatttttctttgttgattggttttttgaaataaaggaatggttcgttcaaaaaaac

SEQ ID NO: 87313 - DNA, 436 bp, Heterodera glycines
  SCN-specific regions: Sequence locations=1-21,43-245,409-410
gcggaggaagagagggcgacggaaaggaaggaggcgagggaggacactctaaccgacaaaaacgattttcttaatcaatcttccgagccggaggacagtgaagacagcaatttggttgaacctgccggacaagtcgttaaggaaaggcaaaaagaaacgcagcaccaaccgacaagcgaaagcttatttgcgaacggactgaacatcacgcaaagaagggacagcggaacggacgaattgcaaatggaggaggaagaacagagagagaaggagcaaaaagggagggaagaggaggaggaagagactgacgatgacgaaataattgtgattgagcagagtaagagcacaggggaagagaagacgaaaagcggaaaaggaagaaaagcaaatcgatgagaaggaagaagagcaaaaaaaaaaaaaaaaaaaaaaaaaa

SEQ ID NO: 87314 - DNA, 566 bp, Heterodera glycines
  SCN-specific regions: Sequence locations=1-566
gtagactgatccgctggcggtgctcgacggtggcggactgttgccttgggcggagtgtcggaggaggacggctcacacaaaggcaccggaattgcgatgatgggcgaacttttttgcggtcttttgggaggcgcaagttttggcaagaaacggtgcgatcgtggcgagaagtgcaaaaggcagccaacctgggccaatgcttcgtggccattgaccccgaatgctttgctccaacatttgtggacaatttgcagttgttcctggaccaaacgcgtgggcttaatccgcgcgacccctccaaatcggtgttagtgcccggtgaccccgaaagaatgaacatcgaacggagcgcaaaggctggcggagttatttactcagaacgacaaattcgggatttggagaaattggcaaaaaagcaaaacgttggcatgttcccttacaaggcaaatttgtagcagaacaaaaaaactgttttctttttgtttcaaagcgatgactttcaattgaattgcattcattgccattattgaacaattaattcgttcccatttgctgctgctgataaa

SEQ ID NO: 87315 - DNA, 529 bp, Heterodera glycines
  misc_feature (506)..(507): n is a, c, g, or t
  SCN-specific regions: Sequence locations=1-301,324-471,493-529
atattcccgcagaagaagtgccgggccttctcttactgcttttcttagtctccctggcgttgtcgacaaattttcggagttcacaaagatgtacaaccattggcgtggactttggaaaatgttttacagaaccacttttgctcaatcacaaatgctttttgctattgaggagaaagcgtctgattctgaccgcttccgtcgtgttctgccaaaagtgctttactttttgagtcaggaagttaaggcaatggacgatgctttaattgttgattggtactccaatttggaagaaaagtcgcaactgaagaaagaagagaaactggctgaattggtcacgtggtttcaaaatgcggaggaatccagtgaaacggacgacgaaggagaggattaaaaattgggaatggaaatggaaacacgcgaagggcaagacaaaagggaccatctttgttgttatttggtcaaaattgtttactttaatgtgatgtaataaaacttttaaatctgtnnaaaaaacaaaaaaaaaaaaaaa

SEQ ID NO: 87316 - DNA, 537 bp, Heterodera glycines
  SCN-specific regions: Sequence locations=1-29,51-320,342-537
aatagaaaaaatgggcgagtgctgccgccaaatgaatttgatttttgaaatattcgcctttggaatggacgatttctcatcggaaaaaaatgtttctcttcttcgtcttttcttattctttttctcgaccgtagtattatttggaagcgcacaccctatggtaaacaaattatgcgaagacctagataaacctgaaggttggcaattattgaaaaagtataacaatcgaaaagtgccggatgagtataatgtggaattccccaaatggaaagacagctacaaaagcattaaaaagtttataaaatattgcaactatcttcagaaaaacgaaaaacccgtccaagaaaacgatcaatataaacttttggcactaaaaccaaagtttctggatgccaataaaaatgagttaaaaatcagtgaagcaatgtctgaaattgttgaagcatacaaaataatgctgagcaaattagtaaagatgaaaatcaatatcactgaaaaactagaagaaaagatgctgaaaaagcttcatttgtatgc

SEQ ID NO: 87317 - DNA, 434 bp, Heterodera glycines
  SCN-specific regions: Sequence locations=140-140
cagcgtctcatcttcgctggaaagcagctggaggacggtcgaaccctcgcggactacaacatccagaaggagtctactctccatcttgtcctgcgtcttcgtggaggaatgcagatctttgtgaagactctcaccggcaggacgatcaccctcgaagttgaggcgagcgacaccatcgagaatgtgaaggcgaagatccaggacaaggagggcatcccaccggaccaacagcgtctcatcttcgctggaaagcagctggaggacggtcgaaccctcgcggactacaacatccagaaggagtctactctccatcttgtcctgcgtcttcgtggaggaatgcagatctttgtgaagactctcaccggcaagacgatcaccctcgaagttgaggcgagcgacaccatcgagaatgtgaaggcgaagatccaggacaa

SEQ ID NO: 87318 - DNA, 508 bp, Heterodera glycines
  SCN-specific regions: Sequence locations=1-100,122-508
cagcggacggaactttagcactcaggcggaatggctactcgaaacggacggaaccgcacttctgagagtgctaagcgagccggacgtcgatttcattcgtacacacagcaatgacatttgtgaaatcttcgaggtgttgggcattgaagctgtccgcaaggcgattgagcgtgagatgaaccaagtgatttcctttgatggatcatacgtcaattaccgtcacttggctttgctttgtgaagtgatgacggcgagagggtatctgatggcaattaccagacatgggatcaacagacaggaggttggagctttaatgcgatgctcatttgaagaaacggttgacattttaatggaagcggcagttcacgctgaaactgacccggttaaaggagtttctgaaaacattatgcttggacagatggctaaggcaggtactgggtgttttgacctcgtgctagactccgacaaatgcaaattggcaatggatattcccgattttattatggcg

SEQ ID NO: 87319 - DNA, 562 bp, Heterodera glycines
  SCN-specific regions: Sequence locations=1-377,399-562
tcttggagtcttacgttccccgccacagtcgaaattaccggggcatccaaccgaccattgacagtgtgcacaaccaccagcaggtcgaccccttcctcccgctatcgactattccccccgcctcgacggtggaaaatgccgacttcgaacggcagcccattcccctcggaatgcccattcagctgttgccgacctctcagaaaacgcctccgtcctctcagcaggttcttctgatgagtgctcagccaacgccgaatcagcctttggtcctccccgtctcttccgtccccactttccaattcgtccaacaacacatgttcccgtccatgtctcagcagcagcctctcatgcccattcgtcttcagccttcgtccatgcttcaccatcagattaaccagcaagcggagcattcgcagcaggacgggacagtcagcgactctcccgacagcggacatgttgttactccatcctcttatccgctccaacaaattggaaatgggatcgactgcattgacttgacacaccaccgacactcggaaagaatgggctcagatgccatgga

SEQ ID NO: 87320 - DNA, 432 bp, Heterodera glycines
  SCN-specific regions: Sequence locations=1-29,92-92,127-127,157 -166,236-237,336-337,373-388,413-432
atgttcgagacgtctaacaacagccggcctgtacgtggccattcaggccgtgctgtcgctgtacgcctctggccgtaccaccggtatcgtgttggactccggcgacggtgtcacccacaccgtgccaatctacgagggttacgcgctgccccatgctattctccgcttggacttggccggccgtgacctcactgactacctgatgaagatcctcactgagcgtggttactccttcacgaccaccgccgagcgtgagattgtccgtgacatcaaggagaagctgtgctacgtggccctcgacttcgagcaggaaatggccaccgccgcttcgtcctcatcgctggagaagagctatgagctgcccgacggccaagtgatcactgtcggaaacgagcgcttccgttgccctgaggcgttgttccagccatcttt

SEQ ID NO: 87321 - DNA, 558 bp, Heterodera glycines
  SCN-specific regions: Sequence locations=1-558
acatgatgaattcgatgttgggcgatgcgtgggacatgctgaacggcttcggaatgatgggccccccgttccccaaccatcctatgctcaccgatggtctgaatcgtcaaaaccaagctcttcgtcgtcagcagcctccacagcatcactttggtcctgatacgatgatgagtccgtttggaggatttggccttttcggcggaatgatgcagcaaatgcaaaatatgcataaccatgcaattagtgatccgaattctgttgttttctccgaatcaacaatggtttcttacgatggaaatggacaaccgaaggtcgtccaacattcgacccgtaaagccggcgatgttaaggagaccaggaatgctctccgtgacggcgtacgtgaggagatgacagttggccattcgatcggcgaccgttcgcatgtgatagaaaagaagcgggacaaagacgggaaggttcgccaacaacagaagtttttcaacctcgccgaagatgaagccgaagatttcaatcgacaattccaaacacgggccagggaaaatatgggaggccttt

SEQ ID NO: 87322 - DNA, 339 bp, Heterodera glycines
  SCN-specific regions: Sequence locations=1-3,59-266,289-318
ccgcttttctctttctttcttttctctgtatttcccacttttcccttccttttttcttgacatggtccaaaatgttgatgattgttttcgtaacaaaacttcaaattgtacaaatgcgacatttctcatttatagtaaattattttgttttggttttggaccagttcgggcaaattgtctatgttttgatgatgcgagatgccattttggttgatgatgacggtgatccatttttaggattgaatttgcctctatttgtattagtattttttataatacattatttttcgttttgctgaaataaaaatgtaaatattgaaaaaaaaaaaaaaaaaaaaa

SEQ ID NO: 87323 - DNA, 233 bp, Heterodera glycines
  SCN-specific regions: Sequence locations=1-111,133-233
gtgatcggagtggacgtgcagaacaggaggaaacgggccccaaagaggcggcgggaaaagaactgacgagtgccacgcacagtcagctgattggcatggcatcaaaggcggtgactttggacatggacaaatggacggaaaaagcacgcgaggggaggaaattgaaaagggaggcatagaggaggaggacgactcggacgtgtacacactgtcatttggggacaaaacgatgt

SEQ ID NO: 87324 - DNA, 515 bp, Heterodera glycines
  SCN-specific regions: Sequence locations=1-75,108-266,288-515
ataatatctgtaattgagtaataattgcctcattaattagtctttatgatgatgggccatccccatgcccatggtccctctgtgcctctctcctccgctctctctgtcgctgcctctgatcagcaagatcactgctgtgccgtgtgcggctgcgtcggtgccaccatttattgttccgttttttcgtgccgtccctgcgcttctttctttcgccgttccatcaaagaccaacgcgagtacaaatgccgcgcgaatggcgactgtccaattgacaaaggtgagagagagaaagccaagagtatgaatggcaagtggttattttgataacactttgttcatctttggattaggtcgatcattttcaatacttatacttttgtgctgttttctttctgtactcagatggcatgcgcaattgttgtcgtgcctgccgccttcggcgctgttttgaggccggcatgcgactcgatttggccccaaatgcccacggcaacgattggccttacgctgagctt

SEQ ID NO: 87325 - DNA, 444 bp, Heterodera glycines
  SCN-specific regions: Sequence locations=1-352,378-444
attttttttgtcgccgaaatgagccggaacgctattccttctctctaccaccttcagtccctcggggaagttgatgcaaattgagtatgcgttgaatgccgtcaagggcagtgcgccatctgttggcacccgagcaaaagattgcgttgtgttcgccaccgaaaacaaacactccgtcctacacagcccgtcagcaaaatctccaagttgtccgaccatattgcatgcgtgtacagtgggatgggcccggatgcacaacttctcgtgaagaaagcgcggaaaattgcgatggattaccaagtgctgtacggctatgaaattcccgtgcctcaactcgtttcccgggtggctgcggtcatgcaggaatacacacagtcgggtggtgttcgtacgtttggcgtttcattgctcattggcggatgggacagtgaaaagggggcgctt

SEQ ID NO: 87326 - DNA, 457 bp, Heterodera glycines
  SCN-specific regions: Sequence locations=1-147,169-229,258-355,377-457
tttttgtcgcattttccgctgccatttacgtgcgaaggttacccggtgaggaagtgaagcggtttgacatccaaattcaggggtatactccgacgctggacgacgattatgtggcggtggcagtcaaagccgagcccggatacattggtgaaattcaaaataatgggaaatggacaatcgtttaattgtgtacaatatttatagcaaaaccaaccgtatatccgtggaatatttcattttttgttcctttttcagttgaattcgaaccgttcgctcatgccgaccgagtccatcacatgctcctttacggctgttctacgcccgcttacgccgacagaaatttttggcaaggaatggccacgtgtgggggcaactcacacattctctacgcatgggcacgaaatgctccgccgctggaattgccaaaggacgtggcatttgccgtcggaaatgaggg

SEQ ID NO: 87327 - DNA, 490 bp, Heterodera glycines
  SCN-specific regions: Sequence locations=1-490
cactgataaaacttgcggggtcggcagaatcaaccaaagagcgtcggaagggggttatggctatttgaaggaatggctatggtggatgggtgtgataacaatgggagttggcgaggcttgcaatttcgccgcttacgccttcgcccccgcgagtttagtcactccgatgggcgctttgagtgttctcgtcaccgccgttctctcttccaaacttttgaaggagcggctcaatttgctcggcaaaatcggatgtgccatttgtctgctcggctcaacttccattgtcattcactcgcccaaagaggaggaagtgtccacgatggccgaattggcagagaaaatgaaggcttctgtgttcattctttacgttgtgctcgttttgctgttcacttttgtgctcgtcgtttacgttgcgccccgttatggccacaccaacattctggtgtacatcgccgtctgttctttgatcggttctctgtcagtgatttcg

SEQ ID NO: 87328 - DNA, 172 bp, Heterodera glycines
  SCN-specific regions: Sequence locations=1-172
gattcgggaagacattgtacgacaaattgctggagggatggatggacaaattgcaattcatcgacgacgacaaccaaaactggctgctgctacgagccgagaaaccggtccatcctcacgcgtatctgaccgaagcgggcgcttagggagagaaaagagcgcagaggacggg

SEQ ID NO: 87329 - DNA, 552 bp, Heterodera glycines
  SCN-specific regions: Sequence locations=1-41,63-495,517-552
ctttctccctacattttccctggtacttttgttgctgcaaatgccttccgaaatgcgctttatctctgccgattgctggcttttggtgttcgatttccttgcgccttctcaacttggcctcggaattgcactgatcagccgtcgatttgacttctacgttgatgaacacttcaagacacgcaaatggatgttgaacaaacaattgctaattacatgggacattgaagaaaatggcacgaagaaaatgcaaattatcgatgccgacagaaaagaaacattgccaatcccgcaaaagccgttgccgaacaaagtgatcggattcagcggacgcattcagatcatttacatcgatcaaaatgtgctcacttttctcggccattttcaccgttttttcgccacttctgcaatggatttggacattgtcattgaaaatggtcgcattttggaatttgttttgctcaacatttggccaatgttccgtgattcaattcgtcgcttgtttttgaacgccatcgcttttcgctgtttgcgtcaattggcgccgtcaatgct

SEQ ID NO: 87330 - DNA, 570 bp, Heterodera glycines
  SCN-specific regions: Sequence locations=1-175,197-570
caaaatgtcttttactgtcgtgcacattcttttttgcttctttttgcctgctctttcgatttataagccaaattgggactcaattgactcgcgccctttgcccaattggtacgacgaagccaaatttggtattttttcgcattggggagtttattcggtgccggcatttgggtcggaatggttttggtggtattggaagggacaacgtgacgcaaaattcgaaagatttgctcaaaaacactacccaaatggcacgacctatgcagactttgccgaatccttcaccgccgttgacttcgatgcaaataatttcgccgaaatcgtaaagtcctcgggcgcacgatattttgttttgacttcaaagcatcacgaagggtttacgctttggccaagcgcgacttcgtggaattggaatgccgtcgatatcggcccccatcgggaccttgtgaaggcactctccgattcgattcgtgcccaaaatattcgtttcggactttatttttcacttttcgattggttccatcctctctttctgaacgatgttaaaaagcacagaacggacttcgttca

SEQ ID NO: 87331 - DNA, 606 bp, Heterodera glycines
  misc_feature (27)..(27): n is a, c, g, or t
  SCN-specific regions: Sequence locations=1-41,63-377,402-437,459 -501,539-606
agcttatctactgatattttgctttantctctctctctatatcttcaaccaacaacaacaactcaatgtctgacaaccgtggtgcctccgttgcgtcgaccggtacgaccaacagtcaggagtctcaagtggcgtctccagtgaaagccggaaaagctactacgaagacgacggctagcggaaagggcggcaaagcgaaggcggacggaaaagtgaaggcgggcggaaaaggggcgaagaaggcgggcggaaagggtggaaaagtgaagattgctgcgagcggaacgtacagcacgcgctctgctcgtgctggcgttgcatttcccgtcggacgtatccatcgtttgctgcgccacggtcgccatgctcagcgcattggggccggagcgcctgtctatatggcatcggtgttggagtatctggcggccgaagtgctcgagctggccggcaacgcggcgagggagaacaaaaagttgcgaatcaccccgcgccatttgcaattggctgtgcgcaacgacgaggagttgaacaagcttctctcggaggtcaccatttctcgtggcggtgtgttgcccaacattcacacggaacttttgtcgaagatgc

SEQ ID NO: 87332 - DNA, 570 bp, Heterodera glycines
  SCN-specific regions: Sequence locations=1-570
gtgtcgcttcgcgaatgaaaggcatcgatttcgaaactgggcaacaaatcctttgcccttctaatttgctttggttggctccggctctgatgaacaactcggtggctatgctcggcaccaaactgttttcaaaagcaaaggattggacggagttgcggaggaattgtccatggaaatgcatcggatcggagcacgcaattttggcagggacgaccgaattggcacagtgaatggcaaaagccttctggcaccgttccttgaggagccgttggtctgctggctgaacactttgccgaccgcgttgaagaccggcttcggactgccgaccaatgacggcaccgccaacaaatttttgttgcgcaacgccctccgctctttgggcgtgccggaatgttttgtgcagcggcctaagcgtgcgatgcaatttggcacacggatggtcaaaatggagaacgcggagaatggcgacccaaagttaagagggcccaaatttgcgagaaactggtgctatgatttgctgtgctaatttatatttgttattgaaataatcaattttatttcaaacgacaa

SEQ ID NO: 87333 - DNA, 197 bp, Heterodera glycines
  SCN-specific regions: Sequence locations=1-149,171-197
agcggcgtcgactttgcctcactttcgtgtctgtcgaccattactcaatcgacctctgacgaattgggcaaaaagtcgaaaggctctcccacaattgaattgctccgtgccgagtcggactgtcttcctcccgaatggcttttgcccaactcttccgacatcattttgaagccgctgattccaatggccgagcacag

SEQ ID NO: 87334 - DNA, 566 bp, Heterodera glycines
  misc_feature (129)..(129): n is a, c, g, or t
  SCN-specific regions: Sequence locations=1-542,565-566
cattgaaatgaacgaactttcccgctcgcttggtacccggctgccgaatttttggaatttgaacgaataacaaagcgtattcgttcaacgtcccagccttttctgtggacacttcgacaacggatgggnccgaagtacacacaaattatgaacgcactgtcggaacaattgcaacagcacgtggccaaggcgaatttgctgatttctctcaacgagaaaatcccgcaattcgatgttgaagttgaggaaatgatgcgcattgcaattggccgtacgcaattgctgctgaacaaacggatgaagcaatttcgggaacatttgagccgtcatttgaaaccaattcctggccaaaaagtgaccaaattgaacgatttgcacgctctttgggtgcctatcgacatgcaattggatgacatccgatccattttcaactccatcgagcagttccgtcttcgctgttgggctgtcgctgaaccaaaggccgccgcgactgccgcttctggcaattaattaatcctcagtctttcatcatcatcgcatatttttgtttttaaagtgccttcaat

SEQ ID NO: 87335 - DNA, 517 bp, Heterodera glycines
  SCN-specific regions: Sequence locations=1-418,440-517
cattttctgagccagttatcttctccatatcctcctattctctcccaaccaaacatgtaagtgcgcaacacacaaagtgtccaaccaattatggtacaaatcagcagaaaatgacgaactgatcaatttgatggtatcggacaaaattgaagagggcggaaacggcgagttctttgtcggcttcaccctctcagagcatcgcttggaaaatctgccgaggaataaatgtgtggcagtcaaaaaaatgaaatgtgccaatcaggaccaattttgtaaccccaaatatcgcaatgccaaatattgcaatgccaaatattgcaatggcaaacattgcgatgctaattactgcaataccacccgagtgttgaaatggcttcaaaggcacattgacggcacaaaaaggggacacatcgccaaactatttgatacaggtttcgaagaagcaacgaattcctttgtcattgtgtccgaattgggcgacgaaacattgaaacatcgtttatatgcagaaaatcgg

SEQ ID NO: 87336 - DNA, 522 bp, Heterodera glycines
  SCN-specific regions: Sequence locations=1-522
attggtgaaaatacgcgcaatcgttgggttacgttgtgacatcacttggacaaagtgttcgcctggccacgaaaatgaacagacgttggatttgcaatgacattttgatggatttgttcccattctttaaccgtcctcaactcggcctcaaattggcacttctctcacctcgtttcaatttgctggtggacgcgcatttcgatggcaaaagcgaattgacaatttggagacaaatcagaattcacaaaaatggacccaaaacacaactatccgtggatacggctaacaatgccgattcggtgccatttccgttgcctgaccgttcgctgcccaacaaaattcgctttcatttcctccgcattggatgtatcgatcattccgtcatcactttcctccgttccaatcagcaaatttttgacggaagaggcaccaatttgcgtctgtggctccgtccggacgccaatgattaccagccaatttgggatgctttcgtccgtgaaatttggccgattttcgtgccaa

SEQ ID NO: 87337 - DNA, 441 bp, Heterodera glycines
  SCN-specific regions: Sequence locations=1-21,43-176,198-292,315-441
aaatattaaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattaggg

SEQ ID NO: 87338 - DNA, 539 bp, Heterodera glycines
  SCN-specific regions: Sequence locations=1-142,164-258,281-440,463 -478,507-539
tttaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgttttgaatc

SEQ ID NO: 87339 - DNA, 531 bp, Heterodera glycines
  misc_feature (488)..(488): n is a, c, g, or t
  SCN-specific regions: Sequence locations=1-39,62-531
ttggagtgaagcttatcggtggaaagaatgatgtgaaaattggcatgcatgaaatgccacagatcaaatttggagggaatgtgatgggctatttccaagacagagtgaatccaggtgttcgttttctcgagacgagcactttgatgaaggcatgggtcgttggttttacgcgccaagttggagagggagatgtccgtaactttattcaacaaattgtggttatgggtcgaaagaggggcatgaatttgccagacccgcaatacgagtgcatcgaattggagaacatttctgaacgtatgcagcaactctcggaccgccgaattcagtttttgctctacatcgacaaaaaattcgtcaaatcacacgcaattttgaaactcaacgagaagaagtatggtctgctgactcaacatgtcacattcgaagtggccagcaaagctcgtgctatgactctgtcgaatgtgctgaataaaatgaacatgaagctnttcggcttcaattacatgcctatgttcccgcaagcgtctaaga

SEQ ID NO: 87340 - DNA, 498 bp, Heterodera glycines
  SCN-specific regions: Sequence locations=1-169,192-498
atcggcgtcggtgtgctacttatttggtaataaacgtcgcgtggaacgcattggccttgttgatcagttcatcatgggttacggagggattcgtggtgccgtttgctacggtttagtgatgtctttggaccccgaattggtcgaatgccgcaatatgttggcaactaccacaattatcgtcatccttttcacagtttttgtgcagggcggttccattgaaaagttggtcacttacttgaaggtcaagcaattcgaagcacacaaaaagaccgtttttgagatgatcgccgataatgtcagcagtcacatggtcggagggatggaaagtatcgccggactgcgcggggattattggtttcgaatgaagcttgaacgctacaacaaaaagtacataaagccgttcattatgctcaatccgaatgacaaggacatgaaaattgtccgacacaatgaggagattcaggtcaaagaagcggtcatttacttgaaaagcacggg

SEQ ID NO: 87341 - DNA, 560 bp, Heterodera glycines
  SCN-specific regions: Sequence locations=1-4,69-79,140-189,309 -350,447-453,479-560
gcatagagaaaaataaaaagagagagtgaagagaggaataaaggaagagagagagagaggggagagagcgataaagcaaaaaggaaaagtcagacaacgggaaagagagaaaagcaaacggagaggagagaaaagaaaaacggccattccttctgctgtcgggacgaaacgggccaaaccaagttcaaggtgccagtgcgacggtttcgttcaatgctaatcagctaattgctcactaattaccccaaataacaaaactgcccctgcatctcccaacaatggccaccaaatgccttccgctcgaacttttgttcgaaattgtgcctttcatccctgccgaaaatgccgccccgaatgcgctctcgtcctgtcggctgctgcacaaacttttgctgccacgtgtcatcaaatggaaagagataatgagtgaaaataccggcttccaacagcaaattcttgaaatggtaaaggccctccaaggcgatgtggctgagctcagttcgcgcgtcacagtcattgaaaaaaaagtcaccgtcattgacgaaaaagtcaccgtcctt

SEQ ID NO: 87342 - DNA, 345 bp, Heterodera glycines
  SCN-specific regions: Sequence locations=1-112,134-320
cattctgcgaaaaggtgcaattttcttcactgggatggttgttggaacagtcgttgtttttaaggcatttaagccaacgtgtcccttcgacgaagcggcagaacgtggcaaaagggagctgttggagaaatacacggaggagtacaacgcgttgcaggaagagctgaggcaggcggaagagcagcagcggaacggagggatgtcgaagaggcggaagcgagaaaggcttagccgatgacaataataatgatcaatttgggtggaagggttgtaaatcctctgaagtaggatcacattgctaattaaacattttgaatttcaaaaaaaaaaaaaaaaaaaaaaaaa

SEQ ID NO: 87343 - DNA, 636 bp, Heterodera glycines
  SCN-specific regions: Sequence locations=1-636
tccaaactgttggctccggaacctgccgatagaccggacatgcgatacgtgcttgccgttctgcaacagataggcaatgatgccgaattgcaacgcgaagttgcgcagtttttggtctttcgcaaggacgaatggcgggaaatgattcgcgagcagaccttcgcattggaagaattgaagttggatttggcccgacagatggaggatttacgaaggcgggaggccattgtccgaaagcgggagaacagccatcgtaattttctccatttggtggacgtcatgaacgtggaggacgtttgcgaatggaacgaggattgtgtttgcgaatgggtgcaaaacattgcggcaagtgccatggaagacttcagcgaggcgattgtcgatcagctcatttcgtgtattcttcagtatgaaatcaatgggtgtcgtctgttaaaaatcaccgaaaaagacttggagtgtcttggaattgaatccgttgctgtgcgacgatactttggtcttaaattggacgagctcagggctatgaatgtgcagctttgtaatttcggctgttcgtcgttggcagatgaacaaaacgactcgttttcttcgcccgttgaaaagccgattctcctccatgtcggcctttacagc

SEQ ID NO: 87344 - DNA, 586 bp, Heterodera glycines
  SCN-specific regions: Sequence locations=1-29,51-586
caaataagggttacacaatccagtcaaacgtgccgggcaatttgaaactgaaatggacatcaaacacactgaacaatccgtacagtcgtccaaatttggacattgaagtgcaatatcaaaaaatgggagatggaatttatgtgcgcattggaacagaagacagatggcttcccccactgaatgagcttcgcaatccgtccaattttgaacaagtgatttcatcaaattcactgagttttgaacttggtaatgccaatgagcctttctcatttaaaattcaacgaaatgattcaaacaaacaaagcatttgggacacatcgattggtggccttgtttttggtgaccaattcatacaaattgcaacttttttgtcatccgatcgcctttatgggttaggagagaatatgcaccatgaattaaagcatgatttttccatctataaaacgtggagtgcattttcacgcgatcaaggaaatgaatattatgtaccgggctcatacaatggatacggggtacatcccttttacgttggtttggagccaagcggaaaagcccatggtgttctgattttgaattcaaatgcaca

SEQ ID NO: 87345 - DNA, 627 bp, Heterodera glycines
  SCN-specific regions: Sequence locations=1-283,305-305,327-627
attttaaaatttattaatggagaaattggcaccgcaaaattattgtctagccgattcaacagcatcatctttggcaaaagctgcccaaatggaattggacttcatccaaagcgttttgttgggcccacagcgaggaaatttgacggcaattgaatgtttattggcacaaaactttagcaaacagtcatcaatgatgccaaattatggcacggaacgtaaaaatgcaaaagtaccaaaattagaaatggaaaaggctggtggtggtgatgaagccaaattggacaatggaagcgagaccgatcaaagtgatcagaagcaaaagagaaaaggggtgggacgaccgaaaaggcatccgagtgaatgcaaagtgtgcgggaggaagagcttttactgttattacagtgtccgatgttgtgaaagctgtaagcaattctttcgtcgtattgttgcaaagcgaacattgttaaactgttttggagcgaaaaattgtcaaattggaaaagatggcattcgatgccgcggctgtcgcctggacaaatgccttttggccggcatggacccgacaatgatcaatgcaatgcaacaggaaggaatggcccaatatttggacagattggaattgcgaaa

SEQ ID NO: 87346 - DNA, 630 bp, Heterodera glycines
  SCN-specific regions: Sequence locations=1-67,90-169,191-558,590-630
ggatttctaaattgaaaatgaaatttctaattttatgcctcttttttgctgtcttattaaaatattcaatttcacaaaagccacaaaaagggaaaaaaagagagtgatggtgacaaagaaggcgaagttccaagtcaaacggaggacaacggcaccggtttaatgtccaatattttaaaaaagacagctgtggcactcgccctgcaaagccccttcattacgggttcagcaataagattgccatcctcctcaacaagtaaagcaccgccgatgttcaaccaacgtaccaataccaaaaataatgtactcgagaatgcggtcaaaatcccaccgttcaaagagctgcatgcaaatccattgggcaatggcatcgaattggcaaaacatgggcaaatggaaaacgaaatggcggcacactttcacgaccagcgaaaattgtccaccaaatcatcagtggcagaaggaaagtttaacccaaagatgaggacgatcgacccaaagttttatccgcaggcgccacgaggcaatgtcaaggacacttacaaaagtcaaagtggcaaagaagtgaaaaaagtgaatgtttagcattggcacttcccactgatagggcggcacttttaatctgatcgg

SEQ ID NO: 87347 - DNA, 559 bp, Heterodera glycines
  misc_feature (544)..(544): n is a, c, g, or t
  SCN-specific regions: Sequence locations=1-170,192-286,309-469,492 -506,528-559
attaaaagatccgaaaaaatgccaacattttaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgtttagttttcagattttattctatcctcttttatttattagtttttcaaaacaaatttcctccacagcaaanaaaaaaaaaaaaaaa

SEQ ID NO: 87348 - DNA, 449 bp, Heterodera glycines
  SCN-specific regions: Sequence locations=1-344,372-376,412-449
aattttgcaattggcattgtggcggggcagcaacggttgcagagattgcaaaaacggtgttgaatgaggagcaccgtctttttctgtccggcatccgtcgtggccttttgacctttttgcacatccaacgccaattgttcgtcctctcaaatggcacgctttcgctgcgcttttggcactcggactatcagcgatttgagaaggaaattggacgagaaaaactgcgcactttccaatgccttttccaccaaaaccatccgaacggatgcccaattggtccggaggagtgcccatttaaacacaattgaaggaaagaaagaaattatttttttgttgttgttattttacaagttattttaatatttatttacgactgtttttaattatttgtaaaaaatgaattaatttaatgattaaacagtaagtcactctcaaaaaaaaaaaaaaaa

SEQ ID NO: 87349 - DNA, 477 bp, Heterodera glycines
  misc_feature (475)..(475): n is a, c, g, or t
  SCN-specific regions: Sequence locations=1-22,50-102,135-135,192 -192,230-265,287-319,344-354,380-427,475-477
acgctttggttgcccttgccattaaatggaattgcgggtcggaggtcgtaaccggccttgggcgtaaaattggcggcggctccttcggagatatctatttacgcgagaacattatgacacacgaggaagtggcactaaaattggagtgcgtcaaaaccaaacatccacagcttcacattgaggccaaactgcacaaaatgatgtccggcggagtcggcattccacaggtgcggcggtgtggttgtgagggtgaatacaatgagacggtgatggaactgcttggcccttaggtctacgatctgtaccacaattgctcgcagaaattcacactgaaaacagtgctattgctcgcacaccaaatgttggccaggatccactacagtcacagctaagatgtcatacatcaatacatatagtcatacaattgtctgatgggtctcggcaagcggggcaatcttgtctacattattgactntg

SEQ ID NO: 87350 - DNA, 458 bp, Heterodera glycines
  SCN-specific regions: Sequence locations=1-428,450-458
taaattggcagcaatgcgaattaaactcgacgttagcgatgacaaaacttattgtaaaaagtcactcgttttagattgaccaactgcttgacagtttggaacgaaaatgccattcaccgcaaagtgacgaagaaaagggagcggcaaaggaaggcaaaagcgaattgacaattgctggtgccgaaaataaacaaataattttgccatataattaattaatcactctaatttgcccaattaaaagtaaaagtgaatctcatttgcccatttcagaggttcaaaaggacttcttccccttcatttacgcaaaggctgaacagttattggttgaccggcgaatggcaaattcattcacgcgaaaattatccgacaaaaagtgataaattgacgggaaataaatgaatcaatacaaataattttgcacattatttatttttgctcttttaaaatgccaaatt

SEQ ID NO: 87351 - DNA, 556 bp, Heterodera glycines
  SCN-specific regions: Sequence locations=1-2,67-77,138-181,307 -348,376-376,445-451,477-556
ttagagaaaaataaaaagagagagtgaagagaggaataaaggaagagagagagagaggggagagagcgataaagcaaaaaggaaaagtcagacaacgggaaagagagaaaagcaaacggagaggagagaaaagaaaaacggccattccttctgctgtcgggacgaaacgggccaaaccaagttcaaagtgccagtgcgacggtttcgttcaatgctaatcagctaattgctcactaattaccccaaataacaaaactgcccctgcatctcccaacaatggccaccaaatgccttccgctcgaacttttgttcgaaattgtgcctttcatccctgccgaaaatgccgccccgaatgcgctctcgtcctgtcggctgttgcacaaacttttgctgccacgtgtcatcaaatggaaagagataatgagtgaaaataccggcttccaacagcaaattcttgaaatggtaaaggccctccaaggcgatgtggctgagctcagttcgcgcgtcacagtcattgaaaaaaaaagtcacccgtcattgacgaaaaagtcaccgt

SEQ ID NO: 87352 - DNA, 652 bp, Heterodera glycines
  SCN-specific regions: Sequence locations=1-652
gtgaatttgctgttggactgtctgatttcgacaaaaacgccggcaaagacgcgatcaatcgtggcctttccgtggaacaggccatcgagaaacgcatttatgccgccatcgaggcaactcaagaaatagccaagaacccttctgagaagttgactgcccatgcgaattccttccttgacattgcgaattcgctcagcgaaagcattttgggactgccgcgtgctgtggaggaccccgagtgggggctgaaggagcgcgtcacgtttctcgcgtcgcgtatcggtcaccgaatcagctcaaagaccaacgaacgcatcgtggaaccgctgctgcagcagatgtgtgtcctcacagagcagttgtcgaagtgcattgtcctcgtggactacgccaagcagcgccaggaatggactttcaacaaagtgagccaattgtcgacatcggtcgttgagttgcgcaacaaaatcgaaaccgaggcaacgcgaacgcgaaagaacccgggagaagtgctgctgaagatcatccgcttttactcctccaagctgaacgttcagatgagcaaactgcgcgaccgcagttcggagttgctttcttcttcgatgcagaaacaaattctgacattgactgcgtacgttcagcaattggatgacaa

SEQ ID NO: 87353 - DNA, 538 bp, Heterodera glycines
  SCN-specific regions: Sequence locations=1-61,122-538
ccccagttaattacacatataattaactccttttatcgtgcattcctccgccgttctttcgtcccttccctttcccttttttctctctttttcactctctcttctgtccctttcccttccccaatcattcaattgcctgccattcttctcacattcattcattgttttttgactgatgaaggtcatcttttcgtcacacagtagaagtgggaaaaaaatttgccacccctcctttgtcggcacatgccattggctgctgcacggcaccgaaacggtgccaaagacggcggagcagcgcacctttacactccgttgtaggcacgtcgtgttggcatgcggacgacaacagcccaaactgttaggggtgcccggcgagtcggccgccgctgctgacggtcgcgtggtgtacagtctcagctcgttgaagcagcgattggaggagacagagggcggcgattcgggcgcgacagagacggcaacgacaatggcaccggcgaccgaagcgacggcgaccacaatggcacgagcgactattgcc

SEQ ID NO: 87354 - DNA, 576 bp, Heterodera glycines
  SCN-specific regions: Sequence locations=1-214,236-454,540-576
gcatcgtaatgtcataaacttggacaaaaacctggagaacattcgccgaattgaccaattcgcccgcaaagtgatcgaacattgcacccatgcggcactgttcaatttcagcattgagcagaacaaatggctgaagacggaggtggacggcccgctgttcatctacgaacggcttgaccagccgctgtactcgatgattgtcgtcaatcgccagtcgcccaaaaattttgtggaaccaatcacggacgggctgcagttgcgctacgagccgccctacatttttgtgcatcgcgaagatggctgtattcgcggtctttgggtgttcggcgaagacgaatgcaaacgagtttttgacactctggcgaatctgagcatggagctgaagatgaaaagtgccggtgccactaccagcagccccaaaaacagcatctccgccatcaacaacgacagcggtgccgtcgccgctttcgctgccgcaacgccgccgacgaaaattgtcgctgccgccaaaccgtcaccgccgccaccgtcgcagcagcaacagcaacagtcgatccgcgtcagcagcttcatctc

SEQ ID NO: 87355 - DNA, 387 bp, Heterodera glycines
  misc_feature (111)..(111): n is a, c, g, or t
  SCN-specific regions: Sequence locations=1-87,139-387
catttcgtccgattacacatttccttctctccgttctgtcgtccaactgctgccactttcaattgcccttcacggcaatggctgacactcctcctcctcctccgcctcctnctcctgctgctgctgctgccgctggtggtggtgatgaagccgttgatttggagcaacgtgttcgccaactcatcatgtccatcggcctgcgaaacgaagacgcactgcgcgagatttccattctgatcgagtcattcaaccgggagcacctcctccactttgtggagatcatggcgagaatgcatgccgagagcggaaccagcattgacatgccgggtggccaaaatggaaccaccatgttgatgatcgctgcggcctctggaagggtggactttg

SEQ ID NO: 87356 - DNA, 435 bp, Heterodera glycines
  SCN-specific regions: Sequence locations=1-199,221-324,361-435
caacgagtttagcggtgacattcgtgatgccaatttggctttggtgaagagtattcgcaaccgtgcctcatatttcgctgagcttctcccaattcgatgaagggcattggcacccgcgacaccgatttgattcgcctcgtcgtcacccgctccgaagtcgacttggccgacattcgccaggcatatcaaaatatgtacggcacttcactggaaaatgccatcgctagcgactgctctggcgcttataaggatggtttggtcgctattgtgaagggatattaccactgattgcgatggcactgctgtgaagaacttccaaacgataaaaaagagattaaaataaaatagcagttgctaattactaataatttaagtgtgtgaatatgtatcactttgtattgtaatgacccatttcgaaaataataacttgcctgc

SEQ ID NO: 87357 - DNA, 437 bp, Heterodera glycines
  SCN-specific regions: Sequence locations=1-200,222-325,362-437
caacgagtttagcggtgacattcgtgatgccaatttggctttggtgaagagtattcgcaaccgtgcctcatatttcgctgagcttctccacaattcgatgaagggcattggcacccgcgacaccgatttgattcgcctcgtcgtcacccgctccgaagtcgacttggccgacattcgccaggcatatcaaaatatgtacggcacttcactggaaaatgccatcgctagcgactgctctggcgcttataaggatggtttggtcgctattgtgaagggatattaccactgattgcgatggcactgctgtgaagaacttccaaacgataaaaaagagattaaaataaaatagcagttgctaattactaataatttaagtgtgtgaatatgtatcactttgtattgtaatgacccatttcgaaaataataacttgcctgcc

SEQ ID NO: 87358 - DNA, 550 bp, Heterodera glycines
  SCN-specific regions: Sequence locations=1-272,294-550
tgatccgccgagaatgcttatctgacatatggagccgaatgatgggattactgatcagccaactgatcaagatgggagtgatacagaagcaaccgattcgacgacagttggatcggattcaggaccaaatgacaatgatcagaatgccactgggccaactgatgaagatgaaacaggaacggaagcaaccaattcgacgacaacaacaactgaatcaaatgcaataggtgaagaaggtactgatcaggatgctacaaactcatctgatcagggagaaagtgatgcagaagcagaagcaaccgattcgacaacaaatggatcggatctggaaccaaatgatcaggatgaaaatggtgcggatgctgattcgacgacaacaaacggaatttgatcaaaatttactgaaaccaaactggcaatgatcagttgaattttttgatttgcagcgtggttgatcaattaatgacgaatgtcaatatcattttgatattgcaattaaaaccgatgtagttcatttgcgatacaattttttttcatgtgtacaacgaaa

SEQ ID NO: 87359 - DNA, 462 bp, Heterodera glycines
  SCN-specific regions: Sequence locations=1-67,89-243,265-462
cactacaaaaatggttccttggtggagttccaacccgtccacattgaacagttcaatggagagcattgaagctgctgctgctggtgaacaacatcgtcatgttcgaccagtgcacgcaacaccaccaccagccgatgaatttgacggaattgttattgttgggcaaggagtaacagcagatgtaacggcagcaggagactttgtgccatgttcaacctctactttggcacaatcaattgaacgcgtttttggcaatttgcaacaccagcaaatccatcctgaaagctatgaagaagcgaagcgactgttggtctttgctggactgtttttcctgctaatgtgcgcatttgtactaatcaaattccaggtggcattcgatgatgtctttcgccggtcaccagcagtttggctggtcggcgtaatcatttgtgctcttctgatgaatatgtctgtgcaaattag

SEQ ID NO: 87360 - DNA, 601 bp, Heterodera glycines
  SCN-specific regions: Sequence locations=1-38,63-97,119-318,340-601
caaattttcgggctttttattgcatttacaggaacttaagcattttgatggacaaaatggcaaattaattggcaatgacagcgacgagtcattggaatcattggtttcatttatttctaaaaatggctttggtctcataaacgacgaacggagaacaaaaattgatcaggcaattcaagaaatagaacaaattgttaagaaatggaatcgcaaagcgaaaattattgtcatgggttcctaccaattgggcgcactcaccaaacaatcagacatcgatgccatttgtgttgtgcccgaattacgcacttggagagcggcaaaattttttgggaaggcaaagtgccaaattcaatggaacgggttcagaaggtgcgcggatgattcactgttttgccacttttgtttggcggcccaagtaacggggctcaatcggatccaagacgcgtgggtgccgctgattaaattcaaattcgaaatcgacccgaaaacttccgtcgattttgacattggactagaaacatttgcaatccgtgacgacatttttaaatccgaagagccaataaaatacgaacaatgcgacgcattgtcagcgaaaatggcc

SEQ ID NO: 87361 - DNA, 509 bp, Heterodera glycines
  SCN-specific regions: Sequence locations=1-509
agaaactggcattcctttgacaaagtcgattcgaccattgaaaagaagctgccagatgaatacgctgtgaaaggatttccaactctcaaaatactccgaaatggccgaaggttcgattataatgggccgagagaagccgacgggatcgtttcgtatatgttggaccaggccaagccggccgccaaacggctcaattcggcgaaggaggtgctcaagttcatgtccccctctgatgtgacagtcgtcggctttttctcctccgaaagcggcgctttttacgaagcttttgctgacgcggcggaaaggacgcgcggtgattttgccgttgggtacgccttggacggtgccattgcgcagcattttggcgcaaaatttggcgaagtagtactcttctggccagagatattccattcggagtacgagcccaaacggaagattttcccacgagagacggccacaagcgaagagttggtttccttctggcgcgacaatgccattccgttggttgg

SEQ ID NO: 87362 - DNA, 536 bp, Heterodera glycines
  misc_feature (459)..(459): n is a, c, g, or t
  misc_feature (476)..(476): n is a, c, g, or t
  SCN-specific regions: Sequence locations=1-536
tttgccacggaagagcggggcaaaggcatggctttaattggtggctccttctccctggcttttttgattggcccttccattggcgcctttttctcgatcggtgcccgggaaagtggcgagttcgacccgtccccggctctactggcaattgcactcacactggcagaattggcacttttggtgttctttttgccggagacattggccaaggcaaagaatgacgattgccataaacaaagtgggcatagccttcggcatttgttgtcccctcgggcgctgttttccttcgacttcttgtctccggcatcggcttcctccccgccggtttcggtgccattgctccaaaagtattcccgcgtctactttctgttcatgctgctgttctccgccatggaatttactctcggctttctcacccatttgcgcttcaattacagctcaatgcaacagggccggctntacctgttctccggctnttgtatgctggtcattcagggattcgttgtgcgacgcattccgtcaacactcaaagcaca

SEQ ID NO: 87363 - DNA, 352 bp, Heterodera glycines
  SCN-specific regions: Sequence locations=1-296,318-328
ctagcgcccgttgtacttgtgtacctgctaaatcagaatggctacgagctgtaccggagcaaggtacatttcggaccaactccgcgtgtgcatggcccgtgtgctgttcgtcatcccgttgctgcttggcacggtcgaactgttggcattccgtcactattccctccggcacaaacatcggccgaccagcgcattgcccatttgataaaatgatagtgcaaattttgtgatttaactctctctctctcccccattttctgtttttgttcagcttaattccttcctttctatgcacagggttttttccatataaatttttgtttttcccaaacaaaaaaaaaaaaaaaaaaaa

SEQ ID NO: 87364 - DNA, 641 bp, Heterodera glycines
  SCN-specific regions: Sequence locations=1-184,206-251,273-641
gtggatcttattttctatacccgtaataccgccatgttatctcgtccgcttctattcattgccgcccttctcttcctcttcggctgctgtcgtgcggatggaaatgttgtgcatctgtcgagcctcaattgtgccacgaaggacggaggaatcgatggcttcaaagctgtggacgacggtctgatcttggattcctcatctgtcaccgctgatacgtctgacctgcccctcatcggtttccagaagaacggaaaggaggacttgatcttcaaactctttgtgcgcgatggaggatgcgtctcaaaggccaatttcttcaccaacggtcaaccgtgtacactcggagagtcggaggacatgactgagtcggataagtgtccgggcgagggcggcacctccaactgcacatcccacgaagtcacctgtacgggcatcggaatggcgaaggtcgcggaggagtccaatggtcacgccttcaaagtcaacctggccaatctcaccaaacttaccaatccgtgcgcgcaatggaaggcacattttggcggtgttcatcaagtgctgaagggttcttccagcggagagaagtgcgcgagtgcaggattccccgtctggatcattgttgtgatcgtcatcatcgcttt

SEQ ID NO: 87365 - DNA, 609 bp, Heterodera glycines
  SCN-specific regions: Sequence locations=1-81,104-128,150-172,213 -275,297-609
cagtcgcccaccggcacaggcaaaactttagcttttatgcttccaacgctgcaaattttggtgcaaaagaaactgaccggcgcaggagagggaaaagaacagccgacgtctgtctccgattcgtgtcgcattttggcacttgtggtggcgccgggccgtgatttgattgtccaacttttccatcttttttcaccattgtgcaaaaagcttggccttagcactttgaaattgcacggggctggcggaaaacaaaagaaaaagagcccaaagaagcacatgaagggcaaatgcattttgatctgcactccgggaagctttgagcactttttggagaaggaggccgagttgaagcagtacctgaagcacttggaagtgctcatcattgacgaggccgaccgctactcggacagagagtcaatgagcagtttgaccactttgcttgccgctttgccaaaacagcgtcggactgcgctgttctccgccacccaatcgtccagcattgagcaactgttgcgcttcggactgcgcaacccaactcgcgtgcacatggcggccgacacgggcgaagtgtgcacggactcaacgggatttgatgtgaaagtagcggag

SEQ ID NO: 87366 - DNA, 661 bp, Heterodera glycines
  misc_feature (598)..(598): n is a, c, g, or t
  SCN-specific regions: Sequence locations=1-352,374-605,631-661
gagcgtgcgcacccgcgagcatgcatttgtacacaaaatcatggccaaccgagaggacatgatggaactgatggtacgcgtcaagaagaaggacgaagacattggggagcaggagagacagatgattctgaaggggctggcggtactcaccgaggagaaattgcgctgtcaccgctgctcacgcgtcgatttgagtgttgcggaggcatccaaaattcggctttgccccaactgcaacgccatttactgcattgactgtttcaccattcggaagaattgcatgcgcaaagagtgccgggcaccgcttcaggcgttgacggaggatatcgacttctacgttgattcgtcgtgtgaagaggatgatgatggtgacatcgtcctcgaaccgccggttgctgctgaaactgaacctgaggaatcgcagaaggaggatgaacagagggaggagggaaaagccgaagaggaggcggccaatagcaaagcaatttgagagtgacaattaatgatacgataatattttgataatgtttctaggcagtttattttatgttgtgtatcttttgctgattgtgaacagatttctttctcctttttgctntaccggtgatcatttatttattttattttcccctaaaatatggcgatttattaaaaattttcg

SEQ ID NO: 87367 - DNA, 442 bp, Heterodera glycines
  SCN-specific regions: Sequence locations=1-442
tatatggcacgccgccaaagcaatgcgctgatcgaagcggccggcaagttaacaaactgttcattatgccgcccaatcggccgacacgcatcaaaaaagcgatgaacattttgtttggccgcaccgaggaggaaaaacgagtgaccggcaattttgtgtcacgcattgcggaacgcaacccccgtcgtgaggacatgtcgaccacgcaggactggccaagtgtttggcccaccgcgcagtccttccgttcatcggtggtgccgttgcccgtccgcatgggcttccgccgtaggccggaacggttcgcgccaaaagggccgtacgggaacttggaattgatgaaaattcccaactttttgcatctgacgccggcgcatgtgcatcgccatgggcaggcaatcaaaaaattttgcaccaaatttcccgaggagttgaagcatgc

SEQ ID NO: 87368 - DNA, 496 bp, Heterodera glycines
  SCN-specific regions: Sequence locations=1-496
tcgtcgtgctttcctgcaagactttgtcgaatttggcgaaaaggtgggccaatgccgagagatcgtcgacgaccaaatgccgggacagatcgatgtccaggaaatttgtctatgcgagggtaatttgtgcaacggcgacggccgtctcagagtgccaccgtctccgctgctgctgcttctgtcgctggcattggctgtccccacctttctttggtttctgcccgccgccgccgtgtgagccgacgaatggacggcacacgaacacgctgacggaacgtatcgcgactgacaccatcgaactctccgtgttgcctcgagactctcgccccccccccaattccctttgtttatattccccctttcgcgtgttaacctaatacattaagtgttgtttgtcgtctcttaatgaattaattgcttcttttgattgtttgttctctctcgacaatgcattttgttccaaatttgcctgtctctctcaagtgatattcctttc

SEQ ID NO: 87369 - DNA, 555 bp, Heterodera glycines
  SCN-specific regions: Sequence locations=1-310,334-502,530-555
ccgcggtgtcctcttctacggtccgcctggttgtggaaaaactttgcttgcgaaagcaattgcacgcgagtgccaagcaaacttcataagcatcaagggccccgaactgttgaccatgtggttcggcgagtccgaggccaacgtgagagatgtgttcgacaaggcacgtgcagctgctccatgcgtgctgttttttgatgagctggactcaattgctaaatctcgtggtggaaacgttggcgatgcgggaggggctgccgaccgtgtcattaaccaagtgttgaccgagatggatggaatgggatcgaagaagaatgtgtttatcatcggagcgacaaatcgtcctgacattattgactccgccattctgcgcccgggtcgtctggaccaactcatttacattccgttgccggacgagcccagtcgcctgcaaatctatcgtgcttctctacgcaagactcccattgcaaaggatgtggaattggaatacttggccaaagtcactgttggcttctccggagcagacatcactgagatctgtcaacgcgcttgcaa

SEQ ID NO: 87370 - DNA, 510 bp, Heterodera glycines
  SCN-specific regions: Sequence locations=1-420,443-510
tggattgatccgccagccccaatgtcggtcgctttgaagcagtggagtttatcatccaatcgttccggggatggctatttagtagtaggatgattctgcccgcgttttattcctttacctttggccttacttcatgcacttcggctacatttcgcgatgaggacgattcgtggaattggatcgcagcaagcgccatttgcggactcgcccatgccactataagaaataacataccgcaaggatttgctttggctgctatcggctctttgttgggcgtctcctttcaagctgttcgaatcagtcacaacggctttggaatggtccacaaccgaatgactcaaggctttcttccgtttactggcccattggactggaagcatattccaacggatgccgttgatgtgttcttcgaatttggcgcagaatcattcacttttaggcattttttgcccaaagcttaaaaagaccaagtcaagttcattgactgtatttgtatggatttaggaaatg

SEQ ID NO: 87371 - DNA, 519 bp, Heterodera glycines
  SCN-specific regions: Sequence locations=1-498
atcctgcttacgtcgtgctttcctgcaagactttgtcgaatttggcgaaaaggtgggccaatgccgagagatcgtcgacgaccaaatgccgggacagatcgatgtccaggaaatttgtctatgcgagggtaatttgtgcaacggcgacggccgtctcagagtgccaccgtctccgctgctgctgcttctgtcgctggcattggctgtccccacctttctttggtttctgcccgccgccgccgtgtgagccgacgaatggacggcacacgaacacgctgacggaacgtatcgcgactgacaccatcgaactctccgtgttgcctcgagactctcgccccccccccaattccctttgtttatattccccctttcgcgtgttaacctaatacattaagtgttgtttgtcgtctcttaatgaattaattgcttcttttgattgtttgttctctctcgacaatgcattttgttccaaatttgcctgtctctctcaagtgatattccttttaaacgattctttgg

SEQ ID NO: 87372 - DNA, 521 bp, Heterodera glycines
  misc_feature (18)..(18): n is a, c, g, or t
  misc_feature (519)..(519): n is a, c, g, or t
  SCN-specific regions: Sequence locations=1-166,191-521
aggagaagacaagcggtncttcccgcaggagcaatttgcacttcaattggcgtccatgccggaatttgccgcctgcggtgccctgttcaagtcgtgtgccgcggttgagctcaccgaaaccatcactgaatacaatgtgtcatgtgtgaagcacattttcaacgacgactttgttcttctgcagtttgactgtcgcaacactttgaatgaccaactgttggaggaagtttttgtcgaaattgagccgcaggatgagggcgaagattgcccttggcatgtgcaaagtgttcacccgttggcccagttgcccttcggccagccttgcaccacttatgtgctgctcaaaatgccggaggacggacgcattgccggcacattcggcgccaaactgaagttcaaaatttgcgacgtcgacccggcaaccggcgagccggaaagcaacgatttgtacgacgaagtgtacacgttggagcccatcgaagttggccttgccgactttctgttggccaccgcgccganag

SEQ ID NO: 87373 - DNA, 508 bp, Heterodera glycines
  SCN-specific regions: Sequence locations=1-38,62-508
cacggcgttatgggcgcaatgccaccgcacatgcaaccgggaatgcctcctcctggcatgatgcgtccaccgcatggctctttcatgcttcctcctccgcccccccggcgcctctgttggcgatgagccgccaaacaaacgcccgcgcgaagaaacgctggaaccggaagaacgttggcttcaaaaggtccacggtcaaatcgctgtgcaaatcgctacgccgcaaaatgatgaatggaacctgaaggggaacacagtacaaattcagttggacatcagtccatcggtcactgcgttaaaatcgttaatccaagagcagatcggagttcctgcaaccaaacaaaaattagtctacgagggcattttcatgaaggacagtcagagtttggcctactacaattttatgccgaatgcttcagtgcaacttcagttgaaagaacgcggaggacgaaaaaaatgaaatgtttttttgggaagtgatcacagaatgatgaatgaattggattac

SEQ ID NO: 87374 - DNA, 565 bp, Heterodera glycines
  SCN-specific regions: Sequence locations=1-565
ggatttacttgcgtggcatgttcctacaaagtcgtccatgctttgctgagttgggaccagttcgaaaaaattatcctctacgcaaagaaagtgaatttcgagccggattatcttttccaaatgcgccaagttcttcgcacacatcccgaaaattcctcaaaattcgctctgatgttgttgaatgaaggtccaagtggcgaaccattggcggacattaatcagattgttgattgttttgccgaggctggaaacatccaacaatgcaccgcttttttgcttgaagcgctcaaaagtgacgacgagtcccaagggcatttgcagacccgtctgctggaaatgaatctgatgtcaaatcctcaagtggccgatgctattctgggcaaccgaatgtttaatcactacgacagagcctcgattggtcaattgtgtgaaaaagctggtcttccgcaaagggcgttggaacatttcaccgatttgtatgacatcaagcggaccgttgtgcacacacaacatttcaattcagagtggcttgtcagttattttggccgtttgaatgtgcaagatt

SEQ ID NO: 87375 - DNA, 260 bp, Heterodera glycines
  SCN-specific regions: Sequence locations=1-235
tcaaagaatgtttcacgaatggatgtcttcattgcgttctgttttgcctgaacctctctgtcattttgaagacactggtctcattgtgctcgcttttgtgattacagcacttgtcgtccatttggtcaatttgctgtttgcctccaattcgggtccggctcccttcaatcatcgccttctccatgattgtatcacccgactgaaggagcaggaattgatcatcgaaaaagcgaacaaaaaaaaaaaaaaaaaaaaaaaaa

SEQ ID NO: 87376 - DNA, 523 bp, Heterodera glycines
  SCN-specific regions: Sequence locations=1-523
acgacccgtttttctccatcgactttccctgcccaataaaatgcatctttttcctcttttgctagtgacattcgcagttgctggcttcctctcattggcttctggccaacaaaatgccaattccacggatggcccagcagacgacgatgatgaagcggcgcccgttgacgcggaagaacagttcaggcagttgttccaggcagtagacgcggacgacaacgggtcaatcagcggggcggaggcattgcaattttggcagaacaaatcgaagacgatggacccagcggagttgaaaaagaagttggatacgttcaacgccaaaacattggacgaggcggtcgaacggggtttcaaaaaggtggacaaaaatggagacagtgcggtgagcccggaagaactcaaagcgtatattcaaagctgagaaaacagaggccagaggaggtcagaaaggcgaagcaacgatcagacgaattgaattcgtttaattcatagacggactttcgtttcaccccttattcggcta

SEQ ID NO: 87377 - DNA, 511 bp, Heterodera glycines
  SCN-specific regions: Sequence locations=1-67,90-224,246-403,425-511
caaaatgaacttatcattgagtcatccatgaacatgttccttctcaaatgagaattacaaaagaacgcaaacatttcctattttattggaaaaaatggaagaaataaatcaatgggtgccaacgtacttcatcgaatttggcaccgaagaacaaaaaagttcaatccgagaaaaggcaagcacagaaaagataattggaaaaagtgataaaaggaacagtgccattggaaatattctaaatgaaatcgaaccggaaaaggtcaatgataaatgggcaaaagtgattcattttgtgccagcatcggatgatgaaaatatgcttatctttttccaaatcgaaaatcccaaattttcaaaatcaatcagcaagaacacggaccttttgccttatgaaaatgaccccgaaagatttgaaagtctatcaatgtgtgaactttatggcgacgattgtcaaccaatcagagaattattggtgaaaattgaggagttggaatactgtggaaacgaagcc

SEQ ID NO: 87378 - DNA, 506 bp, Heterodera glycines
  SCN-specific regions: Sequence locations=1-163,185-279,302-461,484-506
aagatccaaaaaatgccaacttttcaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattag

SEQ ID NO: 87379 - DNA, 510 bp, Heterodera glycines
  misc_feature (508)..(508): n is a, c, g, or t
  SCN-specific regions: Sequence locations=1-16,38-171,193-287,310 -469,492-510
ataaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatnta

SEQ ID NO: 87380 - DNA, 354 bp, Heterodera glycines
  SCN-specific regions: Sequence locations=1-23,46-296,332-333
caccgcggcggagaaatggggagcagaggacaaagtcagccacgtgagcaccggtggtggtgccagtcttgaactgctcgaaggcaaggttctgcccggcgtcgccgctttgagcgatgctccgtgaacaaactgaattgcctcgactgactgacaattgaattggctgtcggacgaacgaataggcggaccaaaaaataagaatttgaaataaattattttcttaggttgtttttttgtgatttttcacattcactttgacaaaatgattgattgctcttaatactatttatgcctttgataatttactaataaaatgcaatttaattttccaaaaaaaaaaaaaaaaaaaaa

SEQ ID NO: 87381 - DNA, 613 bp, Heterodera glycines
  SCN-specific regions: Sequence locations=1-613
aaacgccgcgttgtcgaaagtgtggaaaagccgtcgatgtccatcgaccaaatcgacgaccctttgatccgtgaattggtcgtgaaagagcgccaatttctcaaattgctcacttcgaccaccgccccaattcatccgtccgtcactgacgcactgtcaaaaccgagctgtttccgacagtttgtgcagcacgaacataaccaaatgaaattcggggaccaaatgaacttttcatattggcgagcaaagattctgtccacttcaattgaatgggccaaatcgtttgaagaaatcgagaggatggacgactcggacaaagaggcgatggttgtgaactcggccttttcaattctcgtcttttctgaagcgtttcacacccccgagcggttcaccgatcgcattatgttcccggacggactgtctgggttccgcaatttcagtgccaacattatcaaggagcgcagtggtctgatccccacggttgttgccgttatcaacaacattttggtcccaatccgtcgaatgcaaatgactgaaattgaatatgtgctccttttggccattgtgcttttcgactcagaatgtctttccctcagcaagtcggccgttgcca

SEQ ID NO: 87382 - DNA, 183 bp, Heterodera glycines
  misc_feature (17)..(20): n is a, c, g, or t
  misc_feature (33)..(33): n is a, c, g, or t
  misc_feature (45)..(45): n is a, c, g, or t
  misc_feature (57)..(58): n is a, c, g, or t
  misc_feature (60)..(60): n is a, c, g, or t
  SCN-specific regions: Sequence locations=1-94,117-183
ccccccccccccccccnnnnggaaagggtgagngtaaaaaccggntattttttagtnntnaaaagcattcatctatgtctttactgaacattctgtgtcttataatttctgcttttggtggttgctaaatgattgttgcaaatgaaagttccttgtactgaggcaaaagattaatttgttgtt

SEQ ID NO: 87383 - DNA, 467 bp, Heterodera glycines
  SCN-specific regions: Sequence locations=1-37,71-74,103-128,165 -318,400-467
ttaaaatgcgcgccgttctcttcctggccatggtttgcttggtgatggctgttattcttgagacagccaactcaaaggcagtgaaaaaagacaataagaaaggagcaattacaacgccagcaaaaggaaaagcggcgccgaaaggagcagcgaaaggaggaattaaaaaagacgcaaaatcaaagggaaaaggaaaaaaggacgccaaaggcaaaaaggacaaaaaagctaaaccagccaaagggaaagcatcgcctaaaaatgacaaaaaacccccagctgccaaagcaaatgacaaaaagagcccaaccaaaccaatggcagcagtgaaagccgtgccaaaggcggcggagaatgctcagaagggaccgtcgagtgcggaagtggtggcggaggaaagcaacttggacactgaggcggtcgacgacttgggggcggaagagtcggactttgaccaattggcagag

SEQ ID NO: 87384 - DNA, 575 bp, Heterodera glycines
  SCN-specific regions: Sequence locations=1-251,274-411,434-442,482-575
tttttaaagccctttttactatcggaaatgaatccaacggttttttctttgttttagcggtgctctttcttgtcaaagtcgactttttacagtgcaaatacaatgaaccaatggcacgacaggtgctgcaaaagcatgcttcacaatttcagcagcattgtaaaaatgcccgcagaggaagtgccgtggccaaatgttgcagtgccatcagaagcataatgggccgattcacaagccaaaaaaaggcaatgaaccaaatgctggccaagtgtaaagcgggcacaacgccaagcgaagcacagcaaatgcgaagaaaattggaaggatcgaataaactgaaggattgtggccagtttaaaagccaaattcagcacaagttcagcgagttgaagcagtactgcaacaatggggcagaaaatgaggaggaaaacgacgaatgatcagagagggagagagaagaggagagagtagagagagagaggaacagcaaaattctaatcactagtgatcactgataattgccgattgattgaccggtacgactcatttggctgattgaagtttttttatggcat

SEQ ID NO: 87385 - DNA, 125 bp, Heterodera glycines
  misc_feature (124)..(124): n is a, c, g, or t
  SCN-specific regions: Sequence locations=1-12,34-125
ggaacgaagaggaggcgaaggacaaaaaagagacattcattgggggggggcgaccgcgacttgacaatgaatcgccaaacgactctctcaatcgtgttgtgtctttttctgtcccttcctttant

SEQ ID NO: 87386 - DNA, 674 bp, Heterodera glycines
  SCN-specific regions: Sequence locations=1-4,26-28,262-302,443 -568,590-674
attttttcttccttctgccattttgtgcatatggtcgttttcatttccacccctctttattcgtggtgtgtcgctattgcgctcgtcttaatgatcatctctcaatgttgcggctgttctaaaaagaaacaaaagaaagctaaagagccgctgaaagcaatgcctactcagaaagcggaagaggcatctacagggagcgagaaaacgggtcaaagcgttgtttctgttaggccacccaatgtgccgacaactgctccagtcgcttcaaacccacccatcagcgcggaacagaatattgcttctattacacttacaccttcagatgtgaagacacctgcaccagtgggcgggaaaacgggtcaaagcgttgtttctgatacgccaccaaatgtgccgacaactgtgacttcaaaaacgccgatcaaagcaggacagaatgctgcttctgttaggccaccagtgcctgcaaacacatcaacaagttcaaagcatgtcaaagctcagggcactgtttctaaaaaaccttcgaaagcatcgtcatcacatacctcactgaaggtacccgacgacctggtttctgcaataaaatcgcatgtgccctcgtttctccatgatctagcatcacaaattactggaaggatggaccaaagcagtgcttctgccatgtcaagtga

SEQ ID NO: 87387 - DNA, 503 bp, Heterodera glycines
  SCN-specific regions: Sequence locations=1-27,49-129,229-354,378-476
gtggtggcacaagccggggggttagcgactgtttagcaaaaacacaggggctctgcgaagcagcaatgcgacgtatagggtctgacgcctgcccggtgcctgaaggttaaagggaggagtgaaagctccgaactgaagcccaggtaaacggcggccgtaacaataacggtcctaaggtagcgaaattccttgtcgggtaagttccgacctgcacgaatggcgtaacgacttccccactgtctccagcacaggctcagtgaaattgaattccccgtgaggatgcggggttcccgcggtcagacggaaagaccctatgaacctttactatagcttcgccttggcgttagcgaccgtatgtgtaggataggtgggagactatgaaaccggggcgccagctctggtggagtcgtccttgaaataccacccttactgtcgttgacgtctaaccgagggccgttatccggtcccgggacatggcgtggtgggtagtttgactggggcgg

SEQ ID NO: 87388 - DNA, 511 bp, Heterodera glycines
  SCN-specific regions: Sequence locations=1-27,49-511
atgtgtcgtgttcctgtcgctaactgtcctcccttttcccttttttatcctcatcgttgtcctgaaccaaaaatgctttatcctgcacaagctaacattgtcaaccgtctgctgtctcgtccgagtccatcctaccgttgcaccatggacacacttcgtcgagctgatcgacgattagtgttcagtagattcagacattggaagtcattcagcgaagagtctgaagcacttacatgctgtgctttttcgcccacagataatcatgcttttctgggaacatatgctggtgacattttcgtcttcaacattcacactggaacagtcgaaacgaattacaatgcacagcattccgcgatcaggacaattcagccatcgaaggaccggttgatgctaacatcgtcagcctatgtaaagccttattgtattctttggaaaatggacgaaaagggaatttccatccatgagcgcttgattgatttcaatgaggaagaatcggtcgaatttgctaatt

SEQ ID NO: 87389 - DNA, 491 bp, Heterodera glycines
  SCN-specific regions: Sequence locations=1-491
atgaacttcctcccgggcgtgcccaatttgcccgaccctttcgttcgcattttgcatttctgcaacagcgaagaaggcgaaaccatcgaattgcccgaattccgaatttttgtgccggacacttatgacttgggcatcctcgtgttggaccagaagactttgcccaattccaccgttaatttccccgtgcccgagaacccccgtcgacgcctgcagcaggcaaaaagaccgacggaagtcggcactttggacgaaagcaatggcaaaaagggggcggaagatgggtttgtgactgtcgacgcgccaaaaagtcacaacgccaaaggcctggacgaccttttgccgcccggcaaaacggtgaccaaaacgaacggcgatttgttgtgggagacgcaatcggtggagatggaggaagtgccggccgaatacgacacgtcgatacggcaaagtcagcagcacaattgggaggaagagtccaacgatggaaatga

SEQ ID NO: 87390 - DNA, 545 bp, Heterodera glycines
  SCN-specific regions: Sequence locations=1-72,101-132,159-545
ggtgaggcagacgatgcacaaaacgagaacatagcgaagagggaagagagatcgaacaaacgcaaaacaccaccggagaagaggaagaagaagacaacgaaaccgacgacaatgtcggcatgagttccactgaaagtgatggccaagacaaaatgaaagccaacaacggaaaagggacgtgtaaaaatgaagacgaatccaagccaagtccaacggttgaaacagaacagaataaagtgcatcagtccgcttctgaaactgtgataagtcaaaaggccaatgccaacaattcggaggaatgtaaggaaagcaatggagagaacggcacgcgcatttcaatgaaacgacaacggcgttcacattcagtggacagttcgccacagcaaaagcgagtcttttcacgcaaaaattttactgccgaggacaaaccgtcgacaaacaaaaactctgctgaacattcaaattcacgagatgaaccagctaaatgtgatggagatgaacagaagtgcagtgtgagtgatgagcaagtcgcagcggacaattgc

SEQ ID NO: 87391 - DNA, 504 bp, Heterodera glycines
  SCN-specific regions: Sequence locations=1-34,56-189,211-305,328-504
gcggcacagtaataaaatataaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcaga

SEQ ID NO: 87392 - DNA, 552 bp, Heterodera glycines
  misc_feature (490)..(490): n is a, c, g, or t
  misc_feature (498)..(498): n is a, c, g, or t
  SCN-specific regions: Sequence locations=1-329,351-358,397-435,457-552
ggtcgttgcgtcggtcgttcgttgcttttttcttttcccgctttttttctgattcgtccatttgtttctctgtccgccgttggccgactcttcgaataaatttatgaattcgctgaatattttcttgcattgtgccaactttgtgatcttcagtgccgttattgctctgattgtccaccaccaaactgtccttttaaatgccgagtccaattcgacttcgaaagggcaaaatgaagcgaatgagacggcactttttaagaagataaacgcaactgataagaaggacgagggacagaaagtgttgttattgttgaagcaaaagcaacgacaacattttggagaagaaaaaaccgttaattggtcatcaaatatcaccagcagcaacagcagcagtgcgtcgtccattccttttagcgaaacaaaaaaagcaaatcgcgggaacaattgcacaacgacaacggcacattttggagagaaaaattcgacaaanaaagacanacagaaaagagaaaaacgaaggaagagagaagccgattcgacggtatccgtcga

SEQ ID NO: 87393 - DNA, 576 bp, Heterodera glycines
  SCN-specific regions: Sequence locations=1-283,305-576
gattcgagccatttcgagcgtacggcctttgggacggtcgctttttgggcgttgttctggccgactcttcgcagcccaaactttggcacaatttgaccaccgctggcacaatcgacgcgatcatcaccgaccctccttatggcattcgggaaagagggcaaagattgggcagtgataaacggaaaacgccgaaagagactgaaattgagaatgatttgcacaaaaatggacaaacggaaagtgcagagaaagacaaaaagggaaatccaagcgaatcactgacaaaatcagccataaagaaaaatgtcggaaacgaggaccaaattgaccatttcggcgtcggattcccggagaagcagaaatatgccatgtccaacgtatttttggatctaatggatttgtccgcccgtttgttacgtcccggcggtcgtttggccttttggttccccgtttgcagatccgaatattccgaacgtattttgccccgcatggattgcatgcgattggtgtgcaactgcgaacaaacactcgcgaaggattcgtcccggcgccttttggtctatgaaaagcttcgcc

SEQ ID NO: 87394 - DNA, 670 bp, Heterodera glycines
  SCN-specific regions: Sequence locations=1-670
gtgtgcctctccaatcgccaacaacacaccgtttgttctgaaagctaggccgttgcctgagggactgccggaagccattgaacgcggcgatgtcaactcgacggacgacccgaaaaatcgtgctaaaatactcaccgagaaattcgaaatggacgcgaccgactcgcgcaaaatttggtgcttcggaccagagggcactggtgccaatttgctgattgacgtgacaaagggtgttcagtacttgaacgaaattaaggattcggtggtggccggtttccaatgggcaaccaaggagggtgtgctctgcgatgagaacatgcgcggcgtccgttttgacatccacgacgtcacgctgcacgccgatgccattcaccgtggcggtggccaaatcattccgacggcgcgtcgtgttttctacgcttcggtgttgacggcaaaacctcgtctgcttgagcctgtctatctcgtggagattcaatgtcccgaagcggctgttggtggcatttacggagtgctgaaccgtcgccgtggtgtcgtctttgaggagagtcaaattgctggcacaccgatgtttatcgtcaaggcacatttgcccgtcaacgaatcattcggattcactgctgatttgcgcttcaacactggtggtcaagcgtttccgcaatgtgtgttc

SEQ ID NO: 87395 - DNA, 615 bp, Heterodera glycines
  SCN-specific regions: Sequence locations=1-282,319-615
tatcgcattctttcgagagatgaattgttgagcagtatgcataaaaccggcaatttgaaggccctttttccatgcagtgaacaactgattttgatgctggacgacagacccgacgtttggatgcattccgacgctctcatccgcgtcaacccatatcgttttttttgcggaaattggcgatatcaatgctccaccacaggaactgctcgactcagtgcaagcgtcggaagaaatggaaaatacgcaagctgataaatggactttaaagcaaaaagtgaaatcgaaaacagaagaggacaaaaaggagggggaaaagagtcttttaacgacgaaaaacggagaagaaaatgcccaaaagaaaggcgaaacggaggaaaaagagagaggagacggaggggggaacggggaagaacggactgaaaatgccttagccgagccaattgcggccattgtggacgatgacaacgcattggaacacgtcgaacgtgtgctggctgaggtacattcgctattctaccaacaatatgacaaggacaaaaagatccctgatgtaaaacgcattttgggctgccttcgttccaaagtgctccgtggcgagcgcattgtcttctctgg

SEQ ID NO: 87396 - DNA, 606 bp, Heterodera glycines
  SCN-specific regions: Sequence locations=1-185,207-236,258-258,425 -432,548-548,580-606
caatctgaggaattttttggggttgccttctttcgacgagtcgcttttcccgcccaagtcgatcgcattgctgaaagtgcttgattcggaaaaaaaccgattggaagcgaaaagggaggaaattgtggggagccaagcgaggctgacgggaaaatacaaagcattgtgcgatagggtgggaacaacggcgcgacaaatcgaaggagtgcacgacagaattatgtccgaagatgagttggacaaactcaaaggcgaggtggacgcgctgcagacttttgtcaacaaacggctcgagaaggcacttcagctccaagcggagagcaaacgaatctttgagaccattcgcccgtccatcaatagtttcaatgaagactacctccactttttgcgtgttgacttggacagccaatccaccgtgttatcgtctgactttctgaagaagatggaaacattgaatgaaagactgaaagatcatcacgacttgtgggctaaacaggtcgtcttccgctatgacgagctgctcgttaaattagacgagttgtccgcaaaatgtttccaaccttctacggagtttccagcaaagccaaatttgaaaaatctgagtga

SEQ ID NO: 87397 - DNA, 559 bp, Heterodera glycines
  SCN-specific regions: Sequence locations=1-424,446-559
ttctgtacgtccttaagttatttaacattattaatacaaattacgacaataattgagctgttaattgccgcaaaatgaatcgacgtttaaggaaaatttggatttgtggcgacgtttggatggatattctgccatcttttgaacgcggtgaactcggcctcaaaattgcattgctttcttaccgttacgatgttttggtggacacgcattttgacggaaaaaaagaattgacaatttggaggacaatcaaaatttgcgacggcattggcccagaaccgaaattgtctgtacagatcaaggacaaatgggtggagtttccatttcccgactgtccgttgcccaacaaaatacgatttaagcatctttggattacttacattgaccattccgtcattgaatttctccgttccaacaaacaaatttgggacagaagtggcaccgacttgctcattcaaatagaatcagacacaaatgttatcaagccgatttgggatgtttttaccagtgaaatttggccaatttttgcgacaagcattcgtcatttgagcattgcaaatgg

SEQ ID NO: 87398 - DNA, 417 bp, Heterodera glycines
  misc_feature (263)..(263): n is a, c, g, or t
  SCN-specific regions: Sequence locations=1-16,38-171,193-288,311-417
ataaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccnatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggaccc

SEQ ID NO: 87399 - DNA, 577 bp, Heterodera glycines
  SCN-specific regions: Sequence locations=1-2,41-56,195-577
acaattttgacgatgttttcgacgagttcgacccccgtcctgtggcgctgcttctctcgcgcaagtgcacagggccaagctgaagtcaagcgacgaatacgtggcagtcaaaatacaacatttgcatgtaaagaccgcagttttgttgacatggccacgatggagtttttcgtcaacgtcgcctcctttgtgtttcccgaactcaaattgaaatggttggtccgcgagacaaaattaaaccttccgcaagaattggactttcttcgcgaggccgcaaatgctgacaaagtgcgtcgaatgttctcccacatgcgttttgtcaagatccccaaaattcattacaattactcttctgacaaagtcttaaccatggaattctgcgaaggtggtcaaatcgacgacttggactatttccaagtccatcagcttgacaggcacaaaatttgtcgtctcttgggcgctttgtacagcgaaatgattttccgccgcggctacgtccacagcgacccgcaccccggcaatgttttggtcagacgaagtgccaacaccgggcgggaggaaattgtgctgttggacc

SEQ ID NO: 87400 - DNA, 583 bp, Heterodera glycines
  misc_feature (523)..(523): n is a, c, g, or t
  SCN-specific regions: Sequence locations=1-583
gtggcagtgattgagcggtgagtttcgtccgcattccgtcgttttgactcccccaagggtttcccattcggccctctccgtcccctcgggcgccaacttcggctccgacatggtccaattccgtcaaatggcgcactctccgcccattctctccgtgccgttggcgacttcagtccatcagtcttcagctggtcgccttataaattctccgcaagctgagaatacgacagaagagtcgaacggccgactcagcggccaactgaaacattcgccgaccgtcggcagcgcagcgacatcgccgttggcgagcagttcgaccatcggagtccacgaaatctctctttcctacgtccgtcccaacactttttcgccttcggccggggatgaccgtcgttctttgccaacctatttaagttctcctccggcgcgttcttcggcctttttcccctccggtagtgttcatatgcatttcagcgcgggaaaggcggaagatgcgcgattgctttacacaattggccgtccngaggctgaatggagttttggcgcgggcgaatcgattcagattagtgacagcgaaacgaaa

SEQ ID NO: 87401 - DNA, 545 bp, Heterodera glycines
  SCN-specific regions: Sequence locations=1-229,251-545
cagtgattttgctggctaagattggcccagctcagggtcaatttatctggtctgtacatacatattcaatcgtctttcgcgcttcccaatattctaacaataataaggcacaaaacattgacaaacccaaccaatcagtcatttcatcagatgtcttcaacaacgttcacgctaataagcgtgccctcccttattgttctgttggtcggttattatgtgcaaaggtacggaatgccaccacccccgccaaaaattgcgggcattgatttgggcaccactttttcctcagtcgcaatttttcaaccgcagacgggcgaaacgattgtgctgaaggatccgcttggtaaaagaagcattccgagtgtagttggctttctggaaaacggcgaaattgttgttggcacaagggcagtggaacagcaggaaatgaacccggagaacacaatttatgacgcaaaacgattcattggaaggcgtttttcgtcagacgatctccaatttgagtcggatcgcaaacgctatcctttcacaataaaattggacga

SEQ ID NO: 87402 - DNA, 553 bp, Heterodera glycines
  SCN-specific regions: Sequence locations=1-3,25-553
ggctgaaagaatggctgaggaggctgaaaggatgtccgcacgtgaattggcctcgcacggagtttccattggcattcccgctgttcacgaccgatcaatcgattttccgcggatctgcaaaaaggaagagaagctgtcaaggggtttggtgtcgaactcagtcgatgtcggcatttcgggcttctacgaccggttcgtggcccctcgactgaggaccggcgttgacagcgtggacaatcttgccaaatgggccgaaaactatctgaaacgtgttctgttcaatcccgaaagtgtggggagcgctgcggaaagggcggccaaaattgcggcggagcacaagcgtgatgggcatattatgtgccattttcttgacgactggttgacacattcatctgaagccaacacgaatttcttcagttatgtggccatggagaagttccacaacggcgtggcaaaagcgatgaaaggcgcctgtcccgacgacgtgcagcgcaagcttgaggatgttcggcgccgtgtgctttccgcgccgatgaacgtccacttcggcgga

SEQ ID NO: 87403 - DNA, 425 bp, Heterodera glycines
  SCN-specific regions: Sequence locations=1-98,121-371
gtcaccggactgactctgctcgttttgtcctgcgcccttccgtccttagcaattggtggccattgttcgtgctgttcttttactttttggcaccgttgcccatttccattgccaaacattcgcgctacgaaagcagcggaacatcaccggccattgaatttgcacaattcgccaccgccggcattgtcctctccgcctttgcgcttcccttcgtcctcgcccacgccggagtgatcgctttcggtgcgtttgttgtcgcttcgttgggctcgctggtcattttttgcaccatttttgcctatttttatttgcaccaattggaggaaaacggcggatggagcgcttcagtgatttgagaaaagcacaaaattaaaaaaaaaaaaaaaaaaaaaattttaaaaaaaaaaaaaaaaacaaaaaaaaaa

SEQ ID NO: 87404 - DNA, 290 bp, Heterodera glycines
  SCN-specific regions: Sequence locations=1-263
caatcgatttataacaggagccgaaatgggaccaacataataatgatcctgccctgtcaacgctcaaatcatgtccccgatgttggcaggcatttcttcgatttggatacaaatatcaaaatgttcgccttttccaccgccacctgtttcgtcacaaagttgatggccactcccttacgaccgaatcgtccggaccgaccgattctttaaaaagacacacacacgtttttttaattgcattactcgaaaaagctaaccgatggaaaaaaaaaaaaaaaaaaaaaaaaaaa

SEQ ID NO: 87405 - DNA, 316 bp, Heterodera glycines
  SCN-specific regions: Sequence locations=1-34,58-126,195-289
cagtcgcctccgcccggcagcgaaccgccgccgactgaggagaaggacgagctgtgaacggtggaatcaccaagtgctaactgtgacgactttccttggtctatcccccttccttcccccactatctctttggtttttcatttatttatgttattggtatttttcagatcttgattctgtttttgtttttttttggatttatcctatctcatttcttgatcgagttgttgtgtggatatgtacggttttgttgactattttgtgcagcgttatatataaattctgcgacaaaaaaaaaaaaaaaaaaaaaaaaaaa

SEQ ID NO: 87406 - DNA, 395 bp, Heterodera glycines
  SCN-specific regions: Sequence locations=1-395
tggtttgcctgagctcgcgctccattaactcgttatggcttggctgaagatgcgaacttttctcgtaagcattaattctttctcagaaagttcccatctcagcatccaataaaaacttggagccgcgacaacgttcgttgtccgattattggctgacgaattcaattgcaagagcctctccgaccatggcccaatgcgtcaaagcttcgcgcgactacgccgttcagcctcacacggacccgctgagactggcgaacccccacgcctaaggaagggagcgaagaaggaattcgatttaattaggtcgcttgtaaatgtcttatttaaattcgttttgattctgttttccatgcgaatcaaaagttatcaaaaaaaaaaaaaaacaacaaacaaaa

SEQ ID NO: 87407 - DNA, 503 bp, Heterodera glycines
  misc_feature (464)..(464): n is a, c, g, or t
  SCN-specific regions: Sequence locations=1-44,68-365,387-503
tttattggctgaccgaccatttccacttccatttgctgtttcggcacttccttttcactcctttttgctgcaactcaccagtaatgagcagcagccatcgcgagaccggcagaagtccaagaagtgtgctgatgcgccagtacgaaatgctgctgcaaaactcgaacgacaacagcggattccgtgcctggttcgacaataacaatctcttcaaatggcgcattctaatcgacgggccgccgggaacgccttacgcgggatgcaaactcacggcactgctccatttcccggcttcgtacccaaatgatccaccgacaatgaccttcctcaccgacattcttcatccgaacattgaccagagtggcaaagtctgcatcagcattcttcatgcgccgggcattgatccgcttggccatgagcagccgtccgagcgttggaatcccaaccgttccgtggagtccatnttggtgtcgatccaagtgctgctggcagagccgaattta

SEQ ID NO: 87408 - DNA, 576 bp, Heterodera glycines
  SCN-specific regions: Sequence locations=1-353,376-576
taattctcttttcgtaaaatgctttctcccttctcctacgacccgttctatcgccgttcgttgtggcctatgaccaccgttggcaacgtcctttcgcccttccgccagttggagcgcgaactcgaccacttctttgacgggatgcagcccatgcttcgtgaccacgccgctcagctgaacgtcacggacaagggcgaactcacttacaaagtcgatgtcagcggcttccgccccgaggagatcaacgtggaggtgattggtaatgaaatcatcgtcaatggggaacatcgcgagcagaacgacagcgaatcggtccaccgtcagttctcgcgccgtgtgctcatcccggagggcatccaaaaggagagcatcaagtgcgagctggacggcggtcgcttgtgcatctgcggaatgaaaacggctggcgaaggcggacgaaccatcccaattgagatgaaaaagaaagcggccgtggaacagcagccgcaagcggagaagaaatagagggggacaaatggagacgacggaccgatcgatccattaatatgggtctcctcctttggacattttaaatta

SEQ ID NO: 87409 - DNA, 647 bp, Heterodera glycines
  SCN-specific regions: Sequence locations=1-647
ttggggtggcaacgctgcaacgggatgcaaaacattcttaggcgaaccattgtctctgaacacagttttgtgtgccagtacagtggcaattgcgacgtgacaaagaacgttcgctgcgcgtgccgacactgtcgctttgcaaaatgtgctgcggtcggcatggacgcaaaagccattcaaaatgatcgggacagaatcggtccgacaaagcgtgtccgactttcgcccggcccggacggcaagcgcagttccatggacgaggaccaactgtcgctgtcctcattgtccccccaagcgcgttaccaagacgagaagctggtggaccacaccatgacagttgaagcgttgtgcaatgtgttgaggaaatgtgtgctggtggagaacaaaagtgtgcaggaagcgttggcccaaccgtcgctgattttccaggcccgggatttgcccatcgatgagaggacggagttcaaggagttgtacccggcctcgatgaacgacattcaaatgtggaacattcgtgagctgcgcctgtgcttggaatgggccaaaacatttgaggagttccaacggatgacctattcggaccagttcgcacttgtccgacactttgcgttcacatttaacattctcaaccgcgtgttttattcatt

SEQ ID NO: 87410 - DNA, 375 bp, Heterodera glycines
  SCN-specific regions: Sequence locations=1-259,284-354
acctcgccttgccgagtgccagcaaattcgtgccgctttgaatgccaccggacgggaccacgtccttcaccttctcgtccccattcctcctccatctattgttggccctccgccttccggatgttttcctcggcctccttactcgaagccatttggcgggggatttgggccaaagtccggcggagcagccattccgggaagaggaggaccacagacaccggagagaagaaataacattggcactgaggagggtgaagagaaaaagtgaaggacagagaaaaagtgcaaagagaagccgattgattgaaaacgtacaatgaaatcacattcactctttcgataaaattttaatgcaaaaaaaaaaaaaaaaaaaaa

SEQ ID NO: 87411 - DNA, 513 bp, Heterodera glycines
  SCN-specific regions: Sequence locations=1-513
ccgaaattgtcgactaattggggcggtgcctcctagttaaggagttgctgctgcccaaactcaaagcaaagccggtccgaacagcttcaggaattgtgattgttgcggttatgtgcaaacctcacagatgtcctcacataaatttcaccgggaacatttgcgtttattgtcctggtggtcccgattcagatttcgagtattcgacccagtcttacacggggtatgaaccgacttcgatgcgtgcaatccgtgcccgttacaacccgtatttgcaagcggtcggaaggatcagtcagctgcaatcactcggacacagcatcgacaaggttgaatttatcgtcatgggtggcacttttgtgtctttgccggaggattaccgcgactatttcatacgaaatttgcacgacgcactgagcggacatcgaagttgcaatgtgaaggaagcagttgcttatggagagcacagcagaacaaaatgcatcggaatcaccaccgaaactcggcccgattatt

SEQ ID NO: 87412 - DNA, 578 bp, Heterodera glycines
  SCN-specific regions: Sequence locations=1-84,106-578
ccactcttctcgagtcgtcttttaacgttttagaaagtcttggcgaaatgctcacttggccttttgtcgacgcttttgtcattgccccaaaaattgcacttttaacgggtcgaaatgactttagctttgaccaattgtactaccgaagtgaaattgcgcttgtcgattccatcgatttgcccgcttttccccagccacgtgccactgatgtgttaagtgccggtgcgcattgtgaagtgcccaccgaacttccgaaggattaccgtgtttttgtggaggatcctcactcaaaagggactgtttacgtcgccttcggcaccgccgtgccgtgggactacgccccgcctcacattgccaatgccttctttgatgcttttgagcggttatctgaccatcgcttcatcttttcattccgtggcactttccccaatcggactctctcttcccatattcgccttgtctcttgggccccccaattggaagtgctttcccatccgaagaccaaagtctttttgacccattccggactgaagagtatcaaagaatcgctgtgttctggcactccgatgctaacaatg

SEQ ID NO: 87413 - DNA, 633 bp, Heterodera glycines
  misc_feature (604)..(604): n is a, c, g, or t
  SCN-specific regions: Sequence locations=1-175,198-205,227-294,316-633
tgtcgcgcgaccgggagaccaaattctgttgttgaacaacaaatgcaggaggttacaagcagctggaggacctcactaataccaagaagacgctacagcttgaacttgacgaaatgttgaccaacaaggacgacgttggcaagaacactttcgagctggagaagtcgaagcgtgccatggagaaggagatggaggacttgcgcatgcaggtggaagaattggaggaagcagtgcaattggcagaggaccaacgacttcggatggaagtgaacattcaggctgaacgcaacgagttcaagcagcagttggagcaaaaggaccaggagggggagaacaggcgacggctgctgcagagtcagttgcgcgagaaggaaatgcaactcgaggacgagctccgggcgaggacccgccagcgtacggtggtcacttcgctggaggttaaggtgcagcagctgcaggaccaagtggaccagctgaacaccgaacgggccaccttccagcggcgccttcgtgcattggctaaccaatttgggcgcgattgatttggtcgcagaatgtgcgcgagtttttcatgtttttgcgcgtttgactgaacacaccacanaaaatgctaacgaattaatttaagatcag

SEQ ID NO: 87414 - DNA, 668 bp, Heterodera glycines
  misc_feature (14)..(14): n is a, c, g, or t
  misc_feature (559)..(559): n is a, c, g, or t
  misc_feature (650)..(650): n is a, c, g, or t
  SCN-specific regions: Sequence locations=1-131,154-509,532-668
ggacgcgccccttntacttttatttgaaatacctccgccgatcattcacaaaagctcaaaaataatcccccgtaaagcgaacacaaaatgagaatgacccaagacgcaaatttgagcactttttgtgcccttttcactttccttctgattgttgaaggaactttcggcatttttggcattggcagcagtgacaatgacacaacgacgacgacgacacagggagggggagggacatcgacgacgacggcaaaaccaaagggaggagggacggcacacgacgaaaaccattccgatgactcatcaattcgcggcaaagcgcgcgagaagcgacagcaaacgaaccaacagcaacagcagccgaacttggagtctttgcccgtatgtgctaccggacagtcgcccattgcgccaattccgcccgccggccccgtccttccgatcggcgccattccgcccaccgtcgtttgtctgaagtgccgcccgcccaacggcccattgtccgggaacaatggcgcaaatggcaacaacggcacttaaaagcatttgccattggacgctntgtgaatggcaaccggtgaagaaaaaagagaactaataaatgccatggaaaaagcatttggacgaacgctgactaatcattgcttcttgtnttctaattcgttcgtttc

SEQ ID NO: 87415 - DNA, 632 bp, Heterodera glycines
  SCN-specific regions: Sequence locations=1-398,420-461,483-570,597-632
caaagaaaaaaaggtgcagcaaattttccgtgaacgtgacattctccgacttttgtccacgcccgcaaatgcgtgcccatttgttgtccatttgttttgcacatttcaagacgatgagtcgctgttttttgtgctttcctatgcgcccaaaaaagatcctatggcccggctgaaaaagctccaacggttcagcgttggccagtgccaatttgcgatggccgaacttttcttggcactcgagcacatccatgccctggacgtcatccaccgtgatgtaaagccggaaaacattttgttgcgcgaggacgggcacattttgttgtcggactttggctgtgccaagcaaatcattgcaaagcgggaaaatgtggcggaggaaaatggtgacaaaaccgacggacaaagagcagatgatggccagaaagcagagaaaagtgctgacagcaaaagcagcaaaaaaacgggaggaggaggaggcgacaaagctggcactgagacggcggtgctcatttgttggcagtggcgcctatgtgagcccggaggttctgaatggcaaggaagtgacgggtgcatgtgattggtgggcatttggcgtcactttgttccaactgttggtcggccggctcccattc

SEQ ID NO: 87416 - DNA, 530 bp, Heterodera glycines
  misc_feature (504)..(504): n is a, c, g, or t
  misc_feature (507)..(507): n is a, c, g, or t
  misc_feature (513)..(514): n is a, c, g, or t
  SCN-specific regions: Sequence locations=1-500
cagcgttaaactgcacagcaccgcggatggtctacgaggagtactgcttcgatgtgaggctcgacgacttcaacgaggagtactgtttcgagagacgaatccgaactacatgaccttccatggcgtcgactacgacattttcgtctgtgagaagacaatcagcgggctcaaagatgaccgaagcgaaaatgtgttcaaccgtagacaaggagcatgtgcaagcggggacgaccgatgcgataacgttttcaaccgtggacaagtggcaagtgcgcgcaatggtgaaggaagagacagcatcctcattcaaggattggcgttcgtcattgtgaaagtggtcaatgcagtgtacgatatgattgtttaattgtgatcaggatatattcatcacgtatatgtaaacaattatttttgtgtgtgtcgtatatgtacgaactgaatttctgaacattcgtcatatgtatgtaaaaataaatgtgtgtgaaataaattttggtagcaaanaanaaaaannaaaaaaaaaaaaaaaa

SEQ ID NO: 87417 - DNA, 261 bp, Heterodera glycines
  misc_feature (175)..(175): n is a, c, g, or t
  SCN-specific regions: Sequence locations=1-35,57-261
ggcaatcggcggagcttcaccccaacggaattcgacccaattgggacggccaaattgttaattctgaaggaccttcgcagagcaattgtgaatctcaatcaatttgctgagaaagccctcgacagttgctctaatccgactattgtctgcagtcctacaatcggcgctggagggnaagcagctgatcggtttcacgaagacggaaacaaaaagacatcagccatggtcatgtccacgggtgggccccactccaaccttggc

SEQ ID NO: 87418 - DNA, 445 bp, Heterodera glycines
  SCN-specific regions: Sequence locations=1-367,389-445
tggatataaaaattattccttacttttttggctgtgaaaaaaatgaattatgccaaaatttgtttcattttcctgcaactttttccaattttattccattcatcggaaggccgtgtcgaactttggcaagtcagccaaggtaatcccgattactacacacggggcgccattctgaatgaggatgctgtgccaaatgaaaattacaacggcggaggccaacattatgccacattctgagcaaaaattatgattgattgaatgatcgccagtccaattttgcattactgtacaaaaatcattactgttgctttaggttttcacttttgtataatccaatttcccctactgtacaaaaaattgttgttttaggttttttcatccaattttccgtgctgtacaaatactgttattttaggtgttttttttgtttaaataaattttaaaa

SEQ ID NO: 87419 - DNA, 576 bp, Heterodera glycines
  SCN-specific regions: Sequence locations=1-95,200-576
agaaagaacacttgccatgccaaagtgcggttccaccgaagaaagaacaacttgccaaaactgtggttccaccgaagaaagaacagctgaagttcgaggacagtgaagaggaggacgaagtgacggatgaagagttggacgacgaagagatggacgatgaggaattggaggacgaatccgaatcagacgaagaggaggaacaacagatggtcaagcccaaaaaggctggcactccaaccgttgcccaaacgcagcagcatcaacttgtcaatgccaaaagcgcggttccaccgaagaaaggacaacttgccaatgccaaaactgcggttccaccgaagaaagaacagttgtctacccaaactgacaaatacaagggaattgctgcggaagaagagcgtcgtcgtgctgagagggataaggtaactctttttttacgctgtgaaacgttgcaaaagatgaccgatggtgagatcaaagctcttcatcccgatgccttagctgtacgcaccaacaacagggctttttgctggatggtttttgcatcggaaccgactgcggataaggcatttgccgtgt

SEQ ID NO: 87420 - DNA, 565 bp, Heterodera glycines
  misc_feature (499)..(499): n is a, c, g, or t
  SCN-specific regions: Sequence locations=1-9,31-299,321-565
gctgccgccaaatgaatttgatttttgaaatattcgcctttggaatggacaatttctcatcggaaaaaaatgtttctcttcttcgtcttttcttattctttttctcgaccgtagtattatttggaagcgcacaccctatggtaaacaaattatgcgaagacctagataaacctgaaggttggcaattattgaaaaagttaacaatcgaaaagtgccggatgagtataatgtggaattccccaaatggaaagacagctacaaaagcattaaaaagtttataaaatattgcaactatcttcagaaaaacgaaaaacccgtccaagaaaacgatcaatataaacttttggcactaaaaccaaagtttctggatgccaataaaaatgagttaaaaatcagtgaagcaatgtctgaaattgttgaagcatacaaaataatgctgagcaaattagtaaagatgaaaatcaatatcactgaaaaactagaagaaaagatgctgaanaagcttcatttgtatgcaaaaaaagaattgcctgtaatggagtttaccaacagatcggattgcttg

SEQ ID NO: 87421 - DNA, 565 bp, Heterodera glycines
  SCN-specific regions: Sequence locations=1-472,494-565
tttgctttccaaaacccgcgtggagtcatttcaaaaccacaaatgtgagtgacagcgaaattgacgacattgtgcagaaaggtctaaagaagatgagaaacaaaagcgatttcctgagcagtccctgggacgatctgatggtggtcgacgcctttcagacaatttcttctctgaattcgatggaagtcgaaacgaatccgacagtttttgcgatgactgtgcaaaaaattgggcaaactcagcgaatggccaatgtccgaaagatgtggcaaaaatggaacgacgccgtcgcgcaaagggacgtcactttcgacgaatttaggcaaaaggtcggctcggaaacggtgaaacgatcgttgaaaaatttccaacggatgggcggcggcgccaattggaggcctatccaggacgtcaaaatcacttggatttcactacgccaaatgtgcttccagccgctatacagcccggacgaattcaaagacattgaagaacaggatcaattcttcaaaatgcttatcgttcacggaaaagaatacgagtcgttggactgcatgagcatcgactt

SEQ ID NO: 87422 - DNA, 669 bp, Heterodera glycines
  misc_feature (613)..(613): n is a, c, g, or t
  SCN-specific regions: Sequence locations=1-669
tttgtcctcccttcttgcacttttcctcctttcccttttgtgctttgtgttttgtcactttcgcccccattttcctccgttccttcaaaaagcgtcggttgaacaacgtcgtcagtacaacagaatcgtgaccagccaaaacgacaccaaagcacaaatcaacagcaatgtgcagaattgggcttcaaatgcgggagttgcgagcgattacaacaatttcacatcggagcagcagcagcggtctcaacaattccatgacgcagtctccggcaatttgacaggccaagcgctgcaattattcaacaacctctggagcattcgtcagaatgatcaaatcactcgccttgccgagtgccagcaaattcgtgccgctttgaatgccaccggacgggaccacgtccttcaccttctcgtccccattcctcctccatctattgttggccctccgccttccggatgttttcctcggcctccttactcgaagccatttggcgggggatttgggccaaagtccggcggagcagccattccgggaagaggaggaccacagacaccggagagaagaaataacattggcactgaggagggtgaagagaaaaagtgaaggacagangaaaagtgcaaagagaagccgattgattgaaaacgtacaatgaaatcacattcact

SEQ ID NO: 87423 - DNA, 137 bp, Heterodera glycines
  SCN-specific regions: Sequence locations=1-137
tcggcgtcgactttgactcactttcgtgtctgtcgaccattactcaatcgacctctgacgaattgggcaaaaagtcgaaaggctctcccacaattgaattgctccgtgccgagtcggactgtcttcctcccgaatgg

SEQ ID NO: 87424 - DNA, 533 bp, Heterodera glycines
  SCN-specific regions: Sequence locations=1-94,116-533
ttattcttcctattcccccggtcactttgttgctgcaaatgtcttcagaaattctttggtctactgtttttcttctattggtcgattgtgccaccattcttttttggttcttttttggccatgtcaaaaaacgacaacgcccacataaaaacgaaatctttatctgcggcgactgttggcttttggtgttcgattttcttgcgccttctcaactcggcctcgaaattgcactgatcaaccgccgctttaactgcatcgtcgacgaacacttcaagacacgcaaatggaaattgggctgcatgcgaatttgccacaaaattggagaaaatggcactaagcaattgcaaattgtcaattccgatgcaaagccattgccaattccgcaaaatccgttgcccaacaaagtcatcggattcagacacattcagatccattacatcgatcaaaatgtcatcgcatttctccgccgttttcaccgtcgtattttcgatgtttgttcaatggttttgtacattcacacagacaatgaccgc

SEQ ID NO: 87425 - DNA, 473 bp, Heterodera glycines
  SCN-specific regions: Sequence locations=1-127,150-473
catgattggggagctgaactcgatcgctgatttgatttccaacttctttttggccgcttttgccatcaccaattttgcctgtttcgatgcgtcggccgccaaatcgcccggcttccggcccggctttcgtttctacaacaaatggctgtcattgttcggctcggcactgtgtgtgcttataatgttcgtgctgcattggcccacttcgttggtcacatttttcgtgttcattgtgctcttcgtgttcatcaagcacaacaaatcgcacatcaattggggcacgtccaccgaggcaaaccgttaccggcgcgcactgaactcgttgctgaaaatttcgcgcacggaggaccatgtgaaaaactacaggccccagttgttggtgctgagcgggaacccggtggcccgtcaggcacttgtcgactatgcctactgtatctcaaacggtaggagcttgcttctgtgtggacacattg

SEQ ID NO: 87426 - DNA, 321 bp, Heterodera glycines
  misc_feature (320)..(320): n is a, c, g, or t
  SCN-specific regions: Sequence locations=1-321
cagaaaatgggaaaatgtgtgggaagaattgagtgctcgacagaacccaattgacattcggatcagagatggcggattcgacgacggtcttcccgacgccgcttctcccgggccaagtggacagcagtagaaatgaattaattaattgatgcgattatatgaccgaaatgatgttggcactttgccattaaatattgcctaattgtttgtttgtatttgacctttgcttgttcgcaaatgtgtccatttccattgtattccatgtatatatgtgaaattcattgggagtaattaattaatcgttgataaaatggctaatna

SEQ ID NO: 87427 - DNA, 599 bp, Heterodera glycines
  misc_feature (586)..(586): n is a, c, g, or t
  SCN-specific regions: Sequence locations=1-16,38-599
caatttcccgatcatgtcacacatgtacaaatacatggaaaaagcaggatggcaaactgagaatagcgaattatttaactaccaaaaacaaatattggacaagggagtgccagaactgttctcagcagtcattaacgacaaaaatgttggaaaagctggtgcatacaaggaaaagcataacgaaagttcggatattttctcaaaagtttatgaaattgctgatcaaaaattcaaggaccttttcaagaacaatgcatttcctactctggaaaaattgttcggagatgcaaaagctttgttcgtcaacacaacgcctttattggattatgacattggcagtttgccaaaacgcgtcaaattcattggtggcattgatctgatgcagcccgatcacaaggatgctttaccgcaagtttttgggcaaccaaaaccggtgatcgtgttcagcatgagttctttactagaaccatccaaaatgccattggacaaatttaagacggttattcaaggacttggaatgtgtgaaaaggaagtgatttggaaatatgcgaaacaggaggatcatggtcggatgtcactcttgcanaagcatgctccta

SEQ ID NO: 87428 - DNA, 545 bp, Heterodera glycines
  SCN-specific regions: Sequence locations=1-219,241-545
tggcctttttcttctggcttccttatacttaacctataatataatgggctgagtcggaagcgaaccaattgtccatttggtatgacattggcggaattgtcggttctgtgcttggcggattggcttcagaccgactcggtcaccgcagtcccatcattctcctgatgcttgttttgtccgttccgttgttgttcatctactctggccttggttcctcgcgggttgagcacgttattggcatgtctttgctcggagtgaccatctcgggcccatacaatctcatcgttggcacaattgccattgatttgggttctcagcaagccttggccaacaatgctgaggccctgtctaccgtaactgggctcattgatggcattggctcggctggctccgcattgggccaactttttgtgccgttgattcaaaatgaacttggatggatttgggtcttccatttttttattttaatgaactttctttcatccatgtgccttatccgtcgtttcttccacgacgctcggctcatttccctttcgtttgctccg

SEQ ID NO: 87429 - DNA, 506 bp, Heterodera glycines
  SCN-specific regions: Sequence locations=1-266,291-506
tcatcgcaccgccgttccgcgcccgggacgaggccgaattgttgctgctacccttcttccctgtttcggtttcactcagctgaacatggctttgctgaacgggtccaccggcgttgtgctcagcaaattcgagcagaattccttttgccgagtggtggagcaatacaggattcgccttttgcttctcgtccctcccattttggtgtttttggctaagagtcctttggttgccaatttcgacatgtcccatgtccgtgccattctctccggcgccgcccccgcgggcgccgatttatgcgaagagctgaagcaacgttttccaaatttacagcatatttgccaaggctatgggatgaccgaaatgtgtgttgccatcgctttgcccattttggacaaggaacggcacgaatcatcgggcaaactgctcgccaatttggaaatgaaggtcgttgacttgttgaccagaaaagaggtcgagttgggaatgcccggcgaactattcgtgc

SEQ ID NO: 87430 - DNA, 433 bp, Heterodera glycines
  SCN-specific regions: Sequence locations=1-292,314-433
accttaaatgttttggtttcgtttttccattttcttttctttttgacctttttctcttttttcttttacattttcggcgcttcaccgaataaaattcaagcaacgcctgtcgatgccaaaaaaatggttgagagcagaataaaatgttacgtgtgcaattccgggacgaaagggcaagccgactgcactgaggacgaccacgacaagttgaagacgttcatcaaacaatgcaatccgttaacttttgggacttttgccggagaagaagcgaaggcgtgccgaaaagtgcgccaaacggtggaggacgagacgaccatcgtgagggaatgcgcttacacgggcgaggagttggacggaaagcgacggaccggcaacaaaggggtcacagtgctcatcgaccagtgcatcaacgaccaaaatgcgacctttccct

SEQ ID NO: 87431 - DNA, 305 bp, Heterodera glycines
  misc_feature (304)..(304): n is a, c, g, or t
  SCN-specific regions: Sequence locations=1-25,48-237,264-271,304-305
ttacaataaaacacacaaatcaaaatgttcttcctttgccctcccattgttcttcttccatcggcccttttctgcgtcgcttcccatggcttaacaaatcattcgaaagcatttggaaatgaaagcgaatcgaatagaacggacttttttggcactgaacccatggaaattccctgtcataaaagtgccgacggattcgacccaatggtggacgacgtattcgctttgctttctgctggagaagagggggaagaggagggaaatgggacgaaggtgggaattacggtggaggaggaggaggaana

SEQ ID NO: 87432 - DNA, 612 bp, Heterodera glycines
  SCN-specific regions: Sequence locations=1-195,335-372,394-612
taggagaaggatgaggacgggctttttgtacatagtctatgcaagtcagcacgcctttggatgatgccgcggcacagaaaacagcgatggatggcacggggggcggaggagaatggattgataaaagtgtaaatacctaaatacaaaagcgccaaaagaagctgtgtctctctcacaatcagtgtattattattattatttctttttgtccgccatctttttctccctttttgtcctccttttttttcctctttgtgtctcccatttctttcctttttccctctcctttcctcaacttttgtgtattttaattttaattttttgtctgttttttaattaattagttaatttttttgtcggaactttcgttcattgtgtgtctgtcctctctctctaattataatccttcatcttctttgttctttaatctgaatctgctaatttcgtcttgtaaacatgcattttcatcgtcacgctttaaacagtcaattttacgactgactgattatgaattaattggtgttacattttttaccatggaaaatcgtcatcttgggatagacacacccaatcattttttcttgctatattctgtcacaatattgtttgtgt

SEQ ID NO: 87433 - DNA, 107 bp, Heterodera glycines
  SCN-specific regions: Sequence locations=1-107
gatggatgtttctgctgtcgtagatgaacctctgccggaagaacaaccacaacataagtaacagcagcaacaacatgttgttggtggaggtggtggtggtggtgaac

SEQ ID NO: 87434 - DNA, 713 bp, Heterodera glycines
  SCN-specific regions: Sequence locations=1-713
gtttatggacgtgtttcggcacgggtcgtggactctggaagggcttggctgttttcatcaatgatgaaaagttcatgactaaacttggccttacgactggcttcaagggaaagacattcatcgtccaaggattcggtaacgtcggcttgcactcccaccgttatttgcacagagatggtgcaatttgcatcggagtacaggaatatgactgcgcaatttacaatccgaatggaatccatcccaaagagcttgaggattggaaaatcgcaaatggttcaattcgcggctttcctggagccaaggctttcgagccattcaccgacttgattttcgagaagtgcgacatccttgtcccggccgcttgcgagaaagctattcacttggggaatgcacatcgtattcaagcaaaggtcattgctgaggcggccaacggaccgacaactccggctgctgatgcagttttgatgaacagaggcgactgtcttattgtgcccgacatgtttatcaacagcggaggtgttactgtgtcgtacttcgagtggcttaagaatctcaaccatgtctcttttgggcgtctgacttttaaatatgagcgtgactccaactaccatcttttggagtcggtgcagaagtcactcgagcgcaccttcgaccgtgccgttccggtggatcccagcgaggagttccaattgcgcattgccggtgccagcgag

SEQ ID NO: 87435 - DNA, 501 bp, Heterodera glycines
  SCN-specific regions: Sequence locations=1-444,466-501
ggtttccctatgaatatgtttatccggagcacttttatacatggaacaactgaagaaagtgttggatgcgccagtaagcagttgggagtgttttcgggccattgtttgcttgaaatgccttccggaactggcaaaactgtttctctactggcgcttgtcgttgcttatatgagaaagtatccggaaagactccacaagctgatttattgctcacggacaattcctgagatagagaaatgtgtcgaagagcttaaaaggctgtttcgctattataccaatgtcaccggatccgcccccgatttccttgccctcactctctccgctcgtaaaaatctgtgcatcaataaatccgtcgtcagttttcggtatggttcggccgtcgacggagcttgtcaacgtttgacggcgagttacgttcgggcgaaaaggcggctgaatccgaaccttccctgttgttcctttttcgaaaaatttgacgagaaaagggacatgactttgccg

SEQ ID NO: 87436 - DNA, 480 bp, Heterodera glycines
  SCN-specific regions: Sequence locations=1-480
cggcattaagccggcttctgtcgctggcattctccagcgctatgaaatgcaacagtttcggctgagttgcgccaatttcgagtcggaatcgagctgttgctcgacctcacaacagatggagataattgtcgactccgagtcggactccaatctgacgcggtgtccgtgttgtcgctgtgcccaagtgaatttgatctgtgccaactgtctgaacactaatgttgtccgaattggcaaagtgcgggaggacaaacggcgtctgttgaggagcaaaagtgccatttgccatctcatccagaacgcactcgccgacgaaatcaaattcgagggtgaatttcaccagctcagtcgctccattgaagaaattcgggcgaaaattgcgcacaaaaaggaccaagttggacgacttagaccgcgcatttcgcacacggaaagtcaaagtgagcgcaatcgacagaatgtgctccttctcgagaagaa

SEQ ID NO: 87437 - DNA, 422 bp, Heterodera glycines
  misc_feature (23)..(23): n is a, c, g, or t
  SCN-specific regions: Sequence locations=1-251,278-422
ctcgcccgcgtggcgttggggcngcgcgagtcgcgacagtttgagactgaaatggccacctggcgattgagtcgatgcaaaaatacaataacactccgttcgattacgtcggcttctctttcccgtggttcggcattcattttttggaaccgttcatcagttggagcggaatattgcgcaaagacccgctaattatactgaggaagcagctaatggacgaattaaaggcacgcaaaaagctgagggaaagcggagaacaacagcagcagcagagagcgaaagtcgacttcattgacctgtttttggagacggaacagaacgaacagcagcagctgacggagcaatgccaaaacgagggcgaagcaatgctaagcaaaacggcacttcagagagtagcaaagcggtgcactttggaagagatt

SEQ ID NO: 87438 - DNA, 476 bp, Heterodera glycines
  SCN-specific regions: Sequence locations=1-476
gcaaacgctcttcgaataaccctaatctctgtccacaagcaattcgatgtctgacacctacggcttcatcaacaatatctcagatcgtatatcacgacgcgtacgtcgcaagcgcccaacggagtctggggtttctggtgtcagcggcgcaccgccggagactcggaaggacgacaaggcgaagggcggctgctgctccaaaaagtgcgcttgcatcatcgtgtgcagcattctcacgctcattgtgctcgtcatcggtggactcgtcctggccgctgtcctgacgcctgaaacattcaaaaatgctcctctgttgagcctcatcgcgggcaaaaagaatgggggcgcggatggtgagggggaggataccaacgactgataagcgactctgttgtcctattgtgtggctatattgttcaataatctgtatctgatcttattgtacacacattatgtttgggataaagaaagtacat

SEQ ID NO: 87439 - DNA, 522 bp, Heterodera glycines
  SCN-specific regions: Sequence locations=1-522
atgattgaaattacgcaatggaacacgagatggagacggacacgcagctgatccgtggcctcgtgcttgacccggcggccgacacccggacatgccgaagagtgtgcgaaacgtgcacattttgacatgcaatgtttcgttggagtttgagaaaactgaggtcaattcgggccttttctacaagacggcggctgagcgtgaacgtttgctgcaagcggagcgtgaatacatcacgcgacgagtgctgaaaattgtggaactgaaggagacggtctgtgccggcggagaccaaggctttgtggtgattaaccaaaagggcattgatccgccgtcgttggatttgttggtacagcacggcattttggccctgcgacgtgccaagcgccggaacatggaacggctgcagttggcctgcggcggcgaggcggtcaattcggtggacgacctgacgcccgatgtgctcggatgggcgggcagtgtttatgagcatgtgctgggcgaggacaaatacacttttgtgga

SEQ ID NO: 87440 - DNA, 556 bp, Heterodera glycines
  SCN-specific regions: Sequence locations=1-13,35-35,144-144,184 -206,245-245,292-305,350-373,412-556
aaatttccttggctttcttttctctgtgtttatttgcatttgctgaagtggcagccgaccgggtcctccttcttatagacatcccacaattcgggaatcgcactccgtcttcatcaaatccctcgaagagcgtggccactccgttattattgccatggctgatgacccaaacctttcgcttatcaaatttggcgaatttctctacgaccatttgatcattttcgcaccttcggtggatgactttggtgggaatataaacgttgacgagatcaccaaattcattgacggtggtgggaatgttctcgtcgctgcagacaaaaatttgggcgatgcgattcgcgaccttgcagcggaagtgggctttgagttcggggaggaccaatcgatggtcattgaccaccgcaactacgacactgttttggacgatgggtcgcacacgaccattgccgtgcccaacgcacaactgatcaaagcgccccttatcactggcgaaagtgcgcttttggctcccgtcctttaccgcggcattgcgctggtcgcggatgaactgggccct

SEQ ID NO: 87441 - DNA, 584 bp, Heterodera glycines
  SCN-specific regions: Sequence locations=1-513,540-584
ccgctggagttcttgctaagctgactttacatgttgacgctgggcaacgcgctgttattttcgaccgttttaccggagttaaaccgaatgttactggcgaaggaacgcattttttgatcccatgggttcaacgtcctatcatgttcgacattcgctcgacaccaagggctgttaatactatcactgggagcaaagacttgcagaacgtgtcgatcactttgcgtatcctccatcgtccagacccatcaaaattgccacaaatctaccttaacattggcacagattatgctgaaagagttctgccatcaattacaaacgaaattctgaaagcggttgtggcacaatttgatgcccacgaaatgattactcaacgtgaatcagttagccaccgtgtgtccgtcgaactcgcagagagggccaaacaatttggattcattcttgatgacatttctatcactcatttgtcgttcggtcgggaattcaccgaagcggttgagatgaagcaagttgcacagcgagaggctgagaaggctcgctacttggtcgagaaagctgagcagatgaagctggctgcaatcacaacg

SEQ ID NO: 87442 - DNA, 517 bp, Heterodera glycines
  SCN-specific regions: Sequence locations=1-517
cagcacccaccggttctggaaaaacgctctctttcgccattcccctcattgtccgtgttttgagcgcccgaaaagaacgttcccctgccaatggacaacaaaagtgtgccgacattcactcactgtgtgccgttgtgattgagccgaccaaaatattggccaaacagacctacgaaaactttgtgagattctgtgatggattggacataaattgcgaatatttgcgagagaatggaattggagataaatgtgacattttggtgaccactccaaatcgtttcattttcgcattggaaaaactttcggacgatggccaaaagagggcgaaattagtggagaatttgcaatggctgcttttggacgaatgcgatcggatgttcgaccggacggaaggggaggcgagtttccgagtgcagctttcgaaaattctccgcctttgcaatggaaaggaaactcgtcgcggcttttacagcgccaccttttcttatgaggtggaggaatggtgcaaagaacattt

SEQ ID NO: 87443 - DNA, 563 bp, Heterodera glycines
  SCN-specific regions: Sequence locations=1-563
aattgtgcttacagtgtcggagtttgtatcgtagtggcagtggttgcctggggcattattcgtagccattgggcggttcaaacacgagtggcattgttactgtgccggttcaactgtattcctcatccatcctgcacatatggctgaaaacgcgttcggccactcaggaagtgccagcccggatccgactccggcacccggcaatggacaatgtgacgctggccaaaacggaccagttcatcgagtacgagttccacgagttagcacttctgcttgaaggacccgcaaatctggaatgggccaaagaagacacccgtgtctcctatatttacgtgttcgagccggacaccgttttggagcgcggcattcgtccggcattcatttcaaatgcggcacgctttccggacgtgcgcgaggggtaccattttcgtccgccgttgggatggatgaacgacccgaatgggttcagcaaatttggtgatcactttcatctgttctaccaacattacccacatgcgttgcattggagtgccatgttttggggtcacgcggtcagccgagat

SEQ ID NO: 87444 - DNA, 540 bp, Heterodera glycines
  SCN-specific regions: Sequence locations=1-4,26-270,292-540
taagaatgaatgtccaacctcctcctaccgccactcattcgcaaccgacaattttgccgatgccaattcagaattggtcccatgaattgggcattgaatttggggacgtgctcatcgctgatttgctgcgtcgtatgtgcagtcccgatttttcctcgcctttggcgccctcagctcgttggcatgacatcccattcttcgagcagttccgcagcgatctccaattccaatggactctgctccgatcggtgctcgtcgggggcaatcgtgggaaattaaatgccaaactgttgtccatccttttttggactgtgtcggatcgcgaggaatggcaaaaacgaacggttgcccgactcatttatgcggcaaaagacgacaaagagctggccaacctggtctccctcgtcattgctgtgttgccccaactttgccaacaccgacaacagtcgtcgggtgaacttggtctgatgagtgctgccattttgcttgctttggccgatgcccgtcgctttggcaccgaatgggaccaatttgtgatgg

SEQ ID NO: 87445 - DNA, 606 bp, Heterodera glycines
  SCN-specific regions: Sequence locations=1-35,57-190,212-306,329 -488,511-526,555-606
cgcggcacagtaataaaatataaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgaccctcatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaac

SEQ ID NO: 87446 - DNA, 658 bp, Heterodera glycines
  misc_feature (607)..(607): n is a, c, g, or t
  SCN-specific regions: Sequence locations=1-91,114-658
caagtttgagcgcatattaatttatttgtttaccaaaaacaacaaaaaaaaatgatcgctccattgatcaccatcattgtcatcacgtctttggtcattggtggccatgccttctcggccgatttgacggaaattgtcgaaaatgccaacgaatatgtggagaaattggatcaggagttcataaccgcactggacgttggcccgtttgatcattacacaggcccattgggcaccaggcccgaacccattacagctgtaatggcgggtggttatgcatgtggttcggacgaggcacccgggtcgaaggctggttcgatcgctctcgggttactttgcttcccacttatgggtctctttcataaatgttgtgaggaccatgatgcctgctacgacaagtgcggagccgtctttggcgactgtgaaggcaacttttgcgagtgtttgacgtggtcactgttgatgggtccacattgtatagttgtggggctatcgcattgtaccgctaccacctatgggggacgcgccgcatttgacaaagcacagaatatcgcctgctgcaaggaaaagttgagcccatgccttgaccagcaaaggacctgttactcanagtgcggcaaaacgaggcaaaagtgtgatgatgagtgcaacaaatgcgcag

SEQ ID NO: 87447 - DNA, 535 bp, Heterodera glycines
  SCN-specific regions: Sequence locations=1-39,101-101,517-535
atgctgggacgcttaatctttcaaatcggtgaacaatccaatcggagtcactcgaagagcgatcacaaccagcactttctgttgagaaaaaggagcgaccaaaaacagcaggaatgattgacatgggtggcgcttctgctcaaattgcctatgaacttccattgggccattccgatgctgcaacgggtgggcaagagaatgttcagctgctaaacctcggctgtcgtgacgacgaatcgcgtttccgtttccgattgttcgtcaccacttttcttggcttcggagtcaatgaaggagcaaaagcatacgaaaagtttttgtggaagcggttgaacaacaaaagacaagcggcaaattcgaccgaaacggacaatggaaaagacggcgcgaaagtgccgactgtcgttgacggatgtttgcctgtgaatatgctgaaattgagccatgccgaggagaattacgaccaattcgtacgaaagggaaatggcgactgggattcatgtgtcagcgacatcgcttcgctgctgttcgagtc

SEQ ID NO: 87448 - DNA, 523 bp, Heterodera glycines
  SCN-specific regions: Sequence locations=1-315,337-523
cggcggttacgtggtcgaacttcctcaaaatcccacgaaaattaccttcgtttgtgggccaaatcgctgaattgcccaattgtttcaattgattattctcttgcaccggaacatcctttcccacgcccaactgaagaagttctgtatgtctatgcttggatcctcaacaatcccgaaaaatttggatggacagggagtcgcatttgtatggtcggcgattcagccggtggaaatttgattgtttcagtcaatttgaaactcgtcgaattgggcgtcaaacgaatcccggatggtcttgtgcccatttacactccgtttttgttccaatatttgccttccccgtcgcgtgtgctttctttcatggaccctttgcttcacatgggcgtcgtcattcgttgtgctgccgcttactcgggttcgtattctgacgaggaactcgacaaaaactgctctttccatgtcaaatcggactcggctgttggaaacggccatctgtcactgcaagactatgtgaaccgagttc

SEQ ID NO: 87449 - DNA, 526 bp, Heterodera glycines
  SCN-specific regions: Sequence locations=1-243,265-526
acgcggacgaactgaagaaattcccgtcacttacggatgcgtttaagaagaagaggggcaacatactcaatttcgaggaagaggaatttgacgagatcatcagcaatggcaccagcaagcgcgacaacagtccgtacaccgaccacgactacgcaggcacgcgccaattggcgacggcgaagggagcgaccggcaaacaccaacggcagaagggcggcggagggacggcgaaagagccgaaaaagaaaacggcacttgtcaatgggaccgattcggtggtccgttcatcggcacggccgcaccgtccgaccaaacgttttgtagaggaaacaaacgaatcattcattcgtgggacttcgaaagtgcgccgaacatcgccacgcaaacatggcaagaaatcgactgcggagggaggaagcgaaggggaagaatcggaggatgacgggaaggagtacagcgtggaaaaagtgttcaagaagcgtgtgaagggtggaaaaatggaatactttgtcaaatgggctgggta

SEQ ID NO: 87450 - DNA, 505 bp, Heterodera glycines
  SCN-specific regions: Sequence locations=1-108,130-505
ttaagattttttaaatatttctattgactttcttagtctccatgtatatgacaacaaacagaggcatggcgattggttggaagcttttgacccgagacaaatggcatctttcttctttgtcctgctccctattggcattcgctgaaggaatgtgccatcgaaattccgtagtgcagaattcaagaatttggtcacagaattggtgaatgccttgcggaactgcgcttcggagttgctgcctctgcctgatgaagcacagaaactaacgctgaagaatattgaacatgataaattccgcatgatggatggacgaaccgccgatgaggcgatcgttgccactgtgagtaaagttggcgagaatattcaactcgcccgagcatctgtcatttcttcttcaccagcgaacaaactttttggtcaaacccatccaaaagaggaatttaacggcgttcaattgggacgttttatttcgttggtgtctttgggtcacaaatcggatgagagt

SEQ ID NO: 87451 - DNA, 548 bp, Heterodera glycines
  SCN-specific regions: Sequence locations=1-428,452-548
tttttgactctgtccgttttagttggcttcgtccctttactttttcttccgcctttgtgccgcgtgcactgtcatggctcattttgacctcgtcgttctgttcctttgctgctttgaacttgtccattccgatgtcttcggtcccttcgctttgttttgcctttgttccttcgcttcttccgccactcttttggctcattttgcgcttctccgatcgtcggatctgttccaaatttcgtcttccgattttgttgaatattgccgaacttttgtcacaattctcgcgtttggttacgcttttactccggtgataaggacattgaccacttcaattagtactgacaccatttacgcctgtgccattctgctctttttcgccagtctttttgtccacgactacggcataaatgtgccggtgttcgttcgtgccaatgttttattttctttttaacgatggcattcccgttttagcgtcagtttgcctttgtcggcaaatctttgcctcgccgcttccgtttttctgatttctcgtctccagtccgaccttg

SEQ ID NO: 87452 - DNA, 369 bp, Heterodera glycines
  misc_feature (155)..(155): n is a, c, g, or t
  SCN-specific regions: Sequence locations=1-133,155-289,311-369
cctccgatgggctccgatcccccggccgcggtcacttcctttccctccgccggttcggcaacctttccgtcgcttcacaatgcccgccacaattgcatctccacgtgccactacccttgtcattctgccgtgccctcctcctcctttacctcctnctcccatccgcccgtttccaacgggtgccattctctttgctcctcaaattctgcccagacgcaggcccaaacggagttttaacgcattcaagcagcttctctgcgatcgacgcacgaccaaatgagggcgtgtattaacattgatttgttaataacgtgtcaaagggaagtgaactcttcgcgaatgaccgacaggaaagcgccggtgctttac

SEQ ID NO: 87453 - DNA, 545 bp, Heterodera glycines
  misc_feature (542)..(542): n is a, c, g, or t
  SCN-specific regions: Sequence locations=1-5,27-545
agcaccccatcctgctgtcctggcagccacatgttgtttcgatgatgaaagatccaccggcacattctccgcttcgatgccaaagtcttcgctttgtctgagtgccgaaagagtcgccgctgcgggggaaaaccaactgaaaacaatttggtgccctggcaatggtggtcaaacactcatcaacgagatcaacgcagctcaatcatcatctgatgagtgtgctcgctctctcggcttcgtccgtgccatgttcgaaattgccgcttccgccgcttcccatgtcggtgccaacgccgaattggccaatttggctgtccagttccgagaacaagttggcacaattgacaccaactgtgctgcgctgggcattcatgttgggcaaatcagcttgggcactcccaaaggagaccatccgcaagtgcatgactctgagagtgtgcttagtaaccctggcaccagcgggtctcacaagcgcatttaagtgcattgcgacgattccgatgatgtcatcatttgttgattgatatgctatagaaattatntta

SEQ ID NO: 87454 - DNA, 618 bp, Heterodera glycines
  SCN-specific regions: Sequence locations=1-618
ctgctgtatacaaatgtctttccgtctgctgggcattctctgcgttcttctcttcgtggcgcaactcacaaacggcgatgcagcttggaacgatgccaatgatgtgaaccccttcaaaggtcatcaggaacgcgctctggcattcaacgagaaactcaagcatgcggaagagaacacacccgaaaatgtcagccctacgccgacgccgtccatcaacgctacggagacgcctgatacgaacgcgacgatgactacctccgaggtgactggcacgtcgaccgaaggcccaactatcaagacgaccgcaaagcctgctccgccctcgaccagcagcttccaaatgacgatcctcaatatcgtcttaacgggacttatcgccgtgattcttcttgtcgacatcgtcctggctgtggtcaagtgtaagaagtaggaagaactgaaggaagaaggaaggaagagccgacctaccgctggtgtaaacaattgctcgataccaaataatctgtgtggcctgttcatcgtgatcttttatatccatgtgtcttgtttggagaccgtattctccctattctgttgtctaattgtatgtatatatacctataaacgatgtgcacgcaa

SEQ ID NO: 87455 - DNA, 634 bp, Heterodera glycines
  SCN-specific regions: Sequence locations=1-37,59-192,214-308,331 -490,513-528,557-611
cacgcggcacagtaataaaatataaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaaccccaaaaaaaaaaaaaaaaaaaaaaa

SEQ ID NO: 87456 - DNA, 189 bp, Heterodera glycines
  SCN-specific regions: Sequence locations=1-100,122-189
cagcggacggaactttagcactcaggcggaatggctactcgaaacggacggaaccgcacttctgagagtgctaagcgagccggacgtcgatttcattcgtacacacagcaatgacatttgtgaaatcttcgaggtgttgggcattgaagctgtccgcaaggcgattgagcgtgagatgaaccatagtga

SEQ ID NO: 87457 - DNA, 533 bp, Heterodera glycines
  SCN-specific regions: Sequence locations=1-28,50-533
tctctctactaactgttgcacatcccaattttatttcttccttagtaagtagtattggtgcacaatgcgcacttttctgttcatagctgtagtcgggttggtgttggctgtcatcatggagagtgtaaatgcgactgggaataattcgccgacaaaggggcaaactccgcctggcagtccgaaaggtgggcacggcagcaacaaatcgccaacgacgccgcacagtgccggttcgccacacggcacgcagcatggtaaccaacagaaccatgctgccggacaaacgccgcctggcagtccgaaaggtgggcacggcagcaacaaatcgccaacgacgccgcacagtgccggttcgccacacggcacgcagcatggtaaccaacagaaaaatgctaccggacaaacgccgcctggcagtccgaaaggtgggcacggcagcaacaaatcgccaacgacgccgcacagtgccggttcgccacacggcacgcagcatggtaaccaacagaaaaatgctaccggacaaacgccgcctg

SEQ ID NO: 87458 - DNA, 476 bp, Heterodera glycines
  misc_feature (475)..(475): n is a, c, g, or t
  SCN-specific regions: Sequence locations=1-9,34-69,91-133,171-236,258- 372,394-441,463-476
cagcgcattggggccggagcgcctgtctatatggcatcggtgttggaatacctggcggccgaagtgctcgagctggccggcaacgcggcgagggagaacaaaaagttgcgaatcaccccgcgccatttgcaattggctgtgcgcaacgacgaggagttgaacaagcttctcgcggaggtcaccatttctcgtggcggtgtgttgcccaacattcacacggaacttttgtcgaagatgcagcagaagaagcagcagaacgacgacagtcagtgaacggtggaagaagaaacggacggatagaaaatgaatgatcccaaatatctctcctctttaatatgccaacattttgttcccaaacattttttccgatcattgaattccttttgtttgtttaaagttgtgtcctctcttcacttttttgagtaatattgtgcctttcttttgattgtttgtgccttttatgtaataaaatgtnc

SEQ ID NO: 87459 - DNA, 533 bp, Heterodera glycines
  SCN-specific regions: Sequence locations=1-533
caattcctttgcataatgcaaaatttgtttcccggcaaatttggtcaagccgcgcaagcggccaacacagcccaaatgcaaatgaaagcggagcatgaccctagcgcaggatttccgtggtgggttcgatttctcgccaagggccttggcatcgtcggtggttttgttgccatatttttcggagtccttgccctcttcaccatccatcccatgtgcatggtcgcagcgcttcttcaactcgccgctggttttttgaccattgcccttgaagcgcccttttgctgtgctttcgtcgatttcatcgaaagaattgctcaattttccgagtcgcgtgcgtattggcaaaaggcagcactttatggcgggatgggtatcgtccccattttgctgtgtgccgggactgagactattttgggtgccgggatgatatgcgcttcgggcgtcgcctacggttttatggcattgggaaagaaggctgaccgtactacgatgttaggcggtgctaataccgctggacaggacccggcatggag

SEQ ID NO: 87460 - DNA, 607 bp, Heterodera glycines
  SCN-specific regions: Sequence locations=1-293,315-607
cccgagaaatgggacatgaatacggtggttccaccaatttcactggcaacaacatataagcagcaatttgctggaatgcccaaaggtcatgattacgcacgaggcggcaatcccacccgtgatgtgctacaacaaagcattgccgcgctggaaaatgctcgtcactgtcgcgtgttcagctccggactttcagccacagcagcaatggcaaattggcttcattctggcgaccacattattgcgtcggatgatggctatggtggcactcaacgctattttcggcaaatctctgtccagcatcatggcatggaattgagctttgttgatttaacgaaattgtcaaacttggagaaggaatttaagccgaatacgaagatggtgtggtttgaaacaccctcaaatcctcttctgaaagtgatagacattgaagcagtgtgtcgtgcagttcagtcacgatcaaaagaatgcattattgtagtcgacaacacgtttatgacaccgtactttcaacgtccgttggaacttggcgctgatgttgcgatgcattcgttgaccaagtacatcaacgggcacaccgatgtgctgatgggtgccatggtgaccaaca

SEQ ID NO: 87461 - DNA, 447 bp, Heterodera glycines
  SCN-specific regions: Sequence locations=1-52,74-447
ttggcaattccttcgttcggtggaatacttcgctgagaatgaaattgacaatttcgccattctgtttgtggcattgtttattgccatcgctgaagcagatggcaatgtccgggcaaaacgccatgaagaacgattgaagcgccaagacaaccgagctgatgaggagaaccgccaggtagacagtgctgatcgggagaagcgccaagacaaccgagctgatcgggagaagcgccaggaagacagtgctgatcgcgagaagcgccaagacaaccgagctgatcgcgagaagcgccaagacaaccgagctgatgaggagaaccgccaggtagacagtgctgatcgggagaagcgccaagacaaccgggctgatcgggagaagcgccaagacaaccgaactgatcgcgagaagcgccaagacaaccgggctgatcgggagaagcgccaaga

SEQ ID NO: 87462 - DNA, 386 bp, Heterodera glycines
  SCN-specific regions: Sequence locations=1-386
acaaatgtctttccgtctgctgggcattctctgcgttcttctcttcgtggcgcaactcacaaacggcgatgcagcttggaacgatgccaatgatgtgaaccccttcaaaggtcatcaggaacgcgctctggcattcaacgagaaactcaagcatgcggaagagaacacacccgaaaatgtcagccctacgccgacgccgtccatcaacgctacggagacgcctgatacgaacgcgacgatgactacctccgaggtgactggcacgtcgaccgaaggcccaactatcaagacgaccgcaaagcctgctccgccctcgaccagcagcttccaaatgacgatcctcaatatcgtcttaacgggacttatcgccgtgattcttcttgtcg

SEQ ID NO: 87463 - DNA, 515 bp, Heterodera glycines
  SCN-specific regions: Sequence locations=1-515
ataatcgtgctttgtttttaattgcccattttattgttgcgcttttgtcgttaattggttgttcaaaacatcacaaatgttttttgcgttggactttgttctgttcggcttgtttctgctcctttctctgttggtcggtctttggcacaatttgccgcgtttcgtccggccgtccctcgccgcttcttcgtccaacaaaagtgaccccaccggtgacccgtcgaccctcaaacattcttccgccaatgatttcctcgacggtgggcgtcgtctccccgtgctccccgtgtgtctttcgctgctcaccactttcgtctccggcattggccttctttcgacgcccgctgagatttattcgcgtggttcggcctttgctttgttcaatctttgcggctcttttgccttcgctctcatcggcatcttcttccttcccatctttttcaaactgaaatgtctcaatgcgtacgagtacttcgagcttcgcttccagtcccagtctctgcgtcgtctggcca

SEQ ID NO: 87464 - DNA, 563 bp, Heterodera glycines
  misc_feature (492)..(492): n is a, c, g, or t
  SCN-specific regions: Sequence locations=1-159,184-534,556-563
cagaagagaatgaaaaagcacgacgggtgaaagcgaagaaagcggggaggagggagaagcattcgaccttgatgaatacatcggaagaggcggattggaggacgaggacccaaacaggtatatagcaaacactgtagcaaaagtgccgaaagaggctgctgagaatgagtcggatgaaattggcattttacggactcgtacctatgacttacacatcacttacgacaaataccatcaggttccacgcttttggttgattggctatgatgagaatggcacgcctttgacggtgcaacagatgaaggaggacttctcacaggaccacaaggaccgcacaattacgctcgagtcgcacccccacgtggtcaacctttgcctggccaccatccacccgtgccaccatgcctctgtgatgaagcatctcatcgagcaatactccgagagcggcaaagaactgaatgttctcgactacctgtttattttccttaaatntgtacaggccgtcattccaacgattgagtatgactacacgcgatccattcatttctaattttatgggactt

SEQ ID NO: 87465 - DNA, 529 bp, Heterodera glycines
  SCN-specific regions: Sequence locations=1-344,366-529
taggcttttgcctaaaaatcgaagccctaatactaatttatttattcttaaaaaatctgattttttgacgacggttcagtaccgaagccatttggccacttcacggtccaaagcgctttccgcaaaaaaattcatatcgtttttagagaccgagaggagtcgaatgatttatcatttgttagatttggtgaggtacaagtatccttgaattttaaccccaactcgtttttacgtgttatatggaactgtctaacttctcgcttttgcactcctacataaatatataaacaaaaaacgagttggatttgtaccgtttttcaggatagtgtgttaagccaacaatacaaaattccttttttaattttgatatttaggtatatatcaacatacctaattatctgacctgcagttttagcagaatgggcattttaactgcttcgaaagtatgcactttgccacggctttcttccgctcgctctatgacttggtggtggggcccggagaaaaacaatgggcgcgaagttgttgg

SEQ ID NO: 87466 - DNA, 558 bp, Heterodera glycines
  SCN-specific regions: Sequence locations=1-300,330-558
gatttggtacacccgccaaactcgtccattgcctccaacttcgtaacactttctagcacgaccgatgcgactattggcggagatttgaagcggtggtctctcctccatggcgtggactgttcgacaaattggccccactttgaggaatacagcgccgaattgcgacacttttccgtgtcaaagtcgaggcgaatgcaacagaaagagcagcaaaaaccggagacgggagtggtgctgacaaagaaagtggtgaaggacgaggacgagtcgccgcagaacggcagccgattcagaagttatttgggggaaggggcagaggacgcggggacaatcgcaagcagcggaagtggcggcaatttgttgcgaagtgccgccaaacaccattctatcgattcacaactttcggccatttcatcttcaaagtcggcttggtcaaagaatgagaagacttcacaaaacaatgccattcccacgggcaattgccaacaacgacaaaaatggacaaagaatgccgaaaccggcatgatactcgtggacaattcaaatttgacccaacaa

SEQ ID NO: 87467 - DNA, 347 bp, Heterodera glycines
  SCN-specific regions: Sequence locations=1-153,175-245,270-347
atagtggtgttgaacccgaccttagagaatctccgagacggacgttcgccaggacattctcatggaccattccctacgctccatctcttacatcgccgacattggcgatttggttgttctgatggcccgtcgtgtgccttctcagcaagaacagacggaggatgaagctggcggagaaaccatccgaaaaagcccccgagtgatttgccatatattcgagtcggaagagtcggcattcattgcgcagtccattggccaagcatttcaagtggcatacgtggaatttttgagggccaacggaatcgaagacccaaattatttgcgagacattgactatcaggaagtgc

SEQ ID NO: 87468 - DNA, 542 bp, Heterodera glycines
  SCN-specific regions: Sequence locations=1-127,158-542
cattctctctttttgtgactctaattccgtccgtcccttgccctttaacttccaccaatgcccctcgtgcacaattgcatcgctcgcactcgccattccctcttaattgttttgggcctcattatgataatggccaattgtggacaagcgatgcggcagcaggcggtggccgtacgtggccaactccgttgtgggaacagacccgcctcgggggtcaaagtgaagttgtgggacgaggacgacgggcccgaccccgacgacgtgcttgacgaggcgtttaccgactcttctggctccttccaaatgagagggtcgacacgcgaactgacaaacattgaccccgtgctgaagatttatcacgactgtgacgatgggataatgccaggacaacgcaaagtgaaactgcgcatccccagccaatacatcacaaacggagggttggccagacgaacttttgaagtcggagtactcaatttggagacagtctttgctggggaggaaagggacttcatttgaacatggaggggaagaagaactggcga

SEQ ID NO: 87469 - DNA, 522 bp, Heterodera glycines
  SCN-specific regions: Sequence locations=1-61,83-522
ggtttttttagcctcgatataagcaacaatcacttggcattgttgccaaaagtgagtctccttttttcgatatatttttcagttggcattattaaccttggatgttttgtttcttcaggagatctcttcgttgaaaaaccttcgcgaactttcacttagaaacaatttgctagagaatttgcctaaagaatttcaacgactgcaatgtctacgggaattgaacatttccggcaatttgttggagcatttcccgcgagaactgctccaaatcaaatctctccgtgtgctttatttgggtgccaatcgtctccagtctttcccgtcggacatatgccgtttgtccaaccttcaagtgctttacctgggtggaaatgcgttagtcgatgtgccggatacaatcgggcagctgtcagagttaacttcgcttggtttggcggacaatcggctggagcaaataccaaccgcaattgccagccttcgcaatttgcgaaatttggcacttcataacaatcgactgaagtt

SEQ ID NO: 87470 - DNA, 478 bp, Heterodera glycines
  SCN-specific regions: Sequence locations=1-478
ggaaaattgaattacataattctgtggcttcgccggataacgcattaacgcccattccatgtcgtccatcctttggacgttgacgagctgttcctgcagcacaatcggtgtcgaaatgcacagcaaacaagtgattggctcttccttttcgttgttttcattcgcttcttttgtgttcatggccctcgtgactttggctgaacatcccgaattccttcggaggagaaggattcccttgcgtacctatcttcaaattgttggcattttcttcgtggtcagtttgctgaacaaccgcgtgctcggcttcggcctgcccttccctctgatcatcgtttttcgatcgagcactcttctcgcaaatgttctgctcagttggctgttgcaaaatcgcaccttttcccccgcccgacttttctccgttttattggttagcgttggcattgcgctttttacgccgttcagccgcaaaagtgccacg

SEQ ID NO: 87471 - DNA, 561 bp, Heterodera glycines
  SCN-specific regions: Sequence locations=1-299,321-561
acatttgggccttactccattagcagaaatgctagcattcacagagaaaagaatcgaaaacgccctttctcaccgctggaaaatgaccttgggtcggtgtgttcaatcgccaaaattaaaagtccaaaaactccgcgtcatgcagtcaaaattctcaaaaaaattgactacgaagaccgtgcttcttgctatttggtgcaatggaattgcggaagtgcggaggaaaagggtccttcgacgacgtgggaatgggccaataagctgtcaccgaactgcagaaaattggccaaagtttttgagcaatcaatcgcaaaagacgcgaaaaaagcgtgggaattcaccgactacgaagtggaggccattttggacagaacggtgcagggcgaactgcgctatttggtcaaatgggttggctggcgagtgcccacttgggagaaggtcaaatatttgctgccggattacagcgaattggtggaacgctttgagcaactaaatgcgaaggatatacaattctggacggatacgaagaacacgggggaaggaaagagaccaatggaggat

SEQ ID NO: 87472 - DNA, 476 bp, Heterodera glycines
  SCN-specific regions: Sequence locations=1-476
caaaagtcgattcgaccattgaaaagaagctgtcagatgaatacgctgtgaaaggatttccaactctcaaaatactccgaaatggccgaaggttcgattataatgggccgagagaagccgacgggatcgtttcgtatatgttggaccaggccaagccggccgccaaacggctcaattcggcgaaggaggtgctcaagttcatgtccccctctgatgtgacagccgtcggctttttctcctccgaaagcggcgctttttacgaagcttttgctgacgcggcggaaaggacgcgcggtgattttgccgttgggtacgccttgggcggtgccattgcgcagcattttggcgcaaaatttggcgaagtagtactcttctggccagagatattccattcggagtacgagcccaaacggaagattttcccacgagagacggccacaagcgaagagttggtttccttctggcgcgacaatgcc

SEQ ID NO: 87473 - DNA, 545 bp, Heterodera glycines
  SCN-specific regions: Sequence locations=1-545
taccgtcgcccgcgaaattgttcattcgaatggttggggcactgagggcctttaccgtggcattggtgctaacctttggaggcacggcgtgtggaactcgtgttacttcggaatgtaccataatttgaggcttttcctttgctccatcccttcaaaaaattctcagtcctccgccgatcgtttagaaacggccagcttgaccgtgcgtcttacgatcgcctcactctccgcaattgtggccaatttggccaacattccattcgacgtggccaaaagtcgaattcaggggcctcagccaaccaccggccgactttacttcagcacttggcaatccatcggactgctacagcgacagcacgggttctgctccatttacagaatgctgtttcccttcgcgttcatttttggccctggcggtggaatgatgctggtcatttacgagggcatttacgaatggctgatcaggcgatccatggctttagaataaacatttctgccccttcaattcttcgaattctcatgccaattctaaaacgtgcacattt

SEQ ID NO: 87474 - DNA, 461 bp, Heterodera glycines
  SCN-specific regions: Sequence locations=1-23,57-461
ggagaagaagatcccgtggtgccaggtcaccaagtctgctgccaagaagaagtgaagaataatgtcacagtatcaaaatttcaatgatgcaaacttatgcattgcttttaaagactcatatttaagttgtgtgtttttaaattgtttagccagtttagtctgtagttcttttgcttctgctagttctccgggctccatctccggtgtatgcgctcagaactgggtgctggacaggcggtggtgacacattgctggtttatgtttgagtcaattccgcctttttaaggagggatgttgagagttgaggactatttaattttcaagttttgttgcgtctgtcgaatggataattttttcaaccttatatatttggctttggagtatttttaactaaaaatacggggcggaaatgggaagaaaaacacgaagaaagaacttgaaaagcaacaaaaagcttgatc

SEQ ID NO: 87475 - DNA, 515 bp, Heterodera glycines
  SCN-specific regions: Sequence locations=1-515
ccaagaaaaggcttctattgttacggagtcatcatttgtcactcctggcattttccgtcgtcgtaaaatgctcacaggcagacaactgaatgatgaaggaaacaatgaagctaaggaaaaaagcgcggatttcaaatggtcaattgaccaaatcgcaaagatacaacccattgaatttgatgagactgaggagttttcattgccacctgaaaattgggacccttgtgcaaaattcaagactccacaatttgaaaatattgatcacttttggactcacaacaacttaattgctccttcaccgggactattcgccacagcctctgctttacgtcgtgttcaaccgtccgccaattctccaaccacctcaccgtttcagctcgctctttctcctttcggttcgggtccttcctgctcatcgaaatgctctttgtccgattccacattcatgtccccgacaatgatgctaactcattcccaaatgtctgagtcgaccaaagcgaaaatgtttactgcta

SEQ ID NO: 87476 - DNA, 628 bp, Heterodera glycines
  SCN-specific regions: Sequence locations=1-628
tattattgtgccccctttgtgacgtccttcgtaattgtgctaatttccaacaaaatgaaccgccgttggatttgcaatgatgtttggatggacatgttcccattttttgaccgtcttcaactcggactcaaattggcacttctttcgccacgtttcgaatttttggtcgacaaacatttcgatggcacaagcgaattgccaattttgaaaaatatcgtattgtgcaagaacaaagcgacagcggtgccagaattgcgtgtgtttattgacaatgccaattatgtgccctttccggtgcccgaccattcgctgcccaagaaaattcgttttatgcatcttcggatttgctacatcgaccattctgtcatcgcatttatccgtgccaatcagcaaatgttcgacaaaggaacaaacttggagttcttctatgtgtcttggaacgaaaccttttttgtccagcccatttggaatgctttgatccgccatattttgccaatttttgtgccaaatattcgccaattgaaatttccaagtgctgatcatctgtactgtttgcttcgtttcacttctccaaaagtgctctccgatctcaacattcattcaatcgatgctgatcgtctgttcccaa

SEQ ID NO: 87477 - DNA, 588 bp, Heterodera glycines
  SCN-specific regions: Sequence locations=1-347,369-588
cctcgacgatttgtttgggaagcgcagccagtgttggcacgttcgacttttgtcagctcgggccattacggcactcattggaccggcgacaattcggcacgatgggtcgacctgagggcatcgatcatcggacttatcgaattaacatttttggcattcctcacgtcggtgccgacgtttgcgggttcaatttgaattccaatgaagaactgtgtctgcgctggcaacagttgggagccttttacccctttttcagaaatcacaattctgatggagaaccggcccaggacccaacgcaatggcaatcggtggccaatgcttcgcgtgtgtccaatttgttccgttatcatttggtgccccatttgtacactttgcattttctcgcctcattgcgcggtggcactgtcgtccgtccattgtttttcgaatttccgcacgattttctcacccaccgattggacacccaatttttgtggggttccgaccttttggttgtgcccgtgctcgaccctttggtcgattctgtgcgtgcctattttccgcctgacagcgaatggtattcgataagcaatgctcataaatgcgcga

SEQ ID NO: 87478 - DNA, 320 bp, Heterodera glycines
  SCN-specific regions: Sequence locations=1-320
ggagttggaccgagcgaggtctaatgccgaagaaaatcgtaaaatgaaaatatgtagatggaaatgatgggaaggatggcctaattggaggagcaaatggcacaaaaaagtgatctggcggaacaaatggggacattgcagacgaaaattgacctattggagacggaacagcggcaaagagtggaattgaatgcttgtcctaatgcacataaacattattgggacaacaattgttgctatcatgatctcaaaatcatcgactgtttgactggtcatcgggaaagcaaaagaccgggcgatcgctcactctacgcaaaaca

SEQ ID NO: 87479 - DNA, 578 bp, Heterodera glycines
  SCN-specific regions: Sequence locations=1-185,207-578
acctcgcggctgaaacccggcattgaaaattcggagcgtcgtttcgatgtgcacaaattcacttgcgccgctttggaattgcccgacttttcggacttcgcccgactccgtccgttaattgacgcactcattgctgaattggatctcaacgatttcctcggctgcaccgcggcgctcgaaatgctggcggagacggccgccacggcgccaaagtgtgtgcctttttttggccaaattggcctcctggacaaagtgtacgcgctgttcatccgaaccaaggaggagccggacatgggcatcattcacattgcgtgcattcgcttcttcgcctatctgtgcaccaccgatgacaacgcattgaccaaatttcccaaattcacggccgatgttttcgacgcggtgttcagatttgatgcattcgacgtcacgcgtcgtcagttggccttcgaaacgttggcagtgatcagttcgaccagcggggccaagcagatattctcgcagaacgaaactctctacaacatgcaacgggcgatgagcaatttggctgtggcggtggcaacggccgccgagccgtcgct

SEQ ID NO: 87480 - DNA, 520 bp, Heterodera glycines
  misc_feature (421)..(421): n is a, c, g, or t
  SCN-specific regions: Sequence locations=1-520
cactggacaagttgccgcagaagttgaaaccgaaggcattgatgagcacacttcgaatgccggagacacgcgattgctatcagtgtaacgtggaaaggagcatcaatgacgaaaacctttacctttgttgtgccgttcctcacgctgtgctccttttccaatggtatgaaccgctgcctcgctttgtccatcttaagcgagtccaactggacaaactgagcagtccctacaccgacctgcaacacccacacaaacccttcaatttggtcttcagatccggcgctgccaattccgatttgcccatggtgtgcattggcatttctcgggcgctcacttcgcctgtcggcactgcacaagaattgttgcgcgagttgcggaccaatctccaaaaggacaaattcgagctgcaactcgtcgactntaatggcactgacagcacagtcaacaatatgaacgacatgtactccgccgcactgttcggcgactgttcgtcggatgatgaaatcatcggaagttggca

SEQ ID NO: 87481 - DNA, 507 bp, Heterodera glycines
  SCN-specific regions: Sequence locations=1-122,145-247,273-395,417-507
tagaaataaccttttgggccttacattgttattttatcatgcgtgattcaaaattgtcgttttgggcagcggaggcgtgggaaagtctgcgctgacagtgcaatttgtacagggaattttcgttgagaaatacgacccaacaattgaagacagttaccggaaacagttggagttcgacggtcagcagtgtatgctcgaaattttagacaccgctggcaccgaacagttcacggcaatgcgcgacctttacatgaaaaacggccagggctttgtgttggtctactccatcactgcacagtcgaccttcaacgacttgatggatctgcgtgatcagattctacgcgtaaaggacacggacgatgtgccgatgattttggtgggcaacaaatacgacttggaggatgagcgtgtggtggccaaagagcaggggatgaatttggcacggcaattcaacagctcctttctggagacatccgccaaacacaaaatcaatgtccacgaagtgtt

SEQ ID NO: 87482 - DNA, 648 bp, Heterodera glycines
  SCN-specific regions: Sequence locations=1-162,184-212,235-648
gtgaagaatttggggacgtgctgtattctatttcccctatgattgcctctgaaaccatcacttagaagcccaaaatggcaacagtcccgagggagaagaagagtcgaattgcggaggcagtgcttcgccttcgtctcttcgcgactgtcattctcgagcatcgaccaacgaacacaccaacatttctcatcactctcttcacgatgacaatgcaccaccttctccctccttggccaatatctcaacaaacattgaactccatccacacaacaatgcgcttggaggttcctcctctcataaattcatcaaaaggccattgaatgcttatatgatatggacaagacaggaaaggaagcgaattttaacggacgatcccaaaatgaagatgaacgaagtgagcaaagctattcagatgggcgaaaaatggaagaaaatgtcggacaaggaaaagaaaccttacttcgaaatggcaaaaaaattctctgaagaacacaaattggtgcttcaagaacaccctgaactgcaatatgcgccctccaaaaagaaggtggtgaagaaactggccgatggaaagcaattgtccgtggtcgattcttcgtccgtcaagtcgtgcaccataacacccgacgcgtcgagaagcacaacgcc

SEQ ID NO: 87483 - DNA, 538 bp, Heterodera glycines
  SCN-specific regions: Sequence locations=1-48,70-538
tccttccaatggctgctttctcgtccttcgctttgtcctcccttctccacttttcctcctttccctttcgtcctttgtgttttgtcactttcgcccccattttcctccgttccttcaaaaagcgtcggttgaacaacgtcgtcagtacaacagaatcgtgaccagccaaaacgacaccaaagcacaaatcaacagcaatgtgcagaattgggcttcaaatgcgggagttgcgagcgattacaacaatttcacatcggagcagcagcagcggtctcaacaattccatgacgcagtctccggcaatttgacaggccaagcgctgcaattattcaacaacctctggagcattcgtcagaatgatcaaatcactcgccttgccgagtgccagcaaattcgtgccgctttgaatgccaccggacgggaccacgtccttcaccttctcgtccccattcctcctccatctattgttggccctccgccttccggatgttttcctcggcctccttactcgaagccatttggcgggggatttgggcca

SEQ ID NO: 87484 - DNA, 591 bp, Heterodera glycines
  SCN-specific regions: Sequence locations=1-2,95-96,132-147,172 -226,301-303,360-402,441-441,472-473,521-563,586-591
acccgccgagcgtgagattgtccgtgacataaggagaagctgtgctacgtggccctcgacttcgagcaggaaatggccaccgccgcttcgtcctcatcgctggagaagagctatgagctgcccgacggccaagtgatcactgtcggaaacgagcgcttccgttgccctgaggcgttgttccagccatctttcctcggcatggagtcggctggcatccacgagacgtcgtacaactccatcatgaagtgcgacattgacatccgcaaagacttgtacgcgaacacggtgctgtccggcggctcgaccatgtacccgggcattgcggaccgtatgcagaaggagatcaccgcgctggcgccgtccgcgatgaagatcaaaatcattgcgccgccggagcgcaaatattcggtgtggatcggcggctccatcctcgcctcgctccccactttccagcagatgtggatcagcaaatccgagtacgacgagtcgggcccgtccattgtgcaccgcaagtgcttctgattgagcggcggtgatgtccgcagggaggcgaaagaacgaggaaaatgttggaggataaaatttgattcc

SEQ ID NO: 87485 - DNA, 683 bp, Heterodera glycines
  SCN-specific regions: Sequence locations=1-683
tgaaaaagcgtttgagtgagctcattggtgctgattgtgagccgacatttttgcgcttggttttttgcgggcgatcacttgccgatggaatgcaaatatcaactctcgaacttggcccaaccacttctctcactctgctgatggatactgcacccaatttggatttatcttcttctattggccatccgtcgattgattggccagttggggcgtgttccactggaaatgactctgccgatgaagagcaatgggtgaaactctcttccgaccaatttgcggagaatgcagtgaatttttctgatgaaagtgcgttcagtgcctttttcgtcttttgcaaaagttgcgtttcgctcgaatgtgccaaattgcgtgcgtattgtcgcacgtgcgaatcgtccgcaataattttcctcaatgagccgcaacaatgggacgacgtcaaggagaacaattccattcgcatttttttgccattactgtgacaaggaaagttgcgtttcgttccgtttcaaatgcgttaaatgtggcgaacccgcttcacccctccaacacatttctcgcaatttctctctgcccccctccgaatgtgtcatttgcggctccaattcgtttcccttgggcgttcgattgcgcgactgcacccatctcagctgcgttcaatgtttcgtcgcatatgctgaaga

SEQ ID NO: 87486 - DNA, 620 bp, Heterodera glycines
  SCN-specific regions: Sequence locations=1-620
attcggaaggatttggtgttccgaaaagctggggactggacaaaattgtaaattgggaagcgccggaaattttggaaaaatactgcggctacggcttcctctctgaccacgacggcaatcccattctgatgtctctgctcggaaatactgacgtagaagggatgttgcgatctgtccaatcgaaggattacatcaaattttcgctcgcggcaattgagaaaggcatcacattgtgcagggaacgcgccctgcagacgggccgacccttcgagcagatgatgctcgtgttcgacttggaccacatttcttcggcccactactcctccaagcagttcgcctcctccttcaccaccctcgtcctcctcttccaggagcattttcccctcgttctgcgaaaaatcctcgtaattcgagcacccgaaatggggagaattgcgttcaattcgatgacaccctttctgtcaaatgccatcaaatcgatgatcgaaatgccttctgaggaggggtggcagtccgccttaagcaaatacgtgaatttggatgcttggcctgtccattggggcggtcggatgatggaccctaacggagacccaaagtgcccctccaaaatccgctacggc

SEQ ID NO: 87487 - DNA, 491 bp, Heterodera glycines
  SCN-specific regions: Sequence locations=1-247,270-448,472-491
agttggagcgcgaactcgacaccttctttgacgggatgcagcccatgcttcgtgaccacgccgctcaactgaacgtcacggacaagggcgaactcacttacaaagtcgatgtcagcggcttccgccccgaggagatcaacgtggaggtgattggtaatgaaatcatcgtcaatggggaacatcgcgagcagaacgacagcgaatcggtccaccgtcagttctcgcgccgtgtgctcatcccggagggcatccaaaaggagagcatcaagtgcgagctggacggcggtcgcttgtgcatctgcggaatgaaaacggctggcgaaggcggacgaaccatcccaattgagatgaaaaagaaagcggccgtggaacagcagccgcaagtggagaagaaatagaggggaaaaacggagacgacggaccgatcgatccattaattggatcttctttggacattttaaattattttcaacaataaagcgttttttctt

SEQ ID NO: 87488 - DNA, 303 bp, Heterodera glycines
  SCN-specific regions: Sequence locations=1-303
acacgcgagggggggcgagtgcaaggcgcaaagtgccagaagtgaaccgatgaaaaaggtccctgccgccaaagttgtccattttaagtcggcgcaggaaacggcgcccccggcacgcatttgcggcgattccatcggatcgctcagcgccgcccatcgccagcgaatttccatctgcgaacggaacgaaaaatgctgtcgccacagagacggagagaacagaaaaaagattggctgctgcccctttgaggacggccaatgctgcgcccactcggcccattgttgccccgcgggatttgcatg

SEQ ID NO: 87489 - DNA, 521 bp, Heterodera glycines
  SCN-specific regions: Sequence locations=1-52,74-521
ctccctatattctccggtcactttgttgctgctaatgtcttcagcagaaattcttttgtgtgccctgtctcttattctgttggtcgaatatgccatcatcctttggatcatttttgaccatgtcaaaaaacgactacgccctcacaaagaaatctttatctgcggcgactgttggcttttggtgttcgattttcttgcgccttctcagctcggccttggaattgcactgattagccgccgctttgacttttacgtcgacgaacacttcaaaacacgcaaatggacgttgggcaaaatgcgaatttgccacaaaattgaaaaaaatgggacgaagaaaatgcaaattgtcaaatcagatggaaatccattgccaatcccgcaaaatccgttgtcgaacaaagtcatcggattccgaggcattcagatcaattacatcgaccaaaatgccgtcgcttttctccgccgttttcgccgtattttcgccttttcttcaatatacttggtcatcactgaaaaatgtt

SEQ ID NO: 87490 - DNA, 452 bp, Heterodera glycines
  SCN-specific regions: Sequence locations=1-343,366-452
gctgtcaaaatgctttctccttctcctacgacccgttctatcgccgttcgttgttgcctatgaccacggttggcaacgtcctttcgcccctccgccagttggagcgcgaactcgaccacttctttgacgggatgcagcccatgcttcgtgaccacgccgctcagctgaacgtcacggacaagggcgaactcacttacaaagtcgatgtcagcggcttccgccccgaggagatcaacgtggaggtgattggtaatgaaatcatcgtcaatggggaacatcgcgagcagaacgacagcgaatcggtccaccgtcagttctcgcgccgtgtgctcatcccggagggcatccaaaaggagagcatcaagtgcgagctggacggcggtcgcttgtgcatctgcggaatgaaaagggctggcgaaggcggacgtaccatcccaattgagatgaagaag

SEQ ID NO: 87491 - DNA, 532 bp, Heterodera glycines
  SCN-specific regions: Sequence locations=1-159,188-532
tacctcgtctttcgtctaccttcaacaagttaacatgtacatgaacagcatgggctctcgtggtgcgtcatccgctgctgttgttgcttctgcagcagcattgtgcctattttcggcaatggcagtggtggtgtacggtgccgaaagcgctgggcctaaagcagaccaggccatggctgccaagcagttcaacccgtccgcatttccggccatgccaccagagcttgagaaaatcctgccagccgatgttgtgcaaaagttgaaagctgtccatgccgatatgtcgttgaacatcatgcagaaacaagacaagattgaccgtatcatgagctccttgccgggagaggttttggaccaaatcccggccccgcccggctttgaacgtctccccgacgatgtgaagaaccgtctgaagcagatcaatcgccaaaccaacaaagcatgggccgacaagcaaaaggaactgcaggagtatgtcaagacattgccgcatgaacaacgtgccattctgatgatgggcccaatgggaggt

SEQ ID NO: 87492 - DNA, 556 bp, Heterodera glycines
  SCN-specific regions: Sequence locations=1-255,277-556
gtggaggaaaatttggatttgtattacgtgtggctggacattcttccatcttttgactatgcccaactcggtctccaaatggcactgctttcttaccgtttaatgctttggttgacgcacattttgatggcaaaccggaattgacgctttggaaaacaacaaaaattcgaaaacaaattggagtgccgaaatcggtgttggcaaattatgccgattctgtgcaatttccattggccgaccatccgttgcccaacaaaattcgctttaaggaccttcgcatttcgtacatcgatcactctgtcatcgcatttctccgttccaatcaacaaattttcgacaacaaaggcaccaattttggtcttttttcacacgtaaattatgtctaagagcggatttggaaggtgttcatgcgtgaaatgtggcccatttttgtgccaaacattcgccatttggacgtttctgttcatcatttgaataatttgcgtcgtctcacatcgccaacaattctcaccgatctcaagcagttgaactcaatcgattccgatcgtttgtatcc

SEQ ID NO: 87493 - DNA, 589 bp, Heterodera glycines
  SCN-specific regions: Sequence locations=1-72,103-128,151-412,436-589
ggtccgccgcacgtgcccatcctgcgccagacatcgaacacagacggaccaacaaacggcggacgaagaatcgcaacagcaccagcagaagcagcagcagcaacggtttggcaacatcagccgaagcaacaacaaacagcaaccgccacaagcgaccgaccgccaattcgataacaccgcaacaaccgccagcgccaacagtggagacgagcagcaacaacaacaaacgtgacccaattgccgtgaacgaccagcacaaacagcagatggatggtgccaccgccttctccacagcaaaacagcggacaaacggtgcgcaaagtcaaatcgacctttgatctgcgccctgatgaagcgctgagatgtgagctgttcgatgcgttgatggtgcagcccaaacaatgacaacagcagcaaccgccggcaccgccaaaagtggagacgagcagcgacgaacggaagagttgtggagtgccatttgatcaaaatatggtgatggacgaccagcagcaacaacagcccaagcagatggtgccgacgcctccaccacagcaaaacagcggtcaaacggtgcgcaaagtcaaatcga

SEQ ID NO: 87494 - DNA, 574 bp, Heterodera glycines
  misc_feature (15)..(15): n is a, c, g, or t
  SCN-specific regions: Sequence locations=1-279,301-574
ccgatgaacccgcgnacacgcaagtccacattttcgcccccgcactctctctggacaatttgatccttttccttttggccactcccgtccagtttttcggaggacgaaatttttacatgcaaagttggaaagcgctcaaacatcggacggcaaatatggatgttttggtcgttttggccacttcgattgcttatgcttattccgtctccgttttgattcttgcctttctgttgcaatggtcgtccagtccaatgactttctttgatgttcccccaatgctttttgtatttatttccttgggccgatggttagaaaacaaagcaaaaggcaaaacctcagaggcattaagcaaactgatgtcaatgcaggcgaaagtggccattttgatcacccgagacgagaaaacgggtcaaatcacttcggagcgcggaattgacactgaattagtgcagagaggcgatctgatcaaagttatggctggggagaaaatccctgtggacgggattgtcgtggagggcaaatcatcggctgacgaatcactgatcacgggcgagtcaatgcacgtcgtgaagaa

SEQ ID NO: 87495 - DNA, 422 bp, Heterodera glycines
  misc_feature (21)..(21): n is a, c, g, or t
  SCN-specific regions: Sequence locations=1-37,64-298,322-422
ggaaatggcgctgcatttttntcgaaaaatgaaaattatggtgatcaaagacatcgagcgggatgacatcgaattctatgccaaaatcctcgggtgtcgcccggtggcatccgttgaccattttgtcccggaatcgctcggaacggccgatttggtggaggaaattgagacggctgatgggaaagtcctcaaagtgaccggccttaaacagagtgggtgcgctgtgtccattttggttcgcggctccagcaaattggtgttggacgaagccgagcgctctctgcacgacgcattgtgcgttattcgctgtttggtgaagaaacgcgcccttctgcccggcggcggtgcccccgaaatggaagtgtccgtccgcgtccgcgcagctgctcatacaaaacacggagccgaacagtattgctgga

SEQ ID NO: 87496 - DNA, 472 bp, Heterodera glycines
  SCN-specific regions: Sequence locations=1-472
agcggaacaaccggtgcaccaaaggcggcaattatacggcactatcgctattatttgatgtccattggctgtggcaatgcctttggcattgttccgtcggatagactttatttgacactgccaatgtaccatacggcgggcggcattcttggcacatcacaagttgtcttcaaaggttgtacggcatgtattcgtacaaaattttctgcaagcaatttctggaaggattgtattcgctttgaatgcacagtgagccaatacattggcgaaatttgtcgatatttgttggctcaaccgccgtctccaatcgatcggaaacatcccatccggcttctcaccggcaatggccttcgtccacaaatttggcgtgcttttgtgcaacgttttggcattgcaaaaattggcgaattttatggcagcaccgaatgcaattccaaccttttgaatcttgacaatcggccgggctcgtgcg

SEQ ID NO: 87497 - DNA, 269 bp, Heterodera glycines
  SCN-specific regions: Sequence locations=1-141,163-269
aattccttctgattgtgctttgggccgtcgtctcattccgtctctcggcttctacgtggtgacaaaaaaaactgctaatgatgggacgtggaaacaactcatcagctgggattggtacgaagatcaaaagaattgtcaccgctggactgctcttcacttccctggcgacgggtggggcggaagctattgggcgaagcaatgctcagggaggaaatgccgccggattggtgccatcgcatgtgaccaatcgctcaatggctccaccacct

SEQ ID NO: 87498 - DNA, 343 bp, Heterodera glycines
  misc_feature (57)..(57): n is a, c, g, or t
  SCN-specific regions: Sequence locations=1-287,310-343
ttcgcgcattccattttaatcgtatggaaatgttggcattcatcgcgtgcggacgcncaagccctaccaccacaacatcagcggtttcatcgattaactgtgccgatatcggcacccaaacgatgaagcaccagcagcaacggcaccaactcaccaacaaaatgccaacatcgatgccagcaacaacaacaacgcgagacaaaccctcgtcctcctcctcccgtcggtcgtcgccgttgcccgtccaagtgggccaagactatgtgagcaccattgaactcagcaaacggggaggcggcgccgctgctggcggcggggaccagcgtggatggccactgaagtc

SEQ ID NO: 87499 - DNA, 383 bp, Heterodera glycines
  SCN-specific regions: Sequence locations=1-177,199-346,373-383
acctgttttgctttcctcgggctcatcttcaccgcgtggttttttgtgcatggggtgaccagtacgaagaaaacgcgaaaccttgtcaaggaattgttcatcggcacattggcgtccctttttcttggcttcggcaccctttttctgatgctttgggtcggcatttatgtttagagttgaaaggaggaagaacacagggatttttgtcttatttttggggactttgttttttttctaatttatttgtatttttttttcctctgctaattgttattgagtgagtctgcctttttgtttgtttcttcccaatttggaaactgttgaatgttgtgtaattgtttgtccctttaatatttttattttaaaataaatggaaaactcgc

SEQ ID NO: 87500 - DNA, 519 bp, Heterodera glycines
  SCN-specific regions: Sequence locations=1-322,345-422,444-519
caccggtgaaagaaacggaagaaattgggagcggagaagggacttcgaacaattctcaagaaaatacggacaaaccgaagcgaaagagaaggaccaaagaggaaattgagcaggaaaagttgaacaaagaagtgaaccgaatttgccggcagattcaatcggcgaaaaactccaagtgcgaacaattccttttctgtcatttttcgtcgaagattctcgacttggacgacaaattgagcgatgagctgagaaaacgctttgaggagcgtggaattgaacaacaaattgtttatgacaaatcgcccaaaaatccgatgcaaattttttggcgcaaaaagaaattggaagcgtaccttgacggtgagcaattgcacaaaacggagagaatggaattgcaaaatgtgttctgttgcgttttgagcggtgagacattttctgtgctggtcaaaagtcggggaaattcgatgatggattatttggacgagcaaatggcgagcatccgaaaacaaattggcggag

SEQ ID NO: 87501 - DNA, 459 bp, Heterodera glycines
  SCN-specific regions: Sequence locations=1-55,77-288,310-459
tagcgttagctgatacattaaaagaaaatagtacatttacagactttggcctagagggcaattgttttggaaatgaaggtatcaaggaattttctaaagaattggaaatcaatgatacaattacggacatttatctaagtagcaattattttaaaagtgaagttgtcgaggaattgcttaaagcattggaagtcaataagacaattacaaatattgacctaagtaaaaataagattggaattaaaggtgccatagcattagctagagtattagaaaaaaataagaatattaaatacattaacctggaagacaatgtaattggggcgttaggtatagaagcattaactaaagtatcaagaagaaaaggcatagagattgggctaggctcttaacaataagctttccaagcattttgttgtataaattaggcgattttctttaggacctacccaaattttt

SEQ ID NO: 87502 - DNA, 467 bp, Heterodera glycines
  SCN-specific regions: Sequence locations=1-15,37-467
ctgcacattccccaattttatttcttccttagtaagtagtattggtgcacaatgcgcacttttctgttcatagccgtagtcgggttgatgttggccgtcatcttggagaatgtaaatgcgactgggaaaaattcgccgacaaagggacaatcgccgccaggcagtccaaaacatgaaaaagaccgtaaaaatgagcatggtaaccaacagaaccatgctaccggaaaatcgccgccaggcagtccgagagtacaatcgccgccaggcagtccgagaggaaaatcgccgccaggcagtccgagagtacaatcgccgccaggcagtccgagaggacaatcgccgccaggcagtccaaaacatgaaaaagaccataaaaatgagcatggtaaccaacagaaccatgctaccgttccaaatgtggtgcagaaagttgaagtccacaaccaacctacgccatctgctgctgc

SEQ ID NO: 87503 - DNA, 481 bp, Heterodera glycines
  SCN-specific regions: Sequence locations=1-481
aatgccgggcagaagtgttgaaagatcagctgaaaggggcggtcgacggaagagagggggcgaaagcgtcgtcgaggaaaccgttcaaaccgatccaaccgatcgcaagcgaagcggcgaagagagcgcaacagcggaacagcaccagcagccgcagggagttgctgttgtcgaacgaaggcggcggcggtggttcaacagcgacaacgcccgcccgaccacaggcaaccaaaattggtacaacgccaaacacggtgccatttggcgcgaaggatgctgccggcggcggcgacggaggcgtcattgacaaaattgagcagatgttggaggagggcatgtaccgaatcgagtgccaaaagaggcctttccgtgttcggtgaaagggacagccgactgtgtatgtgagcgttgctgacggcggtaataacgcgacttcaacaacaacagcggcggtgtgaagaagccagtggtgaatgttgtc

SEQ ID NO: 87504 - DNA, 432 bp, Heterodera glycines
  SCN-specific regions: Sequence locations=1-146,169-432
tccgactcggatttgcgtgggttggccccagttcgtcgctcgtctctctttccctggacggcaacaacatttcgcgcatcggatgccatgcgtttgcctccgtcggccgactctccgtactgtcactgcaacacaatcgtatcacatcgctttcctgcgccgccacccacgacccaatttcactcaccgtcttcctggatcagtcctttttgcaaccgttgcaacggcttagtcggctgtccctctcccacaatgcgctgcaattgctcggcgaggacgacttggccggtcttggcgcgctgcgcgaactgctgctggaccataacaacatttcaaagatcgccagaaatgcgttcgtggacctccaactgcgcaaattgttcctcaacaacaatcagctgtactacttgccgaggggcgtcttttccggtt

SEQ ID NO: 87505 - DNA, 565 bp, Heterodera glycines
  SCN-specific regions: Sequence locations=1-6,28-89,111-176,200 -263,287-329,353-565
ggtaatgagaagaaccgcaaattgttggacttgttggatgctttggagttcaacaggtcgtcatttttcttcgttcggtcagccgttgtcgtgcattgaatcagctgttgatcgagcagaacttcccctccatcgccattcatcgtgcaatggcacaggaagaacgtttggcgcgctaccagcaattcaaggacttccaaaaacgcattcttgtcgctaccaacttatttggtcgtggaatggacatagagcgcgtgaatatcgtgtttaattacgacatgccagaggatactgacacgtacctccacagagttgctcgagctggccgttttggcaccaagggattggccataactttcgtctctgatgaaacggatgctcaaacgttgaacagtgtgcaagatcgttttgacgttactatttctgaactccctgatcagattgacgtcggaagttacatcgaaacacgaaccggcaacaatgctgcagccgaatgatgagaattaagatggatgatcagtttattttggatttatattgttttgtgctgtcaatctacatcatt

SEQ ID NO: 87506 - DNA, 423 bp, Heterodera glycines
  SCN-specific regions: Sequence locations=1-240,262-423
ccctcaccgaaacccgcaaaattccctaaaactcctacaacaaataatacgaaatacttgccgccggaacttttggacgaaatgactttttacatatatcctaaccaaaattgttcgagaattctgacttcttcctggttactcatggaatttttgaggcctcatatcgaaaggtggaaaaaaatatttaaaatactgcttaacgagctgatcgatctgcacaaactctgtaaggaaggaatcccttggcgcacatttaccgccctggcagaaaaggacaaaaactgcaatgcctttgttgccgcgttactggaactggttaaagaggacgcttatgcatctatcgacggatctggctcgaatgcgttgttcatccgttttcgcgaactttacccaagtgttattgaaactcttgcgtggact

SEQ ID NO: 87507 - DNA, 367 bp, Heterodera glycines
  SCN-specific regions: Sequence locations=1-367
ttaagcattgacacttttagcaaacaaacaaaaaaaaaatgggcagcagtgcctccgaatcgccgccaccgccaaaacttgtcgccatccaagacttgcccatttacaaggccgagtccgtcccggccgcacgtgctgcacggcccgtcgacaccattggcaggccggccacttttggtgaggaagttttcggcaatttccgcttggttgcgctccaattgagggacttcgtttcggaaaagttgggcgttgtcaacagttcccttgcacccataagagacgcggccaacgccactgaacagttcatccttgacgagcagcgcaaagtgttgccccgtgccgtcgccatttccatgggcggcatggc

SEQ ID NO: 87508 - DNA, 286 bp, Heterodera glycines
  SCN-specific regions: Sequence locations=1-286
tctttaataaataagtttttttgtacaaaatgagcaactttatatttgtcgcctttttaactgcagcgttttttagctcaggcctcgctctaccggctccttatgatgctgaatcggtggtatcttctgaattaaatgttccactactttcagctgacgcaaatgttgaagcagcaatcaccaatgaaagtgatgctgctgctgcgatacaagctccatcaattgcggtaccaattgaacatcaaactgctgctgacattactcatccaactgaaactggcaatga

SEQ ID NO: 87509 - DNA, 458 bp, Heterodera glycines
  SCN-specific regions: Sequence locations=1-458
catctgattgtggacaagcgagccagcaacggaggcggacacttggattcccatcggtggcttggttggccctcaaacatcggtcatgttcgcaggcgacccgaaacagctcggcccggtggtccgtccagagaatttgaaatggtttggctttgataattcgctgatgaagaggattatgtacggcgatgtatattcccaagcaggcgatcgtgtttttgtgactcttaaacaaacgtatcggtctcattatgccatcctgcgtccgtgctcttatcttttttacgataacattctccaagtcgacgatggacaaggcgactttcacaaattgaccgaatgggaaggccttccaacaaaggggttccctgtcatttttcactcctctcgtggcagcaaagatgagcagggttttaacaggtcgcaccacaatttgttcgaagctgaattggtacggc

SEQ ID NO: 87510 - DNA, 230 bp, Heterodera glycines
  SCN-specific regions: Sequence locations=1-230
aacagctcgcccggctgccgacagcattgtgatcagttgcgagctgagcctgaacctggactacatgttggagaagctttgggaatatctcgctttgctccgaatatacaccaaaaagcccggcaatgcgccagaccttgggcctgaagatggcataattctgcgcggtaattccacggttgagcacgcgtgccatgcgctgtaccgcactttggccgcccaatttcgtt

SEQ ID NO: 87511 - DNA, 413 bp, Heterodera glycines
  SCN-specific regions: Sequence locations=1-98,129-413
tcatgacattcccgataaaaagccttcgcaaccctacggcctccaggggaccaatcatcttcttcccggcttcggcaaaattgcctcaaaattgccgactaaaacaattttgaaaaaagacaaagtctatgcctggtgcaattgtggatattcacacagtcaaccgctatgcgatggaactcatctcagcgttcgcacgccagcctgggccggaaaactcagaccggtccgatatattcctgacaaagacatggaagtttggctctgcaattgcaaacagacaaagaatcggccattttgtgatggttcgcacaaaaaatttattgaacaagagaaaaaggatgtgttggcagatgactattgacttttctgatagttttgtttattttattttttttgtttcatttttagtc

SEQ ID NO: 87512 - DNA, 432 bp, Heterodera glycines
  SCN-specific regions: Sequence locations=1-148,182-432
ttgctaaattttggcttaatcgcctgattctttttttatttttgccttttcttttattttttgcacttcatacaattgaaaatggctggcaaattcatcggcggaagaatgccttttcgtaatcacttttggctccttcctttctcacagtttctcccctttggccttttcccttccgtcccaattccgcttcttcccatgcgcgtgtcttcgattccgaattcccttcttctcattctccgaaattgcgctgtgttttgtcggctaataataagacaaattcgcgggcccggcgttaccaccacccgcggcctcagctggtcatcttcgacaaggacggcactctgatctgttttcattctctgtgggtcccgtgggtgcgaagctttgccgaaaaagttgaggaggcgggcatcgatggcattgccccga

SEQ ID NO: 87513 - DNA, 357 bp, Heterodera glycines
  SCN-specific regions: Sequence locations=1-357
tccaaaaactgataaaaaaatggcgttcctctcccgtctctccatccttccaaattcgccaatttcgctgcttgcagtttctttggccgttttggctttcgtcgctttggcatcggccaatccgccgacggcacgcgaaacggcgccaaatgcacagcaaaacaatgccaattcagtggcaactggggaaattgcgaaaaatattgcggaaaagatggagcggatgaatgagttcattaattattttagggcgaagaagttcatcgatgcacataatttggcatttgagaagggcgaagtgtccttcaaagttgcgccaaaccatctgatgcattttacacctgcccaatataatcg

SEQ ID NO: 87514 - DNA, 331 bp, Heterodera glycines
  SCN-specific regions: Sequence locations=1-331
cactcggactgcgaaagccgtgcatttgggcattcgcgcggctgaacatgacacacactgtgatgagcaaacggaagttgacctggctggtcgagcagggcttcgtctccggctgggacgacccgcgaatgcccaccgtccgtggcataattcgccgggggctgaccgtcgaggggctcaagcagttcatcctggcacaaggaggaagtcgctctgtcgtcacgatggaatgggacaaagtctgggccttcaacagaaaagtcatcgacccggtggcgccccgctacaccgctttggaaaacgcttctgccacgctcgtgccggcgacggc

SEQ ID NO: 87515 - DNA, 519 bp, Heterodera glycines
  SCN-specific regions: Sequence locations=1-519
ggaatccaatttccatttatctactcactataaaatgctccaaaacggccttaccattctgcttctgatcagtgttgtgatcggccattccttggccaaccttggcccaaccatcaaacataatcctcattttaaagccgtacaaactgcgcatcatttgcatgatgccattgcgaagaggcacgaggccgaagttacgcagatcatttgctccattagcaacgaacagcgtcaagcattggctttggagttcaaaaaacaattcggcactgatctgattgccatgctgaaaaaggagttcaaaagcgactttgaagaactgatcatttctttgatgcaaacgcccgccgtttacgatgccaaccaaatgcgtgccgcattgtccggctccaatgaggcggtgctaatcgaaattttggcgacgcgcacaaaccgacaaattacggcgctgaagcaggcgtatgagcggttggacagaaggcatcagcacaatcagttggaggaggacatcaaagcgaa

SEQ ID NO: 87516 - DNA, 436 bp, Heterodera glycines
  SCN-specific regions: Sequence locations=1-387,409-436
ctgccgttccccttgagtgtccgaagattgaaattacgcatgaagaaattgttgacgactacgtgcgagatcataccgcgatggacagctttttggtgactattacgccaaaccatcagaagcctgtgttggacatttcggattatcgtcagtattattcgaagaagtctctgttcgacgaagatcgcactgtgcgcacttttctggaaatgtgtctttcccaattctcgatcaacagagacatttactcgccggctggagccggcaaactctacgaagtgtccccggaggaacgagtctctgctggcaatggcattatactccgtcccggagttgcgaagggagttcgagtcgtgcgcaactatggagaattggcgcctgcgcttgttttggacatcaaagtgtcgccattctacgagtccaatggacttgtgcc

SEQ ID NO: 87517 - DNA, 238 bp, Heterodera glycines
  SCN-specific regions: Sequence locations=1-238
atcgcctctcttattaacagcagcgccaacttaccccacagagcgacagcgacacatggcggatgagcttgtggcgcttgcaccaggaacgcgtgtctcaggccgatggaccatcctaaagaagcttggcgccggagcatttggagccgtctatttgtgcaaagatggcaagggaacagtggcagcactgaaaacggagccaatcgacacacgtcaaccgcttcttgttatggaggcc

SEQ ID NO: 87518 - DNA, 302 bp, Heterodera glycines
  SCN-specific regions: Sequence locations=1-302
gattctttttgtccaccaaaaattcgcatttttttgctcgtcgaagcgcgcgcaattcaatacgcaatggaacgcatttttgagggaaagccaaagccgaaactcgttttcctcacattggaagagggaattgaccggctaaagctcaactcggacaattctttgattttggatggcaaattcactgttgccgtttcaatggcccgtaatgccgtgcacgacgcatacgaagccggaatggaagtgtggaaagcacttaaacgctcaacatccattcatgtgtttaacacacttttcatgtc

SEQ ID NO: 87519 - DNA, 312 bp, Heterodera glycines
  SCN-specific regions: Sequence locations=1-90,112-312
atactgtgaacagtactttggcgaatgaacacagtgccgtggcactttcgtcggcaatccccggcaatgatgaaaattcctcgtcgcccgccgttccctctgaacgaagtttagaattgctgaagaaatatttcggttattcgcgctttcgccctttgcaatacgaagtgatcgaagcggctctaagcaaacgcgaccaattggtcgttatgtccaccggttatgggaaacgtgtgtgctaccaattgccctctctcattcaaaataatctcactttggtcgtttcgccactaatttctttgatggaggacc

SEQ ID NO: 87520 - DNA, 312 bp, Heterodera glycines
  SCN-specific regions: Sequence locations=1-197,219-312
actactttggtgcccacaccttccagacaatccagagttgccaatgacaagttcaaggttggcgcttacactcacgtcaactggactggtcgtggtggaaatgtctccgcctcgacctacaacgcataaacaatcatctcaaccgttagtcttttgcgcccactcttggtgagaaatagctcatcgtgggcgtagacaaatatccatggttgcaagatagtaccggtcagtgtgtcgaaacatgaccgactcgttgagcacgtaacatcttactgctcgcacattagctagacattgcatccaaaagttttc

SEQ ID NO: 87521 - DNA, 368 bp, Heterodera glycines
  SCN-specific regions: Sequence locations=1-168,190-300,322-368
gcctttctctttcctatttttcttttccccttttcgcttttatcgtcaaatgtgccaaaattacttttgctgcgttttacattgtttttttttctgtgtgtccttttttcattggtcgattcgcgtcctcagctgctcaattcggtcagtacctcgggccttttgatcggaaaaggaagcgaagtcaaatcggcttcggtcccccttctgtcggagccaatgattgaaatccattcgcattcggcgccagtgtcgccttcggagttgaacttcagcagaagacgaaggaagcgcataagcaacaacaaatccaattgaacaagaaaatttataatacgtatcgcaaacttaaaaatcaaagaagtaaa

SEQ ID NO: 87522 - DNA, 226 bp, Heterodera glycines
  SCN-specific regions: Sequence locations=1-75,102-190,213-226
tttgcattggcttaaatcattccaccatgggtattttgcgcaaccgttcgatcaatagaattccaattcgagtcgaaaaatgtgctgagaatgaaaatggatttgccgatgattatgcaaactatctcttcgattccgaccaatccgacagcgacaatgccgacgaggaaaacgaagtggcggcccaaatccaaagccaacccatcggaggccaccgacgcataaa

SEQ ID NO: 87523 - DNA, 330 bp, Heterodera glycines
  SCN-specific regions: Sequence locations=1-56,78-140,162-330
ccaatgttgaaactgtcgctgttgctcccgcaatttgtcgccgcggtggcgcatggtttgccagttttggcagggaaagaaaccgcgggacgaagttgtattgcatctccggccatgtcaatgatccgaccaccgttgaggaggaaatgtccatcccattgcgcgatttgatcgaaaggcacagtggtggagtgatcggtggttgggacaaccttttggccatcattcccggcggttcatctgtcccattgttaccgaagagcatttgtgacgatgttctaatggatttcgatgcgcttgtccaagtgaattcggggcttggcacagcgg

SEQ ID NO: 87524 - DNA, 493 bp, Heterodera glycines
  SCN-specific regions: Sequence locations=1-493
ttagatccctcccgtcctcttagagcaactccaactcgtccacctttatctctcatggctttatcactttaaatggctttatttgttgggtcagatattcaaactttcatcggtcctttgccttataatcgcgagctttgaacgttatttgatcacttcccattggacattcagcggttttgaggaacgtactcgatggcttttgcttactgttgtccttttcatttccattggcattcgctttacgacttcggtggatgtcgtcattctcttcaacgaacagtccgttgtgcccttccgtcgttacattcccgcacaaatgacccaccgggaatggcttcccaacttcttcaatttgctcactgttatcattccattcggcacattggtgttttttaacggcggaattgtgctcatgttacggcgacaaaatgtgcaacagttacgtctgctgatcaccgaattgactatgggctacgattatatgaaagtt

SEQ ID NO: 87525 - DNA, 419 bp, Heterodera glycines
  SCN-specific regions: Sequence locations=1-226,301-419
taaggaaatttctttacactgaaactaattacgatgatgctccgcaatcgcgatttgaacgtgcagccggctgcaggtgcgggtgctccactgcccaagcgccagtcagctcatttggtaaaggtggttggtggcgccagcagccgtgcttcatctcagtcttccgccgggtcggaccgggactccaagtacgaaccgaggccaaagcgtgcatgcagccagaaggacaaggaaaacagccactacaacaacaacaatcacaacaaaagcagtcataacaagtccaaaaagaacaccagcgggggcaccgtcgttccggtcacggctttttcacggtcgctgctcatcgattcggccaagaaggacgtgaccgttgtgtcaacggctgtcgatgccggcggcggtggggtgcttgccgc

SEQ ID NO: 87526 - DNA, 352 bp, Heterodera glycines
  SCN-specific regions: Sequence locations=1-352
tgttccctatttttgcttctgttctcggcacttttgctcatttttctgtgcccgccgacctcggcccagggccgtcccccgccgagtaagtcaggccggccaactcagcacggacgagtgacaacggacggggaagagaaagacggcactgccgaggggggagcagcggatgtcgagagtggggagaaggaagagccgggactgagccaaaaactgctgaatgtgctgttgaatcatttgatcagccatttgccaaagattagcacggaaagtgtggtcaattgggtgcaggagacattcggattggaccgacaaacttcacggaattatgtgagaaaggcacacgaaatca

SEQ ID NO: 87527 - DNA, 225 bp, Heterodera glycines
  SCN-specific regions: Sequence locations=1-225
gcaaaagcgccctctggcgaaagtaagccaaatccggggcagaagccgatcggagaacggcgaaagagggacgttttggggcacgccggcggatacgtcggaggatgggaccatcccattgactcgacacttgattgggcaaagagtcagtggaatgatgccaattggctcgccgatgttgtcaacacaaacggatgggaaaacaccggcactccaaccggcgga

SEQ ID NO: 87528 - DNA, 376 bp, Heterodera glycines
  SCN-specific regions: Sequence locations=1-376
cgcggcgggcgatgtgatttcgcctcatcgtgcggttttgactctctccaaaacatgttcaatgccggatgcttctcattgccttacgcttggatgctcggcggaaaatgggtgtcattggctctcacttttgtcattgccggctttaattggtacggcaaccacattctcgtccgttcgtctcaacatttggctaaaaagtccggtgttgcctctctcgattatggacattttgcgaaaagagtgtgcgactacagcgaattgccatttttgcgacgtcacagcaagcgaataatgtacgtcatcaacatcaccatcctcttctaccaactcgcaatgtgtgccgttgccattcttttcattgctgacaatatgg

SEQ ID NO: 87529 - DNA, 362 bp, Heterodera glycines
  SCN-specific regions: Sequence locations=1-362
aacccaaacatgcgccggttttggaacgggcggtggatttgatgattaaagagacgaaatacgacaaggacattctgatgacactgttgaagctgtaccagttgaacccatttctttacaacgaaaagtacgtgtgccttgtgctattgaaaacgatgaccaattttccacgcaacgattttgctttggcaaaatatttggtggacgctgccaaagtgaacgctccggagttgcgacgcgtctgtcagattggctctcttcttgagtcttgcaatttcgcgctcttttggcgtctcgatgacggacggtacaaaccccgcgacagtgtcgatgaaccattcaaaaaacctgacgaaatttgc

SEQ ID NO: 87530 - DNA, 577 bp, Heterodera glycines
  SCN-specific regions: Sequence locations=1-577
tgaaggacggttccattctctgggggtcagatgaagaaattggcagccacgacggaatggaaaagtttgttcatacggacaaatttcgttctctgaacatcggttttgcgcttgacgaagggttggccagcgaaacggacacttactcagttttttatggggaacgatgcgcgtggtggctgcaaatcacttgtcctggcgcccctgggcatggttcgcgattcgttgaaaacacagctggtccaaagttgacttccattttggccaatttcaatgcttttcgtgaacgtcagcgtcatttgcttctcgccgacccgaatttgcgtcttggcgatgtcacgagcgtaaatctgaccaaaatcgagggcggagtgcagaccaatgtgatccctgcccaattcgtggcatattttgacatgcgcgtgacgccaaccgacgactttcagcaaatggaagcaatgatcgccaattggtgcaaagaggcgggcccggacgtcacttttgagttcgtccaaaagggaatgtgcaaatcgctgacccccaccgacgcctcatccccgtggtggcacgcgttttc

SEQ ID NO: 87531 - DNA, 452 bp, Heterodera glycines
  SCN-specific regions: Sequence locations=1-46,70-112,134-222,244-452
ggattgtaaggaactttttgaagaacacaggaaatggcggaaggacagaaaaaagcgaaacaaaagaaaatgattttttggcaggaagtgttcgacaataacaaaccggacccttcaaacacagttgtgcacaattggtattcaagaacaacgcaggagagatttttggacacaaaacgtgcggttgagaagggtttccaagtgttggtctcctcgcgccggtaccttaattacatcaattatggccccgattggcgtgatggcactggcacaacccgacaaatttactattgcgaccctcgcggtttcgagggcacttatgagcagaagcaattagtgattggcggcattgcaacgatgtggggcgaataccttgacgggaccaatttggagccaaatttatggtcaagggcttctgcggtcgctgaacgcctttggagtccgcccgagtt

SEQ ID NO: 87532 - DNA, 264 bp, Heterodera glycines
  SCN-specific regions: Sequence locations=1-241,263-264
cgccggcatgctgcgcagcttgggcacagagaactgtccatgtccattgggcatcgaagaggtgaagccgcgttctctgcgctttacttggtcaatgaagacgacttcgtgacttgcaccggacgaaatgatgaaagaaatacgaaaagtactcgacagcgatggatgcgaatatgagcaaagggagaggtatttgttactttgtgcacacggcgacccaagcaaagactgattgatacaatgggagatggaggtttgcaaatc

SEQ ID NO: 87533 - DNA, 322 bp, Heterodera glycines
  SCN-specific regions: Sequence locations=1-322
accaaaatgaataaacgacaaaatgttcctgctttttcagtttattcgtcaaagggttttcagtggtgacagtgccaaaggaacgggtgaaaaggaaaggagcggaaatgaaaacaaaacgggtgggtctaccaatgttccgaatgcgaagccttgctccaattcgttgcgctttctaatccatctgaggtacactaatttcgccctaattgacgcgttcgatactgtcccaatttgcaggctggcttccgattcatcgggaaaagtctatttgcatagcgacatccgaatattattttcaaataaatcaaaagatttggaa

SEQ ID NO: 87534 - DNA, 207 bp, Heterodera glycines
  SCN-specific regions: Sequence locations=1-102,124-207
tcccttttgcgcctgaacgttacatttggcggctgttcatcggactccatggaactccgagattggtcgctgcgttcgccttcaaaaactttctggtcacttccagcctttggcctttcccctttcgtccatggtatcgttgggcttcccaattcgcttgttcgttgaattttggccgaaattctgtcactgatcttgctctcgtca

SEQ ID NO: 87535 - DNA, 375 bp, Heterodera glycines
  SCN-specific regions: Sequence locations=1-265,287-375
caccgccgaagttcgtctcgagtctctttctacgtcagttccaatatttgttgtcggatgttacagagagacttttggctttcggacagtaactgtggaccaaaacagaatttacatcaatgggcgaccattttaccgtcatggattcggaatgcacgaggacatcggaattcacggcagaggttttgaccgggcggcgatggtgaaggacatgaacatgttcgagtggttgaacggcaattgctatcgcacaagtcattacccttacgcggaagagagagcgtactgggcggaccggcggggaattgcggtcattacggaagtgccggccgttggaatttggaagctcaactcctcggcattgctgaaactgca

SEQ ID NO: 87536 - DNA, 500 bp, Heterodera glycines
  SCN-specific regions: Sequence locations=1-500
gaatttggttaatgtgtttggcaatctgctatttgcagattgatttgatgcgcttgcaactccccgacccatttttgattattcactggccgatgtcgtctccgttttctataatcgctatccaaattcatttgctagacacaacatctctgaggatgtgttgtggcgtgagatcactgacgatcgaatagtgacgaagaaactaatcgttaaaaagggttcaagcttcctcagcaaattgcccaaatggatttcgggacaagcgaaaatgcaatttatgccgacacttgaagaaagcatttactgccgtcgtacccacaaattggtgacgtacacacgaaacattgccggcaaacacttgctgaatattagcgagcgaagcgactttcgtgaattgccgaatgagcgctctgctgtcgcgcgtcatttggaggtggctgccaattgtcgcctccattcgctggtcgagaaagtgctgatgatggcattacgcaaatcat

SEQ ID NO: 87537 - DNA, 507 bp, Heterodera glycines
  misc_feature (464)..(464): n is a, c, g, or t
  SCN-specific regions: Sequence locations=1-138,160-507
atgaaatgcttgctcgcaaaataacaagtgaaaattttgaagagttggcacagaatttgcggaaaaatgcactcaaattggcaaaagaaagcactgggaaattccattttctcactgaaaatcacttttatggccaatttatcaattatttggcaaaaattgcccaacttaaagtggaagaagcactgaagaagcgacgggagaatgacaatttggacgaattatcggagaaggaaacgaatgacttttcggagggatggaaatcattacaaatgtttgtcgaaatgtattcatttggctcggaactgttcatgcaattagcggccaattacggcggaaaatttcccaagaaaacgcgaaaaacaatgaagcaattagtggtcaaaaaaataccgcaaatggacgaattgtgccaacaatttgtcgactatttccaggccaaattcatgaaaagcatcccacanaagctgagcattgagccgatgaacgctcaaaaatcatcgacca

SEQ ID NO: 87538 - DNA, 490 bp, Heterodera glycines
  SCN-specific regions: Sequence locations=1-444,466-490
gcgtttctaatgccaccactccttcggcaagctacataattcgacttgtatcaacagaaattgacccagttgaattgatcccatttgaattgatgaacgaacggaccaacgaaatgctgacatttgagaaagaatacgatcatgaaaatatggaggacgatgaaaatatggaagacgaagatgcaagtgacgattggctgttgaagcgatgccaaattggagaaacggcgacgattcaatgggtgtgggacccgagcgattggcaaaatgtcagccttacgctcgatagtgtcaggaagaattgcattgggcaattgtctccacccaaggcggaccaaatgaatgcaaaaatcgtctgaaaatgagcgccgggcccagcggaagaaaaagtgaaagaattattgagaaatgacaaatgagtgatcattatgaatggaagttgatctgctaattgcatttgttgcttctttcgtttgaatacatttatttt

SEQ ID NO: 87539 - DNA, 405 bp, Heterodera glycines
  SCN-specific regions: Sequence locations=1-405
aatgctccaaacggccttacacttctgcttctgatcagtgttgtgatcggccattccttggccaaccttggcccaaccatcaaacataatcctcattttaaagccgtacaaactgcgcatcatttgcatgatgccattgcgaagaagcacgaggccgaagttacgcagatcatttgctccattagcaacgaacagcgtcaagcattggctttggagttcaaaaaacaattcggcactgatctgattgccatgctgaaaaaggagttcaaaagcgactttgaagaactgatcatttctttgatgcaaacgcccgccgtttacgatgccaaccaaatgcgtgccgtattgtccggctccaatgaggcggtgctaatcgaaattttggcgacgcgcacaaaccgacaa

SEQ ID NO: 87540 - DNA, 418 bp, Heterodera glycines
  SCN-specific regions: Sequence locations=1-314,337-418
tctttgtcgcctttttactgcagcgttttttagctcaggcctcgctctaccggctccttatgatgctgaatcggtggtatcttctgaattaaatgttccactactttcagctgacgcaaatgttgaagcagcaattaccaatgaaagtgatgctgctgctgagatacaagctccatcaattccggtaccaattgaacatcaaactgctgctgacattactcatccaactgaaactggcaatgagtcttctattgcatcatcatcatccacgccgaaaagtgagcagacgccaaaaaaagtgatgaacatgaaaagcgcgctggaaggcgcggcggccaacgtgtacggggggcttccgttagacaagcagcccaagacgatcgctgaagcggcagcaaaagcaaagcagacgcccgcc

SEQ ID NO: 87541 - DNA, 330 bp, Heterodera glycines
  SCN-specific regions: Sequence locations=1-330
ggctgttttttgcgcttgtattggaaaaagctcgcgactcgtggttcttccgcttctgtgcctttttggttgcgttgcatttgctcgtcaatgccattttctccgtcagttttgtttatgcgagcgcacaaaactacccgggcggagttgcactgctcaaattgcagcataagcaccgcttccttcgggacaagccaatcgccgctcatatcgaccaattttcggctgagactgggatcagtcgctttttgcacctctatgacgcgtgggaatacaacaaaactgagaatttggcgcaagaggagtttggtcgattcgattacattttgg

SEQ ID NO: 87542 - DNA, 450 bp, Heterodera glycines
  SCN-specific regions: Sequence locations=1-140,162-256,279-450
ttaaatccttctgactgtgcttttggccgtcgtctcattccgtctcccggcttctactggtgacaaaaaaactgctaatgatgggagtggaaacaactcatcagctgggattggtacgaagatcaaaagaattgtcaccgctggactgctcttcacttccctggcgacggatggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttc

SEQ ID NO: 87543 - DNA, 425 bp, Heterodera glycines
  SCN-specific regions: Sequence locations=1-425
ccgtctgatggcttctctcggcgttcgccaatgatcggctcaaacgcagccggcgcactgaacggcgacttccaaacgggcgacctaatggtcatcaaagatcacatctttctgcccggactgtccgggtactctccgctgcttggcattaccgacccccgttgcggctcgagtactgtctctcttcataatgcgcacgacagagaattgacgaaaaaggcgatgagtttgggccgtcaaatgaaagtgccgttgcgcgagggcatttatgtgatgaatgcgggtcctcagactgaaacggcaggggaatgttcgctaatcgcgcggatgggcggcgacgccgtcggaatgtccacgtgccacgaagtgactgtggcccggcagtgcggcatgcgcgtgttcggcttctctctgatcaccaattg

SEQ ID NO: 87544 - DNA, 498 bp, Heterodera glycines
  SCN-specific regions: Sequence locations=1-230,252-421,443-498
gggtcttcgccattgagtttaaaatcccgaataatccctcttccactgctcgagtaactagtccatccggcactatttatgtaattttgttggtcaacaatccaaaaaaacagccgattcatgctcaaatacacttccatttggcttttctgctcattgaatgcatccaaagggaagtaatgaaagcgatgggaatgacgacacgtggaaaaaatgggagttggcagatgaatttgggaatttatttgtcagaacatttattaagcccatatcgaaagaagaggacagtcagattttttacggttgtgtgattgattttccaaagcacaatgaacatttcggttttccgaaaagtgttgcaatcaaacaagtgttcatcaggggtgacgaatattataaggcaaaagatatgttgatccatgaagttgaaatattgaaaatggccgtacaaatggaggccatttacgtgatcaaattaattgattacattaccgtacc

SEQ ID NO: 87545 - DNA, 519 bp, Heterodera glycines
  SCN-specific regions: Sequence locations=1-519
aacttcgtcggacttatttgttaggaaaatgccaatttgctccagttctgttcggaccggttgtttaccgcccatatcaacccaacctattggaatcgggcggtaacaagctgttcggcatcggtgctggtgcctacaacacttgtgttgtgctgtcgcccattctcgtgccgtacattgccttttcttggacccactcccatcacttttcttttttgcgcttcgttttggtgttttatgtcattgccttttccttccgaacgattggtcggctgacaaatgttgactacgtccgttttatcaaattgctcggaaccgtgcgcaaatctccgcagaatgtcactttgctcgacacactcaaagactacgattttcaagtgtacgctgcgcccgctgattttaaagcatcgccaggccgaacggccaaatggcaccctccgcgtgaacgccttccggacttgaatcctccgcttaattttctgcgtcaggctatcgcgtggacggccgctaacacttttg

SEQ ID NO: 87546 - DNA, 495 bp, Heterodera glycines
  SCN-specific regions: Sequence locations=130-130,222-274,296-495
ggattatcccttggattggtacaaatctgtggttgctggccaattatcagtttcggcctctttcgtgacgatttgttaaccgcgttaattgttgctcaacggaaacaaaattttcgagtgcgaatatgaggaccgaaatttgtacaaagacccaaatgcttctgccatttatattctcagtttggctgtctccgataggtatagacggaggggcattggtacgctgttgctaaaccatctgatcactaattacagcgttcccttggcttcaaaactgattttcctgcatgttcttagtgacaaccattcggccatcgttttctaccgcaaaaacgggttccgccatcatatgacactgcccaaatattatttaatcgacggccaataccgcgacgggcaaactttcgtcctcttcacttcgcagggagtgtttggcgaattcgtctcgtcagttggcgattggtgtgccatggcgatgagtttcctcacttcgcc

SEQ ID NO: 87547 - DNA, 477 bp, Heterodera glycines
  SCN-specific regions: Sequence locations=1-477
cgttactgtggccgctgcgcaagagctaaagatcgccagaattttcaatttttactcgaagattatatcaaagcattaaacgaagccaatgaacgaaacaaacaattggtagtgtccgtgaaaagacgcattggaagactggatgaggagaagcaagagttggccaggcatatcgaaagtttgcccgacctgacggaaatgttcgggtccgaacccgcaactacgaacctcccatcgctaggggaattgttcactccaacttcatgaatcgttgccaaagaatttatttatgttaatacaatttttaaagaatgactggaagggtccccataacaaaaggcagaaatagggacggaaacaaaactttacaaactcaaattctccattttgataataaaaatataatcaaatcaacagcgtggtaatttcaaagcacccgacagacaatcagagaatttctaaatcttattaatttcc

SEQ ID NO: 87548 - DNA, 457 bp, Heterodera glycines
  SCN-specific regions: Sequence locations=1-270,294-320,348-457
caaagaaggaaaaaaagaaaattaagcccaaccccgcagcaccgaatgtcgaacagccagcaacgccggaaatcattgagaatatggaggtggaggttgaagcagttgcgaaggctgaagccgaggaggagttggacccgaagggtcgggtgcagcaactgctggaaatgggcaagtctctggaatgggagatggccgtccaatcggacgatgagcaaatcctcgacctggatgatgatcttgagatgtttccaaggctgattttcctgcagctggccaagttcctgaagaatgcacctgatgggttgaacgaacagcaaaagaaggaactgaaaaaagtgttggccaattggatggaagagcaaaagcagccatttacggtggatgaggaaatggcacaagtggacgaaactgtgcaaagtttgagcaccttctgtgaccaaattggcaaaagttt

SEQ ID NO: 87549 - DNA, 485 bp, Heterodera glycines
  SCN-specific regions: Sequence locations=1-12,34-199,221-485
tgatttttcctttactgcctcaacatcgaattcgcttttgatgaaatcatttttcagttcgcctttgttcccatttctttcatccgttcaaattcgcttcaaatcaaccaaaattacaatttaaaattaaccattcttaatggttgagctgtccgctgtatgttttgtgtataaatcctccatccgtcatcttttgtatgtcattattcattatatatcattgcgccttttgtctaattgaacaaaattaaattaacgatcttaacaaaaaggtatttattgaattaaactttgatcattttcttaaataaagcaaatattttttgcatcttgaaatattaaattgattttgacaaggttttagtttttgaaattgttgggtcgattatgcggtaactagcggggtcagtgccttctgcgcatcccccgctaggtagtacgattgtattgtaagattatgtttgataaaatcgactggctcggcc

SEQ ID NO: 87550 - DNA, 469 bp, Heterodera glycines
  SCN-specific regions: Sequence locations=1-57,82-403,429-469
tcaatgttgccgccgatggtgatacgccgcaggacatgatgatggacacgtcggaaaatgatgaacaccaccagcaccagcctggagaggagggggaaatgccaccacctccgccaacgccgtcactcattgaactgttggacgtcgagaccaatgaaaagatgctgttcccgctggacatggacgaggaggtgacggtgcaatggccggacaatgcgacgattggcaccagtgtcacggacggggacgtgccggcggcgccgatcattttgaagctgtgctgggacagggctgtgagaacgcgcttcgaaagcatggaaatcggacatttgatggagcgtgaggtgaacatgatggcctcgctgaagcagtcctacacgttgaaggagtgcattgacatgtacacgcagcaggagcagctgaacgaggaggactcgtggtactgccccaactgcaaaacgcatcggtg

SEQ ID NO: 87551 - DNA, 335 bp, Heterodera glycines
  misc_feature (262)..(262): n is a, c, g, or t
  SCN-specific regions: Sequence locations=1-47,100-139,161-262
ccaaagagtgaaaaattcattaattaattgcatttatagtcaaattcattaaatttttatattttattggtttaaatttcatttttcttttattttattcattcaaacattgattctatgctaattttattgtttctcctattaatcataatttaacattttcaaattttgttgctaatttccatttgctaattgaccacttttatttgtttaactacacaaaaggacactcgccaagcataataaaaactgtccattcgtnaaaaaaaaaaaaaaaaacaacaaaaaaaaacaaaaaaaaaaaaaaaaaattgaaaaaaaaaaaaaataaaaaa

SEQ ID NO: 87552 - DNA, 259 bp, Heterodera glycines
  SCN-specific regions: Sequence locations=1-259
atgacctgagttcggctgtgggcgaagaaatctttgtccgtcatcggctgattctatgccgaaacatcgaagcgttcgaacgaatgctcacccaggacggaacggagacaaaaaagaactctaactgaccgacgatccccagtgccgaccgatgttcgggcccttattgctcttcctctactgtcaccacattgcgtagagtgcctaaaatgcactgccagcgctcatttcggcggacaaatacaatgtgacaggctta

SEQ ID NO: 87553 - DNA, 616 bp, Heterodera glycines
  SCN-specific regions: Sequence locations=1-114,136-616
catcctctaaaaattacaatcctctcagaaaatggcttcatctttctgctcctcaatcatttccatcgtcgcaattgtctgtttgctgtgcaaatgctgcttttcggcaccccatccatgctgtcctggcagccaacatgtcgtttcgatgatgaaagatcacaccggcacattctccgcttcgatgccaaagtcttcgctttgtatgagtgccgaaagagtcgccgctgcggtggaaaaccaactgaaaacaatttggtgccctggcaatggtagtcaaacactcatcaacgagatcaacgcaactcaatcatcatcagatgagtgtgctcgcagtctcggcttcgtccgtgccatgttcgaaattgccgcttccgccgcttcccatgccggtgccaacgccgatttggctgtccagttccgagaacaagttggcacaattgacagcaattgtgccgcgttgggcattcatgttgggcaaatcagcttggatgcccccaggggagaccatccgcaagtgcatgactctgagagtgtgcttagtaaccctggcaccagcgggtctcacaagcgcttttaagtgaatttcgtagattcgatgatgtcatcatttgtt

SEQ ID NO: 87554 - DNA, 654 bp, Heterodera glycines
  SCN-specific regions: Sequence locations=1-654
actgacttatgccacggaagagcggggcaaaggcatggctttaattggtggctccttctccctggcttttttgattggcccttccattggcgcctttttctcgatcggtgcccgggaaagtggcgagttcgacccgtccccggctctaccggcaattgcactcacactggcagaattggcacttttggtgttctttttgccggagacattggccaaggcaaagaatgacgattgccataaacaaagtgggcatagccttcggcatttgttgtcccctcgggcgctgttttccttcgacttcttgtctccggcatcggcttcctccccgccggtttcggtgccattgctccaaaagtattcccgcgtctactttctgttcatgctgctgttctccgccatggaatttactctcggctttctcacccatttgcgcttcaattacagctcaatgcaacagggccggctttacctgttctccggcttttgtatgctggtcattcacggattcgttgtgcgacgcattccgtcaacactcaaagcacaaagtcacggagcgctagttggactggtctcaattgtgccagcttattttgtcatcgcttttgcacattgccaaaatgcccttttcatgggacttcttctgttctcagtcgg

SEQ ID NO: 87555 - DNA, 789 bp, Heterodera glycines
  SCN-specific regions: Sequence locations=1-789
ccctattcttaccacaattatttgttcgtctccaagtctcgtcaaacgtctgcatttattgttcatcaatccttcatcggttgccgcccgcgcgcacttcaaaatggacgccctcaaaagacttgcgagccgtgcacggcagaagtcggcggagatcattctgagcgcggagaagaccgaaatcggcgccgagcttgaacaattgctgaccaagaccgacaagacggaggagcacatgaagaagctggtgcatgccatcgaggtgtacctgcagccgaaccctgcagtccgagcgctcgacccgcgaaaggacaaatccggccgacagaacacgctggacggtcttggggaggcgatgaaggaagcagcatcgaaagcggtgggcgccgagtcgaccttcggagccattctgctgaaggtgtcacagacggagtccaaaatggcagcaggggaacgccaactcatccaatcggtcaccacgcaaaccttggcaagcctccggcacctcctggagaacgaactgcgcaccgtccagaaggaacgcagcgtgttgaacaagaaacggttggatttggacgcgacaaaaagccgttggaagcgcgcctcggacgacaaaaaaccctctgttgaggcagagttgcgcaaagcccaagacgaatttgacacccaactggagaccatcagcactgcgttggaggctcttcaacggccgtggatcgtcaggctgaacaattggtgcagttcgtggcggcacagatcgtatgccacagcagcagcctcaaacttctg

SEQ ID NO: 87556 - DNA, 625 bp, Heterodera glycines
  SCN-specific regions: Sequence locations=1-174,198-625
aaatgactgcggaggaccctttataaccaacgcaaaagtggcggcgaccgatcgttttttatgcgacccgtcgatgatgagcgtgccgcgatggtcgtggacagtgagcggctcaatttggaaggcgcggacgacgcggcgggcggtgcgtccgtcgtgtgcccaaccccttcttggccatgtctctgcagcagcagcgccaacgactgcccatcgcaaaatgtcgcaaccatttgctgtacctttgcgaacacttccaaacggtggtcgtcgtcggtgaaaccggatcaggcaaaagcacgcaattgccacaatatttgactgagttcggttgggccgaaaatgggcgcagaatttgcatcactcagccgcgacgggtggccgccatttcgctggcgagtcgcgtggcggacgaaatgatgtgtcggctgggagacgctgtgggctattcggtccgatttgacgagtgcatttcggcacgcactcacattaagttcgtcaccgatggaattctgttacgtgagctgatgagcgacccgttgctgcaggcgtactccgtggtcatcgtcgacgaggcgcacaaacggtcagtgaacacagacctgatcatcggctccctgcgcaa

SEQ ID NO: 87557 - DNA, 731 bp, Heterodera glycines
  misc_feature (611)..(611): n is a, c, g, or t
  SCN-specific regions: Sequence locations=1-731
gaccgacgcccgtgcccgttctcgctcttcgaaacggggcaaattgttgacattgaacatgctcagaatgttgtgccaaacccaccgagcggaaatagaggaatgcaaatggacggacttttggcaatttcacgtcgtgtgtggcgcctgaatgagaacctggcctctgtccagaattacttgtcgctgatgcttgtcacccaaaaaattaattgctgggatatccagcattgtcaccgcgacctttttatccatgacggggcgctgctagtggaacatgcgggaaatggccactttttgtccgttcgatccctgtctgcggccaacgaaacgcacggggtattctattttgaggttactgtgcttcggatgcaaagtgatctcggcgtcggttttctgtccgatttcatcggcatgcatgagatggtggggcactgcgagagttccttcggctactggtcctatggcagtttgcattgtgattgttcgacagccgacgcacaccttgacggttttccgcagttcacgacgggcgatgtaattggatgtggactgaacgcattcaaccgtcatgtcttctttacgcttaatggcgagaaattggacatggnggattcttgctgctgatccggtccgcctttttgccgccgtcactttggttgacaacaaggacgccatccgtgccaactttggaccttcattcgtgttcaatttgtccagtgtgctgccat

SEQ ID NO: 87558 - DNA, 724 bp, Heterodera glycines
  misc_feature (682)..(682): n is a, c, g, or t
  SCN-specific regions: Sequence locations=1-724
cagaaacatacatacacaacttctcatgtcagccaaccgacgcctttacgagttgatcgatcttcaccgaaagtgcaaagaagacctaccttggaagtattggatcgccttggcagaaaaggacaaaaactgcaatgactttgttgccacattacaggaactggttaaagaggacgcttatgcgtctatcgacggatctggttcaaatgcgttgctcatccgtctccgcgaactttacccaagtgttaatgaaactcttgcgtggactgaacttcaaaaattctccgaacaatttccgtcaactcagcgtatggtgcaagcacttcatgagttaattgaaacgccgggactttattgcggacccgttcccaagtcgtcctcatcagaggaacatttttaccattctgtggcttgcgttggaccaccgccggtgaaaattgatgctggtgttcagtcgacttcctcatcaacggctcccattccgaaaccgctggacaaatcgatgaagccaccgccacagcgtccccccgacgatttctctgagcatttatacgatgttccgccgaccattgatgcccatcctccgccacagcttaagcaacaaaacattgtgccgcccattcgtcagccgacttcgtccgcttcagctgcagtgccattgccgtcgcagaaactggtgctngtgttcagtctttggttcgccgtttgcctttgtcgtccaaga

SEQ ID NO: 87559 - DNA, 705 bp, Heterodera glycines
  misc_feature (466)..(466): n is a, c, g, or t
  misc_feature (597)..(597): n is a, c, g, or t
  SCN-specific regions: Sequence locations=1-705
tgagctggaactgatgctaactacaactgccgacaactgacgaggagaatgaggaacttggctaccggacgcccgacgatttgttgctgtggaaagtgttgaggcgttcatcggcggcccctacctattttgacattatggacgacaaatacattgatggaggcattattgcgaacaacccgtcattggaactgctccagcaaatccaatattggaacatcttcaacaagcacaagaaatttcccaatgccgtgaacgttggatgctttctgagcattggcaccggtgtcattccgaccactccattggagcgcactcatctcgaagtttcgccaaactggatcacccaaccgatcacctcgataaaagcagcgctgaccatcggcgaaatcctggttgaccaggccactgccgctgaaggggtgcccgtgcagcggaccggcgctttttgcatccaacaacgggncgccgttctttcgcctcagcgcgccgctgttccgaaaaatacgattggacgagacaaatgacgcggacattgtgcaaatgatgtgggattgtatgggagtacatgtacaagcatcaggactatgtggaacnggttgtgcacgctgctgcgacgggttggccatgcggagcaccggcgccgtctgttccaaaccaatggggcggcacgtcttctgcagctgttggaccaagcgcagaaga

SEQ ID NO: 87560 - DNA, 775 bp, Heterodera glycines
  SCN-specific regions: Sequence locations=1-775
ctgaagatgagacacgacacgcatttttggcaagaattttggcagaattgaagcacttacgaactttggatttgtccgaatggttactcaccgatttcactgtcctacagaaattggaaaaccttacgtcattaattctttacgacattcacaatttggaagggtctatcgacacgttgtgcaaattttgcaaactcacgggactcgatctgtcccaaagcgatcgttcctccagcggactgtacgctcagccggtgacagcacttcacaaattggtgtccagtttgccaaagttgaaatatttggacatttctggcacaaatcttacgactttgccttccgaaaatgatcgtccatttcgcggtgccggaacgattgacagtgacatcccgggactgagttatctgaagaaaccgctcaaatatttgggcattttcaactgtgaatcgagctcgcaatacaaaaacatcccggcggaaaagataagtggcgaccatggagaggaccaagtgctgacagcgatggaaatgtacttggaaagacccaaaacaatgcaagcggtgctcaacgaaagttaccatttgtaccgttttggcaccaatttgagtcgacaagttgaagcgcttcacctcgtgctaaagtcgatgtccttgcacctcaacaacagcaacctccaaattgccggcagtgcttcgatgttttacataattcgctctgtcaaaatgaattggtccacacgacggagagtgatttttgcgctaattgatggcatggg

SEQ ID NO: 87561 - DNA, 707 bp, Heterodera glycines
  SCN-specific regions: Sequence locations=1-405,427-682,704-707
agaatttgcgggatcgatgttaaagacgtgaagttgtcgctggctaagaacgatcgtatcatgcaggaagaggctacaaattggcgtcgtcatacggaggctattgttaaggagttgggggaccgacatcacagtgacttttctggactccacaaattgctattggaactgtgcattcgctcttcacaattaccacaagctcaacccgctgttgtagaaacgaaacagtcgaaagaggacgaagatcacacgaagaaggatgttgaagttgtgcagattgctaagaaggatgttgaagttgtgtagattgctaacaaggatgttgaagttgtgcagattgctaacaaggatgttgaagttgcgcagattgctaagaccgctgagcctgctgagtttaaaccgactgttgagcctgatgcagaagttctgaagactcttaacaccgttgagcctgttgggtttaagccgactactgagcctactcctgctgttaccaccgctgtttctgttgctccgttgagtggcactttaaccttcaccgcttcgtccatccctattagcggcagtctttttggtggtgcttgtagacccgggacaaacacgttatcgaacttggcggccaatgtcactgctaagaccactgaacctgttggatttaaaccgactgttgagcctctgcttcctgctgttactactactgctgtcac

SEQ ID NO: 87562 - DNA, 405 bp, Heterodera glycines
  SCN-specific regions: Sequence locations=1-54,76-180,203-262,287-405
tgtgccttttcctgccgccggaattgccgtgacgggcggtgtgatagcaattgggcctttgtttgtgccccgcgggtttattctgctagaattgcgaccatgccgtgccctttgtggagccactggtcaaactgtcgcttggagtgccaatgttcgcgggaagggacctccaaatgcgatgcaaaaggaaatgcttttgaaagtcggacttccaaggccaattttgccaacggggtttttgcgacataaaaacggacgaatgccaaaaggggaaaccccggggggcgaagtgcccggcgggttttgtcatgagaccgttgtgaagaaatatgccctccgggcagattcggcactgactgcgactaggcagtgccgatgcaagtcaggcctttgccatcattcttc

SEQ ID NO: 87563 - DNA, 388 bp, Heterodera glycines
  SCN-specific regions: Sequence locations=1-357
tgactcgcagaagctggtgacacactttggcacaccgcgtgacgtgaagggcaaacatttgaagcgcatttgggaattggagtacccggaggaagccgaagtgtcgctggaccgtctctgatcagcgacacggattgaattgtgctgctgatcagcacatgaacgccggaggaaggaggagtaggacaaatgccatcgtcctcataaagttggagcagtacacacccaccacaccgtcatcctttgccgtccggagagtgatcgatccattgataagcaatcactcactcgcccaccaccttattgatctgattcccacttgatcatcattccattatccgaaaatcacttcatcccaaaaaaaaaaaaaaaaaaaaaaaaaaaaaaa

SEQ ID NO: 87564 - DNA, 589 bp, Heterodera glycines
  SCN-specific regions: Sequence locations=1-589
accttacaagccctcctcacggtgacgacgttcctcgtgccgagccatgcccatcgcgaccgtgtggtgacgatctcgtcgcctgaaaactcgaactttattcagtgcgcccctagctatgcattccgcaagacgggtgttcttgaaatcgccaacttcgagcctcgttgggagcaaatgctgtacacgcttttcctggcggaaggctggatcgtgaatgcccctgaccacgaaggtcccgagagcgctttctcggctggccgctttggtggtcacatggtgcttgactcgatgcgcgctgcgaacaactttaagccgctccaactctcgaagcgccctatgcacattggtcacggctactcgggtggctcgacgcccaacggctgggctgcgagtctgcacgagacgtacgccaacgagctgaacgtggtgggctggtcgctgggtggctcaatgactgacccgctgtacacgctcaactccctcgacggtaaacctacttcgtcgctggcggtggccggtgccattggcttgatggacgcctacagggacgaagtccgcaacctgctcgatgacgaagtctggaccg

SEQ ID NO: 87565 - DNA, 832 bp, Heterodera glycines
  misc_feature (771)..(771): n is a, c, g, or t
  SCN-specific regions: Sequence locations=1-605,627-832
gtgatgaattttgcttgttgctgtatttttaagagttgccaacgttatttttcgagcagtcgtaaacaaacggaacaatatttggaacgacaggccaacgaccaatactcgaggcgggccagagaacactcataccgtgcaaggagtgcctttaaactcatgcaaatcaatgacaaaatgcacttcatcaggccgggtaccaataataattgactcgttgcgattgacgcgggtgcaggttcatttctgttactcttttctgttgaaactcgctctttgcccagcgcccggctcgtggtgccaagtgctcagcgagttgattttccctaacaatttcgcaccaaaaaaaagaaccaaagcggatgaaagaacggacgaatgtccgtttgatggaactgagcaacgccaaggatatattttgggcgtcgacctttttgtccggccactccttttccttctatcgcatttcctccgttttatttcgcccctttcagacaataagtccaattgaaaatgttgatttactgtgcaaagccgacttcaccagaagagccactcagacagaaatcagacggcgtttgaatggccgaagggtcgatttgctgctcagtgacatggcaccgaatccgaccggcgaatcctacatggaccatttacggataatcaaactctgccgtgacctctttatgttcggcactgtgcccgatcccgagccaatccttgcgcccaatggaattttactttgcaaagtttctattcattattcaattntcaaaaaaaaatcctagattttcgacggcgttcacagaaatgacttaatcaaagaattgag

SEQ ID NO: 87566 - DNA, 798 bp, Heterodera glycines
  misc_feature (789)..(789): n is a, c, g, or t
  SCN-specific regions: Sequence locations=1-423,445-798
gtgattcgccgccgatgccaacacattcgtttaaggaccttcgaattaattgcattgaccattccgtgatcgcatttcttcgtgccaatcaactcattttccagaagggctccaatttgcgtctgtcgcttccttttggtccattcaacattgatgatgtccagtcaatttgggatgattttgcgcgtcaaatttggcccatttttgcaccaaccattcgacactttggcgttcccgatggccatcttttggacactttgcttcgtctcgtttcgccgacaattctcacggatgatctgatcaacatccattcaatcaattccggtcgtcagtttcccgaagcgattggtgatgatcattttgaggggccaacaacagcaacattagatcgatcaactacaaattatgatggatcaattgcaacttctgctgctgctggtcaagcattgtcaaaatggttgcacatttcgagaaaagatgggcagccgaagcaattgcgattccgcaattttgccaatccgccaaacatggaatggcaaaacaatttcaaagagaaatttctgcgtgccatcacttccgccagctacaaaatttatttcaaaacggacgcttcatttgaaccatttgaattggtgaacgaacgaacgcaagaaaagctgacattgatattcgcaagcgaaacaatttgggcaaaacgatggataatgaaacgatgcccaattggagagacggcggcgccgattcattgggaaagacaaattttgacgacaatttgaacaatgtcgactnttggcattc

SEQ ID NO: 87567 - DNA, 704 bp, Heterodera glycines
  misc_feature (699)..(700): n is a, c, g, or t
  SCN-specific regions: Sequence locations=1-24,46-124,154-704
caggtgctccttccgctcatccgtcttccccttgctcttcctctttgcttcccccgcccgtctcgtctctctccgtcccattgcatcaccgatccagcatttctggcggcgggtcccgcccaattgtcattcggaaagggccccaaggcttcggattttccatacgatccgtccgcgtttatttgagcgaaatgtccgagtattactccattgaacatattgtggccgctgtgcgcgagggttcgcccgcttgggaagccggtctccggacaaacgatttaatcacgcgcgtgcacacccaatcggtccacaacatgactcaccccgaaatgatgcgccgtctcctctcctgcggcgatgaactcactgtccatgtcgttccattgtccagcacctccataaaagagggcgaaccgcgtcgaaacattggcaaacccttgcgcaagaagccgcgacggccgccaaccgcacaacagaaaaacaaacaacagagtcgcaaaggttctgcacttctgcgacgactcagcggcaaacggacagtcggagacatcgttcccggcacttcgtctcagaagcaaatgttcattccccgttccgtgtcctcccaagaagggagggctcaacttttcaacagttcgacttcgaaattggagtaaatttgtatattgctagacgtttattcttgtacttcgggtaatnnttgg

SEQ ID NO: 87568 - DNA, 774 bp, Heterodera glycines
  SCN-specific regions: Sequence locations=1-167,191-355,378-448,470 -591,613-655,678-774
gattataaaaataagatgaaattgctcctttttttctgcctccttttggccaaatttgaatttatttggcaaatgaaaaagcctttagtgattaacgacaatgataaagctgaaggaagcactgggccttctgcggctaatcatcagcagaatgtcagtgaacaatacctcacaaaattggagcttgaaaataggctgctcaaagccgaattgaagcaaagagaaatgatggaagagcttaaagagttgaaagatgccaacattgaacagcagaaaaaggagaatgcgttcattggacaaatccaagagttgaaggatgaacagcagaagtgtttggacaaatatgaagcattggaaaaagaattggccagaaaatacatttgtattggccaattcgctaaacttttgactcgaattgatggaatggaagcccaaataaatggactgaaggaaaaggatgaagaaggatcgttgtcgtcatcagtgccagttgagaaacaaattaatgaagatccaaattcaacgaatcgccatggaatgggaatcgttataagaacacttaccggcagtaggcatatcctcaaagttcatcccagtgacaccatcgaggaaatcaaggccaaaattcagaacattgaacgcactccgattgataagcagagactgatcttcgctggaaaacaacttgagaacggctttactttggagtattatggcattggaaatggggcaaacattgacgttgtcctgcgcctttgtggctgttagagccga

SEQ ID NO: 87569 - DNA, 167 bp, Heterodera glycines
  SCN-specific regions: Sequence locations=1-139
ctgttgcagagactttccatccattcccgaataacaaattttattaacctacttttattttttgttgttttggttgaatattttattatcattataagaaaaatgtaattgcatttaattagtaataaattcggttaccaaaaaaaaaaaaaaaaaaaaaaaaaaaa

SEQ ID NO: 87570 - DNA, 731 bp, Heterodera glycines
  SCN-specific regions: Sequence locations=1-46,68-78,100-530,553-731
agcgaattgaacgcacagatcggcatggaatgggcaaaagcggcgattgccaaagcattggcagaagcggccaatatttcactgatacgaattgtcgacttaaatttagacgaattgaacgacggcacattgtacgctttttttgccattggtgcgccaagcggagccattcaggcgcagacgatctaccttttgaaagaaataacagtagcagaggcagtacagttgctgaacacttccgtcgtgtcaggaaaatttgccgttcgaattccacttgcgacagaagccgagacgaacacagaattggtgttctctggcactcagtttggaaaacagtcctctcctttacctcatccatgcccgccgccgggcccatcgccgcctccacaatttgtcggcttttccggctcaactttagctatcgttgcaattttttgtttcatttccggcgcctttttcattgctggtgcttacattgtccaccagaaaaggcaatacattcgcgggatggcataccaagtgtttgaatgacgaaaggaaactactttatttaatcattcgatgtacatatttttatttttgaattattcttatgcaaattttattttagaattattcttatgctactttgtattctcctgaccagggactgttaagtttagtgtagtcgaaccctttgaacaatgattttgaatgttttttcagatttctatttaaaaagcagtttctgg

SEQ ID NO: 87571 - DNA, 736 bp, Heterodera glycines
  misc_feature (734)..(734): n is a, c, g, or t
  SCN-specific regions: Sequence locations=1-193,215-243,266-736
caataggacgtttctattaagttttgtttatagaatttggggactgtgctgttattctcatttcccctatgattgcctctgaaaacaatcacttagaagcccaaaatggcaacagtcccgagggagaagaagagtcgaattgcggaggcagtgcttcgccttcgtctcttcgcgactgtcattctcgagcatcgaccaacgaacacaccaacatttctcatcactctcttcacgatgacaatgcaccaccttctccctccttggccaatatttcaacaaacattgaactccatccacacaacaatgcgcttggaggttcctcctctcataaattcatcaaaaggccattgaatgcttatatgatatggacaagacaggaaaggaagcgaattttaacggacgatcccaaaatgaagatgaacgaagtgagcaaagctattcagatgggcgaaaaatggaagaaaatgtcggacaaggaaaagaaaccttacttcgaaatggcaaaaaaattctctgaagaacacaaattggtgcttcaagaacaccctgaactgcaatatgcgccctccaaaaagaaggtggtgaagaaactggccgatggaaagcaattgtccgtggtcgattcttcgtccgtcaagtcgtgcaccataacacccgacgcgtcgagaagcacaacgccgcggggttcttcaaatctgatcacaccacaaccggtgtcacagagtcaaatgttntc

SEQ ID NO: 87572 - DNA, 155 bp, Heterodera glycines
  SCN-specific regions: Sequence locations=1-155
ctacgcactgaacgacccaaacagattgttagctgtcgtcccttttcttgtccgtacaaattttaatggcgctcgtgttgtgcagcgggcattgatcagtctcgtgcagtgctgcattgtccgtcaggtggacagtcagccgagcatggtcacct

SEQ ID NO: 87573 - DNA, 126 bp, Heterodera glycines
  SCN-specific regions: Sequence locations=1-98,120-126
tgaagtgattgagagcgcgaccattcttcaacttaaagaaggagaaagtgatcgcaagaggaggaatttgctgatcactcccttaaactggcaaatgccctccctccgtttccctcccccgcccct

SEQ ID NO: 87574 - DNA, 568 bp, Heterodera glycines
  misc_feature (544)..(547): n is a, c, g, or t
  misc_feature (549)..(549): n is a, c, g, or t
  misc_feature (556)..(558): n is a, c, g, or t
  SCN-specific regions: Sequence locations=1-568
atgacggtgccgttctgcccggcgccggtgcatttgaaattgcgggatattgtgcactgaaaaagcttgccgacaatgtgaaagggcgtgccaaactcggtgttttggcttttgctgaggctttgctggttattccgaaaactttggcggtcaatgccgggttcgacgcccaggaggccattgtcaagcttgtggagacgttcagtgctgctggtgagctggtcggattggacctggagagcggagagccgtgtgttcctcagagcgtttgggacaatgtgtgcgtgaagcaggcgagtctgaacgcctgtcagaacatcgcctccaatctgctggaggtggacgaggtgatgcgtgccggcatgcgcgacttgaaggggggacagtgaaaatgaacggaacggaaatgaaggagcaacaccaataaatcacaaaatgttaatggtttttctttgttgaactctgcgctttattgtttgaatcagaccactgctgtttttgctttttcaatctcgcttttctgaacgaatgaaaattttgaccnnnnanaaaaaannnaaaaaaaaaa

SEQ ID NO: 87575 - DNA, 762 bp, Heterodera glycines
  misc_feature (748)..(748): n is a, c, g, or t
  SCN-specific regions: Sequence locations=1-192,214-273,295-762
gcaagtgtccgaaaggcgttggttttcgcactgtttgattatgtgagggaaaacggcggggaaaagcggccgaaagcggaagagcataaagaatttgcaaatgttacgaaaacttatttcgcttctcttcatgcatttgttcttttgacggacctaaattatgaagagttcgcccttaaattacatttccaaattcaaaacagccaagaaaagtttgctgaatattacacaaacctaaaatcaaaatgtgacaattggaccgtcgacaaatggcaaaataaaatggagagaattggcgaaaaaattgtggataaaagtagcaaagaaaaatgcagagaattcgctgtcaaattggacgaacaacggaatcggagccaaaacgaacagtcggaaaacatcgaaccgcccaaacaaacgtcctttcatcgcacctcgtttaaacgatcggtaaaaacttccaaaatatttgctgatcagcgaatcctccgaaatcgccccatcagcccactcgacgcccaattccgtgctgaactgttccaatttctcgactcgcttttcctgcccaatttgttgccctttcccaataaattcgttgctggcccaggcgacttggcccttttggacccttctctgtccgtcgaattcgaccgttgtttttctgattgtgaacaatccgatgagattaaacaattggacattgtcaatgtctattcagtgctcgtctcccatgattccctttattacactnttcctctttcgact

SEQ ID NO: 87576 - DNA, 683 bp, Heterodera glycines
  SCN-specific regions: Sequence locations=1-418,440-683
attgcgaaacttattttgaggaggcgctttatctcacccattccctcgttttggtgcacatttcgcctgagatgtggacggtttttgacctatttacaaggcttttctggaggaaggcacttcatttttctcagattgtgcaccagtgctccacgcttttttgaccaatgacactgacaattttctgtctgtttttgaccgagtgcaacattttctggcgatgtgtgaaaaaacattgaacgatgagggtgaggacggctgtgatgagagcacaaaggcacatgcggcaaaaatgctggaggtttttgtgctccaatgtcaaggacgtgcaagtcatttcatcccggacatattgcgtttggttttcaatcaattgcagaaagagtcggccgatttaaaattgggccaactgaagccacaactattaattattttgatcgctgctttgtattccgattttcaattatgctccaatttgtttggtcagctgcaattcaaaacggagattggcactttcgaatggcttattcgtgagctctattcaaatcggaaggactttgagggtgtgcacgaccgcaaaatgctcatttggttgctctgtcgcattttggctgatggaaatttgcccgctttgttcattaatcagcctgaaaagtttatggagtggcttctgactctttttg

SEQ ID NO: 87577 - DNA, 724 bp, Heterodera glycines
  SCN-specific regions: Sequence locations=1-613,636-724
caaaatttggctgattacggggcaatgcgcgctctgtgcgaaggcctccgaaagtccgtcaaagttcacccctccggcaaaaatgaaacattggcaggcacagcaacagcagccgaagaatcggactgtcaattcactgtttcttcaacaagtagcggcaccagcacaagcggacacaacgcatccgcgcacagtcgccacaacgccgccgagaaaatgtcgcaggacgcggaggacggcccggaagtgttgtaccatgacgagcggtgccagcacacgcacgcgcatctgtacaacgcggcacggccaccgatgaatcaggacgaatttgaccaccgttttgcctaccgcgggcccgaacagttcagcgacgagcgcgacatgtgcagacaaacgggcaaattcttccgccagtattaccgcccgtgtttgtccccggaggcgttttggcactttattttgcgctttgtgcccattttgaattggctgccggcataccaatggcgtcaatgtttgctggccgatgccatcggcggtttgaccgttggcattatgcacgtgccgcagggcattgcctatgcattgctcgcccgtcttcaccccgtggtcggtctttacaccccctttttccccccgttgttctacatgcttttcggcacttctcggcacaattcgattggctcttttgccgtcgtttctctgatggccggcatggcggtggaac

SEQ ID NO: 87578 - DNA, 812 bp, Heterodera glycines
  misc_feature (717)..(717): n is a, c, g, or t
  SCN-specific regions: Sequence locations=1-296,318-812
caaatccgccttattacccaccaaatccgccatattacccagaatatcggcagccgtatgagtacacgagcgatggttattacgacagcagacaaaatcgccacggcgcggctgaccgccgcgacttttacgataatcatcgtgatgattattatgacaatcgccgagattattttgataatcgtcgtgatgataattacgacaatcgtcgtgataattacggcggcacaagtttcggttttggcagcggctttgccggccgatctttgcctccggtgctcaacgaaaataatttcgacccgggccatgcccaggggcgattggtcggcgccacaattgtgccgcccgaggagcaaagccatctcccgccggtgttctacggctcgtcccgccgctttcgacggtctgccgccggcgacgccgtgggcagtggttttctgaattcgtatttgtatccggttccgcaaagtcccggacggaaacgagtgcaaaaccgacggaacggaggccgacgcaccaaacggcggacgatgctttgctttgtgccgtccccggcaacacgacaaagcgggaatatggaattttggcgtcacaatttgctaaagtacagccccaaccaattccaacgccatttcccatacagaacgaatggcgaaatgaacagccaagaccaatcgagaaagagcaaaaggcagacggattttccccggggcgctnctttcccgaacaaccgacgcgggcattacggcgacggcggcgggagatacgatgccggcgaaacaatccgtcgctgatctgtcagccgatggaaa

SEQ ID NO: 87579 - DNA, 773 bp, Heterodera glycines
  SCN-specific regions: Sequence locations=1-64,86-324,355-773
acaccctgacgaggctgttgctatcggggccgcaattaaggaggtgttcttgctggacatgtgacggacctgttgctgctggacgtaacgccactgtcacttggaattgaaacgcttggtggtgtgttcaccaaactgattacgcgtaatacgaccattcctacgaagaagagccaagtcttctcaacggctgctgacgggcagactcaagtggagatcaaagttttccaaggcgaacgcgacatggcattggacaacaaaatgctgggccagttttctctcgttggtattccgcctgcccctcgaggtgttccacaaattgaggtcgcttttgacattgatgccaacggaattgtgaatgtgtcggcacgagaccgtggaactggcaaagaacagcaaattattatccaatcgtccgggggactcaataaagaccaaatcgaaaacatggtacgtgaagcggaaagacacgcagcagccgacgcagaaaagaaagagatgatcgaggcaattaaccatgcggagtcggtgctgcacgacacggagtcaaagatcacggaatacgcggaacatctcaatgcagacgaagttaatgtggtcaaagagaaacttgaagagttgaagaagaagttggccaaccgtgaaggtttgaaatctgccgaagtgaaggagtcggttaatgagctgcagcagaaatcgcttaagctgttcgaagttgcctatcgcaagatggcagaaaagaaccagcaacatcagagcagcagcactgagag

SEQ ID NO: 87580 - DNA, 498 bp, Heterodera glycines
  SCN-specific regions: Sequence locations=1-376,398-472
acagtgcccgggactatgcaactgctgtttacaagcagcacagcatccattcaacccaaatgcagcagcaacaaatccatcaacagcagcaagcgaccattgctcagcctcagcaagctgtttccgccggaatgggcgcagtttcttcttctggcggacctgcgattaatccgcaaactggacaaccggactacagtgcccagtgggccgaatactaccgcaccatgggaatgcatgaacaggccgcactcatcgaagctcagatgaagcaaacccacgccgccgctcaggcacaacgtcctcagcaacaactttacatgcaatgaaggcttgcagaactcgtcgaagaaagacaataatgtggctgaatttctggttatttggattgctttttctaatattatcagtttccgttcgatttcttttatatttaatcatcattacgaaccgttctttgactgatttatttgtcaaaaaaaaaaaaacaaaaaaaaaaag

SEQ ID NO: 87581 - DNA, 684 bp, Heterodera glycines
  SCN-specific regions: Sequence locations=1-684
caatttaagtaaaatgggcgaattcttcttcaaccttgatcacggctatctcgaagctttaatccgaggatttaaatcgggccttttgacaagcacagactattcaaacctcgttcagtgcgaaacgttggaagatctcaaattgcatatacaatcaacagactatgggaactttcttgccaatgagcctgggaatatcactgtgcaggtcattgatgaacggctaaaagagaagctcgtaacggagttcactcacttgcgcaacaattctctggagcctcttgcgacttttcttgactatataacttattcatacatgatcgacaacatcattttgctgatcactggcactctccatcaacggccaatcaacgagctgatctccaagtgccatcccctcggctcatttgagcaaatggaggccattcacattgcatcaaacccggctgaactgtacaacgctgtgctcgtcgacactcccctcgccccatatttcgtggattgcataagtgagcaagaccttgacgaactcaatgtggagattatccggaacacactgtacaaggcgtacattgaggacttctataatttatgcaaaaagatgggcgggaaaactgctgaggtgatgtgcgaaattttagctttcgaggctgatcgacgagcaattatcatcacaatcaacag

SEQ ID NO: 87582 - DNA, 504 bp, Heterodera glycines
  SCN-specific regions: Sequence locations=1-504
atctgatctgtctatggcataggtgtgcatacaatcgcacactgaaatggataaaggccttttttgccaacacgaattgtttattcactactcactcgaacgaactgttagggattctgtcggaaggtattgacggaggtgtgcctgctggtgcacaacaatgaaaaggaagatgtactctgcataccgaccactgctcattgactagcgaattacaagaggatctgcatgtctaccatgtaggaaagcgcccatcgcgaaggaggcctgcttgtgtgtcctatactgccacctgatgaactaggctgttatcctggtcatagctgtttcctgtgtgaaattgtatccgttcacaatcccgcacaacatacaatccgtaagcgtaaagtgtaaagcctggggtgcctaataagtgacctaactcacattacttgcgttgcgcttactgtccggtttccaaacgggaaacccgtcatgccagctgtattaatgaattggccaaca

SEQ ID NO: 87583 - DNA, 723 bp, Heterodera glycines
  misc_feature (432)..(432): n is a, c, g, or t
  SCN-specific regions: Sequence locations=1-565,587-723
taaagccgactcggggcatggagcagacgatgcagtccatcttcccgcgcattcaagtggcactgcgccggtccatgcagaccttccaagactccattgaagctgagttggcacagtggaggtactgctcgaagatgcaatcgagcaaaatggaggcattgatcagattggtcggcgaatcggttgaagttcagattcgcggccctccggaaaaggccactgcgtgcatttacttcctggaggatctgtccacattggtggagctgacgagtgccgaagtggcgcccggtatcagcacagaacggcacttcctttccccggcacatttgagggaacacagaacgacacctgccatttttacgccagaaacaataatggaaatgcaacagaacgagtcgctggtcattgtgaacagtgacggggaggaggagngaggagttcaccgatgtggtttgtttcggctccaaagaagctgccggtctgctcacgctcggcgtcgacatttccgtctcccaattgcaattgtccgcccgctcggaactcgccgctttgctggacgcaccgaacactttgggcatggactggagcatcctggcggtgaagctgaacttgactgaacaaataccggaggtcgactcgtcaggccaatcgttgtcccgcactgatcagctgctcaccgaatgggcacttcactcgcccgacagcgcttcggtgggcaaattg

SEQ ID NO: 87584 - DNA, 316 bp, Heterodera glycines
  SCN-specific regions: Sequence locations=1-47,69-69,94-241,279-316
agagcgcgcaactctatgcgtgttaaaatggtgctgtgtgaatgctgttgtttacaatattattcatcacattattattattttatgtgtatgccgtgtgagtgtgtgttggttgctctctcattcttttatcatcatatctcttctattagatttgaatttcaaaatgataattaatttattttattgtgcaaatttgctgatcgaataattattgcataatacatacatacaataacttaaaaaaaaaaaaaaaaaaaaaaaaaaaaaaacaaaaactaaacaacaaactaaaaaaactgaactcccgcgcgcc

SEQ ID NO: 87585 - DNA, 698 bp, Heterodera glycines
  SCN-specific regions: Sequence locations=1-510,532-698
ttggtttttctattaactctccaacctaatgtattatttatggccattgctcggacttcggttctgtccccgttgctcctcttcatctttcttctgttcactgttgcctttgccatccaaatgtcttttcgcctaatgatttcgcttgcgcgaagaaaaatgccatttttcacgatggactgttcgctctcactgaagacaatcgactccgcattgacccgtcgaagcaaaaaacgaatgacactgggacacaactcgacgctcttctcttgaatcccatcaaagaaagactggtcttttcgctcattttcatcaagggaggcgaaaactgcaagcagtttttcatgaaacatgccgaaaggccgagttgttgtctgtttagcgatgaaatggaattgcataagcatccgtacgcaaaaggcgagtgtcaagctcaaaaatgtacttatgtcgacatgacgtgcagcgttcttccgatggacccggttgagggccttaaggattcttaccatttcaaagcgtcttcatggaacaccgcttcgggtacggatgagatgcagcagtgcgattggatagcatttgctgatggcatccgtattctgcagaagaaagcaggaaatgacaccaaagcattggaggaaaagtgctggaaaaaagtcgcagatggctcctccgcaattcgtgtcgctctgcttgat

SEQ ID NO: 87586 - DNA, 742 bp, Heterodera glycines
  misc_feature (733)..(733): n is a, c, g, or t
  SCN-specific regions: Sequence locations=1-673,695-742
ggtggggcagtcttatttattgagaattttaatcgaattgtccgattgtctcctcactgtgtctatcagacgacggaattattctccgaacggtttctttaacgtctttccttttattacaaaaacgttctacgcctaagcctactggacctgtccgtcgagttcccgctgttatcatcggaagtgatgtgcgacaaaagcattctgaaagaaccgcatgaaaaggtgatggaacaaatggattctggcaaccatggaatgcttctgatgattacagtgaaattaaaaaacgtcttttgcgtcctccgaatgatttctccaagctcagggaaattatacgcaaagacattgaaagaatggcacagataaaggaggaaaacgtaaaaaagaggaatggaacgaccaatgggaacaagcaaatgacggatgagcagaacgaaacacgggaagaaaatgggcacgaggaggacgaagactgacaagaacagaatgatcaagcgaatgttcttggttttttgcctgacctttcctttctttgtgatccattattggcttaaacaacgttccgattcattgctgttgcccaacgatccgaattcttatttagccgtacttaaccaagtcacttggagcgattttattgaacgcattgtgcctactggaactgtgtcaaatgttcatttgaaagtttctcgtgggcctgaaagaagaatctccaagactgggaaaaccntggagttac

SEQ ID NO: 87587 - DNA, 490 bp, Heterodera glycines
  SCN-specific regions: Sequence locations=1-490
aaatgtcgagacgaacttttgacacataaccgatacgcactctggacacagaggggagacgctctctgaacactgaagcgacacgaactttctacacagaagctagactcactctccacacataggcgaggacgcactctcgacacagaatggagactcactctcaacgcagaagcgagacgctctctccacactgaagcgagacgcactctcgacacagaggcgagacgcactctcgacacagaagcgagactcactctcgacacagatgcgagacgcactctcgacacagaaacgagacgcactctctacacagatgcgagacgcactctcgacacagaagcgagacgcactctcaacacataatcgagacgctctctcgacacataagcgagaagtactctcgacacagaagcgagacgcactcttgacacagaagcgagactcactctcgacacagaagcgagacgcactctcgacacagaagcga

SEQ ID NO: 87588 - DNA, 177 bp, Heterodera glycines
  SCN-specific regions: Sequence locations=1-177
cactgacgcatcgcttcattttgccgagactttcgaccgcgccatttttttgcttcgcgcagactgtcgtacttcggagaaacacgtcacttttctgcacattctccgacaattgggcgcgagtgaagagaatggtggactccttggcaatttgaacgggctcattcgaaacctgag

SEQ ID NO: 87589 - DNA, 531 bp, Heterodera glycines
  SCN-specific regions: Sequence locations=1-72,94-185,244-270,306 -338,374-390,413-419,452-531
ccggcttgtgcaatgatggtaccgctggctataactccccccctgctgagatcccgtcaatcgtgcgtcgtacccattatcaccgtgtcatggttggcctgggacaaaaggactcgtacctgggatacgaggcgcattacaagcgtggtattctgacgctcaagcacccgattgagcacggaatattcaccaactgggacgacctggagaagatctggcaccacaccttctacaactagctgcatcgtgtacccgaggatcatccggtgttgctcacagaggctcctctgaaccccaatgctaacatatagaatatgacccaaattttgttctagacgttcaacacacctgccatgtacgtggccattcatgccgtgctgtcgctatactcctttggccgtaccaccggtatcgcgtacgactctggcgacggtgtcacccacaccgtgccaatctacgagggtttcgcgcttgacccatgctattctccgcttggacttggccggcccgtatctccctgactacctgatg

SEQ ID NO: 87590 - DNA, 326 bp, Heterodera glycines
  SCN-specific regions: Sequence locations=1-299
tcaaagtcttaacccgctgaagaaagtgtgctacaaaaaaatttccatcgaccttcccgccagttatatcactgatggacccgtggccgaaaaagtgtttccgctgggcacccttaatttggccgggtcgttcaaaggcgaaacgcgcgactgtctcaactgatctgccgaggcgattgatgtaaagagaatggcacaatgaaaggttgaaaggcatttttggccacacaattcttttttcaattttcactcagtcgaataattaatgattctgtcgttggtatttacaaaattatgccaaaaaaaaaaaaaaaaaaaaaaaaaaa

SEQ ID NO: 87591 - DNA, 418 bp, Heterodera glycines
  SCN-specific regions: Sequence locations=1-418
caccctgaactgctaccaaatgcaactaaagaggacacggaatgagtggccattttgcatgccctctcttacgccgacggaatggcatgcgacgggcgaggaaagactcaagcccaacccttaggctccgaactaccatggcaatgtgtacgacactccgtctgcagaacggcgtgacttggttaaacaatctccgggcgcattactccgccaatcttttacttaccgttacaacaatgccgaccaatcggataatgcaaatgcccatcatccaaactactctgtgcctctacggacaaagcaattatattcgcaatgagcaagagcaacgccgggagtacggaacagatatgggtctcatccagttccttacggtggcccacccaattatgctcacaatcagactgacatgtcaggc

SEQ ID NO: 87592 - DNA, 162 bp, Heterodera glycines
  SCN-specific regions: Sequence locations=1-162
ggcggtgggtgcctccagattaaccggcactcttcactcactaccttcacgatgatggtggtccccagaagttattggtggcgatacacagcaatagcaccccgacctctgtagtagtgtgacggggggttggttgtggaacatgcgggaaagtgtccactt

SEQ ID NO: 87593 - DNA, 325 bp, Heterodera glycines
  SCN-specific regions: Sequence locations=1-212,241-325
tgcccaacggatggtaaaatggtggagcgttcctcagggagttggagagagcaattactactttgggtgggcccgatgcgtccgttttcgacaaatcggaggaactctgcgattactaccgctgtttattatagttgaacaggactggctggctgtcggtgaactgctcgacgggctccaccggcgcccttaacgaactttactacagccaaactctccttttttgttcccccttctgtctgccaaaactctgctgatgccttttcttttcgaactcgtccattgccgcctttgtctgattggtgtgccgcttattagggacttc

SEQ ID NO: 87594 - DNA, 301 bp, Heterodera glycines
  SCN-specific regions: Sequence locations=1-19,49-106,264-277,300-301
acaaaatgaaattattcccttattatgtttaatttatttttaataattgtcaaaattgaatcagaaaagaaaaagtacaacaaaagtcatttggcgaaatatttggagaaaaatgggaagaaaaagaagaagaaaaaagaaatgaactcaaaaaaagagaaaaaattgcaaaatattataaaataaaagaaaaaataaagcaaaaaggaagaaaacactcaacaaaagaatggaataaaattgaagaaaaaataacgaaaaaattggggacaaatcgaaaaaaaaaaaaaaaaaaaaaaga

SEQ ID NO: 87595 - DNA, 388 bp, Heterodera glycines
  SCN-specific regions: Sequence locations=1-388
ttgtttgtgtattgaacggacttctgttcattctatgtgcaaaatctgcaagcgaagagtggcggatctctcaaactgaccaatggggccaccgacggacacgcactgtgtaccttgggaatggaagaattaactcttaacggcggccatgactggctagtgttgctcaatctgcaccgattttgcttctggccgcccattgacgggagtggtcggatgcgaattgggtggctttctctgactgagccgcttctgcatgtgtctagcgaatatggcaccgtgtctattctgagtgccagaatatgcccattgtgggccaatcgcgtcgcttttcctaccgacgaatttcaataggtgcggccaaacatgtgctgtctatcacctgagg

SEQ ID NO: 87596 - DNA, 659 bp, Heterodera glycines
  misc_feature (565)..(565): n is a, c, g, or t
  SCN-specific regions: Sequence locations=1-659
ctccaccgagctttgtcagtccggtgccacagccgagcggcagccaaatgataccatcagtcggtcaaccgcaacctcaacagcacggactgctgctgacagtgtccccaaaaaagtcgactgcagtggtgacagatgcggagaatgccagtgccattgtgccgaatggagatgatgagcaggcgatgaccaattctgcaaacaaaaagcggacggactatttgagttgggacgaatttttcatgggagtcgcattgatggcagcacaacgcagcaaagacccaatcacacaggtcggcgcatgcattgtgaaggagaacagcatcattggcattgggtacaacggaatgccaattggctgcaacgacgacgaaatgccgtggggaaagggcgacgctaacccgctgaacaacaaatatctttacgtgtgccacgccgaaatgaatgccattttgaacaaaaatagcgcttccgttgacggggcaacattgtacacgacgctttttccatgtgcggaatgtgccaaaatgatcatccaatcgcgcatcagtcgggttgtttattntgagcgacaaaataccgtccaaatggaggcttcgcgtcgccttttcacatcacaggcatcaaattcagccgatacgaatcctctcgtccccgag

SEQ ID NO: 87597 - DNA, 654 bp, Heterodera glycines
  SCN-specific regions: Sequence locations=1-444,468-654
cagaagctgtatcacttggaggatttttatcggtttcacgagttccattcgcccgctttggatgatcccgactttaatgccaaaccgatgattttgttggtcggacagtattcaactgggaaaacgacattcattcgctatctgttggaacagaactttcctggaattagaattggtccagagccgaccaccgatcgtttcatcgtggtgatgtacggcgaagaagaagctgttattcctggcaatgcgcttgtcgtcgactccactaaacaattcagagcactgacaaaatttggaaatgctttcttaaaccgttttcaatgttcgatgctgaagaatgaagtgctaaatggtgtgacaataatcgacacccccggaattttgagtggcgaaaaacagcgaattgatcgtggctatgatttttctggcgtccttgagtggttcgctgaacgagtggatcgtattattttgcttttcgacgcacataaattggatatttccgacgagttcaaacgctgtattgaggcactttcagggaatgaagacaaaattcgaattgtgttaaacaagtcggacatggtcgaccatcagcaactgatgcgtgtttacggcgcactgatgtggtccctcggaaaagtgttcaaaacgcctgaa

SEQ ID NO: 87598 - DNA, 722 bp, Heterodera glycines
  misc_feature (714)..(714): n is a, c, g, or t
  SCN-specific regions: Sequence locations=1-52,74-370,451-628,664-722
actctgttttttaaaaatcccaccgattggcactttcattccttggactttctctgcacttagaattatttaaatggataaattggttttaaaaatccgtgagctcctcgatgagaacgaagtaaattttggggaagtgcagcgaattttggaagagtataaaagtgagccgaaggattggagacatttcacacattttgacgaacacaaatacacgcgaaatttggtggacgcggggaatggaaaatacaatttgatgattttgtgctggggacccggcatggggtcgagcatccacgaccacagtgctgcgcaatgcttcgtcaaagttttggatgggcaacttttggagacgcgatttgcatggccaaagaaggaaaaagaagagaaagaggaagaaaaggaagaagagaaggaagaagaagaggaagaagagaaggaagaagaagagggaccgatgagggcgacagggacggagctgttcaaaacgaacggagtcagctacatcagtgacaaaatcggaatctatcggatggaaaatccctcgcacgtcgacccgacggtgacccttcacctgtacattcccccgtacagccaatgctattcatttgaccaagtgatggtccccattattttttcaatttaattttaattcttttttttcatcgaagcgaacggggcgaaaacagcaaaatacagtaagctttcattcanagtacggt

SEQ ID NO: 87599 - DNA, 682 bp, Heterodera glycines
  misc_feature (674)..(674): n is a, c, g, or t
  SCN-specific regions: Sequence locations=1-77,99-395,476-682
gtggattgattctcggatatttaattactctgttttttaaaatcccaccgattggcactttcattccttggactttctctgcacttagaattatttaaatggataaattggttttaaaaatccgtgagctcctcgatgagaacgaagtaaattttggggaagtgcagcgaattttggaagagtataaaagtgagccgaaggattggagacaattcacacattttgacgaacacaaatacacgcgaaatttggtggacgcggggaatggaaaatacaatttgatgattttgtgctggggacccggcatggggtcgagcatccacgaccacagtgctgcgcaatgcttcgtcaaagttttggatgggcaacttttggagacgcgatttgcatggccaaagaaggaaaaagaagagaaagaggaagaaaaggaagaagagaaggaagaagaagaggaagaagagaaggaagaagaagagggaccgatgagggcgacagggacggagctgttcaaaacgaacggagtcagctacatcagtgacaaaatcggaatctatcggatggaaaatccctcgcacgtcgacccgacggtgacccttcacctgtacattcccccgtacagccaatgctattcatttgaccaagtgatggtccccattattttttcaatttaattntaattctt

SEQ ID NO: 87600 - DNA, 654 bp, Heterodera glycines
  SCN-specific regions: Sequence locations=1-631
atcgtattttacagcaacaaagccgcagtttttttcgaggaaggaaaatacgacgaatgcatcgaaatgtgtggaaaagcggtggaagttggacgagagaatcgggcggactatgcgctggtggcaaaggcttacgctcgaatggcaaacagttacaaaatgaaggacgaccccaagaaggcactgcacttctacgaaaaggcattgtcggaacatcgcgacccggacattgtgaagaagcacaaggaattagcgaaggaagtcaaagagatggagcagaaggcatacattgacccggaattgtcggataaagaaaagaacttgggcaaccaattgttcaagaaaggcgattaccccggggctatgagacattacaacgaggcgattaaacggaatccggacaacgctgtgctctactcgaaccgtgccgcgtgcttcaccaaacttatggaattccaaagggccgtcgacgactgcgacctttgcctgaagaaggacccttctttcgttaaggcgtacatcagaaagggcgctgctttgtccgcaatgcgcgagttcggccgagcccaaaaggcttatgaggacgcattgcaaatggacccgagcaatcatgaagcgatggagggactgcgcacgtgcatgcagtcgaacgaa

SEQ ID NO: 87601 - DNA, 429 bp, Heterodera glycines
  SCN-specific regions: Sequence locations=1-429
accttcgattcactgctgattcaatgactgcaagtttcgttgaatggttcgcggacacactttcctataaaagctgtcttcagccggaaatcacccggggaattaacggaaagctgaaatggcctcacgggacgcaattaattgtggaaatatcgctgaaaaatgttttttatgtcgaatggcttttggacgaccgaccgctaaatagttgcgaagaattgtttagagacgggcgactgcttaagggcggtggcgacggtgtacaaattatcgactctttgtattcgtacggcgaatggctgagtcgtctcgtgttgcccgcggcgttgcaaaacaactgcggcagagcctctctcgctctgctgaccgtccgtgccaccaacaaattgggcaattcatgtgaaagctctgtgcgaatcctgccgaccg

SEQ ID NO: 87602 - DNA, 188 bp, Heterodera glycines
  misc_feature (17)..(17): n is a, c, g, or t
  misc_feature (19)..(19): n is a, c, g, or t
  misc_feature (27)..(27): n is a, c, g, or t
  misc_feature (102)..(102): n is a, c, g, or t
  SCN-specific regions: Sequence locations=1-188
ggaagaaaacgaacgangnaccgggcnggcgaaagcaggagacgagggagcggacaaggcccaggggggcgagccgcggaggagcaaaaagcgaaggcggcnggcgcagagcacggaccccgcacagacattctttttttgtatcgaaacgaccgagcggagcggaaacgcgaggaacgaggagagga

SEQ ID NO: 87603 - DNA, 445 bp, Heterodera glycines
  misc_feature (184)..(184): n is a, c, g, or t
  misc_feature (443)..(444): n is a, c, g, or t
  SCN-specific regions: Sequence locations=1-5,27-276,300-445
ttatgccctcctcctcctctctgttggcctttgctttgcccagtttgatcagtctccgtccgctgctctgaatcatgtgcgggccaaaagaggctacaagccgtggaagaagcaatccttctcctcttcttcaagcgaaatgtacagaaggagaagacccagtggtaacggtcattactggtanataacggctacggtagcaatggatactatcgacgaaaacccggcattttagaacgggcgctgggaaaaattacgcggagctattaacggacgagcagaagaagagaagcaaaaagccaaacaatgggcgtaacacttttaattgatcaaacgatattacagtatccaacaccaaaattacagtaaccaaacatccaatggaacgaatgactcatttaattcagcaaatttgctggaattgccgataaagaaacttagcnna

SEQ ID NO: 87604 - DNA, 535 bp, Heterodera glycines
  misc_feature (177)..(177): n is a, c, g, or t
  SCN-specific regions: Sequence locations=1-468,490-535
gacaacgtcggtgactgtctttgcggccgaattgctcagagaggcggaagttatgattggacagcgaattcatccgcaagttattgtttccggctatcgaaaggctgctcgagttgcgaaggacgcacttgaaaatgctgcccaagcatcaggagagcatttgcgcgaatatgctcngaaaattgcgaagacttcactgggttccaagattctttcccagcattccaaccattttgccaaattggcggtcgatgccgtcctccgactcggccccaacggcgctttggactccgtccaagtgattaaaaaactgggtggatcgatggaagattcgtaccttgacgagggatttttgctggagaagaaggccggcatgtaccaaccacagcgaattgaagacgccaaaattcttattgcaaattctccgatggaccacgacagaataaaagttctcggaagcagaattcgagtggatccagtggcaaaaattgccgaattggaacaagcggcaaacaaaaacaaacccccaaaaaaa

SEQ ID NO: 87605 - DNA, 617 bp, Heterodera glycines
  misc_feature (156)..(156): n is a, c, g, or t
  misc_feature (158)..(158): n is a, c, g, or t
  SCN-specific regions: Sequence locations=1-132,154-617
ttaatgttgggcacccaacgagttcaaaggccaatggatgcgttatgccgaaggctactgctttgttgagaacacgtactatgtgtccatgcgcgagcggttcccaatgcgcgagattgatcgggagcagcgagaaattatttactaccagtggangncttttctgttgcttggtcaggcattgcttttgatggcaccaaaatttttgtggaacgcgttcaactggaaatcgggcctgaacatcaacttgttggtgcagaaggcgcacaagcagtgcaaggcgggcacgcgcaaggacaaggaggaggcgagccggcagattggcgtgcgcatccattgcgtgttgcagcacaacatgcttgccaagcttgacatcgtggaccatgatgggagtggccgtacaatgcccgaccacgtggactggaaaagtgttaagccaacgcacagctccgtttcatttttctacattttattcaaattgtttaatcttggctctgcgcttgttcaactgtgcctcattaattacttcatggtgcccgccaattacacctattggggctttgatgtgctggccgatctggttgccggtcgagactggtcaagatccgggctgttcc

SEQ ID NO: 87606 - DNA, 579 bp, Heterodera glycines
  misc_feature (537)..(537): n is a, c, g, or t
  SCN-specific regions: Sequence locations=1-579
tcttttgtcgtaccacttttaaccgttgaaattcgacaatggctgaagaagcggtcgttgcgtcggagatggaatcgcttgctctcacttcttcctcaccgtgttcgccggtgctctctctgctcagcgaggaaatgcttcagaaagaggttccttgcgtgtgctgtgatggcgacaaagttgtggtccgtctctccatcttgtcacagcgcggattctttgccaaaatgttgcctgacctcaacgtggaagccaacggactgagtgaggactttctgttcgacatgaccaaagcggagattccggccgacactttcataaagatcgtctcttggatggaggaacacatgggtcacccggtgcctgcattcgacgcggatcccatcactttcgagcgcaaatggctcacccaaagcgattgtcaaacgaattcttccaactgtgaatttgcggaggccgccgcgctactgaacgccgcctgcttcctcgacttgcagcttctgtcccgtcactcctcgcaagcggtggccagacgtntcaaggaccgttcgccggaagagattcgtgatatgctgcacc

SEQ ID NO: 87607 - DNA, 156 bp, Heterodera glycines
  SCN-specific regions: Sequence locations=1-156
actacgcactgaacgcaccaaaccgattgttagctgtcgtcccttttcttgtccgtacaaattttaatggcgctcgtgttgtgcagcgggcattgatcagtctcgtgcagtgctgcattgtccgtcaggtggacagtcagccgagcatggtcacct

SEQ ID NO: 87608 - DNA, 301 bp, Heterodera glycines
  SCN-specific regions: Sequence locations=1-92,114-301
ccggctgagcccaaccctttgccttccttcgtatatttgcgccactccgttttgaatactctggtgtaccacgtaatactgtgaatccggccgctgcagcacctatgggagagctccaaccgtcggagcaacgtgagatcttactcacctaacagctggcgtaatatggtcaagctgttcctgtggaaatgtatccgctcacaatccccacaacatacgagccggaagcataaagtgtaaagcctgcggtgcctaatgagcgacctaactcacattaattgcgtagcgctcactgcccgct

SEQ ID NO: 87609 - DNA, 137 bp, Heterodera glycines
  misc_feature (19)..(20): n is a, c, g, or t
  misc_feature (22)..(23): n is a, c, g, or t
  misc_feature (33)..(33): n is a, c, g, or t
  misc_feature (64)..(64): n is a, c, g, or t
  misc_feature (93)..(93): n is a, c, g, or t
  SCN-specific regions: Sequence locations=1-137
cccccccccccttttttcnncnncagaagatgnatggacggaaatacccatctgtgcggtctgngtaaaaaaatgccacgcccaagatcaatnccgatgtgccttccaacacaactaacatctttttcacttgcacc

SEQ ID NO: 87610 - DNA, 697 bp, Heterodera glycines
  SCN-specific regions: Sequence locations=1-110,146-235,257-697
gtgaagataaaaaaccatataatagatcaaagtttgagttcctattttgcattggcttaaatcattccccatgggtattttgcgcaaccgttcgatcaatagaattccaattcgaattgaagaatgtgctgagaatgaaaatggatttgccgatgattatgcaaactatctcttcgattccgaccaatccgacagcgacaatgccgaagaggaaaacgaagtgtcggtccaaattcaaagccaacccatcggaggccaccgacgcaaaaagacgaaaagctatcggccgattgaaattgtggacggatttccgttgaagcgaaacatgggggcgcagaagtggcgtcgtgtggaaaacactaggcttttgacgagttttgccgacactcaggacatttgctttgatggttccgatttaatccccgagacgatttctgcgttctcacgccttttgcgagatgaggcaaaaatgaaggtttggaatgacttcctggagaaagacgaatcaggacagaaaaagatgctttcgcaattcgaatacgaaattctcatggcacgcgacgcttcgaaggcgcagcattcgcaacaatcggtcaaaaatacggacatcaaaaagtcggagagtcagccgcacaataaaaatggtcagccttcgtcgggtggtggcaaatcgtcgtccgattgttttcagcgactc

SEQ ID NO: 87611 - DNA, 643 bp, Heterodera glycines
  SCN-specific regions: Sequence locations=1-78,114-203,225-643
aagtttcagttcctattttgcttggctaaatattccccatgggtattttgcgcaaccgttcgatcaatagaattccaattcgaattgaagaatgtgctgagaatgaaaatggatttgccgatgattatgcaaactatctcttcgattccgaccaatccgacagcgacaatgccgaataggaaaacgaagtgtcggtccaaattcaaagccaacccatcggaggccaccgacgcaaaaagacgaaaagctatcggccgattgaaattgtggacggatttccgttgaagcgaaacatgggggcgcagaagtggcgtcgtgtggaaaacactaggcttttgacgagttttgccgacactcaggacatttgctttgatggttccgatttaatccccgagacgatttctgcgttctcacgccttttgcgagatgaggcaaaaatgaaggtttggaatgacttcctggagaaagacgaatcaggacagaaaaagatgctttcgcaattcgaatacgaaattctcatggcacgcgacgcttcgaaggcgcagcattcgcaacaatcggtcaaaaatacggacatcaaaaagtctgagagtcagccgcacaataaaaatggtcagccttcgtcgggtggtggcaaatcgtt

SEQ ID NO: 87612 - DNA, 723 bp, Heterodera glycines
  SCN-specific regions: Sequence locations=1-723
aggattgaccttcatatgacctgacaatgcactcgagtcaaacgatccattgacaaagttttttgcgctttatctgcttcaacgaatgtgttcagccacacttcgacgcggaaacccttcttcgcattgagtcaacctggtggacatccacgaaattggcattctctccgtgatgtcgccattgcgcacgtgcgcaatgtccgaaatattttccaaatagccactcattgtaaaattctggtgcattcgccgggggttggaagtgcgtcgattaccaagtctttggccgatgcgtccgttttcgacaaatcggaggaaattgacgaagacaatgctaataaatcattggtgaacagaaatggcagccttttgttgaactcctcgacgggctcaaccggcgtactgaacgaactttacgaggccaaacactccttttttgttcccccttcgctcaacccgcgctcagctgatgcttttctttccgaacgcgtacattgccgtcgtcgtctgattgttgtgccgcttttttgtgatttcattgtcaacagatgcaaagaattgctttttgctcctgcaccgattgtctctttctacgacaccctttgcactttatatgcaattaaagctctttccaaagtgatctctcactctcttcatgaggatgaattcggagttgtgcagaatgacatgagtaagtcgctttccgaactgacgcgcctttca

SEQ ID NO: 87613 - DNA, 682 bp, Heterodera glycines
  misc_feature (589)..(589): n is a, c, g, or t
  SCN-specific regions: Sequence locations=1-125,147-682
tagatttgttttgcttatttgatctgaaaattaatcagaatgaccagcgaaaagaatttgccgttgacaattggcgtgtgtgcttcttccgttgcgctcggctgtattgcgtacaaattgttgcagcgcaaaggctcccagcaagaacttctagacgaaatgactttgaggaaaaagaaagacgaggctcattttatggactcactgaagttggacccgaacactccgctcaactcacacgagttggcccttgcttcactcatctcattttccgaggatgccgcttcgttcgagaaagtgggcggctgttcttccattttggaacttctgaggcagaaagttgttgtccctcttcaactggcgtccaacaggaccactcttccgtcgttgctgtacagtgcgccgaaaggaattcttctttatggaccaaatggttgtgggaaaactctgattgcgcgtgccattgccaaagaggtggatgcgtacttcatcaattttggaacttcgctcgtcgattttgtcaacggatcatccgttactatgaagtctctgttcactttggcagagaaaattcagccgtgtgtcattntcatcgatgaaattgacttgctgttccatcgcaatcggaatgactttcagctgctgaagacgcaattcctcgcgcaatgggatgagtttctgc

SEQ ID NO: 87614 - DNA, 682 bp, Heterodera glycines
  SCN-specific regions: Sequence locations=1-395,426-531,553-591,613-682
acaaattggtggcgcgggtcgacggaacgcggcggcggagcgagcggactttttccggcgagttttgtgaccgaaaacttcgacaacggacaaatttcgaacggaacggaacgaaacggcgagagaacggaggcagtggaaacggcggttgtcccaaaagtgcaaatcgatgaaactgtgctgatgaaatgcatcgaactgctcgagaagtgtgaccccgaggccgacccgtcgtccgaccctgccgaattgccttttctcgagcaaatggcgaaggctcaagcaccactcatcgatcagaaactcgtcaaaattgacaaacagctcagcatgttggccgaggtggacatcgcaattcgcgaggtgctcaccgcgtatgacacggccgtgcagcgggtgcccatgccaatgcctttctctcctcccgcgggctcactcgcctcgtccgcccctccgcccgtctccttcgcctccaccgcttcagttccgtctgttaatacgccttctttcccaacccaatggactatgaatggacagtggcaacagcagcagaaccaaaaccaatgaaattgttggagtggttcggatggaggagagagagtcattctgtggtccatataaatccattataaaaatgaccgatttaaaaactaattttactgcttaagagtgaacaaattta

SEQ ID NO: 87615 - DNA, 614 bp, Heterodera glycines
  misc_feature (591)..(592): n is a, c, g, or t
  SCN-specific regions: Sequence locations=1-169,191-285,308-467,490 -505,534-614
taaaagatccgaaaaaatgccaacattttcaaatccttctgattgtgcttttggccgtcgtctcattccgtctctcggcttctactggtgacaaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccgcgcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaacccctannaaaaaaaaacccattacccaaa

SEQ ID NO: 87616 - DNA, 152 bp, Heterodera glycines
  SCN-specific regions: Sequence locations=1-152
cgggcctccgcgctgacctttccttgaccgaagatgttcagcggaacgcatgcaggatcgtcgttcgaggtcacggcgtcgacattcacggcgcagacaggcgctccgcctggtcccgcgacagcgttcacagcacgattgaaattgtccgt

SEQ ID NO: 87617 - DNA, 652 bp, Heterodera glycines
  SCN-specific regions: Sequence locations=1-489,605-652
cagccgattcggaaaggcagtttcatttgtttcctcggcggcgaaatctttcccttcgattatccgtccaaaaaagcggaggaattcaaacaaattgtcgatgctgacaaagtctgcttcgccttcagtgacaaagtgcgtcaattcgcctttttcgtgcgatttgaccgattcctaaagaatcgcgcttttttaacagcgcctgctgtcccaacattcgtttggtccatctcttccgcaattggctttcccccgaccgccctttgctcgctttcgttgccatttctgagattggcgtgggcgaagaattgacccattactacggcgaccgttggtttttggacaaactttccgttcgtccaaaatgcgtttgtcgctgcgcttcgcccttttgcgtttggccgcccaaagcgaagcgacgcgacgactttttctcaaggccaaaggaccgccaactgaaggcgaacaaagtgcgagcggagctgacacagcgaaggagcgggcaggaggaagagacgaaaaagaagcgaaacacagaagagaaagagaaaatggagggatagagagacggacggggagagagagagaggggcagaaaaacagacaaaacggggacatacgccaatgatctgaccaactttgcctatggtca

SEQ ID NO: 87618 - DNA, 797 bp, Heterodera glycines
  SCN-specific regions: Sequence locations=1-204,226-797
gacttctgctgacaaaacaacaaagcagaaggacaacaaatgcaagacggatcagaaccatcggtggaacagcagcaaaagtcatcgaaaacaaatgaagagggagggaaggaggacacagcgaacagaaaggcgaaggaaagcgcggcggaatggatcggtcgggaaaagtgatggattagacaacaaagaaatcattatcaatgaatgacttttgattgataaacctaatgaatgcaaattcagcgcggacaacaggtggaggcgcattgcttcatctttcgccggaagaagcactttatttgagccacgacctcaatgtgctgacactttcttcgcaacagaatgacaaggcaacattagctgattactctcccgagcaattcttcgctgatttgtgcgctttccatcccaattttgcttcgattctctaccgttatttagtttatagatacttccgtcggctttgttgggtcgttagagatggcatttcgtttggcgtcgacttcttgctctacaaatgttctgtggatgagtaccattccagcgcgggcgtacgcatcgttcactccgcacatgaaccaattgcggcagaaacttcaattggggcgcttcagcgcgaattggccaactgtaagaaacgtttactgctcgcgaacgttgtcggacttccgggaaaactgcagaacttgcgcctaacgcagttgtggagtggccaatgttcaggtgctttctatgtcgatttggaatgcgaacagaagtcgtatttctgatttggatgggcaggaattgcaggc

SEQ ID NO: 87619 - DNA, 655 bp, Heterodera glycines
  misc_feature (21)..(21): n is a, c, g, or t
  SCN-specific regions: Sequence locations=1-457,496-655
tggaggggaaagccgcattcntaaccaagttgaggcgctaactgcggaaaagagacgaatggagaagacactccaaacgacgagcagagaacgcgaagaattggctcaggaaaacaagaaattggcagcaaaactgatgaacagaaaggcacaggatcgaataatcggagagcgagagaggggacttgaggaagagctgagacaggaaagactcaaaagcgagtccgccaatgcgcggatccgcgagttggagcagcgcatcgaatgcattcaggacatgaacagagacattgcagttgaaatatcaaacgcaaattcacctctgctcatcacaatttcttctttggaagagaaactgcttggattggagcgtgaaaatgacattttgacgcgttcgacgagacaaatgtccgccgaattgggggcaatgaaacggaggcacgaagccgaaatgggaacaatcgaacggagtttggaagaagaaaaacaacaaaatgcacaaaaaacggaggaattggcgaaggcgttcagcgaaagagcgaatattcaaactcgtatagaaaaactcgaagacgaattgttgcagtcgaaaagagagcactcggaaagggtaaaccgaatggagaagagaatggaacaattggagacggatatc

SEQ ID NO: 87620 - DNA, 361 bp, Heterodera glycines
  SCN-specific regions: Sequence locations=1-8,31-56,88-146,304-317,343- 361
ggtggaattgaagaacaaataaatacttttaagacgacaaaaatgaaattattccctttattatgtttaattatatttttaataattgtcaaaattgaatcagaaaagaaaaagttacaacaaaagtcatttggcgaaatatttggagaaaaatgggaagaaaaagaagaagaaaaaagaagtgaactcaaaaaaagagaaaaaattgcaaaatattataaaataaaagaaaaaataaagcaaaaaggaagaaaacactcaacaaaagaatggaataaaattgaagaaaaaataacgaaaaaattggggacaaatcgaaaaaaaaaaaaaaaaaaaaaagaactctgactcggcgccgctg

SEQ ID NO: 87621 - DNA, 677 bp, Heterodera glycines
  SCN-specific regions: Sequence locations=1-35,57-677
tgaatataaattttgttcttctaaaactgatgctcagaaatgaacataaattaccaattttctgacattattggcactgtttacaaaaatggccaagtcaaatttatgcccgatggaaatgttttgcttagtccggtcgggaatcggataaaaacgttggatttgaagcttttttcttcatgttcacttgccacgcaattacggtcaaacatcacacattttgacattaattttgccgggacacatgcctttgttatgacagaaactggccatggcttttatttgaacttgttcagcgacaccgttcttcatcagcaactcttttctgagcgtgttcgtgcactaaaattttcccccgatggacgattcattgccattggtgtcgctggctttgtccacgtctattcgatagttccattccaccgagttcagttcaacccgttcatccgagtgaataagttcaaacattctgcggatcgcatcaattcgttggattggtccgacgatggcagacttattattgctgccggtgagaatcgcgtggtcaaagtttttgccgcgtttaagtcgacctttgctaatgttggagtttatgtgctcaatgaaagggcctcagttgtcggggcacgtttctttgacgaatacaatttattttgcgttgacaaaatcggaagtgc

SEQ ID NO: 87622 - DNA, 687 bp, Heterodera glycines
  SCN-specific regions: Sequence locations=1-189,211-504,527-687
catttcgaagtgcgcccgctgcaacatttttaaacggcctcgacaaacaagcaaattcttcaccaacacaccgatgaagagcgtcgtcagcccaactccgttccgccggcccctttcgctccgctgtgtgtgctcagtgctggtgctgctcatctgtgcgttcgatgtgtcactggcagcaaaagactttgagaagaatggcaaagaataaccaggaggcccatttaatacgctcagcatcattttgctgattccgctggtcatcgtcaccggcgcgttcgtctacctgctgtttatgaagccacagagcgaaggaaccggcgaggacgacggagaaggcgaaggagacgcggacctggaaaagggaccaaccgaagagacgaaaacggagcctcgaattgaatctccagcaactcttttgggcgtggcagtgccgttggagcaagacgaagaagagcagaaaaaggacgacgagggtggcgaccaaaccgcggagaagaaagaagaggacgcggcggcagcggacgaacaaccgaaagaaggcgccgcggaggcagcggaagcggagaaaagtgcgacaaaggaggagacgaccgaggacacggaggagaccacggaaggatcgaccacagagacttccgacagcggctccggctcgggatcgtcttcagcatcgggctctgaggg

SEQ ID NO: 87623 - DNA, 249 bp, Heterodera glycines
  SCN-specific regions: Sequence locations=1-249
acggcctcaacaaacaagcaaatacctcaccaacacaccgatgaacagcgtcgaaagcccaactccgatgcaccagaccctttcgacccgctgcgtgtacccagggctggtgctgctcatctgtccccacgatgggtcactggccacagactattggtgtatagcggcaaacaagaacccggacgcccataaaaaacactcagactcagatcgctgaggacaatagccatcatggccggtgcgcatcat

SEQ ID NO: 87624 - DNA, 402 bp, Heterodera glycines
  SCN-specific regions: Sequence locations=1-312,337-348,370-402
cattcctctctcttttctcctcctcccttctccctctttctgtggcacttccctttgcccctccggccaatttcgtttcggccgtatgttttttttcattgtttaattactcattctctccttcgcctttttcagcttgcatcggtgaccaatgtcctccgacttgtcccggcgtttgcacatgcgtcggcagaagggactgctgcacagatcgaaacgccggcggaggcggcgatggcattgccggcggcttaatatccggcggaggcgcctctctgccccgtcttctgttggcacttctgctcggcaccggtcggcccggccttccctccctccaattggctttgtgccgtgacaatgccctcaactgtccgttgtttttgtcctactgccaacttccgc

SEQ ID NO: 87625 - DNA, 616 bp, Heterodera glycines
  SCN-specific regions: Sequence locations=1-87,110-465,488-616
ttcacaaaagctcaaaaataatcccccgtaaagcgaacacaaaatgagaatgacccaagacgcaaatttgggcactttttgtgcccttttcactttccttctgattgttgaaggaactttcggcatttttggcattggcagcagtgacaatgacacaacgacgactattactcagggagggggagggacatcgacgacgacggcaaaaccaaagggaggagggacggcacacgacgaaaaccattccgatgactcatcaattcgcggcaaagcgcgcgagaagcgacagcaaacgaaccaacagcaacagcagccgaacttggagtctttgcccgtatgtgctaccggacagtcgcccattgcgccaattccgcccgccggccccgtccttccgatcggcgccattccgcccaccgtcgtttgtctgaagtgccgcccgcccaacggcccattgtccgggaacaatggcgcaaatggcaacaacggcacttaaaagcatttgccattggacgctttgtgaatggcaaccggtgaagaaaaaagagaactaataaatgccatggaaaaagcatttggacgaacgctgactaatcattgcttcttgttttctaattcg

SEQ ID NO: 87626 - DNA, 519 bp, Heterodera glycines
  misc_feature (33)..(33): n is a, c, g, or t
  misc_feature (132)..(132): n is a, c, g, or t
  misc_feature (148)..(148): n is a, c, g, or t
  misc_feature (159)..(159): n is a, c, g, or t
  SCN-specific regions: Sequence locations=1-249,273-519
gcagacactctcgtatacaacacgggatcgttncagtcgcagatcgtcgtcctcttcgcgtacttactgagcgcaggaacatcttaggcccactggtcaggacatacgaatcactactctcagtagatatgngtacacgtaatcattngtccgatcccncgggtgcactgcacaccgcttatcgtgcaaacttaccatagattccgcagactgtgacggagctacatcaactcacgcaggaagtactggcagcgcaataccgacacgacacacctgatctctagctagctgcatagcgctgttcggcacctcgttcttcccaatcaacaacgtattaccacattatcacgggaaataaagtcaaaactatggtgggaacacttaccacggacataattggggtgccaaattgtacatctggccaaatgtcggcttactgaaagaagacgcctactcacttctggtgttagacagtcgatctgcccaaaaacatttgtccactgaaacggcgatgagata

SEQ ID NO: 87627 - DNA, 285 bp, Heterodera glycines
  SCN-specific regions: Sequence locations=1-258,283-285
caagtctaaaaatgtttatgccttggaccacaacattaacaacaggtccaggcctccgcttctaggaaggcccgtgacgactttttcacgttcgtcgcttgtggcttcatcttggagatcggcactcgcgcacttcgttatgttggattcgattcttttctcgtctaatttcgcacgaattgtttttcaattttcgcaggaattgtttttcaattgaaagtcgtaaaaaataaacattgtttttgcaaaaaaccaaccaaaaaaaaaaaaaaaaaaaaaaaatcc

SEQ ID NO: 87628 - DNA, 637 bp, Heterodera glycines
  SCN-specific regions: Sequence locations=1-191,224-296,324-334,356 -396,418-579,607-637
ccatttggatgcggctcgtcgcaatgaatcatctgctgattgagtatcagcaccaacagcagaagaacagttcgaacagtatgcagtcaatgcaccaaaatgtgcagcaaaaggtggcgtccaatcgcaattgtaatgcgcagcagcaaatgaatggccacagctgaacgaatttctttccatttacgccgcttcagcactccaacagcagcagcagaaaagtgccgacccgcagcaacaacaattggcagcacagcaggcggccgcggccgactcgtggctttacaattgggaatggatgacagcagcagcggcggcgacaagcaaaccgacgcagcagcaaaagccagtgaacagcttgaatttgacgcccgggggaacaactccgacgaaagtgaacaaaggcacaccaaacgagcggaggacagcagtacgaggaagcagtaacagcaacaacggaaacgcactgaatatgctgatgagtgcagggttaccactgctcagtacacttagcctgagcggaattggcacgggaaacaatgggacggcggaagttgcgcaacggaattgtgaggagatgaagccgcagcaacagcagcagcagaccaacctgaacaaacagcaaacgaagcggtaa

SEQ ID NO: 87629 - DNA, 736 bp, Heterodera glycines
  SCN-specific regions: Sequence locations=1-522,546-685,707-736
tttccttcccctacttttctcttttattcttccaatgtcctcccaaatggcactgattcttcccttttggacgatggtcaatggttggacgggcatttccccctgcaccacgcagtgtttgacaacgatgtgccaaggctgggacaattgctcaaagaggcagcagcagcagcagctgaatcttcggtcatcgacagagaagacacccacgggaatacggccgtgcacatcggctgtatgcttggccacagagagtgtgtaaaattgctgttggaacatggggcatccgtccaatccggcaacaatttgggctggtgcagttttcacgaagcgataagttacggcgatcgcaaaacgattcgaatgatgctaatcgcgctcaaaaaacagtccagcggacagcttaaaagtcgactgcctttgttgggcgaacatttctcaaaattggccgacttttatatggagacaaaatgggagttctcctcgtggattcctcttctctcgcggattctcccctccgacactttcaaaatttacaaaaaagggcatcgccttcgctttgacttttcgcttgtcgattttaacaacaatggcccattgccaaaatgggaacgtggcgatgtgtctttgcttttggacattttgtcaaccgatggacgaaaggcggtgctaatggacaatcggaagaaggtttaccaagtgttgcgggaaaaagaccaaaatctgagcgatgaat

SEQ ID NO: 87630 - DNA, 392 bp, Heterodera glycines
  SCN-specific regions: Sequence locations=1-15,91-173,230-365
gctttttatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgttttttaacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgc

SEQ ID NO: 87631 - DNA, 615 bp, Heterodera glycines
  SCN-specific regions: Sequence locations=1-202,224-615
catcccgacccgaagcaggttctgatcattgggggcggcgatggcggaattttgcgtgaagtgcttaaacatccctcggtggagagagcggtcatgtgcgaaattgatgaaatggttgtccaagtggccaagaaatttttgcacggattggccacttcttttgactcgccgaaactccaacttcacattggagatggtttcgagtttctaaaaggacatgaagcggaattcgatgtaattatcactgattcttcggacccaattggcccagccgagtcgcttttcggcaagtcctattatcaattggtcagaaacgcgttgaatgaagacggagtgttggcgagtcaggcggagagcatttggctccatttgccactgatttccaaattgatgaattgcgcgcgcgatttgttcccttcggtggcttatgcttctgcgactgttcccacttatccttcgggcactatcggatatttgctcgcctcaaaacggcagatgcatgttctgagtgttccgcttcgtcccctcaatgattccgaatgccaatcgatgggtctgaaattttacaatcgccttttacactcggcttcttttgtgctccctaactttgccgaa

SEQ ID NO: 87632 - DNA, 707 bp, Heterodera glycines
  SCN-specific regions: Sequence locations=1-649,671-707
tttcactgattgattgcattgtgcctgtgaaaccttaagagtgagcatacaagttggtgcaaggatgtcatcatcaaaacgcaaacatcagtggcatttgttggcaaatgtctcggattattcaaaatccgagaaaggatttcagagtgacgagaagctggatgataatgaccttgaggttgcgatgattaatgaatcatgtttgttcggtgacacggtcttccagcaacaatcggccgctttttttgccttgccttcactgcttccgttcaacaatcagaccaacatcgtctcttccttcgtctctccgtttaacgaagaacagaattcagacgagtccgatgctgcggccaaatcgatcgcgtatgacgttgtctcttcactgtttgatggagagcctttgtattcttctgagtcgttttcggatgacgaggggagcatggtggtcaatgccagcattctccaagtgcttcaagacgacgaaacggagtcagagcttgaacaagagaacactgaagcgacaaaggaaaatgaaacggcaaagagtgtttcggaagagagtgaatcgattgaattccaaccgacggttccgacttgtaacaactcaatgcccactctcctgtcgcaaatgtacgcagcagacgagcagactttgccagtgtttgattcatgggaggaactcggagattcgcctgttgccgcggaga

SEQ ID NO: 87633 - DNA, 522 bp, Heterodera glycines
  misc_feature (29)..(29): n is a, c, g, or t
  misc_feature (500)..(501): n is a, c, g, or t
  SCN-specific regions: Sequence locations=1-49,77-522
gtgatttggtaactcgcggtgaatttaanccacttcgctccgaagcgctccaacaccaacaacagcagcaacagaatggtgccactcataatcagccttcaaatggaagtgcggtgctgcaggatatggcaaatttgacacttggaaaggacaaggaatcgtcagtggacagcgaaagagcaagcaaacgatcgtccagcgtctacagcagcagtgagcaggacccttcgtgtgatggacaagggggtaaacacaccgtttcaaaaaacgagacatgaaccaataaatagagagtgcagagaaaaaaacatctctctttttggcgtactatttctttatctctgttaatagagaaaacccgaattttcttctctccatataactttttttcaatccatacaatttacaccaaattttgcataccgatagacaaaaattttatgcatcgaataatatagaaggtttttgcaaaaataaggctcattaaaaagttattcgannaaaaaaaaacaaaaaaacaaa

SEQ ID NO: 87634 - DNA, 718 bp, Heterodera glycines
  SCN-specific regions: Sequence locations=1-287,309-310,332-718
caatgaaaaaaattgattgtactccaccgatggcaaacagtggtgaacattcctcgcgccgtcagcagcaacaacaacgccatcctaacaccacggcggaaaacaactcggacattgagggcactgcgcatcgggtggcgtccgttactttgaacacggagtccgactcgcgcacatccgccgacctgccggcatatccttttcggagtaaacggcgcaaaaaagttgccacgtcgagacaaacaacagggggccgacatggatgttgatgaacatcaaccgccatggaaaaaactgtcggtgaacaccgtggacaatttgactcttccaagttgtaaagtgcaaatggactgggagcgtggacatggacaggcactgtccactgccaatgacagcactcaaaaccaatcgtccagcacaacgagacaagcatcggacatggaaaacagtgtatccgaccagttttcccattcacaatccgaatctgaggccagcacttccaacattgacgcggatgatgaacaaagtgactggcccggaaatgaactcgctcgtcatccccaactgtcctcctcctcttcggtcattgtgcccttccaactcgccccaccacagcaacgcgtcgcatcatcgaccaacaaacagcagaaggatgcagcgccgttaagtgcagaggcaatcaaacgcattgagtgctttttgcagagcgctgacgaca

SEQ ID NO: 87635 - DNA, 435 bp, Heterodera glycines
  SCN-specific regions: Sequence locations=1-208,231-382
accgccgcgaatcgtcgcacttccgccgaacggcttcagccgcctcgcgcgagtatcggtcgggtggcgctttcgctggcggagaaaatcttttgcggccggcggaggaattgggcgggcgaagttcggcatttggcactcgaaacgtgccaattcaccgtggataaagccaatgtgagggggaagcgcccgcatggacgacacatgagacgaacgaacagacaaaagacgaaatcactcccccccactcactcatttgccttagagtgtcaaagggcagactgactgataaataagcccgatcactttttattgcttcaaattaaaaatgtacccattttccatgctaatttagcctcattatcagtaaggtgcttcgtacaaaaaaaaaaaaaaaaaaaaaaaaaaggcctatgaaaaaaaaaaaaaagaaaa

SEQ ID NO: 87636 - DNA, 681 bp, Heterodera glycines
  misc_feature (604)..(604): n is a, c, g, or t
  SCN-specific regions: Sequence locations=1-681
atgtaacggccctttcgtgccactgaatttgggcaatttttgcggcggggaagagcagacaaaaaacgttgacagaaacagtggcgaccacggcgaagaaaagtcccatcagccgagtggagcagtttcggcactgtgcgcggctgtcagaagttcgtcccatttgctcgacaacagtccgtccgtcccgaccacgtcatccgccgtcgctttccctccctttggttcgtctcccaccaatgggggcgtcgtcggcgtttccgccgtttcggtggcacaaacttcgctctcttttgtgccttcgtttgggctgctccaacagcaaagtccgatcaagcagctgctgtacacttcctcacaaaacagacacaatcagttggtccccagtgcgttgccctctgcgtcgcctggcggactgatgccaaaccaacagaacggcataaagtcagcagcgagtgccgtcggaggagggcactccgccggtgtacttcccgcggaaatgaacactcacaaccaacagcagcaacgggaggagaacggcaacaacactttggcattactccttcagtccctccaaacgtccattttgctggagcagcagcanaaagcgtttctgagcaacagtggcaccacccacaacaatttggggactttattgaacagacttccttcattgaatgg

SEQ ID NO: 87637 - DNA, 677 bp, Heterodera glycines
  SCN-specific regions: Sequence locations=1-107,129-253,275-677
agcgctcctaatgagtgccatttcccgcgaattggccaatgcccttcacaataatccgaacgctccgccgccgggcggtcgaattttgttgtgcctttctgagagtgatgtaaccaaaaaggatttgaaagcgaatttggacgatttttttgatggaaatttgaaaattgaagaaatgggagcggaagagttaattgaggaagcggaaaaggaggccaaagcggcaaattgtcagcagcaatttgatggaattatttgctcaaatgttttcactgggcaaaaaatggtggaaaaccgacgaaaaatggcggccgttttgggcgttttcctgcgaatgcttcggggcgaaggcgccgttctaatccttcgcgagaatcttgaagatttttctgccaaattaatcgccgacctcaccaaattcgtcgatgtgttcgccgccaaatggcaaaatcacacttttggcttccgtctctatgggatgtgccaagtgcagaattcgattttttcgcattcaaatttcctcgacgtccattggacgttgacaaaatccgaagaaaatcgtttgtccgatgacaaattgcccactttccgggaatttcttgacaaaactcactacactgaggacaatgtgggaaagctccaaatggattttcggcaaggatttcataagcccaggc

SEQ ID NO: 87638 - DNA, 578 bp, Heterodera glycines
  SCN-specific regions: Sequence locations=1-578
gaccgacaaaaatggcaaaactcgtggccgttgctcttctctacgctgaccatagctgcgatggcacttgcaaaaacgggcaaaagtcaaacggcagacgaagctgagggattgcgcaatatgaacctaggggacaacaatacagtggacgccggaaaggaacccgcggctgatattgtaaccaaaaagggaaaagctcagaaagccggaacgaaatcggcggcggccactaatgagcccgccgctgctaaaggaactaagaatggaaaagccccgaaaaccaaagcgaatcaagaggaggccactaatgcgcccgccggtgctaatgaatggaacgaccaattgatgggcatgagcgccgagaaatccaacgaggagctcgctgtgttgctgccaaaagcccacactttcatggaaaatgctttgagcctgatcaatgaacaaatggaaaaaaatggtgttgcaactggcgctgccggggactcgagctcgaccgggatcccggccaactaggagaccaatgccacaggacggtaccggaggacggaacaaaggatgacgagctctgaggatgatca

SEQ ID NO: 87639 - DNA, 584 bp, Heterodera glycines
  SCN-specific regions: Sequence locations=1-584
aattgcccattagaagaaatgttcagctcttccatttgtctgctctctttttggcctcctccgttttggccgtgcttataattggcattaaaatggacggaccgacggaggcaaaagccgccgcccctccaaacgccgcggggccaatgggacttttgcttctattgaatggcaaacaatcggcggctaatgaaaagggaaaagcgccctctggcgaaagtaagccaaatccggggcagaagccgagcggagaacggagaaagagggacgttttggggcacgccggcggatacgtcggaggatgggaccatcccattgactcgacacttgattgggcaaagagtcagtggaatgatgccaattggctcgccgatgttgtcaacagaaacggatgggaaaacaccggcactccaaccggcggacgatgaatcagtgaattgtgccgaccaaagaacgaaagacggcatttttgtttgggaatttaattgactttcacgatcaaacacactttcctttttagttccctatttattctaaattagcgttttttctgttcattttctacgcataaatttgtgtgaaga

SEQ ID NO: 87640 - DNA, 712 bp, Heterodera glycines
  SCN-specific regions: Sequence locations=1-217,240-447,469-569,591 -663,687-712
ggtcctttcgctttgtccaaaagaaaaatatgaaattggcgtttgttcgtttgaatgttcttacggtactttgtctgttctgctcaatgggtcattcctacggtaatccatccgacgaatccgatgacgaaatttgcgaggaagaagaaaatgaagcacaatcagaagcagaagaagcgttttatttttttcataattttaacggcacaattcaaagtgaaagagaggagaaaagaacggttgtcgaaatattttgccgaaatacaaatgacaaatttcaattttccaccgacgacgagggaaatttcaaaattcaaatggaagcgaaaatcaaatggaaatttcacaaatgcaccaccggactgagaatggcattttacaagaaaaaagtgatggaaaacaaagtgccaaaatgtttgcccattattttgcggagtccaaaacggaaattaaaaaatgcaaaaagattggatatttgtgttgtcccaattcgcatcaaatggcttaaatttggcccaaaaataaatgcagaagaagccgaaaccgaagaaaatgacgaaattttgagaaatgaatttgcattggattttgatgtggaaaagaacgcgcaaatgaacggacaaattagaaattgcagtgatttacattctgctgaacacaattttgaaatgattttcaacaaatatttcgatgatggaaaaagtgttgacga

SEQ ID NO: 87641 - DNA, 724 bp, Heterodera glycines
  SCN-specific regions: Sequence locations=1-724
cagcgactcggcgaccagaacacagaaccaagccatccaaccaccccattccaacattcactggtgcccccgtctctgcctgttcagcaccgcgtctccgttctcagtcagcaaatggaggcggcggcgagcgcagtgcagtcgcccgtctctctgcgcggactgtcggcgccgcccgcggaatcgcaaccacagccaatgccgctgtccatgccaaatgattctccgtccccttcgcgacgtgcgccgcttttgctggaaaatgcggtaaaaattccggcggttgactacgacgaccaacagccgaccacgagctgtggccaaggcacgaaaagctgctcgtccgactcgggccaaggctcatccgccggttcagaggactccgcggaaggaattgtcgtcgtttccgccgtttgctcttcgccttcgccgtctttcaacggaaattcgccgctttccgccggcactttcaaaaaaaagctcgttgaaaattgggactttgaggacgtcgcggaatggttggcttcgcttggaatgggcgaatattcaaaggcattcggaaggaccaccggcagagaattgctgcgattcgatcgaacgcgattcaccgcgttgggagtgactcgaattgggcaccgccaaacgatggaacgttcgttgcagtcgttctcgcgacggagtgactgatcggaagttcggttggccgatcattcgttcgggtagc

SEQ ID NO: 87642 - DNA, 677 bp, Heterodera glycines
  SCN-specific regions: Sequence locations=1-530,573-677
gtgaggacgggacttttggatggggcggttcggctgaaattctgttggagaaggacgcgtccattcgcctgaccaccgactcggcatttgagaagtcgggcaccgccatcaacctctacgtcgactacaagaacataacgaaggttgtgaccaaaggatcgcgcgtgtacatcgatgacggattgctgtcgcttattgtggaagaaattttcgacgacgccatactgtgcaaagttgaaaatggagggaaattgggcagtcgcaaaggggtgaatttgcccggaacaccggtcgatttgccagccgtttccgagaaggacatcaaggacctgcgttttggtgttgaacagggcgtcgacattattttcgcctcttttattcgaaacgccaatggcatccaaaccatcagagaagtgttgggcgaggcgggcaaaaacatcaaaatcatcgcaaagatcgagaaccaggaaggcgtgggcaatgtggacgaaatcattgcggcatcggacggcgtgatggtcgctcggggcgacttgggcatcgaaatcccagcccataaggtgtttctggcccagaagatgatgatcgcaaagtgcaacatggccgggaagccggtgataactgcaacgcaaatgctcgaatcgatggtgaacaagccgagaccgactcgtgcccga

SEQ ID NO: 87643 - DNA, 204 bp, Heterodera glycines
  SCN-specific regions: Sequence locations=1-204
catattttggatgaggaactgaggctgaggtacgatctcgagtcgttgttcttggggttggactgtgacgaggagggcaattccagtgccgcgtcgtggcaagttgaattccgattgccggcctcaaagctgatcaaaatgccttcacaacttggcctagtctcatgagcattactttctttctaaaaacaaatgccaaaaaaa

SEQ ID NO: 87644 - DNA, 182 bp, Heterodera glycines
  SCN-specific regions: Sequence locations=1-182
cgtttccctgacgcatcgcttcattttgccgagactttcgaccgcgccatttctttgcttcgcgcagactgtcgtacttcggagaaacacgtcacttttctgcacattctccgacaattgggcgcgagtgaagagaatggtggactccttggcaatttgaacgggctcattctaatcctgag

SEQ ID NO: 87645 - DNA, 217 bp, Heterodera glycines
  SCN-specific regions: Sequence locations=1-217
tcgacatttccctccttctttacacttgagccaagagtttccctgacgcatcgcttcattttgccgagactttcgaccgcgccatttctttgcttcgcgcagactgtcgtacttcggagaaacacgtcacttttctgcacattctccgacaattgggcgcgagtgaagagaatggtggactccttggcaatttgaacgggctcattcgaaacctgag

SEQ ID NO: 87646 - DNA, 623 bp, Heterodera glycines
  misc_feature (164)..(164): n is a, c, g, or t
  misc_feature (168)..(168): n is a, c, g, or t
  misc_feature (176)..(176): n is a, c, g, or t
  SCN-specific regions: Sequence locations=1-234,257-441,463-623
ttgtaacaagttgacccttcagaggcatcccttccctctgaccattgctctgtcctcctgccttacaatgtgctctattccctgcccctactccgctttttgtccatctcttccgtctccgtgcccaccgattatttgcttcgcattgttttgcccattttcgnctgncgcgcggnggccaccgtcagcgcatattttgcgctgtggaaaatcagtgtcagctacacgcagacaattaaatccacaatgcctttgttcactgtgctcatttctcgtcttttgcttggcgaacgtcagcccatgcgaatttacttgtctttgttgcccattatcacaggtgtttttattacgactgcgaccgaattgcaattcgattccttcggcctttgcttctcattactttcgacgggaattcttgcttttttgaatgttcttgccaaaaaggtgctcgatgaggcgcgaatgcatccgataaatctgctctctctgaactcccaattggcttctctgctgcttttcccattttggctgttcaccgatgctctcaaaatgtggtcgaacattcattcgacaaatcgacataatcagtcgcccgacccgcgctttctctttatgcttctcct

SEQ ID NO: 87647 - DNA, 411 bp, Heterodera glycines
  SCN-specific regions: Sequence locations=1-79,102-115,294-350,372-411
atctacaacaatgctcgcacgtaatgcttctaaagaacgctgccgaccacaaaaacatcaaggatatatgcagaagacttaaataaaaatacaaaaaacaagtaaagcatctcatgaaagaaaagaatcagcaaaagcaaaagcagcggaaagaagataagaagatgtctaaagacaaaaacaagaacaagagatactaaaagaagcagaaagaacaaaagaagcactaccaatagcagaagttgacagacaagaagcacaaataaaagaagaagtagaaagataagaagcagtagccatagcagaaatcgaaagaaaagaagcaggggctatagcagaagtagaaagaacagaagcagtagcagtagcagaagtggaaagaaaagaggccgacatctgagaagaagtgga

SEQ ID NO: 87648 - DNA, 583 bp, Heterodera glycines
  SCN-specific regions: Sequence locations=1-25,47-217,239-247,269 -475,580-583
caaaaactccctctaaaatgagttcttcgtccattttcctttcctttgcgtctttttctttgataattttggcattgtgccgagcccaaaatgaatcagctgcccaaggcgatgcgcagcccccgccattcttaacagaggccagccaagagaaaatcaacgaattctaccattacgtcacgagcctggggcatttaaaagaaacggaaatagcggaaaaagtgaaggaatgggtggacaaacaatcggaggaaattcagaagaaatacgtcgagtttgagcaggaaagggaacgggcgaaggccgagggcgaagcggcgcacgaagaagcggtgagaaagttcagcgaagcggcgaaaaaggcggacaaggaactgaccgaaatcgcgaacaaccccaatttgtcggcaaatgataaggcggaaatgatcagcagaaaagtgcagtcactgcccaaaaaagtgagggacgaaataggaggagcaatgggcggaggcggaggaggtcaatagcagcggaagaagtgaagaggaagaggaagtaataggaaggagagggagaggagaggagcgaaaaggaacga

SEQ ID NO: 87649 - DNA, 104 bp, Heterodera glycines
  SCN-specific regions: Sequence locations=29-30,57-57
atggcataagcgtgcttaactgcgagaccgacaagtcgagcaggtgcgaaagcaggtcatagtgatccggtggttctgtatggaagggccatcgctcaacggat

SEQ ID NO: 87650 - DNA, 666 bp, Heterodera glycines
  misc_feature (662)..(662): n is a, c, g, or t
  SCN-specific regions: Sequence locations=1-36,70-73,102-127,163 -289,419-666
taaaaatgcgcgccattctcttcctggcctggtttgcttggtgatggctgttattcttgagacagccaactcaaaggcagtgaaaaaagacaataagaaaggagcaattacaacgccagcaaaaggaaaagcggcgccgaaaggagcagcgaaaggaggaattaaaaaagacgcaaaatcaaagggaaaaggaaaaaaggacgccaaaggcaaaaaggacaaaaaagctaagccagccaaagggaaaggagtgcctaaaaatgataaaaaatccccagcggcaaaagccaatgacaaaaagagcccaaccaaaccaatggcagcagtgaaagccgtgccaaaggcggcggagaatgctcagaagggaccgtcgagtgcggaagtggtggcggaggaaaacaacttggacactgaggcggtcgacgacttgggggcggaagagtcggactttgaccaattggcagaggacgaactgctcgaggacgacgccatggacggcgaggcggacgaatgggaaggcatgggggaggagacggagatggacagccaaatggcactctgatggccaactaattggacaaattacaaacggaacaaaacgggacaaatgacacaaaatattatttatcatttttggcatatcattgaaaataaatagaatntatc

SEQ ID NO: 87651 - DNA, 251 bp, Heterodera glycines
  SCN-specific regions: Sequence locations=1-228
taatgttcgcgagcgtcttcgcggtcgtttcctgcgtcgagcccgacggcgtctgcacgatcacgaacatcaggccctggtcttcatccggcaggaacgacttcggcaggcgcacgaacagcaggccgaccgcgacgatcacgaccaggtagatgatgagccagcggcccgaccgcttgatcacgtggtgcacgccgacgtggtacttgtcgcggctgttgttgaatgtgcggttgaaccagccgaagaag

SEQ ID NO: 87652 - DNA, 288 bp, Heterodera glycines
  SCN-specific regions: Sequence locations=1-288
tgatctgttgcagatgccaatacaattaagccgaacgacgctggctgaacgggtatatcaccccgcatgtggcctttattgctactcgaatgtgtggctgatcaaagtgccattcacattcaacagtccgatcagtgatcacaacgatttagcgtgaaaagctgcatgaggcgcttgatgatgtcattgactattgattgattggcacacaccgcgttaatgaatgcaatcgaaatttatgacttcaatgaaaagtttatgggtgccgatgtaaaaaacaaaaaaaaa

SEQ ID NO: 87653 - DNA, 241 bp, Heterodera glycines
  SCN-specific regions: Sequence locations=1-119,141-220
gtgagcgggttcatcaccggctttggcctggttggttacgcggcactttggctgatcgaagtgccattcacattcaacagtccgatcagtgatcacaaggatttgcgtgaaaagctgcaggaggcgcttgatgatgtcattgactattgattgattggcacacaccgtgttaatgagtacaatcaaaatttatgagtccaatgaaaagtttatgggtcccaaaaaaaaaaaaaaaaaaaaa

SEQ ID NO: 87654 - DNA, 184 bp, Heterodera glycines
  SCN-specific regions: Sequence locations=1-127,149-159
tttgaaggaacaatgtgctcaaatggaaaagatggaagttcattagtcaaattaattaccaattgaagagataattggttcattgaaacggacgatgcgatgacgtcatccattcatttatcatttggataatttgttaaataaaataaaggccaacggaaaaaaaaaaaaaaaaaaaaaaaaa

SEQ ID NO: 87655 - DNA, 190 bp, Heterodera glycines
  SCN-specific regions: Sequence locations=1-31,135-135,163-190
cgcgacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccataaatcgatcgtagtcc

SEQ ID NO: 87656 - DNA, 177 bp, Heterodera glycines
  SCN-specific regions: Sequence locations=1-177
gaaggacctggcctgcctgggcttcagcgccgatctggtcatgcaatcgttctgcactacggccgcttaccccaagcccgtggacgtgaagatgcaccgagaactgcccgccttcatcagcaaccgcggcggcgtggccctgcgtcctggcgacggcgtgatccactcgtggttgtt

SEQ ID NO: 87657 - DNA, 543 bp, Heterodera glycines
  SCN-specific regions: Sequence locations=1-70,92-543
aaaaactgcacagcaccgtggatggtctacgtggagtactgcttcgatgtgaggctcgacgacttcaacgaggagtactgtttcgaggtgagcaacgccgacatcgtacacaacagctgcctctatgtggaacagacgaatccgaactacatgaccttccatggcgttttttactacattttcgtctgtgagaagacaatcagcgggctcaaagatgaccgaagcgaaaatgtgttcaaccgtaggcaaggagcatgtgcaagcggggacgaccgatgcgataacgttttcaaccgtggacaagtggcaagtgcgcgcaatggtgaaggaagagacagcatcctcattcaaggattggcgttcgtcattgtgaaagtggtcaatgcagtgtacgatatgattgtttaattgtgatcaggatatattcatcacgtatatgtaaacaattatttttgcgtgtgtcgtatatgtacgaactgaatttctgaacattcgtcatatgtatgtaaaaataaatgtgtgtgaaataaattctggtagcta

SEQ ID NO: 87658 - DNA, 414 bp, Heterodera glycines
  SCN-specific regions: Sequence locations=1-414
acgtgaaacttttccacgccaaattgcgcctgcgtctgtgagtggctgacattgaccgtgagcgcgtgctgtcgctggatgacgacttgggaaaagttaaaacggaactcactgtgcatgcccgggagaatcgccagctgaatctttttttctccgactggagacgcgtacgcgagaatacgagatggaactcgaaaacgggcgggagcaccatggaacgtgccaagcgctacattgaccaggagaatagaccggagaaggacgcacgtagcacactgctcaaattggctgatatgttcgagtcgcccattcccacaacatctaatgtggcccgcttacgcatacagtttgacgacgacgacaacgatgctgatgacaatcatagaccggacactgcttcaatcgattcaccta

SEQ ID NO: 87659 - DNA, 376 bp, Heterodera glycines
  SCN-specific regions: Sequence locations=1-376
atgatgggagtgccatacacattatcacctggcattggtgcaacatagattagttgtcaccgctgcacgtgcgtcttacttacctgatacagttggggcggtagccacagaccgaatcaatgctcacggacgaaatgcctgcggacagtggccatctcatgggacccatcgctcaatggctccaccaccttcctctgtgcagttcccaatgggggcataaccaattaaaaaaaatgacggctcaccgtacaccaacttgctgagaaaatgccggtcaacgaatcgtaacgtctgtcacctgattggaccaccacccacatcatcgttagggccatggatggatctaaccgtggaagaaagagtggatgcttcactt

SEQ ID NO: 87660 - DNA, 585 bp, Heterodera glycines
  SCN-specific regions: Sequence locations=1-6,30-585
gaaaaggaaacatagtaaaagatatattcttgttggagacctgactttactatgtttcccagaccattccacgtctttcccaaagatattgaacaggaccaaattgtgccaagcttctgtggtcggctcgaaccggacaatgtcgtccagcgacaaactgcagcagcaaaaggtgctcaccgtggacacgatcaaccccaacgttatcaccatggaatacgcagtccgtggcccaattgttatccgtgcggttgaattggagaagcagttggcgaaagagtcgttgccgttccccagcgcgatcagagcgaacattggcgacgcacatgccatgggacagacgccgatcactttcattcgccaagtgattgccggcattacggagcccgcactgatcaagcaacagcccaacctgttcccggaggacgtgcagcgcaaggtggcctcactgttgcgcgcctgcggtggcggcagtgccggcgcgtacacacagagcaccggcattgacctgatccggcagcatgtggcccaatttgtggaaagacgtgacggtttcccctgtgatccggaaagtgtgtgcatctc

SEQ ID NO: 87661 - DNA, 595 bp, Heterodera glycines
  SCN-specific regions: Sequence locations=1-59,83-201,223-453,476-595
ccaaaatgactgccgcccgtcttctaaaaatggttccatccgaaagtgccttgttggtctgtgacatgcaggagaagttcagggagcacatcaaattctttccgcagattctgcaggtcacttgccgcctcattgaagctgctaaactgctcgacatgaagattttggccactgagcaaaacccgaatggtgtttggccacactgtgccagaaattgtcctcaaaaagcatgacattcccttctctgagaagaccaagttttccatgtgcgtccccgacctccaacgcgaactcggcctctccccggccgttcggtcgctgcttctctgtggcattgaggcgcatgtttgcgtttaccagtccgccattgatttccaacagcaagggttcaacgtccacgtggtggtcgacgcaagttcaagccgttcaatggtggacaggatttatgcctacaaacagttggagaaagtgggcatcaatctgattaccagcgaatgtgccattctcggcttggttggcgacagtgcgcacccaaaattccgtgaagtccaaaaactgatcagagagagtgcgcccgacacgggactgatcagcc

SEQ ID NO: 87662 - DNA, 654 bp, Heterodera glycines
  SCN-specific regions: Sequence locations=1-654
caatgcgcaacaaaatgccaaatcatctgagcctgaacacaaagtgccaaagcttcagagcctgctcaacaaaatgccaaagcatcagagcctgcaatccagcaacaaaatgccaaagcatccgaagctgcagaacaaaatgccaaagcttcagagcttgctcaacaaagtgccaaggcttcagagcctgttcaacaaaatgccaaagcatcagagcctgcaatccagcaacaaaaggccaatgcgcaacaaaatgccaaagcatcagagcctgcaatccagcaacaaaaggccaatgcgcaacaaaatgccaaagcatcagagcctgcaatccagcaacaaaatgccaaagcatccgaagctgcagaacaaaatgccaaagcttcagagcttgctcaacaaagtgccaaggcttcagagcctgttcaacaaaatgccaaagcatcagagcctgcaatccagcaacaaaatgccaatgcacaacaaaatgccaaaatggagaacataacttcaaaagatgcgccaaatgtcaaaagtgataacagcattaacaaacagtctatgaatggctctgatacaaatgagaaaaatgccatggaaacaaaatttgttgtgccaagctctattgagtcacgggttattgagcctgttcga

SEQ ID NO: 87663 - DNA, 560 bp, Heterodera glycines
  misc_feature (41)..(41): n is a, c, g, or t
  misc_feature (59)..(59): n is a, c, g, or t
  SCN-specific regions: Sequence locations=1-170,192-560
tttttcccccccccccgtttttcccgcccgggatgtgtttncaaaaaccccttctgttncctctaaaaattaacctcctctaagaaaatggcttcatctttctgctcttcactcatttccatcgccgtaattgtctgtttgctgcgcaaatgctgcttttcagcaccccatccatgctgtcctggcagccaacatgttgtttcgatgatgaaagatcacaccggctcattctccgcttcgatgccaaagtcttcgctttgtctgagtgccgaaagagtcgccgctgcggtggaaaactcaactgaaaacaatatggtgccctggcaatggtggtcaaacactcattaacgagatcaacgcagctcaatcatcatctgatgagtgtgctcgatctctcggcttcgtccgcgccatgttctaaattgtcgcttccgccgcttcccatgtccgtgccaacgccgaattggccaatttggctgttcagttcccagaacaacgttgcacaattgacacctactgtgctgcgctcggcctttatgttgggcaaatccctttgtgca

SEQ ID NO: 87664 - DNA, 765 bp, Heterodera glycines
  SCN-specific regions: Sequence locations=1-254,276-490,514-765
caagtcgatacgtcggaagacacaggaatcaagaccctgtgggttggccagttgagctggaatgtcgacatgactggctcaagagtgaattcgagcaatacggcaccgtacttgatgcacgagtgcaatacgatcgtgactccggtcgtagccgcggctttggatacgtcgactttgcctcatcggctgaagcgcttcgtgcttcgaaggaagctcatggtaaagaactcgatggtcgtgctcttcgtgtggatctgcagcctcctcgcggccctcaggagcgtgtcgaatctcgggccaaacattttaaggatgagctgagtgcaccttccaacacgctctttatcggcggtctcgcttgggcattgacagaagacgatgtttggaacgcatttgccgagtttggtgaggtagcgggtgttcgtcttcccaaagagatcgagtctggtcgtcccaagggctttgggtatgtggagttcacctcagaagaaaatgcagccaaggcactggaagccatgaatggtcaagctttgggcggccgtcccattcgcattgactttgctggtaagcgcgataacagcaactcctcgcgtggcgcacctcgaggtggtaatactggtcgtcctcgcgacagcggttggggaggacgtgccggtggtgcccgctctgcatcaggaagtgcccgatctggagccatagccccttctacggggtagaaaatgaccttcgatgattaaatgatcatattctgttcatataattcaa

SEQ ID NO: 87665 - DNA, 556 bp, Heterodera glycines
  misc_feature (168)..(169): n is a, c, g, or t
  misc_feature (174)..(174): n is a, c, g, or t
  SCN-specific regions: Sequence locations=1-272,295-556
ggagacaacagcggatttgtctgcattgtgcccagcgttttctaacattttcttcgatgcgacagccgatgaagaaagtcactttggggaatcgtaacaagggaaaatgaaagatccaacgatttgaccgaccaactcaaaccgtgggatgttccgattttccaattnncgtangtccccagcatccaaaaacaaggatcattttcctgtcgctcttctctttccggttacgattccgctcaatgggtcgactcgacagacgccgccatttcccatcggccaccgcctcgtccacctccgccaaaattatgccaaacaacatcggaagtgacgtcacccagacgacactttcatcagtcccatcgacacagcgtagaattagtggacgaaaacttacaattagtaaagagtgttggacgaggagttctgccagattcagtgaacccgcagctgatgcaaaacgcggcatcagtgtccaaaactgatttcaagcagaaagtggtgcttgaccttctgaacacggaacgggcgtatctgttcgacctaaacacctggg

SEQ ID NO: 87666 - DNA, 209 bp, Heterodera glycines
  SCN-specific regions: Sequence locations=1-2,101-209
ttatgatgaggaagactatgaataggcggtgacgatgatgatgaataggcgatgatgatgacgaagatgccgagggggatgagggcggtgaagacgacgaacaggaacaatgaccttttcgcatctgttttaagctaactcttctggcgacactgttctgactgtttgatgctttgcccaattccccccttctgccctgctgactgagc

SEQ ID NO: 87667 - DNA, 217 bp, Heterodera glycines
  SCN-specific regions: Sequence locations=1-217
tcgacatttccctccttcttaacacttgagccaagagtttccctgacgcatcgcttcattttgccgagactttcgaccgcgccatttctttgcttcgcgcagactgtcgtacttcggagaaacacgtcacttttctgcacattctccgacaattgggcgcgagtgaagagaatggtggactccttggcaatttgaacgggctcattcgaaacctgag

SEQ ID NO: 87668 - DNA, 471 bp, Heterodera glycines
  SCN-specific regions: Sequence locations=1-310,333-471
ccttgtttgtgtacttacacggatctccggagcacttttatgtgcaaaactctgcaggcaaagagtggcggagcactaaactgttcgatggggcgaccgacggacacgcaatttgtacctttggaatggaagaattcgctcttagcggtgtccatgagttggttgtgttcgtcaatatgcacggcgtttcctcccggccgcccatttccgtgagtggtcggagtcgaattgtcgggctttctctgaaggagccgtttctgcatgtgttaagcgaagatggcaccgtgtctattttcagtaccgtcgatgcccatttggtccaatcgctcgcttttccaaccgacgaagttcaagaggtgcggtaaaacatttgcggccgatcatctgcgccgatcacttgccaattggagaacattgacggcgttattctgatcgcatcacccggcgacttggcactgtacgaactcgtcc

SEQ ID NO: 87669 - DNA, 631 bp, Heterodera glycines
  misc_feature (617)..(617): n is a, c, g, or t
  SCN-specific regions: Sequence locations=1-281,303-602
gcgcggcgttgtttcgggtgaattgaagcaagtaaaggcattggtgcttctggttctttccgtctcggcggaagtggcacgccaaaaacatcggatgtgaaaaagagcccaaagaaaagaattgctgcgaagaagccatcggtgatgaaagcgacgccgaagaaagccaaaaaggccgtcccgaagaagtcgccggctgcgaagaaggcgaagcccaccgctgctgcaaaacccgaagttcctctgcccgtttcgccggcagtgacaaagtctaagaccgcgaaggcactgaagaaagacgtcccgaaaaagtctaagatggccaagagatctcctaagatcgctaagaagtcgaagactccgaaaaaggcgacggggggtgcgaaaacttcgcggaaggtcaagaaggtggcggcgtcaaaatctgccaagaaggatgtcggtgttgatggtgcttcgtgaatatttcttttcctcccttccatcgatctccaaaatgtaaaattcgtttatgtatctctcaattaccttgcattttccactcagatattttccgatcattcttcactccatttgttttcgcgcaattatctttgccttttaaaaaaaaaaaaaanaaaaaaaaaaaaaa

SEQ ID NO: 87670 - DNA, 605 bp, Heterodera glycines
  misc_feature (578)..(581): n is a, c, g, or t
  misc_feature (584)..(584): n is a, c, g, or t
  misc_feature (589)..(589): n is a, c, g, or t
  SCN-specific regions: Sequence locations=1-158,180-274,297-456,479 -494,523-581
gaaaaaatgccaaccttttcaaatccctctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaacgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaaccccnnnnaanaaaanaaaaaaaaaaaaaaaa

SEQ ID NO: 87671 - DNA, 198 bp, Heterodera glycines
  misc_feature (118)..(118): n is a, c, g, or t
  SCN-specific regions: Sequence locations=1-47,98-198
gagggtgaaggacttgctccgtaagctatgccggtcgaagaaccggccgctgcgactgtttattaaaaacacagcactctgcgttgttaccactagcttcaatcgaattccccccccnccggggccaccgccccattgggatcgggcccgggaaaacttgcgacgtcgggcccaattcgccctatagtgagtccgtat

SEQ ID NO: 87672 - DNA, 691 bp, Heterodera glycines
  SCN-specific regions: Sequence locations=1-383,410-691
gtaatgactgcgttgcattgccatgttgttaaatcttctttggggcccgttggattggacaaaatgcttgtggatgatgtcggcgatgttacggtgactaatgatggcgcgactattttgaaattactggaagttgaacatcccgcaggaaaaatactcgttgatcttgctcaactccaagatgaagaggttggcgatggaacaaccacagtcgtcattattgccgctgaattgctaaaagcagctgatgaattggtccggaagaagatccacccaacgaacatcattaacggatatcgcttggcctgcaaagaagctgtccgctacatgaccgagaacctttccttccctgttgaagagcttgaccgtgccagtcttattcgtgctgctaagacatcgatgtcttcaaagttgattggatcggagtcagacttttttgccgaactttgtgtcgatgcaacagtggcagttaaacggactgacaaggcaggcagagtgagctatccaatcaattcggtaaatgtgttgaaagctcatgggaaatcgagcaaagaaagtcaattgatcagtggatatgcattgaactgctcggcagtgctgacgaagtcgtacagactcgcatttcagacgacgaattaattttgatcaaaggaacgaagttgaaatcggctgcttccatcattctgcgtgg

SEQ ID NO: 87673 - DNA, 680 bp, Heterodera glycines
  misc_feature (567)..(567): n is a, c, g, or t
  misc_feature (615)..(615): n is a, c, g, or t
  SCN-specific regions: Sequence locations=1-69,91-680
cccttgatggactcgctgaaaggccgttctcttcgtctcgtgctgaaaaatgtgcgcgtctacgcgcggatgtccccaaaacagaaggaacgtgcaataaacgcgttgaaagccatgggtttgacgacactgatgtgtggcgatgggaccaacgatgtcggggcgttgaaacacgccgaagttggcgttgcgctgctgacccatccgctgaagcccgaagaggcgacggctgccacctccgcgggcagtggaacaccgacgcaaagcacctccggcaccagtggcagacagcagcaaaatgagggcggcggcggtgagcagactcggcgttacaacaaccgcgagccgacctcagcggatgccaatggacagcgacaacaacagcagcagttggccatgaccacggcgggcggtggtggcacgtcttcacgacagcaacagatgcagggtcgtctcaatcaaatgatgcgcgacttagaagaccaggaggagcaggcgaaggtccgtcttggcgacgcgtcgtacgccgctccgttcacttccaaatcgacttccatccaatcaatntgcaacatcatcaagcagggacggtgcacgctcgtgaccaccttacanatgttcaaaattttggcgctgaacgccttggtgttggcgtacagtcaatcggtgctgtacctgga

SEQ ID NO: 87674 - DNA, 707 bp, Heterodera glycines
  SCN-specific regions: Sequence locations=1-16,38-40,63-96,124-617,639- 707
gactctttccctttcctttaaatttttaaataattttgcttttattttcccaatgcttttctccccgtccactgttctgctattgcttctgatcgtcctccctttctctctttctttcattttaatccctcaaaatgtccgccaaatttcccccgccctttcgtcgcgtcccttccgccgatttggccatttttctgtcattgccaaacgaaacccaattgttctcatccccggcgacgggggaagtcggctaaaggcgaatttgacgggcaaaccgtcggtggtccattacttttgccagcgacagaccaacgatttcttcgcgctttggctcgatttgcaacaatttggcccttttgtcatcgattgttgggccgacaatatgcgcctcaacttcaacagaacgagcggaagggcgcaggatttggagggagtgaaagtgcgagtgcccggctttggacacacgcgaaccgtggaatggattgactcctccaaacggtcgccgagccgttacttcgcgcccatcgtcgcctccctcgccaaattgggctaccaacgcggcatcgatgtcatcggtgcaccgtacgactggcgaagagcgcccgaggaactccttcattattttgttaaattgcgttcactgattgagcaactttaccacgcaaatggcaaccgcaaagtgatcgttttggcgcatagtatgggaa

SEQ ID NO: 87675 - DNA, 711 bp, Heterodera glycines
  SCN-specific regions: Sequence locations=1-711
gtgaatcgtcggcagagattgtggagggccgagctcagcccaaagttccaatcgtacgacgaagccatcaaatggcgaatgatgggcgtaaaccacgtccgccattcgaccaaagccaaaaaagtgttggggaagacgcgctttttggacttggatttgcccgaatctttcgacgcccgccagcgatggaatttctgtccgtccatttccctcatccgcgaccagtccagctgcggctcgtgttgggcattcggcgcggtggaggccatgtccgaccgaacatgcattgcgtcaggcggaaacattcggatcgctctgtccgctgacgatttgctgagctgttgccataagtgtggctttggctgcgacggcggcgagcctctgcaagcgtggcgctattgggtgaaggagggcattgtgacgggctcaaatttcaccgcccacggcgggtgtcgtccctacccattcccaccgtgtgagcaccacagcaacaaaacgcactacgagccgtgcaaacacgagctttacccgacgccgaaatgtgaacgaaagtgtcagacatcgtacaacaaacgcgaatacaaggaggacaaattttatggcaaaagtgcctatgccattgacaattcggtgaaagccatccaaaacgaattgttcgtcaacggaccaattgaagtggcattcgaagtgtatgaggactttctgaactac

SEQ ID NO: 87676 - DNA, 561 bp, Heterodera glycines
  SCN-specific regions: Sequence locations=1-427,449-510,555-561
taattttactcctccgccaaaatgaaaagtttccatttgtccattgttgtgacactttgtctactcattagctgcttaaccccctcctcgtttggctatgatgatgatgatctgttcgacattggcactgctcagtccgttgcagtcaccggcattttgacgtgcaacggacggccaagtggcggcacaaaagtgaaactgtacgacgtagacacttttgacccggacgatttgatggccgaaggctttacggacgaaaagggacactttctgctggagggattcgaaacggaaataagcgacatcgacccaaagctgaacatttaccataattgtaacgacgaacactttccatgtctgcagaagttctccattgaggtccccgacaattacataaccgaaggaaaacgaccacaaaagatttttgacattgggaaattgaatttggaaggcaaattctcgggccaacatcgagattgtattaattaatcggacattttgttgaatcccaaattttaaatttataaaaattgtgacataaaaataaaataatacaaaatc

SEQ ID NO: 87677 - DNA, 497 bp, Heterodera glycines
  SCN-specific regions: Sequence locations=1-442,469-497
caaaatcgttgaatctctacgtgaatattccacaaagttgactgcattttgaccagcggtggaacagggttctcaaaaagggatgtgacgcccgaagcgaccaaagaagtcattgagagggaatgcccaggaatcgctgtggcacttctgaagaaagggcttactcattacgccattcgctgctctcacccgtctcaccgcgggaattgctgccaattgtctgattatcaatttgccgggaagcccaaaagcagtgagagagggatttgaagtgattgagccgattctgagccatgcgattgccattgtgaagggggatgagagcgaaacttcagttttgcacaagagaacggcttaataagacagaagagactgtctgtcgataagcatttgatatcctatgtatgtgagaaccaattttaaactttacttcattactatgtaccattttgaaaaataaatctttaaggtgacacaaatcaaaaccaaaaaaaaaa

SEQ ID NO: 87678 - DNA, 108 bp, Heterodera glycines
  SCN-specific regions: Sequence locations=1-108
tggataccgaccgccacggccaagaattatgtataggagagcgaaagcaccactgggcacgtcatcattgtaaacctcgacggacatatggttggtgggaatacaatc

SEQ ID NO: 87679 - DNA, 612 bp, Heterodera glycines
  SCN-specific regions: Sequence locations=1-587,610-612
cgatcggtgtccaggacgtgtcctcaaatggcactccgatgccatgtgccaatactttcaatgaaaaggtgccgcttggctgtcgactgtccggtacgattgtgcatccaccagcgactcgtccggctcctactctcagtgtggcacgccgcccatggccgacgcaatgcaacagcagagaacagccttgaccacagagagagggggtctgaattatgtcatttggtggcaccgatggaggactggcgcctgtcctcttccgcctccacttcctcttcatccggacatcattctgacagaccatccgaagttgctcatcacgtcccaaatgccatcacataataatcaccagggtcctcctgttttgagatggcggtcaaatgcgggaaaaatggcaaagacagctgcggaaagagacagcacttccgcacatgctggaagcgtcgttcggctgcatcgaccaccacaggcatcaccacacgatccacgccctatttcccttacgccgcccaccaccaattgcctccgggcactgtcattccgtttcggtcgagcattcagcacctgaagcattggcacggaggaagcgatgccgatgatgatgacgacttg

SEQ ID NO: 87680 - DNA, 657 bp, Heterodera glycines
  SCN-specific regions: Sequence locations=1-176,200-235,265-375,418-657
tcaccccccccctcgtttttctctctttttcctcctcgttttttcgagagtctcggtcttttttttcttgttctaaagtttgctctcgagtagtattcgccctctcttcacccaaatcctctactataaaatctctcctctctttgttaggtggttgagtatttgtacatgactttttcttggatgatgggcgtttttgtgttcgcccttctgttgggacaaatccgtgacattgtgtcaaatgcgaacaaaaacaacgaggaatttcgcaccacaatggacaaagctttatccgagtgcaagcgactcgacttgcccgagcatttgacggcacgggtgaggtcgtggtttctttacacgtgggagagacaacggacattggaggagaagaagctggtggagaagctgccattgaaattgcagacggacttggcactgtccgtccattacagcactttgggcaaagtgaagctgttccaagacgctgatcgggcatttctgcgcgatttggtgcttcgtctacgtcctgccattttcttaccaggggatatgatttgcagaaaaggggacgtgggcaaagagatgtacattgttaacaacggcattttggaggtggtcggcggtgagcacaacgaattggtattcgccacccttgcg

SEQ ID NO: 87681 - DNA, 781 bp, Heterodera glycines
  SCN-specific regions: Sequence locations=1-382,404-781
gtggtggacggcgcccgaacttttgcgagaaaacaatcggacgggcacaaaagagggcgatgtgttcagttttacgattatttatgtggagatggtgaacagagagacggtttggaatgggacggagagggacgacgacgtggacgaaatcctttatcggctcaaacgcaccaacaacacaatccctcaccgtcctcagctccgcccccgcgaagacaccaatcaaagtttggtccatttgatcagagactattgggctgaagtgccggccgaacgcccgcgcatggatatggtgcggacgatgcttaagcagatggtccaggacggaaaccaaaacctgatggactacgtgttcggcatgctcgagcagtacgccagttcactggagcaggaggtggaggagcgcaccaaagagttggtggaggagcgcaccaaagagttggtggaggagaagcgcaagagcgacattctgcttaatcggatgctgccgcggcaggtggcggacaaactgaagctgggcgaggcggtggagcccgagtccttccaaatggccaccattttcttctcggacgtcgtctccttcaccactttggccggcaaatgcacgccattacaggtggtgaatttgctgaacggactgtacaccgcctttgacggcatcatcgacacccacgactgctacaaaattgaaacaatcggcgacggttatttggtgtgttccggcattccgaagcgcaacggcgaccaacacgcgaaagaaattgcggaactttcgttcgct

SEQ ID NO: 87682 - DNA, 542 bp, Heterodera glycines
  SCN-specific regions: Sequence locations=1-13,36-67,98-542
catcgacgaaatcgacgccattggaaccaaacggtacgattcgaattccggcggagagcgcgagattcagcgcacgatgctggaactgctcaatcagttggacggctttgactcgcgtggcgacgtcaaagtgctgatggcgaccaatcggatcgactcgttggacccggttctatccgtcccggacgaatcgaccgcaaaatcgaattcccacttccggacgaaaagaccaagcggaggattttccacattcacactgctcggatgcaactggaaaatgtggacttggaggaatttatagcagccaaagacgatctgtcgggagccgacataaaggcaatgtgcactgaggcgggtttgcttgcactgcgcgaacggcgaatgaaagtgacaatggacgacatgcgaaaggcgaaggaaaatgttctttaccggaagaaagacaacgcacccgaaacgatgtatctttgaagggttcccaaaattggaatttgtgttgacttttattcaatgaacggtaaattaaattaacagaaaccaaa

SEQ ID NO: 87683 - DNA, 118 bp, Heterodera glycines
  SCN-specific regions: Sequence locations=1-118
ttcttaaagtgatccaacgagttccgccatcactcatttgttcgccaaattatttgatgacacaattcaccccggaataagggacacacaaatagaggacgcattgctccgaaaaagg

SEQ ID NO: 87684 - DNA, 756 bp, Heterodera glycines
  misc_feature (726)..(727): n is a, c, g, or t
  SCN-specific regions: Sequence locations=1-205,227-543,565-662,684-756
caatcccttcctttatctgcacaaatcaacatttgttcgccgttaattctgtgaatccgaacgcacattcgcagcaaatggccatggaaacattgggaggcggcgaagaacggaacaaaatggagactgaaatggacgtgtcagttggagaagaatcgcctcatcagcaacggtttctggaagaatgtctgaatttgagtcagaaatttctgaaggagatgagtaaagacgaagagcagcaacagaatgtaataaatggcgaggcgaatgatggcaaatcggacgtggcaaaagagttgctgatttgccattcttcctctcccactgcatcgcctcaaccgagcggatgtttcttaacgtccgccaatgtcgtagcggaatcggacggaatccttcgggaacagaacagaagcggagaagcggacggacaaagcaccgccgcaacgacaccgaacgcatcgcgaaggccgagcaattcatccgctgccgcggtcagtggaagcgttgaagacgaattggccaaaatcaaagtggtcttacgacagcacgagaggaggatccgattgcttgaggaccaattggcggatgccaacatggccaatgcttatggattatgaaaattaatacggacagaaatattgtgattgaagaaatgacgaaaggaaaatatttgaaaatttatagaaaagaatgcaatttgctcatcacaaaaaatggaatatccgnncagcttttgtaaatgagcttcaaatgttt

SEQ ID NO: 87685 - DNA, 706 bp, Heterodera glycines
  misc_feature (704)..(704): n is a, c, g, or t
  SCN-specific regions: Sequence locations=1-57,79-706
aaccggcgccgtcgtcagtcgattatttcttttggcaatcggacgaagcgtcgtcatcttctgtttgtgcagaagaaagacgacagatgtatgaacaatacggcggacaaaagcaaatgagacggaccgaaaatgacaaaaacacggaacaatgccaacggaacgcccagcggaacatcggcgaaagaatgccaacgatggacgacaacaacgaccaacagccgtcgatgctgcgaagaatgcctttgcaatcgatggaaaacgcatcgctactgaagtcgtccgaattttcctcttccgaacatttttctgcttgcaaaaaagaacccatcgaacagagcgaagtcattgcgccaaagaatcggttgggtccaccagcgcattggcgagtggaagaaacggagaagagacagaaacggagtgcgaaaagggcaccacttcccagacaaacgacctaccaaatcgacgagcacggcagacaggtggtcgttgtgaggaacgatgattcatatcggtcaaatgacgaagacgacgagcggacggaaaacgcagagcgcggagtgccacccatcgcgcgcaacggatttgtgaagccggcgtattcctactcgtgtcttatcggactttcgctgaagaacagcgacacgggcgaactgaccgtgtcggagatatacgcatttttatgttatcactttccttacttncg

SEQ ID NO: 87686 - DNA, 139 bp, Heterodera glycines
  SCN-specific regions: Sequence locations=1-108,131-139
tgacggactggctgcctttccccttacgatgaactggctgttacgcggccgggccgggtgaagttcgagaagggcgagcccttctgcttatcaatctggtcgagcacaagaaggtcgagcagttccagccggtgatccg

SEQ ID NO: 87687 - DNA, 205 bp, Heterodera glycines
  SCN-specific regions: Sequence locations=1-1,35-45,149-149,177-205
tgtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtcc

SEQ ID NO: 87688 - DNA, 668 bp, Heterodera glycines
  SCN-specific regions: Sequence locations=1-158,183-608,631-668
atttgcttatgctctttccccgcccatcggctggcgtcggaatggattttggcccatatctgaaattgaccgccattttcatcgtcctctctacttttgggctcggcttatcattggcccacatgaaaaaaatgctgcaaatcggcaaagaattggccaaacaaaacgaaacgacaaaaacagcgtcggccacttttgttggacaggacaatttgcgaacacttcgggcattcaccgggtgtcaggccggcctttccgtactttccatttatgtggccgcctcattagcatttatgaaattttggtatgtgcgtactcatctcgtccaggagttctcctgctctttgatggccattactttggccgttgtccaattttttgtgcttcgaatggccaatggcggcggattacttctgatcaaaggaattgttttggccaatgcgtgccaaattgtccaggaattgaacatgtctctgtccgccttttacacctttttttacgcgggtcggatttacgacgcggttgaggagcgcacttcgttcttcactggtccggagagtgcgcatgttcgcttcgcattgtcccgagtacaacacgccaaaacctttctcttcctcagtttgttgttccatgttggccggatgctgttcaatgccttcgtgttgtgg

SEQ ID NO: 87689 - DNA, 560 bp, Heterodera glycines
  SCN-specific regions: Sequence locations=1-138,160-375,397-560
actgttttgcttctttcctcactttgtttctgcttagccatttttctcgcgatgactcatcggcaagagttgagctgaaagtgacgtcttcaaacggaatgcctttgtaatggaggataagacggatctgcgcatttggatgaacaaatatggaaatgtgttcgaatttgctcttacgggttccgcaattcctctcgacgaaaaataagcaacatccaccagtccatctgccttggagacaagacaaaaagccgaagttgaagtaaatgaatatttgcgggatccaaaaattaaatccagggccgatccatcattatactgggaagtcaattcacaaaaatggccaatgattggtgacgttgtacggaaatttctttctccacctgcaacaagttcagaaagtgagaggcttttctcaacggccggtctaatttcagatgacttgcgaaagagtttattaccagaaaatcttgcaaaacttttgtttcttcatcacaatttgcttttaaccggtttctcaattgaatgattttgcttttacaaatttgctttcaaaaaca

SEQ ID NO: 87690 - DNA, 381 bp, Heterodera glycines; identical to SEQ ID NO: 86763
  SCN-specific regions: Sequence locations=1-219,241-360

SEQ ID NO: 87691 - DNA, 740 bp, Heterodera glycines
  misc_feature (624)..(624): n is a, c, g, or t
  SCN-specific regions: Sequence locations=1-359,381-740
tatcgtggacgttacgtcaattggctgaggttgctatgaatggtcgaaagaatcgtttgttcatgtcaatgcgaatttgcaagaatattaaggaattgttggggaagtttgaggggcacgtgccagcgtcggaggaagtgaatgggaaagcggagaatgtgaccattcaatctgaatctatcgtgaccgagagacttttatattacatcgaccttcgcgaaaatcggcgtggttcctttttgcggattactcagctcgagacgcattccgggattcgcaactcagtggcattgccatttgaggggatcggccaattgcacgatgcactggactcaattctggaggaatatggcgaagggttcattgaggaggaagccgaacttccccattctcagatgattcgtactgatgggaaaagctttttttttgatcctggccacaattctcgcggggactttctgaaaatcaccgagttgaagtcattcatgggagtgcgcaattccgtcgtcctttcaatcagagcaattccgcaattcactcaagtcctctccaagctctacgatgactttcaggagctcagagccgtagaggaagtgaacgtgaacaatgtgcttaagaaggagnccgccgaagaagcgatcaccgattccaacgaagagtcacccaaaaaagagaccaagtccactgattgatattgagacaaattaatactcattcttattggaagacgattaatgttt

SEQ ID NO: 87692 - DNA, 591 bp, Heterodera glycines
  SCN-specific regions: Sequence locations=1-567,589-591
cgcaagcggttgatctcctgctttaactgtaccgacaagcagagccgcggcatatttcggcatgttcgctgtccatccctttttccagcgtccggacttggcaagcgattgttgactgttgctgaacgctatgcccgtattgtgtggggcagtgacgagatgcatttggatgttggctggagtttggccgaattaaagttgggcatgggacgactgcagagatactacaagcggcgcgggttcctatcaaccggcattcttcgccccttcaatggggctgtggcgcgcttcatcacggtagaccgaaacgatctgtggattgagctgatggtcaaggacatacgtggagcattggatgacatcggcggagatccagagaaacggatgaaaagagtgaacagtcgggggagattggccagagaagcagacaaagacgacggcggcagagatccacaaaaaaggatggaaagagtgcgaagctttgggagattaaccatagaagcagacagggacgacatcggcagagacgcgcaaaaaaagatggagagagtgcgcagtttagggagattggcaagagaagcagacaaatcg

SEQ ID NO: 87693 - DNA, 506 bp, Heterodera glycines
  misc_feature (15)..(15): n is a, c, g, or t
  misc_feature (159)..(159): n is a, c, g, or t
  misc_feature (187)..(187): n is a, c, g, or t
  SCN-specific regions: Sequence locations=1-332,354-506
agacgagaaagccgngccataacgacgacgaaaaccatggcaaacggatggtacaatcggagcccagaaagccgtgccaaagacagtatcagcaacaccaaactccggcctcggccataaaatcgattctcaagacgccaaacggtggagacataaacncgaatcctgtaactgggcaacaggtggncgttatcagagaaaacatttcggaccgggacagaagcgccgcgtcagtttcggcccacaatcagagagcaatgacagcgcgaccagaaagcacaaaatgccgaaagtggaagtgtcgacagagcaaatgacgacgccgaaagccgggcagcaaaaatgccagacaaaaatgaacggaagcgcgtcatccggcaaagccataaatggaccgcaaaagaaacttgccgaagaacaaaacagagcgccgccacagcgctcgaacatgccgaaaagcgggggcaacgccaatattggcggcggtgccgacccaacaccgattc

SEQ ID NO: 87694 - DNA, 526 bp, Heterodera glycines
  misc_feature (169)..(169): n is a, c, g, or t
  SCN-specific regions: Sequence locations=1-363,386-526
ttttgccgcattatcggaacccgggccaagtaaagtgcaaacagtgcactttgccatgtttgctgtgggagagggaaagccacgcgacgaaacgggcgattgacggagtgttgcgcgaggccgagcaaatgggcattgccttgaccctttggagtgaatccttttagtngtgctttggcttttgccttttctgcctgatcaaaccggttgttttctgtttgagtgttccttttgcccatctccccccccgccaccactccgattggatgcttacttttgtttgcgagactgactttgtacaattccaacgggacttatgtaccatgggcctataagagcattatgctgggtcctatttataaataacagtatcactgattatgcaacgtgacatgatggcaatgaaacacattccatgtaaaaataaactggtgagagcggctgtgcaaaacagcagactgttcttccacgacgctttgtccaaaccatccttttggtccaccaaacgcccaccgttttgtacgtg

SEQ ID NO: 87695 - DNA, 702 bp, Heterodera glycines
  SCN-specific regions: Sequence locations=1-394,418-487,509-702
caattgaaaaaccgaacgacaaaaacggagatgcatttgaagacggaagtgaagagaaagacatggcgattccgttgttgggcgagggatcggtcggatcggcaaaaagttcgccgagaaaggcaaaggcggcggagggcggcggcactttgtggcgaaagcattctccggcgatggttctccgtcgtcgcaaaacttcttccgcctctttacgcacttcagcttcgacggatgtgttacaaatcagccaaatgcaaaaggaattggacgagtccgaagttcgtccctcttcaattggcaagattttccgcttcaacaccggcaattggcacttggctttcgtcggtctcatcggctgttccatcagcggattggccgtccctttctttgcgcttgtttatgcccaaattttctccgtgttcagtgaaccgttggaccaattgcagtccgatgcccttttctgggctgccatgttccttctcgtcggctttttgaatgcctttggctttttcatttcggccaatatgttgggccgttctggcgaggctttgaccaaaaagctgcggacggaggcatttcggaatttgatgcgccaagacaccgctttctttgacgacgaacggcacagcacgggcaaattgtgcacgcgcttcgccaccgacacgcccaacgtgcgctacgttttcacccgtctaatggtgg

SEQ ID NO: 87696 - DNA, 700 bp, Heterodera glycines
  SCN-specific regions: Sequence locations=1-491,514-700
tccaaacggccttaccattctgcttctgatcagtgttgtgatcggccattccttggccaaccttggcccaaccatcaaacataatcctcattttaaagccgtacaaactgcgcatcatttgcatgatgccattgcgaagaagcacgaggccgaagttacgcagatcatttgtttttttagcaacgaacagcgtcaagcattggctttggagttcaaaaaacaattcggcactgatctgattgccatgctgaaaaaggagttcaaaagcgactttgaagaactgatcatttctttgatgcaaacgcccgccgtttacgatgccaaccaaatgcgtgccgcattgtccggctccaatgaggcggtgctaatcgaaattttggcgacgcgcacaaaccgacaaattacggcgctgaagcaggcgtatgagcggttggacagaaggcatcagcacaatcagttggaggaggacatcaaagcgaagacgaagggacccttccaaaatctgttggtgtctttgctcagctgctctcgcgaagaaagtgcgcccgcaagcattgtattggcacacgacgaggccatgaaactgttcagagagggcgagggccgacggggcgttaacgccgtggtgttcaaccaggtgttggccactcgcagcttcgcccagcttcgggaaactttcgagttttaccgacaagccacg

SEQ ID NO: 87697 - DNA, 317 bp, Heterodera glycines
  SCN-specific regions: Sequence locations=1-317
gaccgcgccgaacatgacgccggcaccgcagaagaacagggcgacgcctgcgaggcccgccgacaggcccgcccaaaggagagaaacgagttttttttttttgcagcggcccggcctgcgggcgaagcaagaagccgagcggggccacgccgcacagccgagcggagacgccaccgggcacgcagaggatctactcgccgaccagaccgacgaacggcatgcaggcgaacacttgattgaagaggtcgacgagccgacgagcgcccggtagcgggtaacggcggccgatatcatagaacaagacatacactctgttc

SEQ ID NO: 87698 - DNA, 513 bp, Heterodera glycines
  SCN-specific regions: Sequence locations=1-478,508-513
atgacgtaaggagatcggaaggatgaaatgtcgccgcatggaagagcaaccggacgaaattagacaacaggccatcacagaattcattggagggtgtccgccggaattcacccagatacttgcgcatattgatggactccagttggaagaccggcccaattacgagatgattgagacgatgctgcgtgagcacctcacccgaagccgtgttccggagcacccgtacgactgggaagtgggaaggcgcaacgcgatggcacaagcgcagagtgaggcagcgaggaggaagaaggataacacgaaagaaggcggaggaggaaaaaacaacacgcaaggatgagtccggccctggtctgatcgtatttgctcgccattgtacatattactgtgcctgtctgatcataattgctcgtcattatacataatatgctgtgatcagttcttatttgtcctgtcttaaacttatcattgacttgtgataaaattttattgattaaaaaaaaaaatggcgta

SEQ ID NO: 87699 - DNA, 315 bp, Heterodera glycines
  SCN-specific regions: Sequence locations=1-168,202-293
gtgaattcgcttttcgatgttgcacacgcaaaaaaatgaagacggaatcaaacaattcttccaggaaatttatgagatgtacatcaaattctcgatgaaccctttctatcgacaagacactccgatcagatcgccaagttttgagcaaaaagcggcgatgtatggacggaagtttttaggggtttaaaaaagaccttggaaatttaagtttttgttgccatcagatttgtgtattttttgcattacattattttatacgggtttaaatcttaaataaaagaattcgcttttagaaaaaaaaaaaaaaaaaaaaaa

SEQ ID NO: 87700 - DNA, 639 bp, Heterodera glycines
  SCN-specific regions: Sequence locations=1-9,31-167,207-469,491-612
tccgaaaacggaagaggcacaaaaggaagaagcaaagcccagtgccccggccgtcttaactgaagctgccgataatgtgaacaaagcggtcgatgacttaagcgttaaacaggcaaaagcattgaaaaacgcggccgaagcaacggcagagaaaacgccggaagaacaggaaaaagcattgaaagaagtggcagaaaaaggaggaaacgaacagctgaagacggctgtcaacaaaattttggaggcaaaagcgaaaaacgacgcggaattggaaagcgaagtgaaaacgaaaacggcaacactttctgaggacagcaaaaaggccagcgcagagttgactttgataattgaagacaaaaagacgactttggacgagaaggtgaagcggacggaagagctgacagccaaaatgtcggacaacacgaagaaggagctgaatctgaacaacagtgccgacgtcgtcgccttcgtcaagtcgtactccgccgtcgccgtgccggcggtggccacggagggcaaagcatgatcaatcagtctgatcggaggattcggcattgttgtgtgatgaaatgtagccaataatgaaattcattgattaaattaattttcgctaaaaaaaaaaaaaaaaaaaaaaaaaaa

SEQ ID NO: 87701 - DNA, 718 bp, Heterodera glycines
  misc_feature (587)..(587): n is a, c, g, or t
  SCN-specific regions: Sequence locations=1-24,46-136,159-555,577-718
ctgtcaagagttttttcgccggtgcgctcaagaaagtgcagattctgaaggacactttcctgctgcacagcagacagaagatgctgttgctgaaccgtcatgaggagaccatgaaaatgttggccgcccaggagccgcccgacgagttcttcgaggagtttgaagtgcagaccgtttatgatgggacttgcaattggaagccaaggggccaacatcagcagtgtgcgcaagttggaaggtgtcaaggaaattttggttgacgactcgcaacgagcgcagggcttttgcaagattaagatctatgccatcaatccggagattgctgaacaggcgcgcaacatgcttgagtttttgcaaaagcatgtcaaagtgccgcatgacaaagttgggcagatgatcggcaagcaaggcaaatcgattcaggacattgtggacaaatcgggcgtcgtacgcgttcagattggcgaagaaaatccggaacatggccttgtcgacttcaccttcaccggcacgcgcgaatctattggcaacgctgaactgatggtcgagtttctgctgaagcacatcaaagaaatggacgaaattcnagaggaggaggaggagtgcaagcgaaaattgttcaactctcggcactcgcccttcacttacccgaacagtgggtggcagtcccatcagcagttgaacgccagtcagagagcatccatcaatgggggtggtg

SEQ ID NO: 87702 - DNA, 377 bp, Heterodera glycines
  SCN-specific regions: Sequence locations=1-377
gctttactgatggaaaaagaggaggaacaaacctgtgaggaagaagaatgcttatggggcataaactatggcttagcgcatgtcctattgggacggcgacccccactgtgccgagcatctcttgagctggcgctcgaattgggtcatgacaccggactgtctaaaccaccaactgattggccatcgaagaccaacgctagttcgaccgaggagaggagtagcagcgcgcatttgagcagagcggagccaccaccggactacaccgaatgcacgtgatggacaaccgacgagaaggctaccatgcgaaaagtcggtcgatatgaagacccagctaaccctgctcaactggatcaacagcagccagttcaaccatttcg

SEQ ID NO: 87703 - DNA, 695 bp, Heterodera glycines
  SCN-specific regions: Sequence locations=1-150,172-217,239-563,585-695
tgttatctcgtccgcttctattcattgccgcccttctcttcctcttcggctgctgtcgtgcggatggaaatgttgtgcatctgtcgagcctcaattgtgccacaaaggacggaggaatcgatggcttcaaagctgtggacgacggtctgatcttggattcctcatctgtcaccgctgattcgtctgacctgcccctcatcggtttccagaagaacggaaaggaggacttgatcttcaaactctttgtgcgcgatggaggatgcgtctcaaaggccaatttcttcaccaacggtcaaccgtgtacactcggagagtcggaggacgtgactgagtccgataaatgtccgggcgagggcggcacctccagctgcacatcccacgaagtcacctgtacgggcatcggaatggcgaaggtcgcggaggagtccaatggtcacgccttcaaagccaacctggacaatctcaccaaacttaccaatccgtgcgcgcaatggaaggcacattttggcggtgttcatcaagtgctgaatggttcttccagcggagagaagtgcgcgagtgcaagattccccgtctggatcattgctgagatcgtcatcatcgctttgttcgtcattggtggtgcggtgactgcagaggttgtgatccgtcaacgacaagcagcagcgcaaccgactctggaaactcctgcaccg

SEQ ID NO: 87704 - DNA, 744 bp, Heterodera glycines
  misc_feature (627)..(627): n is a, c, g, or t
  misc_feature (739)..(739): n is a, c, g, or t
  SCN-specific regions: Sequence locations=1-184,218-435,477-744
agaacaagaaatttcgcgcagcgaaatcaacgaaatcaaagagattccgcgcaacgaattcaaaacggcgccaatcactgagagccgtgaaagaccgttcattaaaagcgaaatcatccgcgacatcagctccgcaatgaacttcttgaacgagcaaatccgggagtactcggaacgaaccaaggacagagaggaattcaagggcatcattgaggccagaaacaaactcgagacggccatcaaaccattgcacggagtgatggagtccgacatggcttcttcgagcctggagacgtcgatgaccaactcggccaacatcgcccgacaagccctggaggagttgcccgtgaaacaggtccgacaaatggaacaaattgcggaggagggaaagagcaaaacggtggaggagcaggagagggcactgcgcgagtacgcggagaagaacagcgaaagtgtgaagaaggctgttgaccaagtgtccgtcgccaaggaccgggcggacatcgctttggagacgtacttgaggagccacgctgacaccttctcccaggaggcgcgaaaggccaacgaccagatgctgttcgtgatgaaggacaagaagctcaactcggaggacaaagtgcgcanattggaggagtgggccaacactttgccggagaatgtgcgcggagagctgcgcgtgcgtgacttgcgcgagctgaagcagctggtgcacctgtacaacggactgacgcccgtnctgca

SEQ ID NO: 87705 - DNA, 326 bp, Heterodera glycines
  SCN-specific regions: Sequence locations=1-296
gtttggacccgagcggataaattgggcttatggcatgagtcctgaaattaattccagtgccgaaccaccaggaaagcaaagtggctgaagagtgtttggaatatcagaaaaaattcgacaaaaagataaaccaaatcgcaagtcattggcacggcgtccgcgtgagcgcgccgaaagcatttggcggcataatgatcgaattgtcaatttcaaaaggaaagtacaatctgagcgacacccaaaattttaacattgaatttggaaatccgaaagatttgatgacaaaaataacggacaaaaaaaaaaaaaaaaaaaaaaaaaaaaaa

SEQ ID NO: 87706 - DNA, 567 bp, Heterodera glycines
  misc_feature (544)..(544): n is a, c, g, or t
  SCN-specific regions: Sequence locations=1-83,105-348,375-465,489-529
gtgattgtgagaacatccgcgtcattgactggattgtgcgccgtttggacaacacagcgaacattggcattgaatctgccatcggcacaattccaacccgagaatcgatgcatttggaaggacttggcaacatcgactgggaccagctgatgtctttgccggccgactattggcacgaggacgcgaaggaagtgcgcaaatttctcgaggaacaggttggcaccgatttgccggaacaaattctgtccgagttggaacagcaagaaaagcgtatcatggcattatgagggatggacagttgatggagatgagaaatagagaaaattgactggaaattcgcattttaattacctaattatttatttattttacatggacatttcgtttcttaattttgtggggacacttcccccccccccccgaaatgtttaaaaaaaaataaattttccgttataaaattttttcttgtaaaatattatgatttctttcaaaactatgtatttgtttccgctttctttggttttttaataaataaaaaaagccnaaaaaaaaaaaaaaaaaaaaaaa

SEQ ID NO: 87707 - DNA, 797 bp, Heterodera glycines
  SCN-specific regions: Sequence locations=1-121,143-797
gcaaaatccgttgcccacaaagtactcggattacgacgcattcatatcatttacatcgatcaaaatgtcatcgcttttctccgcctttttaccgttttttcgccttttcttaatattcttgttcatcactgaaaatgttcgcattttggactgtgttttgctcaacattttgccaatgtttcgcgactccattgatgtgttgtttttgaataccatcgcttttcgtcgtttgcgtcaattggccccgtcacttctcagcgattgtccatcacttcgcagtgtctctttcaatgatgccattctgcccgcttttccgcccgatgacagtgccaatgcgtcggatggccaagcggtggccaaatggttgttcacccctcgtccggatggtctgccgaaggagcttcaatgctctgctaatgcaccggttggtcaatggtcgtcaacgatggaacagattaaagcggcattttccaatgcttcttctccggttcctttttgcattcacttttggtcctcttctccacctgactccgttgtgttatttgatcggatcaacgaagtgactggggaggaattggcacttcaacaagataatgcacatgattgttgcctcttccgtttgccaattggatggggtacaagaaaatgggacaatgtgtgggaagaaatgattgctcgacagaacccaattgacattcggatcaaagatggcggattcgacggacggtcttcgggacgccccttctcccgggccaattgatcactaatcaacagcggaagaaatgaatgaattaatt

SEQ ID NO: 87708 - DNA, 798 bp, Heterodera glycines
  misc_feature (738)..(738): n is a, c, g, or t
  SCN-specific regions: Sequence locations=1-29,52-531,553-798
gtggggtgattggctggtgtatcggagcgtgggtggggccacccattccatgttggccgacgaagacggtgctggcgacagcagcagtgccgttgcacccgttgcggaacaacaactgccagtgctcatcggaatgcgcggacaacgcatggagacggacagctttccctctggctggggtcgcgtcgaaaccgacactcttgacacattcttcgattccagttggtattatttgcgttatttggacccgcacaattcgaatgcgccgttcgacccggacattgtcagcaaacacatgcccgttgacatctacattggtggcatggaacatgccaaggtgcatctgttctacgcccgcttcatctaccatttcttgcacgagcttggcatggtgcccagccgtgagccgttcgcgcatttcattcagttgggcgttgtccgggcgcccacctacaaattgcctgacggcagatatgtgcccgactcggaggtggacggcaacaaaaaattgcctaattctcggctggtgcacaaagggagcggccaagccgtacagaaggagtttgagaagatgtcaaagtcgaagcataatggcgtggatcccatgggtgtcatcgacagctatggtcttgacgagacaaggatgcaattgttgatcgaagcgaggcccaactatcagattgattggccctatccgtaccccacatttcagttgaaaaccatcaatcgatgggtttntgcgtgtgcgaacagtggtggacaattatgtgacagaacgccaacgggcattgtcaatgg

SEQ ID NO: 87709 - DNA, 797 bp, Heterodera glycines
  misc_feature (733)..(733): n is a, c, g, or t
  SCN-specific regions: Sequence locations=1-347,371-797
gtgaaatggaaccgaaaaaccgttgctacgttttgacaagaattttccgatcaatttccttttggcccatttttggatgattacgccggactttggctgctcgggttggacattctcccaaaatttggaccgaaaacaacaaatatttcaatggaaaagccgaagaattgccaattggagtgtgaaaattattcctactgtaattgctcacgattcttctgcgtgtgttacatttaatcctgccaaactccccggggcgttaggacttcgcccgatgatggttggtggtttccctatcgacataaaaattgcgccgtggacagtgctatttaaaggctttaaattcaaagggataagaaaaggaaaaagtgtagaattatatggaacttgcgctagcacattcatttcgccagaatttgtgctgttagccgcgcattgttttgacaatgtgacggaaggaaatcccttttatttggtgcacaattcaaacgcaagtaatctttcttctagcaagaagagtaaaaaggtcataacaagccatcgccacgatcagaagaatgtgttccttcaccccaaatacgaccctgtttcggaccaatcggaatcacagttccacgacatggcacttattaagctttctcgcccaatggcgcgggttcagccaatttgttttcactgtgccaaagttgataggtttcgcaatggcactgcttatgtcatgggctgggggcangagacaaatgattgtgtgggcttaacgaggcctgccaaaatgttaaatggtcgcccagtgaaaa

SEQ ID NO: 87710 - DNA, 651 bp, Heterodera glycines
  SCN-specific regions: Sequence locations=1-135,158-651
tccttttttttggatttgaattactttttaagcccttttttaccattttaattgcttttccttctgctgttttgtttctgcttctgaacaacatgcacacttttgttgttttttttgctgatgtccttcaaattttcatttgctttttcaaactgtgcgatcgaatgaacaatgacaacatcgacaatttggcaaacaagcagctgaacaataatgatcatcagtaattcttacaattattatgacgcctttcttccgccaaacgttgacaatcaaattgccttttttaatgagcatggcatgtcaattaatccgcttctccaacagcaattgagcgtggagaatgaaagcagcggaacatgcttggcaaaaagcagcaatatgatgggtcaccagcagcagagattggcaacccatgccaacagtttgaccctagcaaagttggcaacaaatgccaatcaaatgatgggcagtcagcacggattaaccacacatgccgaaaacaaaagcggacagagcaaccgaagaaaggcaactgcttgtgcttacaatagtgccgcccaaaaagtggagatgaaacgccaaagtgcacggaagccaaaaaagtcacgcaaaccgccaccctttgtggtgccagtggacaaaaccaac

SEQ ID NO: 87711 - DNA, 124 bp, Heterodera glycines
  SCN-specific regions: Sequence locations=1-124
gtgattcgcccttccgttggcattcactctggttttgaacaagattacattcgatggctcgacgaacgttctaacgtcttttcgtcgatgatttcgacagggaaatccccgctttccgcctgct

SEQ ID NO: 87712 - DNA, 797 bp, Heterodera glycines
  misc_feature (791)..(791): n is a, c, g, or t
  SCN-specific regions: Sequence locations=1-470,492-797
cctttacgaaatttcccatttttgcccgctgaaaagaaatcgaccgcttaccgggaaagaatcgaatcgcttcccaaagtgcaccaaagcactttaaagaaacttctgggccaccttcaggagattgtctcgcacgaggaccgcaatttggcctcgttggaaaatatttcgaaagtgtttggcccaactctgttcaatgtgtccaatgccgaggaagaaatttcgttggaattgtacaacacggcgaccaaacaagcgattgtgacgcgcgatctgatattttattattgtgacatattcggagtggacgcggagcagctgctggcgaagtgccgaatggacgtcgtccgggaacaaaagacttccaaaaaccctgccaatggtcttctgattcccgtccatttgttcgagcgggacaacaaatgttttaatgtccaatcggaatggacagcttcacaagtggtccaattcaaagttcaaaaattggcttttgtgtcgccttgcgaaaattatgcgcttttcgaaatgatcaaaaaagggcaattggagagacgaattggcgcaaatgaatcgctgagatcgattgtattggggcgatggatgacggacggagtgggaagagcagcagaaggacaacttcctcttgctgaagaaggatccgcatcccttccaaccacaaagtggccgtgcctttgctgaggatttgaagttggctgagcccggctcgcgcactttcaagacggcctcacttcgcattgaggacggagtgcacgtgtgccatcattcacgcngaatga

SEQ ID NO: 87713 - DNA, 705 bp, Heterodera glycines
  SCN-specific regions: Sequence locations=1-3,25-101,130-705
tactttcctccttttccgggcaacgacgcagcagtcgaaacaaccgacgcagaagtgggcgcaacggcaccagtcaaacggcacagtgacaacaccattatttatcatcagcaacagcaacagcagcgacgcatgggccaaatcaatctctgcgacgacgtttggttggacacattggcatggatcaatcgtggagaagtcggcatgaagttcgcgctggtcaatgctcggttcaacactttggtggacaggcatttcgagcagaggaagtggtgctttggcgagtttcacatctgtgagcggatgacggaagaatcgggcgcagaaatcatgacatcgatcgacggcaccgacttcagcacgttgccattgcccaccactccgctgccggacagtgtcgtcggcttccaatcaatctccatttggtacatcaacgaagaggtcatcaattttctgtgcacaattcgccgtctcctcgccgaagacattgcgctggaattttccacttacttcacagaatatcgcagttggaaagtgatggcacgacacatttggccgctgttgcgggatgggatcagcactttgttcctgaagaagtgtgacttggccatgctccgtaaacacgtgtcgcccaccgtgctgttcgactgtgccggcctgcaccgaatccacacgcaaatgctgcccgagtgtccgtctgctgac

SEQ ID NO: 87714 - DNA, 728 bp, Heterodera glycines
  misc_feature (717)..(717): n is a, c, g, or t
  SCN-specific regions: Sequence locations=1-592,621-728
ggtggacctaacggaggacccgcaaacgcattagtacttcggaccattgcacagacggaggcgcgaaggaagcgaatcggacactttggagtgcgagatagtcgacgacagtcgagaaagcgaaagaaattcgaatcaccgcaagccgtaccgcctgccgcgaacaccgacttcattcagacagcccggggcgcaattcggcgtcagtcattacgcgatcggagtgggatgacacttgcacggcttgattcacaacgtgaagggtccgacctgattaggagttggagcaaggaggatgtgtccaatgaggaaatgtctgcgcatcatttcggcaacgggggaccgtccacctctcaccagccgacagcaaatcagcaaagacgcgactcgccgcctaaaagaatgccgaaacaatcgcagcaaaagcagaagcaaatgtcgccagacgagtggttgaagaagttggaggccgaatcgggcggccttcgagacgaagaggaggagcaggcggagaaagacgtgctgaaagggagcgccggggagagcatgcggaagggagcgaaagcacagaaaggcaacggggtgattaggagagatcagcaacagcagcagcaacacgatatgaacggaatgaatctgaagggatcactcggtggacagaatcggaggcggaagaagagctgttgctgcattatttgatcacgccttcgccttctncccaatcgctt

SEQ ID NO: 87715 - DNA, 129 bp, Heterodera glycines
  SCN-specific regions: Sequence locations=1-40,63-129
atcttgttttttttgtcttattatcccattaagacgccacctttttctctgtcacacaaagatcaatagatagcggaaatagttttataaagacatgcttgcgtccgaaacctccggggggggtggctt

SEQ ID NO: 87716 - DNA, 488 bp, Heterodera glycines
  SCN-specific regions: Sequence locations=1-488
aaaattgaaaaatatctaaaaaggccggccaatgacgcatttgttgagggatgtcatcgaagcagcggataatcggattgctgatgctaatgcgcaagccaatcagcgggctgctcatcaggttgctcaagcataaaggcggactgtttattctggttgctcaggcataaaggcggatggaattgtttatgttgtgttcccgtttatttcgacaattttatgagattgatcacaaaatcagcgccgaggacagaaaaaaatttttcgaaaaatactgtgaggttacgacatggatggagcataatgcaggtgcaccatctgtggaagtgactcaaaaaaaagaggcgtttgaacatctgtaccaatcaatcattgacggtgcagtcgggcaacgactatgtcgcgacaacgggttgtgtggcaaggacgtcatccgccaacgaagttgctataaccggttgtgcgcctggaaattcgaagaatgatga

SEQ ID NO: 87717 - DNA, 134 bp, Heterodera glycines
  SCN-specific regions: Sequence locations=1-88,110-134
cgagggcgagcgagagcgttgacgaaaaccggtcggtcatcgtcttgcatccttcagttcctccgcgaacggagctgaacagtcactcaagagaaaagggctgcttgcagccaacgtcggcacccgcgtgggct

SEQ ID NO: 87718 - DNA, 624 bp, Heterodera glycines
  SCN-specific regions: Sequence locations=1-187,209-624
agcgcaacaatgtcttctgacgaatcgacgacttcttctgccagtgttgtgagcgttcagctgcgtgaagtgcccatcacagacttcaaggacgtgcttccggtgctgcacaaaacgctcaacgaattggaacatccgttcatcaagaaggccgaagaaatatgcggaatggaacgtgagaagctcttctacatcacttcctctcttgtgctgctcgtgttgatgctctgccctggcaatatgcttctctctactgttatcactgtggcctacccaatgtacgcgagcttgttgaccctcaacactcaaaacacatcggaatacacccagtggctcgtttattggtgcgtgtgcgccgagttctgccagttcgactatctctttggctctatcaatggccttctgctgctgtacgtgcctctgaagaccggctttctgctctacttggcccttccgcaaacttatggcgctcacaacttgtacgtgaagcatatccgcaaagtgcttgccgtgacgaacgtattggacaagatgaagaagatgttctgatcgagcagataatgtatcactgtgtaatgtctaggatgattctctgttgtgattcctatattatgtgttatgtat

SEQ ID NO: 87719 - DNA, 754 bp, Heterodera glycines
  misc_feature (118)..(118): n is a, c, g, or t
  SCN-specific regions: Sequence locations=1-641,666-754
ccatggttgctttctcgtccttctcttggggctcccttctcccacttttgctcctttccctttgcgtcgtttgctggttttgatagcgttttcgtccctccattctgttccatctcgnttcccttcaataaatgcgtggggcttgaacatacgtcggtgcgtacagcagaatcgtgatccctccaaaaggactccaatgcacaaatgatcagctatgtgcataattgggcttgaaatgctggagttgtgagcgatgcaactatttccatctgagcaggacctgtggctatcaacaattccatgacgtagtctccggacatttgacaggccaagcgctggaattatttaacaacctgtggagcattcgtcacaatgatcaagatactcgccttgacgagtgccaggaaagtcgtgccgctttgaatgccaccggacgggaccacgtccttgaccttctcgtccccattcctcctccatctattgttggccctccgccttccggatgttttcctcggcctccttactcgaagccatttggcgggggatttgggccaaagtccggcggagcaaccattccgggaagaggaggaccacagacaccggagagaagaaataacattggcactgaggagggtgaagagaaaaagtgaaggacagagaaaaagtgcaaagagaagccgattgattgaaaacgtacaatgaaatcacattcactctttcgataaaattttaatccagaaaaaaaaaaaaaaag

SEQ ID NO: 87720 - DNA, 868 bp, Heterodera glycines
  SCN-specific regions: Sequence locations=1-192,215-318,340-868
cgttcggacgatttggcccatcgccagcgccggtcgaccatcgacgaccactccacgcgttggtccaagtcggccagaaggcttttgccaattcatgaaaggggttcgccttgcgatgcgccggagagtgtgcaaaaggcgcagtcgtcggacaacaaatcggaccaatctgagaacaacagcaacgacaaacagcagcacgtggacgagcagctcgagaaactgccacggatggacgagcagcaaaaagacgatgaaatcgttttggttgggtcggcgaatgtttgcgttgtccttccggaagaggcgggaaatgaacacaactgccaaaaaacagctgaacaaccgaatgacgcactcgaaaatgacattgacaaaaaagtgaccgattttcaaacaatggtggaaacgacagaggaggacaaccgaagtggcactgccaccttcgaaagctttggcaacagtgccgagccgacaccaatggaaacgacaatttaccattcggcaaaagaatcctcggaaattggaacggacaatggacttctttcaaaaatggcggaaagtccgccgaaagtgccgccactcactcccccaagcattctgcgaaaagtgaactcccctggtggcaatggcgtcaaaaagattcgacgcgtccaattcaaagaagacgaacttggtcccggcagaattcgttttggtcgctccttttcggcgtcaccatacccaaaacagctgcttgaacatctcgaccaaagcacaagcgaaggcgccgccagtccatcggctggacatgagtcacccgccaagcgaccgatgaaagcgtttcgacagaatttgcccatcgccagcgccggtcgaccatcgacga

SEQ ID NO: 87721 - DNA, 617 bp, Heterodera glycines
  SCN-specific regions: Sequence locations=1-617
gacgttggctggaccttttggctgaggactttgaggaaccatgccacattcgtcgactctgacgactaggaggaggaggattcacggaactactggcatgatgaacatgccgtactaaggggacctttttgcggtgtgcctcttctgccctcactgcacgggagaaactcgcggaaccgatcttacacatgaatgacactccaatttctaccttatcagtttcatccactacaattacatggacacatactaccggatgatatccgtcaacttcattccaaaacaaactttaacactcggactaacgaccaccagacaatggatatccaatgcgttgaagttcccggccaagagcaatgggacactgacgacaatttggtgccgcctgtttgggaatgaccatttgctttggatgttggagagtaggcatttgtagcgagaaatggagcaaatagcaaaacaaacggcgactgaatgtgatgaaccgatagagaaagctgtcactgaaagtgatgtgcgattcaccaaacattaacatgggcacattggtcgaggagtctaagcacaacgccctggaacgggtgattgccgaatatttgtcggatctgacgggcagt

SEQ ID NO: 87722 - DNA, 260 bp, Heterodera glycines
  SCN-specific regions: Sequence locations=1-7,164-186,224-232
cgccgcagagaaggaggaaaagaagtcagaaagcaaggaagcagagaaaaaggagaatgaggagcaaaagcctgctggtaagaaggagaagcgcgccgcagagaaagaggaaaagaagtcagaaagcaaggaagcagagaaaaaggagaatgaggagcaaaagcctgctggtaagaatgagtagctcgccgcagagaaggaggaaaagaagtcagaaagcaaggaagcaggcaaaaaaaaaaaaaaaaaaaaaaaaaaaa

SEQ ID NO: 87723 - DNA, 791 bp, Heterodera glycines
  misc_feature (778)..(778): n is a, c, g, or t
  SCN-specific regions: Sequence locations=1-211,233-665,691-791
atgctgcaaacgcacaaacgtgcaccgcctgcgttggcccacatcatggcacatcattcgccccatttgccggtcggaagtgagctaagtccagctaaatcactcgacagccatcaccaacggcaaatgccactgtttgcggaaaaaaaatatggccaaaaccaccagtcgcctcatatgtcaccaataaagctgtcaaatggtaatgtctcaccaccacaatcaccatcacatcgtctacaacagattatcaagcggcattcacagacaaaggatttgtccagggaaaaagtgcaacgacaacaacaaagtccgctgttacagcacccatcaattcgcgccctaattggcctgcccaattcgccggctgacgaccaaaacccgcctccgccattcacgccggaacagcacgcgctgcttatggacaccgtactccgtccaccgtccggtcttccgttcgagagtccacgatcagcgccgtcaccgcttgagctgagcgaggagcaacgcgacaaactgatcgatgccatccaaggacgaccacagccaggacttccatttgaggatgaagcggaacatgaaggactacatccggcacaccgtgtcaattcggcacatcttgaacacgttttggatgccatattccgtaagccgcctggcctaccatttgaggatgatgaagaggaggaacacagcagcaccaacatgcatcactcaattgccggctatgagactaagctattcaagaaagatgaatgctgatgaacgatgaactgantataataattttt

SEQ ID NO: 87724 - DNA, 636 bp, Heterodera glycines
  misc_feature (622)..(623): n is a, c, g, or t
  misc_feature (636)..(636): n is a, c, g, or t
  SCN-specific regions: Sequence locations=1-35,57-190,212-306,329 -488,511-526,555-636
gcggcacagtaataaaatattaaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaggatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgaccctcatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaacccctaaaaaaaaaagnnggaaaaaagaagn

SEQ ID NO: 87725 - DNA, 526 bp, Heterodera glycines
  SCN-specific regions: Sequence locations=1-183,205-361,383-526
tcatctttggcaagaacctgcccatatggaattggacttcatccaaagcgttttgttgggcccacagcgaggaaatttgacggcaattgaatgtgtattggcacaaaactttaacaaacagtcatcaatgatgccaaattatggctcggaacgtaaaaatgcaaaagtaccaaaattagaaatggaaaaggcatggtggtggtgatgagacctaattggacaatggaagctagaccggtcaaagtgatcagagacttaagagaaaaggggtgggactaccaagaaggcctacgagtgaatgcatagtgtgcgggaggaagagctcttactgttattacagggtacaatgttgggaaagctgtaggcaattctttcatcatattgtggcgaaccgaacattgttaaactgttttggagcaaacaattgcccagttggataacatggctttccatgcacgaggctgtggtctgcacaaatgcctttcggccggcatggacccgacactgatcaatgcggtgcagcaga

SEQ ID NO: 87726 - DNA, 504 bp, Heterodera glycines
  misc_feature (3)..(3): n is a, c, g, or t
  misc_feature (19)..(19): n is a, c, g, or t
  misc_feature (22)..(25): n is a, c, g, or t
  misc_feature (27)..(27): n is a, c, g, or t
  misc_feature (38)..(43): n is a, c, g, or t
  misc_feature (49)..(51): n is a, c, g, or t
  misc_feature (64)..(64): n is a, c, g, or t
  misc_feature (67)..(67): n is a, c, g, or t
  misc_feature (87)..(87): n is a, c, g, or t
  misc_feature (106)..(108): n is a, c, g, or t
  misc_feature (123)..(123): n is a, c, g, or t
  misc_feature (125)..(127): n is a, c, g, or t
  misc_feature (143)..(143): n is a, c, g, or t
  misc_feature (165)..(165): n is a, c, g, or t
  misc_feature (227)..(229): n is a, c, g, or t
  misc_feature (394)..(395): n is a, c, g, or t
  misc_feature (413)..(413): n is a, c, g, or t
  misc_feature (415)..(415): n is a, c, g, or t
  SCN-specific regions: Sequence locations=1-143,165-229,255-285,313 -378,413-467,499-504
ccnttgtggaggttggggnttnnnncnccaaaaggggnnnnnncgaaannnaaaaaacaaacanacncaaaacaacacgcggccttntgagaaaaaatgagagagnnnaaaaggccgaaacancnnngaaagaaaaaattttnttggggttgggaggggaggggngcgggcctcccccttggggggggagaaacacaaaaaaagaggggggggggggaagagggggnnnaaaaaaattaaataaaaaaaaaaaaggggggggggggggccccaaaaagggggcccaaaaaaaaaaaaaaaaaaaaaaagaaagaggggggcgcccccaaaaataaaaaaaacacggggcggggaaaaaaaaacaccccttcgtgtgttgggggggggggggggnncccccccccccccccccntnttttttttaataaataataagaaaagaggggaggggggggcgccgcccacccaaaaacaaaaaaaaaaaaaaaaaaaagaaaagagaga

SEQ ID NO: 87727 - DNA, 707 bp, Heterodera glycines
  SCN-specific regions: Sequence locations=1-28,50-707
gtggaagatgggcctggttgaccacttgttagccctgggcccggggctgagtgacccgatcagcggcacacatcgctacttggaagaggtcgccatttccgcctgtgagcagctcgcggccggcacgctgaaaatcaaccgcgagcgcccgctgatggagcgcattcagaacgcgttgctgacacgaaaaccgttgctggacgcggtggttatgcgaatggcacgggacaaagtgatgaagcaaacccatggcaattacccggcaccgttgcgcattttggacgttgtccgcaccgggctggtggacggccagcaggagggctacgaggaggagacaaaggagtttggctatcttactcaaaccacacagtcggaggcgctcatcggactcttcaaaggacaaaccgagtgcaaaaagaacaaacacggcgaggcgcgcaaaacggagcgtttgggcgtcatcggtgccggtctgatgggcgctggcatcgcaaatgtcagcattgacaagggcattcatacgactcttgtcgacacgaagcaggaggcgttggaccgcgggctgaagcaaatcaccgcccaaatggaggggcagctgaagcgaaggaaaatcaacgccgcagagcacgccatctgtctgtcaaagctgaagccggtggttgacgactatgagcaattgcgtgactccgacgttgtgatcgaggcag

SEQ ID NO: 87728 - DNA, 628 bp, Heterodera glycines
  SCN-specific regions: Sequence locations=1-70,94-407,429-500,522-628
atgttccactgaacaggtgccgcctattcagccaacatgaacaacccccagcatgccccgccacaaccgtcgccgggcgccgcgccggccggcaacaccaccaccacttacgtgtacatggcggacgggggacagccccactgggggcctcggccgcaaaatgtcttttgctcgaactgtcgccaacaggtgctgaccaaagtcaaatactccgccggtctgctcacttggctgttgttcggcggttgtcttctgttcggctgttggttgggctgctgtttgcttccgttttgcatggacgactgtcaggactgtgagcattactgcaccaactgcaaggcgtacatgggccaatacaaacgtctctgataaatggttttgactcgtcgttcgtcctgacaacttccaccgttcgccctctcccccgtcccccggaaaacctttataaaagaagcgacaaatttcagcaatttttattttcaaaattcgcatcacttttatatcattcccattattttacacattatgcaattatctgttttttaatggtcatatgccgtatttacatcacatggatatgattatgatttgatgatgttttccatatcataaattatgaaaattcgcc

SEQ ID NO: 87729 - DNA, 354 bp, Heterodera glycines
  SCN-specific regions: Sequence locations=1-75,97-354
ccttgacgatatgtgcaatgacgccgatacccctgtattgttgaatgacgacattttccggctttccaaatattgctcaacagaggccaccctacagatctcacgcgcaacacatgtttcgttacagaacacacaccctaccaacgcattgctcatgaacgagaaccactccatggcactggtaaactcgatcaaacaccgcatggaaatgcatacactagggccgagtcagcatctttactcatgcgaagcgccgtgatccctacattatttccgggctgctgaccgatctgttgagcatggacggtgttctgacctttgtgcggaccgttgtgagtgcccagttcatcgatt

SEQ ID NO: 87730 - DNA, 641 bp, Heterodera glycines
  SCN-specific regions: Sequence locations=1-641
aaataattatggagaatacaaaagaaaatgatggaaaaaccgagggacattgttcttcggtgagtgagtcgacgtctaaagaagagagcatttgtaatgataaaagcgaagcggaaggatccaatgaaaaaggaatgccaaacaaagaggaagtgccaaaaggatctgtatagaaagtgcaaaatggagcggaggtgccaaatgttgagggagtgccaactgaggcgggcagcgcttcacagccgagcttgtacagccaatttgtgaccagcttcgagagcgtcatcaacagtttggtctcagaatcacttcgcagatgacgtagcgacgcgtccacagcaaaaattgccatctttggacttggagggcgttgcggcgttcatccgcgaagaacgacccgagattgtgttcatggtcggtgccggagtgtccacgtcagccggcatcccggactttcggacgcccggcaccggtctctacgacaacttgaagcagtacgacatcccaaatccgcaggcgatcttcgacataaattacttcagaaggaatcccgagcccttttttgtgttggccaacgcacttttccacgaaagcataatgccgacttccgcgcatcatttcattcgtttggtggcggacaa

SEQ ID NO: 87731 - DNA, 91 bp, Heterodera glycines
  SCN-specific regions: Sequence locations=1-14,41-41
taactgcgagaccgacaagtcgagcaggtgcgaaagcaggtcatagtgatccggtggttctgtatggaagggccatcgctcaacggataaa

SEQ ID NO: 87732 - DNA, 100 bp, Heterodera glycines
  SCN-specific regions: Sequence locations=1-100
tgttagagtgatacattattggagtaaccatgacctcctgtggactttgattccctagatggtaatgcacaaacctttgaaaacaggtgggtgtgtagaa

SEQ ID NO: 87733 - DNA, 448 bp, Heterodera glycines
  SCN-specific regions: Sequence locations=1-89,141-259,292-385
cctctttgcggtgtttgttcttttgatgttcgccgtttctctggcggtggtcaattccgatttagcaataaacggacaaaagtacaacaggagaaagcaacagatggaaaagcaaatggacaacaacaacaacaacaacagaaaacgaaggaagaaaaagttaattcgcgtccaagaacgccattttttcagcagatctttccaaagttggatgctgaacaactggacaaaccatggtcaagcattttcgaaaactgaacagatggaaaaggatggagaaatgagaaaaggtttatttttcgacctaaacttgtgattttgaagccaactgaattcgattgtgattgatttcaagttttttgtgaaagaattgttaccgattgttaaaaaaaaaaaaaaaaaaaaaaaaaaaaaaaaaattgaaaaaaaaaaaaaaaaaaaaaaaaaa

SEQ ID NO: 87734 - DNA, 683 bp, Heterodera glycines
  SCN-specific regions: Sequence locations=1-469,491-683
ccaaaagatgaagacaaataaaaggcaaaaagtttcttcatcagaagaagaattcgacccgaatcagaaggatgaggattatgacctgctcatggatgacgaagagcgagaaaaattcgacaaaatgactgaaaaggagcgagaaattgaaatttacaagcgactcgagcagcgtgaaatcatgaagacgagagagaaaataaaaaagaaactcgaaatggctgctgggaaaaaggcagacggagaagttgccgcaaggcaaaaaaaagcgaaagcgaaaaatgtccgacgaatcaaacggagacgatgaaagcgacgagaaggactcggcatccgaagcagaggaagccgaaagcagttccgacgacgcggaagagacatcacattcgaagagtgcggttaaagctgaacccgatgagtcggacgacgaaatcgacacggaataccacaaaccatccgaagtcgcgaacaaacagagtaaaaagaaagccatggccgacttattgagcaaacgacgcaataaaatacaagccgaggaaaagcggaagaaggagacattgaaggcgactctcgacttggacgaaatatttggcaacgaaaacgaatgtggaaaatcggccggcagcagcagttcgtcgacgagttcttcgcgttcctccagccccgactggaccaagtcacgt

SEQ ID NO: 87735 - DNA, 682 bp, Heterodera glycines
  SCN-specific regions: Sequence locations=1-263,286-562,589-682
aaactgttcttcttccttcattacactatgaggaaattctattatttaagctgttccagcggtcttggcatttgtcattgtttggcaaatcctttcgattgagaagctttgcgggaaatttgctgagccaaagtgtttctatccaacggaagcttgcgacaacttcactatcttcaaacaaaacgcagaaaccactgaactcaacgcggacaatgaaacaaaatggatccagctgaacgacctcccgaccggcgagggctgtctcccaatcaatatttccattgtctccactcttcgaaatggttacaattgcggtgtatcgaatcaattgaaggacactgcggatgcgttggcccgtgtgctttacctgtgcttactgtttctgttcgctctcgttttccacactttggctcagcaaccttcggaagagtatgacctgttcggttatttgtgtgccgcttacagcgtcttggttttgggtttttcgaccgtgacaacgattttggagtcagtgaattggaccactctctgggaatgcaccaatttccgaccctatcagtcctttctgttgttccttttgcttcccagtgtcattctgttctgctcagtgatttacgaaaccttctccaactgttctctgcttaaagaaagcgatgccgagaacgcgcaaaagcaaaccgtc

SEQ ID NO: 87736 - DNA, 148 bp, Heterodera glycines
  SCN-specific regions: Sequence locations=1-120,142-148
cctgatgggactcttacaatgaagtgatatgagaagcgcgacactttcttcaacttaaagaaggagaaagtgatcgcaagaggaggaatttgctgatcactcccttaaactggcaaatgccctccctccgtttccctcccccgcccct

SEQ ID NO: 87737 - DNA, 755 bp, Heterodera glycines
  SCN-specific regions: Sequence locations=1-62,99-198,220-282,304 -333,357-409,431-755
gtgattccttttcgcgtaacaaaattttaatttattattgctgagcaagtggatatttaagcggggtttccttttgcaattaattaattgtaattaattgatcgtctccccaatggcttcttcactcaccattgaaaaacgctgcaaacttttcaacacaaaacaaatggaatgccaattcgatggaactgaagccggaaaatgtgctttttgtgtaaagcttccgtgtaaatttggagcagttaattgtgcagaggaagtgagcacctcttgtgtaaatccgcaagaattggaaaaatgctgcaaggcgcgtgacaacgaatgctgcgtgtgtgtgctatgcgagaaaaacaaagttatgaaggttttggtcgaatgttgcggaaagcgcaccgaaacgagtgccgaggccgggaaagcgctttgcatttgtgtgccgaaaattggtggaggcaaatgtggaggacaagtgcaagtgaaacaatgcgatgcgaagctggttgacgagtgctgcgcagctaacacggagagtggcgactgctgttgcgtctgtttgagctgcaatgaccaaaagtgtgtggtcaccgtccgttgtcctgctggagaagcaaagtcgactggtccaacttgcactgcttcaaaatgcgaaagtgtgaagtgctgctgaagtcaaaaaaactgatcgaagactgaaaggatgcatgcatttaactgactcagttttaaaaatgctttttcaattagcaaataaataa

SEQ ID NO: 87738 - DNA, 708 bp, Heterodera glycines
  SCN-specific regions: Sequence locations=1-2,25-708
ttgccgtcgggcagcgccgcctttctccgctcattggagcaccactgtgactgggtgaacgacatcgttttgtgcagtgatggcactcgactgatctccgcctcttccgacaccaccgtcaaagtgtggcacacgcgcagaaatggcgcgtgtttgtccaccctcaaaacacacaaagattgcgtccgctgcttggcttatgcccggtggcccaccgaattggtggcgagtgccgggctcgacaaatgcatttacctttgggacgtgaacacactgaccaaagtgacggccaccaacaacacggtgaccacttcgtctttacgcggcaccaaaaattccatttactctttggcaatgaatgagtgcggaactgtgattattgccgggtccactgaaaatttgctgagagtgtgggacccgcgcacgtgtcaaaaggtggccaaactgcgcggacacaacgaaaacattagggcaatttcggtgaacagagacggcactttgtgtctgtccggcagcagcgatggcactgtcaaattgtggagcatcggccagcagcggtgcattggcaccattcgttgccattcggacagcgtttgggcactgcaaacggactctgtttttgccaccgttttttcgggcggacgcgaccatcgcgtgtttcgaactccgctgcgcaacctcaacgactcggaattgctgttcaccgaa

SEQ ID NO: 87739 - DNA, 754 bp, Heterodera glycines
  misc_feature (672)..(672): n is a, c, g, or t
  misc_feature (685)..(685): n is a, c, g, or t
  misc_feature (692)..(692): n is a, c, g, or t
  misc_feature (724)..(724): n is a, c, g, or t
  SCN-specific regions: Sequence locations=1-754
caccgtttgctgctattgaatcaattcccgcggccgcctggcggccgggagcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaanatttaacgcgaantttacanaatattaacgcttacaatttcctgatgcggtnatttctccttacgcatctgtgcggtatttc

SEQ ID NO: 87740 - DNA, 183 bp, Heterodera glycines
  SCN-specific regions: Sequence locations=1-183
cagtttccctgacgcatcgcttcattttgccgagactttcgaccgcgccatttctttgcttcgcgcagactgtcgtgcttcggagaaacacgtcacttttctgcacattctccgacaattgggcgcgagtgaagagaatggtggactccttggcaatttgaacgggctcatttgatacctgag

SEQ ID NO: 87741 - DNA, 428 bp, Heterodera glycines
  misc_feature (338)..(338): n is a, c, g, or t
  misc_feature (407)..(407): n is a, c, g, or t
  SCN-specific regions: Sequence locations=1-428
tcaaagtgattgactaggactaggacgactgttctgactccttccacatgatagggtaggcctctacctctcttcttgttccttccgctgaaaaggtataccactaactcactagcattatgcccgtactacacatatataaacagtgcgtccataggataatgtcacaacaccgcggttgaaactacgaattctcgaactatgcatactaaattgagggacggccttaccatctgatgaaatggacattcttaatacatagacgggattaactgctgacgaaatggactctgttttatcatggatgcgaagaaaaactggctaacataaagctgttntttgtatacatacttcgtatccagccattgaatgtggaatcctttgtataccacattcgtgttcagcanaagaatgtagaaaaaaaaaaa

SEQ ID NO: 87742 - DNA, 260 bp, Heterodera glycines
  SCN-specific regions: Sequence locations=1-260
gaactcaaaggttacaatgacttggtcaattcatggctgtgccaacgtgaaactgtgtcctattactgctccttacgtttgctgcctgcacaatcttgatgtgctagagcccgcggccatagtagccaaattctgaccaagagtggacaagcgacatacaccaaaaggaaatcagtaacggaggaacaccgacgttcttgctttagatgattcagggacgaggtttctatcaattcttattccgtacagcacattgtgat

SEQ ID NO: 87743 - DNA, 826 bp, Heterodera glycines
  SCN-specific regions: Sequence locations=1-826
cgacttcaaattgaggtgtcaatccgcgcaacacggagtccgtccaatatattttcgtggccaaaaaactgcaaaagttgtaggacaactggcaattaatgtgccggaggatgggagcattgtgagcggcattttggtgcggcgaaatttcaattaccatttgttgcatccgaatgaactcagcgcttacactgacttggccaattcgcggctgtcccaacgtgaaagtgtgttctatgacggttccttccctttgctgctgcacaaccttcgtctgctgtcgtccgatgcgattgtgtcaaattcggacgaagcgtcgacaagtgacaaacagcaaaaggaaagcaaaaacggaggaacaccgacgtacgtggtcaaaatgttcagggacgaaattactatcaatttttattccgtccaacacattgtgatcgttgaatggatgtcaaaccccgtgaatgatttatttgccgatgcgacactttcggccattcttcacgcccaaaccaaccctatcctcgataaaaatgttccgaaggatttcggtgcgaaagcacagcaaattgagcaaaatttggaatcgattttggttgggacactgtgcgaattatgcggtgacaaaagttttgtggaagtgaaagaggaggaaaaccaaggggaaaaggacgcagcagcggaggaaagcgacaaaaaagaggggaagagacggagagtgattcaattggagttggacgggaaagaagcgtgcatctgtcccgtcagtctgcagatcactgaatgcgaggaccaattgctgcaccatctttttgtcttcgctcactcaaaa

SEQ ID NO: 87744 - DNA, 730 bp, Heterodera glycines
  SCN-specific regions: Sequence locations=1-698,720-730
aacactgacgaagtgccaaggacattttgcagaaaatgcggtcacgtgccccttaacatgcaaggacacgctgacgaaatgccaaaaataccaccaatgaatgcagtgctaccaaatgccgaagaaatcttaaaaagtgccgaagaaatgccggaaattgaagaaacgccgaagaaaagcgtcgaggaaatcctgttcaatctaagcgaaatgccgaaaggctgcttgcaaaaaatgcagtctttgccaaaggacatgcccggaaacactgacgaagagccaatagtaccaccaatgaatgcagtgccgccaagtgccgaagaaattccggaaagcgttgaagaagtgccgaagaaaagcgccgaggaaatgctgtccaatctagacgaaatgccgaatggctccttgcaaaaaatgcagtctttgccaaagtacatgcccggaaacactgacgaagtgccaaaggaccttttgcagaaaatgcggtcactgcctcttaacatgcaacgacacgctgacgaaatgccgaaaataccaccaatgaatgcagcgctaccaaatgccgaagaaaccttgaaaagtaccgaagaaatgccggaaagcgttgaaaaaacgccgaagaaaagcgtcgaggaaatcctgtccaatctaagcgaaatgccgaaaggctccttgcaaaaaatgcagtctttgccaaaagacatgcccggaaacactgacgaagtgccaa

SEQ ID NO: 87745 - DNA, 703 bp, Heterodera glycines
  SCN-specific regions: Sequence locations=1-339,361-517,539-638,660-703
attggcaaaacgaatgagcacgctcttccacctgctgaccatctgtttgagtctgcagtcgcaacgcatcgacgagtccatccaatcgcaacttcaggacaaataccgggaaagaactgctgcgtatggccaacggcgacatcgacgagttccgaaacgccttccatgcgggatgtcccaagttcttgtcccccaccactgttgtctacgacagggagcagagtggccaaagagcctttgcttcgccaatgcaatgcgtttttggaaggtatcgaaagtcaaattacgctgccaatattgcgtggctatcttaaactctacacaactcttcccgtccaaaagttggccagtttcatggatattcccgactcggagattggactctttcatcggcaagctcctaacctacaaaatgattgtcaccgagttgggcaaggaaaccattgaccaaaccgaaggggccgatgagaccaccgaattggatttctacgttgataaggacatgattctgatcgctgacactaaagtggctcgtcgcgtcagcgaatatttcatcagacaaatcggataacttcgtgagatttctcgaagaatcaaatcatctgtcactcccgttggtcaaatacacaagaattgatgttttgtcactgtaattgttaattattctagacgttcgttcgttttcgcttggcatgatttgttc

SEQ ID NO: 87746 - DNA, 259 bp, Heterodera glycines
  SCN-specific regions: Sequence locations=1-236
ctaatcggaaatgttcgcgagcgtcttcgcggtcgtttcctgcgtcgagcccgacggcgtctgcacgatcacgaacatcaggccctggtcttcatccggcaggaacgacttcggcaggcgcacgaacagcaggccgaccgcgacgatcacgaccaggtagatgatgagccagcggcccgaccgcttgatcacgtggtgcacgccgacgtggtacttgtcgcggctgttgttgaatgtgcggttgaaccagccgaagaag

SEQ ID NO: 87747 - DNA, 726 bp, Heterodera glycines
  misc_feature (635)..(635): n is a, c, g, or t
  SCN-specific regions: Sequence locations=1-127,166-726
tatttccgtattttcgccttccgttggcctcgacaacgcaacagcagcaacagcagacggaaacaatcgacgcagaactgtgccaacaaccgacgtcatctgtctgctgttaaacattggacatatctcacaatcatcaccatcatcatcagcagcagcaaaagcagaggacaacaaaacgcatggaccaaaaccgactcagcgacttcgcttggatggaaacattggcgtggctcggtcgtgcagaagtgggcatgaagatggcgctggtcaacacccggttcaacatgctggtggacaagcaattcatgctacggcagtggcgctttggcgagtttcacatctgcgggcgggaaggagcacaacgaggcggcgcagaaatcatgacatcggaagacggcaccaacttcatcacgttgccactgcccaccacgccgatgccgagcagtgtcgtcggcttccaatcactctccatttggttcatcaacgcggacgtcatcaaatttctgcgccggattcgccgtctgttcgccgaggacatcgcactggaattctccactcggcacacggagtttcgcagttggcaagtgattgcgcgacatgtttggccactgttacgggacgggatcagcacnatggtgtgcctgaggaagtgcgatttggccatgctgcgcaaacacgtgtcgccgaccgtgctgttcgactgccctgatctgcaccgaattc

SEQ ID NO: 87748 - DNA, 682 bp, Heterodera glycines
  SCN-specific regions: Sequence locations=1-9,31-280,308-411,456-682
taggaggaggagccagggctcactgtccggcatgtcggtaggtgggaaggacaaatccagaccggtgagcagcacagccgtggccgggactccgtggtgcgtggtgtggacgggagacaaccgggtctttttctacaatccgagcactcgaacttctgtttgggagcgtccgccagaactttacaatcgtccagatgttgacctccttgtttcgaagccacctccctcgaaggaacaaaaaggtgccggtaaaagtaaaaaacgtcagaaattcgagagcgacaatgaggaggaggaggaaggggcggttgaagagggagagtccgacacttccgaaactgaacaatcgcccgagcttcagccaacaaagaaaaaatctcgcaaagagaaaaaggctgaaaaggaaagggagaagctgaaactggaacagcaacagcagcagcaactccagcaaaaacagcccaaacaaccattacctatacaagtggaaaaaccaattgaccccgcaatacaagccgaactcgacgcgcaaaaggaacgtgaaaaggtaccgttggaagagcgtattaagcagtttcgtcagttgttggaagacaaaaaagtcagtgcgacaagttcatgggagaaggaactctcgaagattgtctttgatcagcgctatcttctccttagtactgtggaa

SEQ ID NO: 87749 - DNA, 468 bp, Heterodera glycines
  misc_feature (438)..(438): n is a, c, g, or t
  misc_feature (440)..(441): n is a, c, g, or t
  SCN-specific regions: Sequence locations=1-270,294-441
ctcctcctcctctctgtcggcctttgctttgcccagtttgatcagtctccgtccgctgctctgaatcatgtgcgggccaaaagaggctacaagccgtggaagaagcaatccttctcctcttcttcaagcgaaatgtacagaaggagaagacccagtggtaacggtcattacagggattacaacggctacggtagttttggatactatcgacgaaaacccggcattttagaacgggcgctgggaaaaattacgcggagctattaacggacgagcagaagaagagaagcaaaaagccaaacaatgggcgtaacacttttaattgatcaaacgatattacagtatccaacaccaaaattacagtaaccaaacatccaatggaacgaatgactcatttaattcagcaaatttgctggaattgccgataaagaaacttagcancnnaaaaaaaaaaaaaaaaaaaaaaaaaaa

SEQ ID NO: 87750 - DNA, 767 bp, Heterodera glycines
  SCN-specific regions: Sequence locations=1-195,217-696,720-767
cctatttgctgtttatgtactcataagcgtcattttcacttgtcatttgtgcaagcgtcggaatcccatcactttcgaatccatcgaccatctggaagcacattttgcacaacaacatttccaatgtttgccgtatgtttgtgagcaatgtccgcagtttgccagtggtctttaccctacagaaggcgcaattattgaacatatgaaattggtccatggctctgagagtgaatttgagtttaaaatcatcatccgtgaggacactgaagagaagcgggcaaaagtccgtgctgcacttgagcattgcgtccgtaattctggcgacgtggccacttcgtcgtccgctgccactacaacttcgaacaatgacagcacagcgattgaacttccacagacgcaacagcaagtgcaaacaacgcatcagcctcgcgttgtccaagtggttcctgcgccgacagttgttgtcaggacggaagtggtgcaacagacagcggaaaaacactcgggggcaaacaacacgagcaacggcgcggcattggcagaaggcggtgggagtggaacgacgacgacgaacacaagccgaaccaatcgaacatcatccggagggaacaagcgtaatgcatcagaagctgttggcgctggaaaaggaccgcccgtttggaaaattccgaagaagtccacaagcaaaaagggaagtgatggtgctgggaaaccgagtcgagagagccacaacaaccgggagagccacacaaccaacagtcggattc

SEQ ID NO: 87751 - DNA, 391 bp, Heterodera glycines
  SCN-specific regions: Sequence locations=1-391
caactcgtggcattctgtgtagaggtgctagtgaacgaaaagcgcctttcccttaacggatggttccattacgctccggggacggcgaatgttgcacagacagggccaaattgcgctgtggaagagccgatttgtcgggtggagccatcgatgaatatcacgttggcagaagtcaacgaatggctgagtccaaattacattcgtccgggacaacatcggcaaatcaaacggatttttgcatacaaatccgagctgtccctccaacaatttctcaataatgaacgttataacaaagctttggatgagttggaaaaggcgcaatttgaaagtgttggcccaccgcacaaaagaaatgtatggcgtctcgtcgagtcatccttgggacagaaca

SEQ ID NO: 87752 - DNA, 449 bp, Heterodera glycines
  misc_feature (15)..(15): n is a, c, g, or t
  misc_feature (27)..(27): n is a, c, g, or t
  SCN-specific regions: Sequence locations=1-54,76-134,156-409,431-449
ccccccccccccccncccgccctttcncactccagttggggggaaacagacccattttttagggccaagaaaaaacaccccgaaagaaccaacacaggcgaccgccacaaaaaaaaacgcccccagggaaagggcccctcagggaacccctccctccctcctctccaaagctttcgattcgcagctttgacgcaaatacaaacatccaattgggcatcatcatggccatcccacccacgaaccgcgaccggcctcttttttcggtcgtctccaacgcttgtcctactgtacgaagtgcccaattgacaaacttttccggtgccgcactaaaaaaaccccggccccccctaagccgggcagaatccactgtgcacattcttatttgacccaccacgtcccggcaaaaacccccaatttaactcccccggccccctcggcggtcgggagcc

SEQ ID NO: 87753 - DNA, 278 bp, Heterodera glycines
  SCN-specific regions: Sequence locations=1-278
cattaaatgaacaatgccgactctgaacgctcggaaattgcgaagactgaaagaatggacgcgaaatgcataaaaaacgatatggacttaatctgacgaatgaaacctgtactaattttgcccagcccggatggctacgggacaaccatggacgaagaccagctgtttttagtgtcatggacaacgcaagcgggtaaataagatgagtagatcatggaccacaccatgacagatggaacggatgtgcaatgtgtatgaggaaatgaaaagtggcggag

SEQ ID NO: 87754 - DNA, 132 bp, Heterodera glycines
  SCN-specific regions: Sequence locations=1-132
acggcggacgcatcgccagcgcacgcttccgccgagagcactgctaacgcaatgctaacgaactctgacactcttccgattcgtcccattgttcactcattggcatttcacttcccatttttccattgtccg

SEQ ID NO: 87755 - DNA, 688 bp, Heterodera glycines
  misc_feature (665)..(666): n is a, c, g, or t
  misc_feature (676)..(676): n is a, c, g, or t
  misc_feature (680)..(681): n is a, c, g, or t
  SCN-specific regions: Sequence locations=1-99,121-621,643-662
caaatcctctcagaaaatggcttcatctttctgctcttcactcatttccatcgtcgcaattgtctgtttgctgtgcaaatgctgcttttcagcaccccatccatgctgtcctggcagccaacatgttgtttcgatgatgaaagatcacaccggcacattctccgcttcgatgccaaagtcttcgctttgtctgagtgccgaaagagtcgccgctgcggtggaaaaccaactgaaaacaatttggtgccctggcaatggtggtcaaacactcatcaacgagatcaacgcagctcaatcatcatctgatgagtgtgctcgctctctcggcttcgtccgtgccatgttcgaaattgccgcttccgccgcttcccatgtcggtgccaacgccgaattggccaatttggctgtccagttccgagaacaagttggcacaattgacaccaactgtgctgcgctgggcattcatgttgggcaaatcagcttgggcactcccaaaggagaccatccgcaagtgcatgactctgagagtgtgcttagtaaccctggcaccagcgggtctcacaagcgcatttaagtgcattgcgacgattccgatgatgtcatcatttgttgattgatatgctatagaaattattttattagataaaaaatgaatcgttgctaannaaaaaaaaanaaannaaaaaaa

SEQ ID NO: 87756 - DNA, 307 bp, Heterodera glycines
  SCN-specific regions: Sequence locations=1-285
tcaccgagtggagccgacgacctcccggacttaaattggcggggacgtcgaaatcaccggcattcaaatcttctgaaaggatttagaaaactggcgaatgtattgaatgacgatcattcgttgtgatggatgggtgttccgttttaattaatctgacaaaaattagtctctccgggcgatgattgtccatctgtgaattgctgctgttcccaaccgtccgacttttcttccccccccatttctaaaattctaatccctctgccttccctttagtggtgctaaaccaaaaaaaaaaaaaaaaaaaaaa

SEQ ID NO: 87757 - DNA, 405 bp, Heterodera glycines
  SCN-specific regions: Sequence locations=1-255,277-405
ctggagcatgaagcccacatgcagacacagcctggtcgaggacgcgttgaccatggcgttcgcttccggagacgggcaccgccctgaactgatcttccacatcgatcggggcaaacagttctgcaaacgtgacaccgggtactgctgcgcttgataccacctgcattaattcactacatgagatccgacggatcggccgtgcacagtctgaccaatcatagtggagagtctcccatcacatatgtgatgcatgagcatcagaaatgcttatagaagctaccgtaatagcgtggtctgtttgatagcgtgtgcgatgcggctgcgggaaactgttatgcgttcacaatttcccgcaccacttcgaaccatgctcgtgaagcgctaagactgtggagcctaacgagg

SEQ ID NO: 87758 - DNA, 335 bp, Heterodera glycines
  misc_feature (2)..(2): n is a, c, g, or t
  SCN-specific regions: Sequence locations=1-2,49-184,220-335
cnctgtgatgcccttacatgtccggagctgcacgcgcgctacactggcaaaatcagcgcgcttgtccttccccgaaaggggttggtaaaccggtgaaaatctgccgtgattgggatcggacattgcaattattgtccgtgaacgaggaattccttgtaggggcgagtcatcaactcgctctgaatacgtccctgccctttgtacacaccgcccgtcgctgcccgggactgagccattttgagaaattcggggacggttagtgttccggcttcggtcggtatgcagactggaaccgatctaatcgcagtggcttgaaccgggcaaaattcctaaca

SEQ ID NO: 87759 - DNA, 90 bp, Heterodera glycines
  misc_feature (25)..(25): n is a, c, g, or t
  SCN-specific regions: Sequence locations=1-25
cctgcttcaggaaaagccactaagncttcagctatagacgaccgtaccgcaaaccgacactggtgcgcgagatgagtattctaaggcgct

SEQ ID NO: 87760 - DNA, 858 bp, Heterodera glycines
  misc_feature (760)..(760): n is a, c, g, or t
  misc_feature (826)..(826): n is a, c, g, or t
  SCN-specific regions: Sequence locations=1-437,459-858
attttctgcgaatctttgggctatttgagtgaacaattcttctgcaatgctcacaaagtgtttcttctattcccaaattcgtcaatgccttttctggtcccaaattctttctcattttctccaaatggaaatggccaatgcccgtccaattgactccaattgatcacaaattcttcggcacttttttgagttggtctccgttcggcgattggatcggccgcagagatttggcatgggaaaaagcgcggagaaagcatcgaacgaaaaaagagcagcaaaatgaaattgaaaaggcaatgaaaagcattcggaaggaattggcaatggcagtgataatgccgacaattgggggacgaaatttggccgaaaaagtgaacatttcgagcgcaaaagtggtgaagaatgagctgaagcgagcatgtgacaaattgagaagcaaaatggaaacaaaagatgaagcgatagcattcactgagaagtacgaacattttattgtcatcgaatgcaaaggctcaagtcacaacgtggacaaattctgcgattttgtcggaaaaaggctgcgctacgaactgcttgaatttgtggagaaccctttggccatttgggtggacttttgccacgtccgcccaaaaatgatcggcccaacggaatgcccttctgccgacttggagaaaaatggaaactcaattggcctgaggcattggctggtgggcattcaaatggcggcagaacaaaaggcaaacagcgcatttaagcgcanattgaggggacatctgagggaagagttggacgtgaagatcaagggagactttgagaagggcagctntcacaatgtgcagctgaaatcggaatttgcag

SEQ ID NO: 87761 - DNA, 759 bp, Heterodera glycines
  SCN-specific regions: Sequence locations=1-21,45-759
gggtttgcccattggcaatcctgcgggaaatactcccgagaaatgggacatgaaccaggttgtgcctcccatttcattgtcaacaacgtacaaacagaattggcctgggatgcccaaggggcatgattacataagagaaggcaatcccactcgtgatgtactccaagaaagcatagcgaccctggagagtgctcgccattgccgaattttcagctcaggacttgccgcaattgcagcagtgtcccatttgcttaattccggacagcatgtcatcgtgtcgggggattgtaacggcggcacgaaaaattatttcgacaaaatttgtgtgccgcatcatggcttggagctgagttttgtggatttgacgcgattggaaaacttggagaatgaatttaagcccaacacaaaaatggttttgtttgaaacaccctcaaatccgcttctaaaaatcgtcgacattgaagcggtgtgccgtatggttcgagcacgctcaaaagattgtgtcgtcgttgttgataatacgttcatgacaccgtactttcaacgcccgttggaacttggcgccgatgttacggtgcaatcgctcaccaaatacatcaacggacacaccgatgtgctgatgggcaccgtagttaccaacaaggagcagcttgatcagcacatatacgcccagcaaatttatgctggcgccgttccgtccgcctttgatgcctttttggtgcttcgtggcatcaaaacgctcccattgcgaatgcgcca

SEQ ID NO: 87762 - DNA, 774 bp, Heterodera glycines
  misc_feature (740)..(740): n is a, c, g, or t
  SCN-specific regions: Sequence locations=1-774
ccaaaaacgaaaatggcccataaaaggaagcgacaaacaggatgcgccgtgttcataacaaattccgacttggtcgaccagtgttcgttcccgcttgaccagctgccactgaacacactcgtcattatcgcctcacaactcccgttcaaggacttcaagcgggtcggcatgatttccaagcagttcaaccgagctcaacgaatgaccaggttcagcagaaagcacgtctcggtcgacctgttgcgcaagctgttcccggacgaagtgcccgacacggacgtggacaacagcaacaacgacggcactgagcgtagcgttggcatgctggaggtgatggacccgctgcgtcagcacctgcgaagttcgccgcccagaaacatccgtgaagtggacatgagcaagttcagcacgttccgcgagtcgcactttgtcgaactgttccgttcaatcagcaacggcagagaactgttcacggaagtacgacggctcaatgtgcagaagtgtgtgatcgagttgcgcgacatggaatttttggcccaactgatgcccaaagtgtggtacattcgctgctccgcccaaacgcttgtcattccggaagacattgatcagtccaaattggcactcagcgtggaacagatgcgccaattgcacgccaagctggacaagttcgactacgtggcgaggaagtgcaccaaaaaacacctgtggttcatcagcaaactcaccgaactgttcgccgnagctcgaatcatacaattggacaaatgacgagcc

SEQ ID NO: 87763 - DNA, 747 bp, Heterodera glycines
  SCN-specific regions: Sequence locations=1-39,61-747
ctcttttgagtccttagcttcttttacctcccctttctctttttattgctaaaatgacttctcccattgcttatgaccaattgcgagaaatgacgcgcaatttcctctcaaaaggcgtcagtgccgtggaaacaaatgccattttccagggaaaatttggcaccgaaaattctccgactctttgcacgatttacaaatggcgaagggaacaccgcggaggaatgggggagcgcgaggcgaacgaccaaaatttggaggaaaacgaaaaggaaaaagaaagggcggcggacgacggaggcgaaaaaggggcaaaaccgtacaaaaaagattgtgacaaatattgcgtaccatgcaacagggaattgagcagcagacattactacgaattgcatatgctaaagattcacaacatttttgtgggcgattcgaaggcgctttacgaacttttggagtcatttgggccgaaacgcgagaagaaaatcatttaccgttgcgacgaatgttttggaggcgaattggactacgaattgttggaggatttgcgtcgccaccgtttgttggaacatggaaagaaaatgcgagagaaattcgactcaccggcgtagacaacttttttgaggccccctccccctcaaaatgccccccctctgttcctcctcccttttcccctcttcgccccgtcgttcgaccccaaaaatcgtcgctgtcggtcgaccgttcccttcgctttttcgccctccacaaaaa

SEQ ID NO: 87764 - DNA, 767 bp, Heterodera glycines
  misc_feature (722)..(723): n is a, c, g, or t
  misc_feature (735)..(736): n is a, c, g, or t
  SCN-specific regions: Sequence locations=1-767
atggcagcagtgatacaccaaacccttctgttactatgacacgcagtttgggtgaaaatgcaagaatggaattggcccagaaaatcgaaggtcagctcacgggacgcatcgccggcattcatttgttggagcgggaggacggactgctcgttgtaaatgaggacagaacgctaagagtgctgctcagacgcgagtcgggaatgttttggccttcaattatccatgacttgccgcacatccccacaaaactcagctgcagtgaacagaaaaacacgatttttgtcggttttgcaaatggacagatccacgaatattcaattgaaaacgatttcaacagcatttcattcaaacggcaatggaattcgcacaccaattccatcagtggactcggcttttcagaacgattagaacaaatggtcagttgctcaaaggacaaaacggtggtttggcattgcacgtcgaccactcgcaaaatcgcaagttactgtacgggttcgccttgtaccacacttcaattcgatggcgatgcttccttcgtttttgtgggcgattattccggaaatatttcagtgcttcggctggtggttgggacgcaacagcaaccgcaattaatcagcaaattatctgctcataccggggcaatcactgatctttgctgggatttgagccatcagcttcttttttcggcaagcactgattcgctggtcattgtttgggacatnncgaggcaacgcnngcactgttatgagctcaatgtcacaatgcca

SEQ ID NO: 87765 - DNA, 632 bp, Heterodera glycines
  misc_feature (23)..(23): n is a, c, g, or t
  SCN-specific regions: Sequence locations=1-151,173-215,250-345,367 -495,561-632
tggggacagagggaaggagaaantgttaacaaatttaaaaaagcaaaaaatgagttattaataattaacaaaattaaaaagtaatgattgccgtggtggcacacgtgaaaaaagaacggactttaggaggaattggaaccaaatagaaggaaggaaacacaaatgtacaataatataatgttgtcgtaacgtaatgagaatttgatcggaagcataaggaaaaggaaaggagagaaaaggagagatttatgaaagagagcgacagacggcggaaggagggacaactgacaaacgatcacagagcagaagcagacaacggaccaatggtacacaaatgggaaaggatgaatgagagaaagtgaaggagaagggttaggacggaaagggccaaatttggtgccattccaaaaaaaaggaaaagatgacattttggaagaaatagtaatggaagaagtaaaattttgaagaaatagtgcgataataatatttttggttgagaaaaagagaggagagagagtgagagtgagagaggaaagcctagtgagagaggggagagagagtatgaggattttaaaggggaagagaatgagaataatggagggaaaagatatgaagcgaacgaagagagaagg

SEQ ID NO: 87766 - DNA, 734 bp, Heterodera glycines
  misc_feature (45)..(45): n is a, c, g, or t
  misc_feature (665)..(665): n is a, c, g, or t
  SCN-specific regions: Sequence locations=1-570,592-734
accttacggcgttggctctttgggctatgttaaaaggaatttggncatttttccgacaacgcaatacaaattcaaagatcgaatggacctatttaacggagcgaaaaaggatgattcggttactttggaggatgcaattccgcacttaaaggaaatattccacgagccaaagttacacttttgcaccggtctcaaacgttgggtgtccggccccgtggtgcttccctgctctgagaaggcttttaaaaacatcggtcacagccttttccaaggagagtccatcagtcacagcaatgagcattggacagcccagcacatgcaccgagcattggcaatttgcatttcgcgccctcccagagacgaaggtgccgtcgatggctacgccacgttccaagacacgagccgtgccaacgaatatattttcgtgccttcggtaaaaatcagaaggcgggcgaggtacgggaaatttgctgtgcagggcgaactcttctaccgcgtgcttgactcgcagtgcggactttcactcctcgacattcatttctcaaaattcagccgacacttcccccggctaattctctcccatttgggctgtccaatctttggcgattggatttacgagcagagattgcttaacgttgacggacatccgatctgtgccgagccgnaagacgtgtggagggctgaggcgaaaaagttcgagccaagcgcctttctcaataaaatcggcatcggaa

SEQ ID NO: 87767 - DNA, 648 bp, Heterodera glycines
  SCN-specific regions: Sequence locations=1-648
ccttgggaagacgcgtgcgacgagtgccaattgatcatcaaacgcgttgtcaatgtcgccaccgacccggaaaaagttgccgagttgaagatccttctgtcggcactgtgtcaggagacctcctacgtggaggagtgtcgtctgttcgtcagcaaattggaccttttcctcggccgtctgttgccctttttgagggatgcccaccacgtgtgcaaagaattgcggatttgcaacaacggacggctccaacagtttcacgtgctcggcttacactttgcacgtgtaaatgcttcgttccaacgtaaggatttgatctgcgaggagtgtcaattggctgcccgggaattggcacgtgaagtcagtgagccgaaattccagcagtacgtggaggaatggctgcaggggaatgtgtgtgtccatctcggcactttgaaatcatcgtgtgagcaaatgttggacgaattcctcccggaaatgtggcgagaattggaggacattctctcggaccagaaaaagttctgccaggatttggagctttgccccgcgggcatttcctcgccgagttcggcccgacgccccacggcccaatcaaaggcccgcaaggtcagtcgccatttgttggccccgcgccgcgagtgatcgatcaaa

SEQ ID NO: 87768 - DNA, 636 bp, Heterodera glycines
  misc_feature (23)..(23): n is a, c, g, or t
  SCN-specific regions: Sequence locations=1-72,114-472,494-636
gtgaaatggaagagcgcgcgggnccatgtgaacatggacttactcaccgcgttggcggacaaaatgaaaaatgaggagcaagatgaagtgggggaggaagaggaggaggacgaattcccacacattgcaaatggcacggcagcacacctgccggcaatcattgaggacgaggcggaggacgaactgaacgccatgctggctaaagctcgtcggctgaagcagacggagacggacaaaatgcatttcgtcaagtcagagcagtacaacaatgatggcaccagcagcgacgacgaggagacaacgcccgctaccctagcgggcggacacagcacttccgttgtgttcgactccacctctgagaagtacaagtccatcggtggcagctttggactcttcacaacctccaaacaccaggtcaaaatggagacgggcatcggatttgacgagagcgaagcggtgccaaaacgtagcggaacagagcaaagaaaaaaggcaaaggaaatactgagaacggcaacaatttcaagtgtcgggggaagtgacaatgaaatggacattggcactgactttgacgggtttgggccaatagcgacggggaatggcaaatcgacggtcagcgaaagtgacgaagaagag

SEQ ID NO: 87769 - DNA, 658 bp, Heterodera glycines
  SCN-specific regions: Sequence locations=1-250,272-658
cctttactgctgatgctggacgagcacacaactctttcgtttgaattaccggccgagccatccttcctttgccagggtgcgtaattaacaaattaatgagccgaaaattggccccctgctaataattgtccatcccacccttccttcggccgcaatggcccccaaattccttccgcccgaacttctgttcgaaatcgtggcgtttatgcctgcaagaggtgccgtgccgaatgctcttacctcctgctggttgcttcactcacttttgctccaacgagtcaccaaatggaagcagcaaatggctgaagaccgacaaataaaacttttaatggagaaaatggatgagaaattcgccgaaatgaaagctgaactgaaagctgaaatttctgggaaattcgccgaaattgatgggaaattcgccgaaattcaggaccaaatccaggacttaaaagccgaaataaatcaaaaggcggccaaaatcagcattgaagtgcccgctcaaggactcaccattcaacaggcgaccaaagcaggcctgttggacttggaaagcggacaattaacgattatgtgtgacacggcgacaaacttgtcactggcgaaggcaatcgaaattggcatgttggacccacactcgatgactgcgtgcgactcgagc

SEQ ID NO: 87770 - DNA, 681 bp, Heterodera glycines
  SCN-specific regions: Sequence locations=1-148,170-681
ccaaagctgttgggacgaactcgaagaagctaagagcaagactgaatttaatgttggcctaatggacgtgtgggatttcggggcattggcacttttccacaaaattggcaccaaaaatgttgtgcttacacacaatttcccgatcatgtcacacatgtacaaatacatggaaaaagcttgatggcaaactgagaatagcgaattatttaactaccaaaaacaaatattggacaagggagtgccagaactgttctcagcagtcattaacgacaaaaatgttggaaaagctggtgcatacaaggaaaagcataacgaaagttcggatattttctcaaaagtttatgaaattgctgatcaaaaattcaaggaccttttcaagaacaatgcatttcctactctggaaaaattgttcggagatgcaaaagctttgttcgtcaacacaacgcctttattggattatgacattggcagtttgccaaaacgcgtcaaattcattggtggcattgatctgatgcagcccgatcacaaggatgctttaccgcaagtttttgggcaaccaaaaccggtgatcgtgttcagcatgagttctttactagaaccatccaaaatgccattggacaaatttaagacggttattcaaggacttggaatgtgtgaaaaggaagtgatttggaaatatgc

SEQ ID NO: 87771 - DNA, 567 bp, Heterodera glycines
  SCN-specific regions: Sequence locations=1-246,276-457,479-567
cagttgatggagcacgacctcgagggcgccccgtacggctacacgccgttttgcgacagtcgcaagtccatggacggctttcggttctggcggagcggctactgggcccagcatttggcgggccgcaaataccacatcagtgctctttacgtggtggatttggtcaaatttcgccaaattgccgccggcgatcgtctccgtggccaataccaagggctcagctccgacccgaactcgttgtcaaacctggaccaggatttgcccaacaacatgattcaccaagtgcgcatccactcgctgccccaggaatggctgtggtgcgagacgtggtgtgacggcgtgtccaaggacagtgcgaagaccattgatctttgcaacaatccgctgaccaaggagccaaagttggactcggctgttcgcattgtgtccgaatggaccgagttggacaacgagataaagcggcttttgacaagcagcagcaacaatagaagtgctgttggaaagccgcaagacgacgaaacagcatttgatgacgatgaaaagcacgaggaattatgattaaaagaa

SEQ ID NO: 87772 - DNA, 684 bp, Heterodera glycines
  SCN-specific regions: Sequence locations=1-2,254-339,376-684
tcggaggaagaggaataaaaggaggatgataaagaaaaggaagaaaaagcggaggaagaaaaggaggatgaaaaagaggaggaagaaaaagaggaagaaaaagaggaggaagaaaaggaggaagaaaaagaggaggaagaaaaggaagatgaggaagagaaagacgacgaggaatagtcggaggaaggagaaacggaataagaggaggacaaaaaggagtcagaggaggacaaggagcacgaggaagaggcggcgacacgtgcgccgagtgcgaagaaggaaaagtcggtttccgaatccgttgaagagtccgatggggacccggtggaacaggagccagaggaagaagaagaagaagaggaggaggaggaggagccgtaccacccgttgaagtcggacgaaatcatcggcggatgcgaggacagcacggatgactgcgctgccaaaaagatgcgtctgtactgcagtgacgaggactacgaagaggacatgcacattcgttgcccgctcacgtgccgtttctgcaaacgcggagagccatggcattataattacgaggccacttacgagaaattgggctgcaaagacacgcacccaagcgattgccgacgggagaaggaatggtgccggagggggacttataaaagttttatggctgaaaagtgtgcgctgagctgtcgccgg

SEQ ID NO: 87773 - DNA, 715 bp, Heterodera glycines
  SCN-specific regions: Sequence locations=1-208,230-693
tgtgtcttgggctgacaataaagcgcaacaatgtcttctgacgaatcgacgacttcttctgccagtgctgtgagcgttcagctgcgtgaagtgcccatcaaagacttcaatgacgtgcttccggtgctgcagaaaacgctcaaccaattggaacatccgttcatcaagaaggctgaagaaataagcggaatggaacgtgaaaagctcttctacatcacttcctctcttgtgctgctcgtgttgatgtactgccctggcaatttgtttctctctactcttatcactgtggcctacccaatgtacgcgagcttgttgaccctcaacactcaaaacacatcggaatacacccagtggctcgtttattggtgcgtgttcgccgagttttgccagttggaccttctctttggctctatcaatggctgccttctgctgctgtacgtgcctttgaagaccgtctttctgctctacttggcccttccgcaaacttatggcgctcacaacatgtacgtgaagcatatccgcaaatggattgccatgacgaacgtattggacaagatgaagaagatgttgtgatcgaggagacaacgtatcactgtgtaatgtatgtaggatgattctttgttgtgattcctatattgggtgtatgtattggttgggggagtaaagcccctatattgtataaacaatatttgcaaaaaaaaaaaaaaaaaaaaaa

SEQ ID NO: 87774 - DNA, 215 bp, Heterodera glycines
  SCN-specific regions: Sequence locations=1-215
ccatcccccacaacatacgagccgtaaccataaagggtaaagcctgaggtgcctaatgaatgagcttactcacattaattgcgttgcgctcactgcccgcttttcacttgggaaacctgtcgtgcctactgctttatttaatctcccaacgcgccgtgagacgcgggttgcgtattgggcgctcttccgcttccttccccactcgactcatgcgc

SEQ ID NO: 87775 - DNA, 468 bp, Heterodera glycines
  misc_feature (118)..(118): n is a, c, g, or t
  misc_feature (439)..(439): n is a, c, g, or t
  SCN-specific regions: Sequence locations=1-9,31-261,283-468
ctctggccgccattttgctggccaaaaaggctttgtggctcttttccgccctttccgccggctccccttgcgcgccctttgtgtcctctgtcggatgcaaattccaagaattccccgnggtggttcgtttacatgcactcattggcattatccttggcatttagtgtgcaaatgtacacaaaaagcctaagcgactctatgggttacagtgctgaaagaaacacaccgaactcccccaaaaacattgggacgacagcaacagaaagacggcacgggcactggaaaagcatcgtgccaatgccttcgtcgcctttgccccgtcccttcgccgtcgtttctccctcagacagtcgcccactttccttctcttttggctttgctccgctcgtcaaatagcgctgctcgccctctgtttggcgcccgcttttctgttcaccgntttcgattatgaacctttgcgtcgtaaaa

SEQ ID NO: 87776 - DNA, 196 bp, Heterodera glycines
  SCN-specific regions: Sequence locations=1-196
tttgacgcgtgatgggctcgaaggacatggcctgcctgggcttcagcgccgatctggtcatgcatcgttctgcccacggccgcttaccccaagcccgtggacgtgaagatgcaccgagaactgcccgccttcatcagcaaccgcggcggcgtggccctgcgtcctggcgacggcgtgatccactcgtggctgaacc

SEQ ID NO: 87777 - DNA, 675 bp, Heterodera glycines
  SCN-specific regions: Sequence locations=1-1,24-61,112-290,312-675
caaatgtttgttgttgaacatgcgcacggcgaccaaatcactttcggcgaattacaatctctggctccacctatgagccgactgggcaaatcatgtacaacggagtccaaataaactgtgcaaccgaccaacacaaagcattgacagaattagccaccatttgttcattgtttatcgactcttccgtggattacaacgaaatgaaacacgcttatgaaaaagttggggaggccactgaaacagcattggttgtgttggctgagaaaatgaatgtgtacgacacgccgaaacacaatggactgagtccgcgcgagttgggcagcgtgtgcaaccgtgtgatccaactcaagtggaaaaaggagttcacgctggaattttcacgtgataggaaagcgatgtcggtgtattgtaagccgccagcggacagaacgggggccggtgccaaaatgtttgtgaaaggagcgcccgaaggggtgctctcccggtgcacccacgtgcgcatcggggaccaaaaggtgccactgactcaggcgatgacccaacgcattgtgcagcagtgcgtcaaatacggcaccggacgcgacactttgcgttgtctcccgcttggcaccatcgacgagccgccaagccccgaaaacatgaacctcgaggactccaccaaattcggcgagtacg

SEQ ID NO: 87778 - DNA, 568 bp, Heterodera glycines
  SCN-specific regions: Sequence locations=1-247,270-568
aggattccgtttcgcacttaacaacgctgccaatgagggccatttggaggtgtgccgtctgctggcggaggagtgggccttagatgtcaaccaacagaccatcctatatcgaaccactgcactgattagcgctgccagccgatgagatttagccttcctgaatttcctcatctaacatggtgccgaccttcaacatgttgaccagattggaaacaacgatttgatgtgggcagggatcattatgaaaactgaaatggcacagcttttggtggccactcggcgcggacattaaccaacgggacacgcgacggcattcgaacgcaggatatactggaactgaccggacatgcccaaatgatggccattattagaactacggcgacggacaatgggcaacacgcggaatgcaccgatggacagcataatgatcagcaacagatgtgacagcatcgcagagagagcgaatcgctggccaaaagccgcggatggatttattcggaaggcattaattgatcactaatgtattgtatgttattatgcccaccatctctatttgatccgatttgtc

SEQ ID NO: 87779 - DNA, 748 bp, Heterodera glycines
  misc_feature (2)..(2): n is a, c, g, or t
  SCN-specific regions: Sequence locations=1-69,91-508,531-748
cngacgatggaagtcccaacgaagaagatggggcagtgactgcactgatgaagaggacgacgaccaattggacactggctttggtttcctgaacaacataactctgagtgaaataaagcaaattcactatcaaacgaatttgaatgtggcaaaagtgaagaaggcgatgctaagggtcatttcctcccataagaagtgtgctcctccggcagttgattttgtgatgggtttggacgacgaagctgatgcagaagaccatctgtcatcttgtccatcacaggacaatgattcggaacagattgaaagcgatgttgaaagtatggctgccatttccgacgatgggacgccaactgcggagggagttcagaacaccgcagcgaaagcccgggggatcaacagcagagagttattcgcgaatgtcccgcgttttttgaatggaatgacaaagcgaaatttgactgtcacaaattcattcgctgttctgctgcatctatgcaacgataagcaattcactttggcacaaatggaaggagagaataaattagtcgaagggcattctatggctgaattcttcgttaaatttccaaattgagtccgagtaccttgtatctcacaaatccgaaaccgatctccagacaaattgtatagtttattattgtttctacattcttttgctgaatacgaatgtggtatacaaagaatatcaaatggaatgactgattatactgtatgtgataataaatcagct

SEQ ID NO: 87780 - DNA, 586 bp, Heterodera glycines
  SCN-specific regions: Sequence locations=1-89,113-364,387-586
ttttatggcgcgggatgcctgataacagaaggatgccgaggcgagggcggttttctgatcataacgaccgggaacgcttcatggaacgctacgccccggtggcgaaggacctcgcctctcgggacgtcgtctcccggtcgatgaccatcgaaataatggagggacggggagtcggacctctcaaggatcacattttccttcaacttcaccatttgcctcctgaacagctccacaacgtttgcctggcatttctgaaacagctaaaatcttctctggcgttgacgtcaccaaagaaccgatccccgtgttgccgactgtccattacaatatggggggaacaccgaccaattacaaaggtcaagtgatcagattctccaacgaaaaaggcgaccaagtcgttcccggtctttgggctgccggcgaatgtgcggcacattccgtccacggagccaaccgactgggcgccaattcactgctcgacttggtcattttcggtcgcgcatgtgccattaacattttgtccgccaataaacccggcgattcgctgcctcctttggaaacggatgccggagagtcttccattgcc

SEQ ID NO: 87781 - DNA, 698 bp, Heterodera glycines
  misc_feature (645)..(645): n is a, c, g, or t
  SCN-specific regions: Sequence locations=1-266,291-698
acatcgcaccgccgttccgcgcccgggacgaggccgaattgttgctgctgcccttcttccctgtttcggtttcactcagctgaacatggctttgctgaacgggtccaccggcgttgtgctcagcaaattcgagcagaattccttttgccgagtggtggagcaatacaggattcgccttttgcttctcgtccctcccattttggtgtttttggctaagagtcctttggttgccaatttcgacatgtcccatgtccgtgccattctctccggcgccgcccccgcgggcgccgatttatgcgaagagctgaagcaacgttttccaaatttacagcatatttgccaaggctatggaatgaccgaaatgtgtgttgccatcgctttgcccattttggacaaggaacggcacgaatcatcgggcaaactgctcgccaatttggaaatgaaggtcgttgacttgttgaccagaaaagaggtcgagttgggaatgcccggcgaactattcgtgcggggaccgacgagaatggttgggtatttggggcgtccgagtgagacggcgaaagtgatcgacggcgagggatggctaaggacgggtgacatcgtgttggtggacaagtacggcttcatcactgtggtggaccgactaanagagctgatcaaagtgaacggattgcaatcgctccttctgagttggaggattt

SEQ ID NO: 87782 - DNA, 642 bp, Heterodera glycines
  SCN-specific regions: Sequence locations=1-125,170-299,330-342,364 -413,449-452,478-513,535-545,592-605,638-642
tgtatctggttgatcctgcctgaactgatgtgttatttaaagataagcctgctgtgtagttaacctgccagacgggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagctggatctgtgct

SEQ ID NO: 87783 - DNA, 770 bp, Heterodera glycines
  misc_feature (668)..(668): n is a, c, g, or t
  SCN-specific regions: Sequence locations=1-770
ccccgactcgtccaaacacttccgaccgatgtgcaggagttcttcttacaagtcaatacgaagccttggagatgaaagaccaagaagtgcagatggccagggaaccaaccgcggccggtgcgtttggcaacggcacagcggatcaacaaagtgccggggatgaagccgtttggcgcagaattgggccaagaagtaaacatcttccgcccaggtcctttctcccgactaccaagaccccttcacgggcacgaaccgatacatgccgggctgtaacaacggagtgacgacggcacaacaaaatacgaaacgtagtccgattgtgcctctgccagacaatttctgcacttttggcctcgacggtgtgtccaaaaaagtgattgaacggctgcgcgagatgaatttgctccagccaaaagcgttgcaactgaacgatgacgaattcgcttcggcagaagtgatactctcccaagctgactttgccatcaatgagtgccaaatcgtcgcattagaaaaaggaattttgtggtcgcccgaaacgattgtgcccgcgttggatttgtttcgaattgctttgctccatccaaaattgaacgaaatcttttgctcattggagtccgttcttggaaacccgccaaaaggtgttccgaccgtacggcgtttggtggaanttgctcacttggcccacggctcggagcccgtccgcattttggcgtgccgttcgctggctaatgcctcggcgcatgactttggccggtctatgctaatggccg

SEQ ID NO: 87784 - DNA, 746 bp, Heterodera glycines
  SCN-specific regions: Sequence locations=1-456,478-746
ccaaagcaaagcctggatcacccaaatcaccatccaaggcaaagcctggatcacccaaatcaccatccaaggcaaagcctggatcgcccaaatcgccatacaaggcaaagcctggatcacccaaatcaccatcgaaagctaagcctggatctcccaaatcatcaccatcaaagaaaggcaatgtatcaccaaatgtatcaccctcaaaaggcaaaagtcctcaaaaactactgtcaccaaaagcaatgctgcaaacgcacaaaagtgcaccgcctgcgttggcccacatcctggcacatcattcgccccatttgccggtcggaagtgagctaagtccagctaaatcactcgacagccatcaccaacggcaaatgccactgtttgcggaaaaaaaatatggccaaaaccaccagtcgccttatatgtcaccaacaaaactgtcaaatggtaatgtctcaccaccacaatcaccatcacatcgtctacaacagattatcaagcggcattcacagacaaaggatttgtccagggaaaaagtgcaacgacaacaacaaagtccgctgttacagcacccatcaattcgcgccctaattggcctgcccaattcgccggctgacgaccaaaacccgcctccgccattcacgccggaacagcacgcgctgcttatggacaccgtactccgtccaccgtccggtcttccgttcgagagtccacgatcagcgccgtcaccgcttgagctgagcgag

SEQ ID NO: 87785 - DNA, 685 bp, Heterodera glycines
  SCN-specific regions: Sequence locations=1-338,362-685
gaatcccatttccatttctctactcactcataaatgctccaaacggccttaccattctgcttctgatcagtgttgtgatcggccattccttggccaaccttggcccaaccatcaaacataatcctcattttaaagccgtacaaactgcgcatcatttgcatgatgccattgcgaagaagcacgaggccgaagttacgcagatcatttgctccattagcaacgaacagcgtcaagcattggctttggagttcaaaaaacaattcggcactgatctgattgccatgctgaaaaaggagttcaaaagcgactttgaagaactgatgtaaattataaaatgcaaaaacagccatttaaatttaaatttacaaagcatttctttgatgcaaacgcccgccgtttacgatgccaaccaaatgcgtgccgcattgtccggctccaatgagtgagtacatttacaattgaattgggataaagcacatggagagaacttcaaaaaggaacgccagtagctcaacaggtttaagtgatagattacggtataaacgccataatgaccacaggagaaacttagctatttgttttggctaaatttaatgttcatataagccatcgaattgatggtggattctggttacagtttacctcatggcttaccgtatatacatttcattacggtgttactgta

SEQ ID NO: 87786 - DNA, 232 bp, Heterodera glycines
  misc_feature (185)..(185): n is a, c, g, or t
  SCN-specific regions: Sequence locations=1-154,178-232
gttgctccgatggacgttgaaaaggtttccgcccctagcgatgagctcgtaacaaactgcatgccgaatactgcgcacgacttcgcgagctgttcaacgcacacaaagtgaagcatggcggacttggccacgacgtgcagttggaaattgtgtgaaattggcaaatgaaaggccacaaaaattanaagctcaattttcgaatctaaaggacaaagtgcactcaaatacaata

SEQ ID NO: 87787 - DNA, 739 bp, Heterodera glycines
  SCN-specific regions: Sequence locations=1-739
ccacgacgaccgagggacaattagcgaagggaacgacgccgccaattccccaaacgtcacaacagcagcaaatacagcagccaatgaccatcagcaaaccgaaccagcatcacaacgccaacaccggtggacaccgtgccaacgccagcttgtcgccggcactgggatcctccggtttcggctcgtccgcctctagcaacgcttccgcccaggtcgagcgcgacctgatcgacctcttcgacgagcagtgttcgattgggccgccgctcaaatggacgccttcccctcctccgcttcaacagcaccagttctccggtgtgatgtacccacacaccggcgtaatagcctccatggacctcaaatccagaggctactacgtctacagcaacgagttcgacaacgaactctacctgttaacggaggagttgctggagaagggaagctggattaaatttaacatcctcgacgattattaccgcttgacgattggacagtacgccctgctcaaaaaatcccccttcgacgtaagagtcgaaagaaacacaatttatgtgggttttttcactgggtcttgggttaagtttgtctatatatattgatttttccagatgtgtgtcagcgcgtacattacccccgaggcactgacgcaacgtacaatcgacgcttcctacgtcaaaaatgtctacgacagatgccgcttgcttcagcatgcgcatgttgggaaggagctgaagctgga

SEQ ID NO: 87788 - DNA, 696 bp, Heterodera glycines
  SCN-specific regions: Sequence locations=1-190,212-410,432-499,522-696
cattcttaaaaaccagcagtatcagcagtcccttttgggccattccccccccccccccacaaatcagcacagtcaattcatcaattctttcgttccttcgttcatttccattctttgctgctctctttttctatcatttctcaatgctgcgcatgctcaacttttcgtttgcacagtattaaatcgaatgaaagaataatgaatttttccttacttatattctcccgccgatcaaatgggcccggaaattgtcactcgcgcacaacacaacaacaattgagtggtgtgtattgtgtttggtgaatgagcaatggcttaagaaagcacacattgtctgtgcaagatgagaaaggatgggagacggcgaaactttttattctcctcaataaaatggcataatttatttaccaaagaaaaagtcataataataagaaaatttcccatagggacggacaatcgccattttctcacattcttgattttacattttgattcccattgtgctgagctgatgaaaagagaatcgaattgctttctacaaaaaaaaaaccctccacactttcccgttccccccctaaccccccccactttaccccttcattttccgtgccccctgggataatttctcccgggggtttttccaaacccgccaccctctacgctcggtttttcacccctgtttcccatttggcccat

SEQ ID NO: 87789 - DNA, 522 bp, Heterodera glycines
  SCN-specific regions: Sequence locations=1-240,263-522
ttcctcggggatatcattgaccgtggcacgcacatcctgtagaccctttgttagctcctacctaaaaataaatgccctgagaattactttattctccggggcattcatgaatgcgcttcaataaccgaatgtattgctcttacgacaaatgctaacggacgttttctatcaagttatggaatacatttaccgattgttgcaactgtctaccaattgctgctttaatacactagaaaatcttctgttgtcgtggaggactgtctcccgatttacaaaatatggaacaacattctcagaattatgcgaccgactgacgtgcccgacacccgacttttgtgtgatcttctctggcctgacccagacaaatatgggcatggatggcgcgaaaatgaccgtggatggtcattcactttttgcccgcacatggtaccaaatttcttgaaccgacactacttggactcgatctgccatgcacatcatgcggtggaagactgctacgaactcttttcaaaaagacaatcg

SEQ ID NO: 87790 - DNA, 175 bp, Heterodera glycines
  SCN-specific regions: Sequence locations=1-149
acaaatgaatcgattgaactcaactgattgacatcagtagaattgtcggtgaaatgagacgaagtccactcttgtagtagttttttcacggtgttcagtatttgcttcgttttcactgttgttgttgcacataaacccgcgtttacgccaaaaaaaaaaaaaaaaaaaaaaaaaa

SEQ ID NO: 87791 - DNA, 725 bp, Heterodera glycines
  SCN-specific regions: Sequence locations=1-78,100-396,477-654,690-725
ttgattgattctccgatattttaattactctgttttttaaaaatcccaccgattggcactttcattccttggactttctctgcacttagaattatttaaatggataaattggttttaaaaatccgtgagctcctcgatgagaacgaagtaaattttggggaagtgcagcgaattttggaagagtataaaagtgagccgaaggattggagacaattcacacattttgacgaacacaaatacacgcgaaatttggtggacgcggggaatggaaaatacaatttgatgattttgtgctggggacccggcatggggtcgagcatccacgaccacagtgctgcgcaatgcttcgtcaaagttttggatgggcaacttttggagacgcgatttgcatggccaaagaaggaaaaagaagagaaagaggaagaaaaggaagaagagaaggaagaagaagaggaagaagagaaggaagaagaagagggaccgatgagggcgacagggacggagctgttcaaaacgaacggagtcagctacatcagtgacaaaatcggaatccatcggatggaaaatccctcgcacgtcgacccgacggtgacccttcacctgtacattcccccgtacagccaatgctattcatttgaccaagtgatggtccccattattttttcaatttaattttaattcttttttttcatcgaagcgaacggggtgaaaacagcaaaatacag

SEQ ID NO: 87792 - DNA, 741 bp, Heterodera glycines
  SCN-specific regions: Sequence locations=1-475,497-741
tgcgaattgaattttccgacttaaaaaattggagggcgaagcgacggcgaacaatcggaaggcgaaactgattttcttcttcgagtggtccatcgacgtcaatttcattgcaactgtttctggttccgaaactgagtacaaaggaagtgtggaaattctgaatttgagcgatgagaacgaggcacacgaaattgagatttccgtgcacattgaaacggcgggcccacatgaaaacgaaattcggcacattctctccaccgatgggctctcattcgtccgttccaaagtgggcacttacgtgcgcgagttgaaggaggagttcagcaaagggatcattttgccggtggacagcaaaggcgccattcgtccgcaggcggtggcaacgcaagggaaaacggtggtggacaagaggcgctttcagaatgatatcattcagaagacggaggagaaagtgaccacggcggaaactcaaaacgctctcaaaactggtggtttcgaactgaccgagacattcaaagtgccgcccgaacgcctttttgagattttgactgcgtctgagttggtcagtgtttggtctccgaattcgtcaattgatgcgcgggaaggtggccagttttcgttgcttggcggagtgatgtcgggtcatttcaccaaattggcaaatgcggcgcttatttcaatggcatggcgtttgaagagttacccatcaggacattttgcagatgtgacatttacgcttaa

SEQ ID NO: 87793 - DNA, 796 bp, Heterodera glycines
  SCN-specific regions: Sequence locations=1-587,610-724,747-796
aatcgcttttctctaattagatggtcgaacttgatggcgcgcctatgatttccgctgaagagattttggaccaaaaattctttccagactgtgttcggaaaattaaaaaaacccatgaagaaataatagagccttcgacatggagaaatttgacataattcaaagaacgatgcgaatgtattttgagtcggaagattcctcggatgtgtttgaaggctttctgaacgttgtcaaatatgtgaagtcacttaccactgagcaattggacatttcgctcgtcaaactcgctctgctcgcattttacgaatttcagaaactcggaatcgcgcaaggccaacaaatcccttttgaccttcacattgataagactcttctcttggatgcgctcgtcccgtgtttccgacttaaaaccaaatacatcgaagcgatcagttccgtattccatctgaaggacagggaaatggttgaagttgcgattgctcaaattaaaacccttttggagaacgaagtgccaaaggctgtcttttggatggaccatttgaatctgcgcgaccatttcccatttaacacaatcgtttgtaaacttattttggaaaaccaaactgctttgatttatcctttcgtcggtgaaagtcaatttcgacgtaataaactcattcattatttggacaatttgttgggccttgttttgcgcaacagacgagcgggagatgaatatgagcgggaaattatgaaaaaccaaaaacaattggagaagctcaccagaaagtttgtcaagaatttcgaattaacggaa

SEQ ID NO: 87794 - DNA, 215 bp, Heterodera glycines
  misc_feature (178)..(178): n is a, c, g, or t
  SCN-specific regions: Sequence locations=1-215
ataaaatcgtccgtggcttttacggttggcttctccgttccttggattggattaaccggcaaattttacaccgactctctctctctgctcataatcgcgaggacatgataatcaaaagtttccgcagatcgtaccctggactgctccagcgtttgaacgaattgaaacggagcggaanaccggttttacaacggcggagtgttcatcttgttaca

SEQ ID NO: 87795 - DNA, 452 bp, Heterodera glycines
  SCN-specific regions: Sequence locations=1-17,39-401,423-452
cgctcaaaatgccgtcgatttcctcccaataaaaacatcaaattctcgaagaagaaatgaagccatcattcaacttcaaacttttcgcatccgtctttcttgtgctttgtgtggcctcacttgtcctctgtcagcataagccagcagcagcatgtaaaccgcccaaaaacgtgggaagaggcaacttggcactcacgcgatggtggtgggacggccgtagttgtaagcaattcatctacaaagggcagggcggcaacacaaacaatttcccatcaaataagctttgtgatcaagtgtgcaagccatgaatgagtcgtggaggtgcagcgtgaagagaccaccccaagaagaaaagtgaagaaattaaaagaaaaatttttcacaaaaataaaattgtgcattacataactacataatgatttcgtcggaataaatcaaatccccccccccca

SEQ ID NO: 87796 - DNA, 554 bp, Heterodera glycines
  SCN-specific regions: Sequence locations=1-31,53-554
caaggagagtcgggcgctttcggatcggattgttcgcattatttcatcgcttgcgcaagcagttccatcagactttcatgaaaagctgtccgatgaatcgaagctttggcttgggatgcgcttgaagagcttcacaaatgctttaatgagcagctgcgccggagaagccttgcgtgatggtcgttcaatgttggctgagatgtttcgggcaattccaacagaaagctctgctattctgcgagcaatttacgaatcggtcacaaaccatgggaatcaattgaatgcccaattagttctgatacgccttgctgctgaatctggagacggacaacaaagcttgttgcacgtgttgaaagaggtttctggtcgagaaagtgttcccggcaaatttctgaagtcgctggaaacgtttcaatatttgtgcaaccagttgaaaaaggtggaggaacagcggaagacagcgcaactcacacaacagaatgacgacacctgttaacgatggagccgaggaacagcatcatgcaacgacatcgaaacctcaagcccgaccacac

SEQ ID NO: 87797 - DNA, 288 bp, Heterodera glycines
  SCN-specific regions: Sequence locations=1-288
tgactggaaagcgattgattcgcggcaatattgcgaagggaatgcctttcatccgaaagcaagataaatgggcatatattcactcttaagtatggacttaaacccgtcaggaatttacggtcgccgtggacgcccttagagaacctctaaccgtgttgttgcacatgataaaaaattgctctgacatagaacagagccgtgatttccgctagcaaatattttaatgcataaactcgacccgacagctctgagccaatagaatgtctctccccgtggcaagcagtttgg

SEQ ID NO: 87798 - DNA, 197 bp, Heterodera glycines
  SCN-specific regions: Sequence locations=1-197
ctatgacgcgtgatgagctgaaggacctggcctgcctgggcttcagcgccgatctggtcatgcaatcgttctgcccacggccgcttaccccaagcccgtggacgtgaagatgcaccgagaactgcccgccttcatcagcaaccgcggcggcgtggccctgcgtcctggcgacggcgtgatccactcgtggctgaacc

SEQ ID NO: 87799 - DNA, 240 bp, Heterodera glycines
  SCN-specific regions: Sequence locations=1-120,143-240
ggccagctgcgacaaaggagcagccgagcgcggagacgacggaaacatccggagactcacctgccgccaccgaataagcgcccaacgaagaacagccgatcgcggagacgaaggaaacaaccggagacgcacctgccgccaccgaagaagcgcccatagaagaacaggaatgaccggccggctacttatgacctgcgatcgatgattggcttggtttggattgtccataccccttcttgg

SEQ ID NO: 87800 - DNA, 162 bp, Heterodera glycines
  SCN-specific regions: Sequence locations=1-130
ggcgatgagagctgctttttacatttatgctgttttcgcatagtagaaatattgtgtggatttgagcgtattggataattgttatttttagaggatgcggatctttttgccagttgatttatggacgttgaaaaaaaaaaaaaaaaaaaaaaaaaaaaaaaa

SEQ ID NO: 87801 - DNA, 797 bp, Heterodera glycines
  misc_feature (740)..(740): n is a, c, g, or t
  SCN-specific regions: Sequence locations=1-450,472-797
gaagggcgccgatccgaatgagccggtggttggccgtgagaacgacattaacacgaacttgacgcctcttttcgttgctgccctccatgcacattttccgctgtgccgtgtgctcgtcgaccgtggtgccaacgtggacttgggatcggactgcccaacgccgctgatgatggcttgcaaaagatcgcaaatggaaattgtcgcatttctcatcgagaatggtgccgacatcaatctgcagaatggtgacggagaaacggcattgatgatcgcctgttcaagggcaaatgtggacattgtgcgcttgttgctgtcacacggtgcaaatgtggagcaaacggattacgaaggattccgtttcgcacttaagaacgctgccaatgagggccatttggaggtgtgccgtctgctggtggaggagtgggccgcagatgtcaaccaacagaccatccaagatcgaaccactgcactgatttgcgctgccagccgaggagatttggccatcgtgaatttcctcatcgaacatggtgccgaccttcaacatgttgacgtggttggaaacaacgctttgatgtgggcagtgatcagtaggaagactgaaatggcacggcatttggtggccatcggcgcggacattaaccaacgggacacggccggcaatcgagcgcaggatatagcggtactgaccggacatgccgaaatgatggccatttttcgtactacggcgacggacaatgggncacacgcggaaggcaccgatggacagcaaaatgatcagcaacagatgtgacagcagc

SEQ ID NO: 87802 - DNA, 444 bp, Heterodera glycines
  SCN-specific regions: Sequence locations=1-444
ggtggtggtgacggccgttgagggggaggacagcacacggagagaaagtggtagtgagaacgattgtgacgcagtacgaaaagaccgggagcagtgacagtcatctgaccctgtctgcggagatgcgcaaggaaagctctgtcgacgaatcggtcactgacaatgtgcctgacatctgcacatgccgctgttgcaatgatgctgaacatcaaagaataccatccttccctgtctactgttacgccagacgctaccatgagtctggtgatcggtggctttggtgacgagtatgaataattgtgaggttgatcagacataggattggtcgtaatctctcatcatcaattggagatgatctctgtctactagaggcctatgttcaatgccctacgagacattaactagtttatattcccgcagacacagtgtgcgaacaaatccctc

SEQ ID NO: 87803 - DNA, 442 bp, Heterodera glycines
  SCN-specific regions: Sequence locations=1-219,306-442
ttccttgcatttcgcgttggcttcgtactcgtcaggtttgtccgttggacaatcgcgactgggagttccaaagatatggacattgagttgccttgcggttattgcacacggctgaatatttgggatcacgatcattatttaaatatgtgttttgttaggtacttgacaaaatcatgactttgttttttctatgaaagtattaaaaaggattcaccatataaaaaaaaaaaaaaaaaaaaaaaaaaaaaaaaaaaaaaaaaaaaaaaaaaaaaaaaaaccaaaaaaaaaaaaaaaaaaaaaaaaaaggtcctttggtttgttccccctgtttaataaaatcccccgggcccccttgggggccggaaccttgcaacttgggccccaattccccttttagggagtcgttttaaaattcactggccgtcgtttaacaacgtggggc

SEQ ID NO: 87804 - DNA, 554 bp, Heterodera glycines
  SCN-specific regions: Sequence locations=1-554
caggatggacacactattcaaatgttgtaaaaccaacagtgcgttggtcatactcgacaggagtgatgaccctgtcttaccatctgcttaaccaatggacctacgatgctatggttcacgaactgatcgggctgaataaccaccgggtgaccttaaaaaacacgggcaacgatgggctgaaaaatattgttttgaatgctcagtacgacgaattctattcaaagaatatgtatttgaattttggcgatatcggacaaaacatcaaaggactgatgaatgaatatgaacggaaggctaaaacacaccaacagttggaatcaatcgcggatatgaaaaaggttgtggaacagtaccctcaattcaagaagatatcgggaacggtcgctaaacacgttcagttggtgggtgaacttagccgaatggtcaccgatggaaatttgttggaaatatcggagttagagcaaaacattgcggtcgcaaatggggattattcggcttgtctggattcccttcgaagacttatgcagcgtcccaaaacaactgatttgaatgcc

SEQ ID NO: 87805 - DNA, 458 bp, Heterodera glycines
  misc_feature (14)..(14): n is a, c, g, or t
  SCN-specific regions: Sequence locations=1-458
ttttcaacaacatncggaaccaacaccagtcagcagaagagcaaaaggcaaacgaaggctgtgacccgggggagaaggagcgcatggaacgtgagagtttgatcgaggaagcgtacgctttgtcacaagaggccaacatcagcttagagcaaatcatcaaacggtacaccaaatgccgtaatcagttccttgaacgtgtcaccgaccaaatcagcgaccaactacaacaggatcattctgacagcactgacgacatcagcaccaacaaacatgagcggaagaagcgtccgattgtgttcatttcgccacagttgcgcaaacgggtcaaaatacaacaacaattggcggaagcggactcggccaacgacggcgacgacgacagtgaacaaaagcaacaaaaagaaaaaagtccatttaccattcccggcggtgctgaagacgacgaaatgacagatgtt

SEQ ID NO: 87806 - DNA, 235 bp, Heterodera glycines
  SCN-specific regions: Sequence locations=1-133,155-235
ttgagtcccctgtacttccaaatcgtcgctcaatgctgtggaagcgaattggggttctgaatgacatacgataacataaaacttagctcttcaagagcaggacgaatgagaccagaattgtgtgatgacgccggtccaaaaagggatgggcctacatttgcactctgatcctccagtgataaaccggtattttagcgtgtccgctcatgacgagcgatgcttgtgatgaccacac

SEQ ID NO: 87807 - DNA, 155 bp, Heterodera glycines
  SCN-specific regions: Sequence locations=1-155
atacgcactgaacgacccaaaccgattgttagctgtcgtcccttttcttgtccgtacatattttaatggcgctcgtgttgtgcagcgggcattgatcagtctcgtgcagtgctgcattgtccgtcaggtggacagtcagccgagcatggtcacct

SEQ ID NO: 87808 - DNA, 212 bp, Heterodera glycines
  SCN-specific regions: Sequence locations=1-84,106-130
agcagagggcggaattggggcatttatggcaaaaagacgggaaaaaagcgaagaaaggggagaggaaaagtgaccaaagaccaatttgttttgtttaattttttacattaaaatcctggtttgtcttattaaaaaaaaaaaaaaaaaaaaaaaaaaaaaaaaaaaaaaaaaaaaaaaaaaagggaaaaaaaaaaaaaaaaaaaaaaaaaaaa

SEQ ID NO: 87809 - DNA, 704 bp, Heterodera glycines
  SCN-specific regions: Sequence locations=1-212,234-704
gtatcgccgttttggcgtcgttgacggagatagcatttaccagacggagaaattcaacccagtcagaatttgaacatcaaaattgagccttcgctaatcgccgtcggtgccaaacacattgccattgtgctgaacagcaaagcatggttttatgaaatcaagcgcaatggcacttcatttatgtacgaacatgactatatgacgaccattgtgaagatgaagctgaaccgcgattttgtaatggcgcagttggacaatcgcgtgcatttgcacaaaatcatccgttcccaaagcgatcattccgatccctccgataattacatgacaaatgacgtgctttttcccaactccaacgagacgaatccgcgtgatgtgattttggacgccgatctatcagaaaaattcttcatttactccacacggtcgcgcttcctcaattattactcattagcccatggtcgttttgtcagcgacttcaaacattcgtccgaaatccgaaagttgttcagtgaaccggatggaattcggaccattttttacgatgatgcccatgatttgcacatttattcacccgcggatgatcagctgagcaaaattccgcgcgagggttcttccatgagcaaccaaaagtacgatggctgcctttgggaagcgtttactgtggataaagacacctttttggtgcacgatcagcacactatttt

SEQ ID NO: 87810 - DNA, 684 bp, Heterodera glycines
  SCN-specific regions: Sequence locations=1-479,502-684
cattgaaactgtttatcattcactgattattccgcacggaaatgaataccacgcgcaaaagctttgactgaaatgaaaatttgggaggcttaaatgcatccgatcacttcagccaagtaaaaaaaaaaattttaccactgagattctcatggaaattccgaggcttacatgtcaccccaaaataatacacataataaagcatttttttgtttttaataaacctaaaacagtgacaataaagacaataggtaaatgatagaattttataagtggtcagcaaattatattcattcttttggtgcctttcagctctgcccccccccccctccgaaacttatcggtgatttgattttctctgactggtctgatctgatatggttaaggcaaggtgtaaaaaaatcaatcgtccgaattaattttattattaatgaaattctaattctcatttattgtaccaaacgaaaaacaatattcagtccaaacaataaaatatttaaagcctttctttccctgcaaaaataagatcaacaacaatccctcttctgtgaaatgaatgctttagctattgttagtctctttgtccaaagcacaaacagccgcggcccgggcgaaatattcagtgaaacatccatcagctgatgatgatagccaaaaattgagaagaaagccatcattctattcact

SEQ ID NO: 87811 - DNA, 290 bp, Heterodera glycines
  SCN-specific regions: Sequence locations=1-290
aagatggttttttggaaagataataacgtttggtacgcgacaacgcccgaaggcgtccgtcgatggtccatctcgacctcaacacgcggcctcaggaaatcaaatgtagcacagaggcactctattttttttggccgccattcattgcctcaagacacacttccaattttcttacagacattgcccttgatagccccgtggaaaggctttacggcgctcatagaggcagacaaaatggtcaatttcggctgtcaaagccatcgatggctggcccactcaatggccatata

SEQ ID NO: 87812 - DNA, 175 bp, Heterodera glycines
  SCN-specific regions: Sequence locations=1-68,91-175
attggcatggaccaatcgaggaaataacaggcatgatagattgcgctgattaacgctgccaacagcagtttatgtggacaagaaaaatgtatcacaggatgcaggggttctgccatcggtgaatttgagaccggatgacaggagaatggggggcacagatattgacataaaacga

SEQ ID NO: 87813 - DNA, 294 bp, Heterodera glycines
  SCN-specific regions: Sequence locations=21-26,50-294
ttttttttttttttttttttgcttccttgctttctgacttattttcctcctactatgggccaggaccacagctgaaaagaatacgaggaggaacaatggcgggcgggagaaagggaaggtaggctcaaatcgccctaacgagagacgaattacaagttatgatggactggaggattacaaacgtcgcaaccgggaaaatcctttcgaatcccaacttaaattctttgcagcacatgcctcttgctgcaaatgatgtattgagcaataggttccctccgattgacctacccaaca

SEQ ID NO: 87814 - DNA, 416 bp, Heterodera glycines
  SCN-specific regions: Sequence locations=1-387
tagtggaggagaagttaacggcgtaattcggacggaaggagaacaatggaagcaattgagaaagttcactctgaaagcattgagagactacggattggagaagggagccacagaagcgatggtgctcgaggcaatcttcactctgatcgacgaggtggagggggaggtgaacagcgggaacagtgagctttctttttatcggaaggtcgatctgatgacggggtcggtgatcaaccgaatgctcttcggattctcattttacggagaccgctacaaaacattcacttttctgaaagatgcgcttgacgtggagcaagaatatttcatctcactaatcagccaaatgatcgaagcgcggccatggcttcgccatttgccatacttttcaaaaaaaaaaaaaaaaaaaaaaaaaaaaa

SEQ ID NO: 87815 - DNA, 327 bp, Heterodera glycines
  SCN-specific regions: Sequence locations=1-327
tgacccacccgtgcaaacttgaagtggccatggccacccccgctgaacttgacttgatgccggtcattcttgaaatcaataaggatacgttttccgttggtgtcactccgaccacccttacatccgttggaaagggtccgtgcttttcctgtcagcaaagcgaagaagtcaaccgtcagtcgatggccgcagcttctgaaggaccttgtaacttcgcttgccaatttccccgccaagtcgcagcagccgtcgaactgatgggaccaatagagggacgattaagtgacgatgcgaaagacggaccgactaaagacccattttccactg

SEQ ID NO: 87816 - DNA, 741 bp, Heterodera glycines
  SCN-specific regions: Sequence locations=1-267,289-383,405-533,573 -587,610-741
gacggaagtgcgacgagtgatacgcgacagcgaatgcgccgattcggaaagacatatttgtgctcatattctcgactgtgcatagatgccaagttgcgttgcaacggcgaagacaattgtggcgaaaacgacgacagtgacgaggcgcattgctcccgaattgaggccctcgcctctcccaccacaattgtcgtcgcttacatcgtttcgggcatcattttcttcttcattttgtctctgttctgttttctgttcaagtcaaagctcgaaaagaaaaataacgcaaaaggggaagagaaacgaagtcggagagagagggaaaagcggaagagagcgcagagaaagcggagggaggggcgaaagagtgggcggaaggcggagggcgaagcgcagagacagacagcgcgacaacccagcagacagccgaggccacgcagaacggtggcggacggacacaaattgtccggcatttacggaggcgtgggcggcactcagtcggtgttcggcagaagagggacaatgagaagaatggcggaggaagagagcgaggaagagggagcaacagcaacagcaggacaccaagaggacgcacaacaccaccaccacaagcagcatcaccacgattacagtcaacaattctcacaacatggacaaactgaccaattcgaattggaatcgcagaaaagaccaaaggccaatgagaataatgtccgaatattttatggataattggattaagaa

SEQ ID NO: 87817 - DNA, 340 bp, Heterodera glycines
  SCN-specific regions: Sequence locations=1-248,272-340
aaccgttttttccaccatagacatttggtccaccagatctaccgacgaccattcgacggacgacctgagtatttgagctgcatagggccgaccacgccggtattgctgctggcacgagtcagcacagccgactacccatgggacacggctgaacacatttgggcgaaccaacgcacacggtaaagcaatgcgcagccaaacgactgcctactgaacattttgaacacctgccaatggacaactgtgcataaacttcccctacaatggtacaaccgtaccgaaacttactgtatgaagagcggcctgtacacaaataccctgagctaaaagacgtctacac

SEQ ID NO: 87818 - DNA, 323 bp, Heterodera glycines
  SCN-specific regions: Sequence locations=27-323
ttttttttttttttttttctttttttatataccctgcgctgaaacaaccccttatgattttcccccacggcctcaatgtcaggaggaaacatgtgactgtcagggccaatcccgcctttaacaatttccattagaattgacctagccatattgccaactacattttagtgcctaaaaagaactggcgagacctcacttttatattctatacagagatctcctgaaaccaacatgggcgaacgtcggctcttagtttaaaccaaacactatctcacataccatttttagccttaaggggataaggaacaggatatcaaaacatc

SEQ ID NO: 87819 - DNA, 584 bp, Heterodera glycines
  misc_feature (558)..(560): n is a, c, g, or t
  misc_feature (562)..(562): n is a, c, g, or t
  SCN-specific regions: Sequence locations=1-72,95-560
gtgatggaggactgtcgcctgtcctcttccgcctccacttcctcttcatccggacatcattttgacagaccatccgcagttgctcatccgtcccaaatgccatcacataattatcaccagcatcatcatcttttgagatggcgttcaaatgcgggaaaaatggcaaagacagcagcggaaagaaacagcacttccgccatgttggaagcgtcgttcggctgcatcgaccagcacaaccatcaccaccgctccacgccctcttccccttacgccgcccaccaccaattgcctccgggcactgtcattccgtttcggtcgagcattcagcacctgaggcattggcacggaggaagcgatgccgaggatgatgacgacttggacgatgtggagatagaggtggaggaggtgctaaacgaagcggacgacgcactcagaggaggcgccggaggggggcacgactcgggcaccggcatggagagcatgtcatcggccgacatccaaccgaacggcgcaccatcggttggccgacgatgtctcaacaacggcgcaggggacgtnnnanaaaaaaaaaaaaaaaaaaaaaa

SEQ ID NO: 87820 - DNA, 325 bp, Heterodera glycines
  SCN-specific regions: Sequence locations=1-325
gacgcaacagccacaaaaaccgatggaagtcgagcagcagcaaacgccacaggcacagctacagcccaagaaggctatagaggacgaacaacagtaacaggtcattcagtcgcagcagcagcctcagaagtccaagtacgtgccaccgtcgatgagaaaatatcggagcgatttgtttgatgaaaattgagtatttaatgtgtgcttaattggtgttgcaaagtattgttgatgagacatttaagcgttttggagttgtaataaattgttgttggtttttgctcatgttttttcgaaataatgacttaaagttttgttggctatt

SEQ ID NO: 87821 - DNA, 424 bp, Heterodera glycines
  SCN-specific regions: Sequence locations=1-340,363-424
tcttttacccgcttaaaaccttggcatttatcttcgattgcacttggcttcattacaccgctggctgctgctttatccgcttggcctttttcttgaggcacctcgccttttctcatttccgctcccattttttactttttcagcgtctattcactgcaacttctaaatgcgtctaatttcagttacaattttggcgttgtgtatggcccttttcaccattcattatgattgtccttctcatatggtttcacacctcattaaacatatgttaaatcatacgacgaaaaaaatggacgaattgcacatggaagaattggcgattattacaagtccgcctaatattctccaatgatgaaaaacacaataattcgacgcattattacataattacataccatgtaattaaatcagcacaatctccggg

SEQ ID NO: 87822 - DNA, 286 bp, Heterodera glycines
  misc_feature (17)..(17): n is a, c, g, or t
  SCN-specific regions: Sequence locations=1-286
ggcgtgccggaatgggnccttcttcatgaagcagaaaataccaacgcttgcggcacttttgctctttttcatgctctgacgaataacaccgaccgaattgacattggaaacggcgtcttctatgattggtttaaggcggcaaaacaactcaatgttgaacaacgctcggaccttttggcaaacgattcggagttggctcatttgcatgaacactgtgctttgagggaatcggagacagatgtcccaaggaatgttgctcaccacttcatctcatactttacacatg

SEQ ID NO: 87823 - DNA, 184 bp, Heterodera glycines
  SCN-specific regions: Sequence locations=1-184
aaagactggcccgccaacttttgcctgtgccaatgccttcccctttgaccatggatggcactgggaccagttgactgtcacgtcgtaacagaccgtctttcggcacggccactgacatggcgcatcttctccaacgcatcgcaacgtgcgacaacttcaactgatgcacggttcagaaacaaca

SEQ ID NO: 87824 - DNA, 398 bp, Heterodera glycines
  SCN-specific regions: Sequence locations=1-16,38-287,310-398
ttaaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgtggtactgctcttcacttccctggcgacgggtggggcggaagcgattgggcgaagcaatgctcagggaggaaatgccgccggattggcgccatcgcatgtgaccaaccgctcaatggctccaccacctcctcctgtgcaatgtgaaatgggggcaaatcgattagaaaaaatgagggcacacctacgcgaacttgctgagaaaatgccggtcaatgaatcgaaccgt

SEQ ID NO: 87825 - DNA, 295 bp, Heterodera glycines
  SCN-specific regions: Sequence locations=1-295
tgggacaatgggcaagccaagtgagatttggacggaaatgagtcgggtggaagtgaagaacagaaaaaggacactcgaatgataatccgtgcgatctaccgacggacagtgtattaagattaattaacaccgtttcattgcaaatgtatctcaaatggttgatgatacaacagcaatacatgtgagaaaaaaagagcaaagatatataaacgcattgaaatcgtatggaggaaacgaacacggctggataaagactgatcgcactggcggactcaaactgaccaaccagggtcag

SEQ ID NO: 87826 - DNA, 645 bp, Heterodera glycines
  SCN-specific regions: Sequence locations=1-352,380-563,590-645
tctcgctggtgcgaagattatcgaagtgggcgacacgccaaaggaacgggcattgttcaacggggcgcaaaaactgttcggaatggtcatcactattggacaggcaattgtctacgtggcttccggaatgtacggaaacccacacgaaatcggcgcctttatttgcttgcttatcgtaattcaactcgtcgtggctggtctcattgtccttctgctggacgaattgcttcagaaagggtatggacttggctcgggaatttcgctgtttatcgccacaaacatttgcgagaccatcgtttggaaggccttttcaccggcgacgatgaacacgggccgtggcacggaatttgagggggcgatcatcgcacttttccatctgttggccactcggaatgacaaagtccgtgcacttcgtgaagctttctaccgacagaatgtgccaaatttgatgaatctgctggccactgttctagtttttgccgccgacatttatttccaaggctactcgtgccgattagcccataaaaagtgctcgctaccgcggtcagcacagatcctatccgatcaagctgttctacaccagcaacatgcccatcatcctccaatctgcgctcgtctccaacctttacgtgatctcacaaatgc

SEQ ID NO: 87827 - DNA, 348 bp, Heterodera glycines
  SCN-specific regions: Sequence locations=1-179,206-225,248-270,344-348
gggggggggcgaccgcgacttgaccatgaatcgccaaacgactctctcaatcgtgttgtgtctttttctgtcccttcctttatcagtttgtctcggcgctgatggcccattgggtctcttcacattggctccttcccaaccctaattaatattgtaattgccttcctcgtctaagttcgttagacatttgatattaattttattaaatgattcgttcttttccggccctctcttttctcttctcttgaaaaaaccgatggttaattaattaaaaaaaaaaaaaaaaaaaaaaaaaaaaaaaaaaaaaaaaaaaaaaaaaaaaaaaaaaaaaaaaaaaaaaaaattaat

SEQ ID NO: 87828 - DNA, 187 bp, Heterodera glycines
  SCN-specific regions: Sequence locations=1-92,114-164
ataacgagaaattggctactcgcttctcggagtggcacaccgaacgattcaacgagtacaaaagagcacaccaacagcccaatgatcccatgcaatagtgattattatttattacggtgccatttgttttgttcggcttatttatccaataaaaagaccgatgcaaaaaaaaaaaaaaaaaaaaaaa

SEQ ID NO: 87829 - DNA, 278 bp, Heterodera glycines
  SCN-specific regions: Sequence locations=1-104,129-278
tcccaaataaaatgaacaaccacccaaaaaatggataaacacatgaaaaaaacagcatttgtaacgcgtgcctcgtcctcttaacaaatataatttccctcaccaaaacattttctcaaaccaaacattcggtcctttcggccaatcatccgctggaaccggcgtcatttggtacggcatttccgctgctttggtcccccggcgatggggacaatggcccaaggcattcaatgccccgaattacaaagcggccaattgaattcccgcgggcgtcatgg

SEQ ID NO: 87830 - DNA, 197 bp, Heterodera glycines
  SCN-specific regions: Sequence locations=1-197
agcggcgtcgactttgcctcactttcgtgtctgtcgaccattactcaatcgacctctgacgaattgggcaaaaagtcgaaaggctctcccacaattgaattgctccgtgccgagtcggactgtcttcctcccgaatggcttttgcccaactcttcgacatattttgaagccgctgattccatggccgagcacagcaa

SEQ ID NO: 87831 - DNA, 452 bp, Heterodera glycines
  SCN-specific regions: Sequence locations=1-30,52-414,436-452
agaacctctgccggaagaacaaccacaacataatcaacagcagcaacaacatgttgttggtggaggtggtggtggtggtgagcagtcacaacaacaatttgcaacggaggaagaggaggagcaaccggttagcagttatgagcaaccacaaccgcaacaacacgttccggccgacatggttgactgtggtggtggtcgagcaacacaacagcatccgatggatgccgaaaaagaatatatggaggaggagcaggacgaattgggcaacatcattggcgttggcacgcgcattgtttcaattgcatagcattcaacatctcctacagcttttgcccatgtttgtggtgcagagcagtagtaacaacatccatggactaagacaacaacagtcacaggacattactgcagcacaaccggaacaccattatcattcaattcctattggtcaccgc

SEQ ID NO: 87832 - DNA, 439 bp, Heterodera glycines
  SCN-specific regions: Sequence locations=1-439
gctgaaagcgttggggtatactccgactttgacatggagcctcctgcacttaatgggcacaaatgaaggcactttggctgacacgggccatgacctgcattgtatgccattgataccgaataactttacgatgcaatggccaaagtaagggcacactgtgcaccaatccccgacattcggaaatatttgctgaaaattccgttagcattgatggaatgagggggctgaatgatccgtacgacggcaaacaattcgccactttcattgggctaacgcaaatctgggaaaacttcttgaatctgtgctcaaacgctggcggagaattgacgtggaatgatcagctgatcagtcgattagaggccgaacattgcgatgtcggaatgtgcgaattgtatgacatttgccgcttcgctatgttccatcgaattgcggcaaacga

SEQ ID NO: 87833 - DNA, 714 bp, Heterodera glycines
  SCN-specific regions: Sequence locations=1-434,457-513,535-714
tgtggactgtttattggcgccctttgctccggcgatggcccgactgtcttgcgattgtcgacgcctaattcgtgctcagtctcttgacgccctcgggaattcctttcgtgtgcccgctttaagtgaactcatgcaaccggcggattgggaggattgttttgctgaattgctcttccccctcctcaccaaactcttggccatcagccccccaatttctcccatggacccaattgggatggaggaagcccaaatcctctccattcaattcatttgcaaaattctgctcggcaatcttacgcaaattagcagattggactcttttgccgatttgctttcacatctttttgagctgatggaccaatttctggagggaagttcgtgtatcgaccttttggcggaagtcatccaagaatcactgaaaaattgtgctctcgtctgtgaaaactttggcgtttttcgcgacaatttggccgaattgcacggccaattgcaggaaaggctaaacgcactggcgaaaaaacatgaaattgcttcctctgttggcacaataaaactgagcacttgaaaagggataaaagaaggagatgaaagattttttgattccacgagctaatggctccccaaattaatgtgatatttgtgatacccatgatttcgcacaatatttccaattgcattgtcatagtttgtaaattcaattgttcctttgaatac

SEQ ID NO: 87834 - DNA, 652 bp, Heterodera glycines
  SCN-specific regions: Sequence locations=1-438,463-652
atagaacaaaaatggaaatccaaccgcagccttttgtcgatgaagccgctaatgttcaaaatattgtgaatgctatcggaaaatgtcctttggcgattgctgtgccgcaagagggcagtgaaacagtgccaataagtccaagcttcacgggtaacatcaacatgtttagttcgattcccatcagtcaggaattgccttttacttcaccagccaatgaactcggtgtttctgctcccctttctcgacttcgttcagtgactgatttcgatgaccaaaatcaagccgaaagtccacgagcctccaacagttttccccagaatttggcgtcacataacaaaaatcggatgcgcaacaattcctttccttttgcttcacttttgcttgagtcacaaagttcgtccagtcaaacattgccaggggtgccggagaacgacaccgtttcggggaaaaccggcgaaagtgacaatctctccaaaagaggggccaattttttgcacacgaaagtgcattcggcccaggaattgacaatgcggcggaactcatccctttccatggacactttcggggatttaagcaccaaaatcgcttcaactcaaagtgccgagaaagttcattttgcttgtggcgaacaggaccaacggttggaaaatga

SEQ ID NO: 87835 - DNA, 719 bp, Heterodera glycines
  SCN-specific regions: Sequence locations=1-442,464-719
cagccccttttacacacgaaactcgccgaattattgaaggaaaggccgtgtgtgcaggagacgcgcattgccattctccgcacattgtggcccaagtgcattctttacaccgggcgaattgcgcgaacagctcagccaattggtgcagcgttttccgcacaacatcccaattttgcaagcacctctgcgtgttggcagcgattttcacaggcgccgctttttggcacaacatcctggtacagatgatcgttctcgtctgatccgcacctgtggtcgtattttcgccgctcatcatcactacttggccgagcacaaacgatattatgagcagaaattcgacaaccaagcctttcgaactttgctctaccaatatgtgcacctcttacgcaaggctgccgaggaaaattgtggtagtgcgcttcccgacgactatatttgggttttcttgatgcaacacatcacatcggagaggacaatgttaccaaggcgcgttattgacgaggtgtttacaattggccaaggtcgttgcccctggagtaagcagtttctcatggagtcgttgcgcggctgttgcgaccgcaccgacccatcggtggcaatggtaaacgccacaatgaaaacgcatggcatcagtgtgtactgcacggacccggaagtccaactgctgcttgagaacgtgtgattttggccttcgtacgaacgacgcattcattgcctgg

SEQ ID NO: 87836 - DNA, 172 bp, Heterodera glycines
  SCN-specific regions: Sequence locations=1-143,166-172
agaagggccgctgggggaaggagtcgggttggctgttggggtaagcggggggggggaaaggggggagccaattaaactcaattggtgatgggtatatgtcccctttacggccgcagaatcggtctcgcgttgtgtatttatgatttggtgccggcccgggggagggtggttt

SEQ ID NO: 87837 - DNA, 693 bp, Heterodera glycines
  SCN-specific regions: Sequence locations=1-635,657-693
cgtaattatctcttctttgtgtacaacaataacgacgacaattgagcaatgtcggaccatccaaatgttgcgctggccgaccttagccgcgtggcaaacgacgtttggctggacactctgttctggattgatcgcgctgaagtgggcatgaagtttgcactgatcgacgcacgtttcggccggctggtggccacgcatttcaacctgcgcaagtggtggctgggcgagctgggcgttcatcgcgcaccgaggcgatggcagtgcggcggtacggcagcggtcagcgcaatggacgactacgcgatgtccaatcgactgccgctcgccacgtgtcctgcaccgaacggcgtgatcggcttccgtgccatctacatttggtacgtcgacctggaagtgatcgcatttctgcagtgcctgcaacgtgtcatcaaccgcggcatcgctgtgcagttcaccatccactcgacggacgtgcgctgctgggcgctgatggcgcaacgcatttggccactgatcgcgcacggcatcatcgcactgaacgacatgaaagccatcaacctcgcgctgctgtgtcgccatgtgtcgccgaatgtgctgttcgactgtgccaaccttcgcgccatcaccaacacgcacatgttccccatccgaccgcctcacagcgctgtgcacatcaacgaactgctccagccg

SEQ ID NO: 87838 - DNA, 90 bp, Heterodera glycines
  misc_feature (2)..(2): n is a, c, g, or t
  SCN-specific regions: Sequence locations=1-90
gngaaacggctcataggcgaccatctgagccgtgctatttgccgaatcgcgggcaaacacagccgagtgatatatgaccattgataacgt

SEQ ID NO: 87839 - DNA, 257 bp, Heterodera glycines
  SCN-specific regions: Sequence locations=1-45,67-139,161-257
cacgaagcaagaaccacgtttttttttagacacaacagggagggatcaacagctggaaaatataaaacggttatgtagataggaaggagcaaagatggccatatctgtcaatagagtaaaaaagttgtgcaatcagaagcgaacacgaaatacaagctggtacgggtaaagagccaagacatggggtgtattatggagggagtgaacaaacagtcagtgcgttgttctcattggcttgtttggagaggggtaaattg

SEQ ID NO: 87840 - DNA, 749 bp, Heterodera glycines
  SCN-specific regions: Sequence locations=1-61,84-160,183-749
cccggcaaccctagttaaactgctgcttgcgaaagcctatccgttggcacccgactagataattttgcatatattgttttgtgatatacatagtgattacatggctgtcgttgattattcctccaatttctggggggacaagcacattggatacagcgtgctttatgaaaacatgaagaagggcgaggagtcggttcacgaacttctgacctttctcaaagaacgcgtaaatatggaggacgatttattcaaatcgcttgggaagagtctgcacagagttaacggatacatttcaaacaagagcggttttgtggacgcgtggaaattggcgaaggaaaccttggaattatggactgaaatccaatcgtcgacacttcgaaatttaaatgatcttctgaaagaagtcgctcgttatcaagaagaattggctcggatgcgaaaacgtgccaaagacgcggacactttggaaacgatcaatttgatgcaaacaacgaccacctgtctgcaaaaagcaagggacacgttcaaccagcgaagcactgacgtggtcagtctgaaacagagcaacaaagaatggacggctgccatcacataagaataccttcgagcacgcaacatattgaacaatgctcacgatgagtacaagccttacatggacaagtacagccaaattcgcgacactttttaagaacgcgtcaaccaagcctcacgctctttccaagaacatgaccgactccatttgctacaaa

SEQ ID NO: 87841 - DNA, 635 bp, Heterodera glycines
  SCN-specific regions: Sequence locations=1-337,361-404,426-635
cagcaaacagtgggactggctgcacaaaaagtggtcgtaatgaaaatttcgtccgagccaattccgacgagtgcggacggcgtcaaacgaaggcaccaaaagcggaaaggcggaagagcgtcggaagaacggacggacgcaactttagtgaagcaaatgaaaggaaccaatactgttgttatgggaacaatgaaggaagaaagggaggaacaactgtaccagcgagaggggaaacccgaagcgaaagaggaggacaaattgaagacggcacctgcagaagcggagaaaaagacggagaagacgggcaaagatgggaaaagaggacggaagaagaagagggacaagcagcagcgggaagagggaggcggcacgaagttcaattggttcgccgagttcccattcgacaccgccgccacttccatctctgaagaacagtcagcaccagcggcaactgatggtgggatccccgccaaagtgttcgcgtcgcccacccgttcatttgtgctccctgcccacgagcgtcacttgctactgcttccctacatggacattggccttccggactggagagtgcacgactttccccaaccggaccgattcttgtttcctgagccaagtgaatggcacaaaaagcc

SEQ ID NO: 87842 - DNA, 100 bp, Heterodera glycines
gcccttatgggtagggcttcacacgtcatacaatggtgcatacagagggttgccaagccgcgaggtggagctaatcccagaaaatgcatcgtagtccgga

SEQ ID NO: 87843 - DNA, 690 bp, Heterodera glycines
  SCN-specific regions: Sequence locations=1-690
catttcgtaaaaattgcaaatgaatacgcaacaagagatgtcgtcattcaatattggtgtcttttgaaagctttggaggacggagtgaaattaagcggaaatgagccgaacacgaagaagtttttgcttgatttgatgacagtccttgaaaatatgaaacagtcgcacaaggaaaatgacgccgtaatgcaagaaattgtgggccaatcacacatcgaagaccaagcgcaacggttgttccaattcgcttacggattggaccagcatagccaattcggacagaagctcataaaggcattttacactgcaggttatttgtttgacgtgctcacatgttttggacaattggacgacaacattcagtctgcacggaaatatgccaaatggcgagcaattgacgttcacaactgtctgaaaaatggagaacaaccgaagcccgcgaccaatccgacggcccaacagcaaaaagaattgagtgaccaagatgacattgctgcacaaataaacgacaaactttcggccgaattgaatgatttgaacgcgtctttagccaaatcgccgcagtcgcccgccgtcccacagcaacaatttttcaatcccatgctcactcatccgtcgcaacagcgtcaaattccttcaaattatggccaaagcgatgccatcaacggcggtcactccaccgggcatttc

SEQ ID NO: 87844 - DNA, 152 bp, Heterodera glycines
  misc_feature (42)..(42): n is a, c, g, or t
  SCN-specific regions: Sequence locations=1-44,66-120,142-152
cctgatgggactcttacaatgaagtgatatgagaagcgcgancctatcttcaacttaaagaaggagaaagtgatcgcaagaggaggaatttgctgatcactcccttaaactggcaaatgccctccctccgtttccctcccccgcccctttcg

SEQ ID NO: 87845 - DNA, 321 bp, Heterodera glycines
  SCN-specific regions: Sequence locations=1-35,58-213,235-321
cgacaaaagtgtgctgaagcgggtggatgtgaagcagttgcagctgtttctgcagggggccgtcatgccgacggttaacgccggtcttttggcctacgcggagacattcaccgcaccggcgcagcagaaacggtacggcaacaaaggactgctccgcctttggaatgcactgaagactttgctggacgaattggacgaggcgatgcgcgtcaacgaagcgacgatgggcaacgagcggcgcgagtatcagcaaatgctgcgcaacgcgtacgaaaacactgtggagaaactgaacagggcattcgcacgcggcagagagtc

SEQ ID NO: 87846 - DNA, 436 bp, Heterodera glycines
  SCN-specific regions: Sequence locations=1-436
attattctcttccactcaattttacttttccttcaaaatgtcacttttttctccccttttctgttcttcatttttacttttgtcattctgcttttaatttgtgcttttttgcctcaaataagcgaagttgaaaatgaaattgccgaatttattcaccgtaaccctttggccattgaccaccgtatcgcactcgtccaactcattttcgaacaccaaaccgaactgattttggccaatgaacaaatctcattcccaaagaacatctctttagacgatctggcatttccctatgaaatgcttgtcagcaaaataacaagtgaaaattttgaagagttggcacagaatttgcggaaaaatgcactcaaattggcaaaagaaagcactggcaaattccattttctcactgaaaatcacttttatggccaatttatcaatt

SEQ ID NO: 87847 - DNA, 359 bp, Heterodera glycines
  SCN-specific regions: Sequence locations=1-214,241-276,298-329
ttcccggctgatgtgcgccagcgcgtaaacaaattgaacgccagcagggaaagtcattcagcactaaatttgaagagatcatgaaatatgtggacactttgcctgaaggcacaaaatcggctgccaaaaacattttccattgaatttttcatggaaaaggaggggaggaaagaagtggaaaaagcagcatggattaatgaaagcaaggctaaacaatatttattaaatattttattttttggtaaaatatttccaatttttcatttccaataaatatttttgctttgttcttttcttccaatttacgcttaagcatgcacataataaggaaaaaaaaaaaaaaaaaaaaaaaaaaaaaa

SEQ ID NO: 87848 - DNA, 640 bp, Heterodera glycines
  SCN-specific regions: Sequence locations=1-340,363-640
tcatccgaacgtggacacatttgcgtttatgggcaacccgcaaaaggactatctgatcgcacttgtggtcccaaatcgcaaaaacttgcaagcacttgctgaaaagaatgccgtcaatgagtcgagttgggaggcaatttgtgccaacaaagaaatggccaagcttctggaaaaggaactccaaaactttgttttttggaaattgcgcagggaggaaatcccgaggaaagtcattatctgtgcggagccgtggactgccgactcgggaatgctgaccgaagcactgaagttgaagcgcaagaacatcgagagaaaatttgcggaggaaatccgacagctttatgaggggaaatgattgggttgttaattcccggaggctatttcgcttcaatttgatctcgaacatcaaatcaagcagtttcattgtgccgtaattgccatcatcatgagctttgtacccccaattatacgcaattaatttttgttctgttttcactggtcattcttctgtcagtgcgcgtttatttattttttgatattcgttagggctcttgtcgagagaaatgtccccatttgtcgctattaattgatgtgtaatgtttgaatttgtattggaattgtacgatttcgtaaaagagta

SEQ ID NO: 87849 - DNA, 396 bp, Heterodera glycines
  SCN-specific regions: Sequence locations=1-58,82-220,243-396
ccagttgggaggcaattttgtgccaacaaataaatggcctaacttctggaaaaggaactccaaaactttgtttcttggaaattgcgcagggacgaaatcccgaggaaagtcattatctgtgcggagccgtggactgccgactcgggaatgctgaccgaagcactgaatgttgaatcgcaagaacatcgagagaaaatttgcggaggaaatccgacagctttatgaggggaaatgattgggttgttaattcccggacgctgtttcgcttcaatttgatctcgaacatcatatctagcaggttcattgcgccgctattgccatcatcatgatctttgtacccccaattatacgcaattaatgtttgttctgtctacactggtcatgcttctgtcagtg

SEQ ID NO: 87850 - DNA, 296 bp, Heterodera glycines
  SCN-specific regions: Sequence locations=1-296
ggatgggaatggcacccatgcccaaccgagggaaagtaaatgctctccatcctggactgcactcacacttccaaattccctgcgtattggtaatcaatctggctgttcacagaaccgatgcccaccactcatcgctggtcatatattgacaacagccatatgattactgccactatgggtgtaataaataagccttctcttatgccgaaacattgaaagaacccgaaccaggtcgtacacgcgcttcaaagaatatgctttcttaactaccactgcgcccggatggatgggaatag

SEQ ID NO: 87851 - DNA, 185 bp, Heterodera glycines
  SCN-specific regions: Sequence locations=1-185
gaaataatcggaaagagacctttgggttaattgaatacccgagcatggccgcacttactaagtaccgtattctttgtgcgaatattggcaactactcattcccgacggagatctgtgcctctgcctttgtggtacatgaactcttgtgcatgcgcatgaacagggcgcctcgtgcccgttacgac

SEQ ID NO: 87852 - DNA, 455 bp, Heterodera glycines
  SCN-specific regions: Sequence locations=1-165,187-414,442-455
tgggtgcatgagttcttcgtcttctgccgccccatcggacccgcagcaaaaaagcatttatgaattttcggccaaagacattgacggcaatgagaccagctttggcaaataccgtggcaaagtgctgttggtggtaacgtagcgtcgaactgcggcttcaccgactccaactacagtcagctgaagcagttgctggacaaatacaagtcgaagggactcgaaatcgcggccttcccgtgcaaccaattcaacaaccaggaatcgggctgcgccattgacatcaaagactttgtgaccaaaaagtacaacttcgagccggatctctacgacaaaattgacgtcaacgggcccaatgagcatccgatctacgcctatctgaagagcgtccaaggcggcatcctcggctttgatgcgatcaaatggaactttacccaagtttttgatcgataaaaacc

SEQ ID NO: 87853 - DNA, 506 bp, Heterodera glycines
  SCN-specific regions: Sequence locations=1-122,144-286,308-506
ttccggctgatgtgcgccatcgcgtcaaacaaattgaacgcctgcaaggaaagtcatgcactacttaattcgaagacatcatgaaatctgtggacacatttgtctgaacagcacaatatccgctgccacaaacattctccattgaatttctactggaacaggaggggacgaaagaaccggaaaaagaacatggattaatgaacgctaagctaaaccatacttattaaacattgtattcattggcaaaatatttccaattgttcatttctcgtgcaattggtgcttttttctttgcttccaatttacgcttaagcatgcacctgactgggcatcctcgtcactgagctacacctaaaactggtcgtgtgggtggttaccactgctgacccactaatgaatgtgcaagcgccttctagggaaccatatgggatatctccccacgcctcggatgcataacagtgtccattctatatgtgccacctaaatagcttggcttatccatggcc

SEQ ID NO: 87854 - DNA, 684 bp, Heterodera glycines
  misc_feature (172)..(172): n is a, c, g, or t
  SCN-specific regions: Sequence locations=1-566,589-597,619-684
cccaaattgtgctccgtctgttactctttgctgtcctcattttgaactgcttcgactgttgccatggatttcatcctaagtccagcacagttccaacgactacgaagtccagcacagttccaacgactacgacgaagtctcctccagctccaaaaaaaggaagtattcttgnataactcccaatttgggccaccattgtcatcgccgttttaattggcatggtcatcgcaattggcattgtttgctgcgcgtggtggtgctgccttcgtcaacgatatgttcgccgttctgcaactgatgggccctcctcgtcactgagcgacaccgaaaagtcaaagggcggcggatattcgtcgaagccgagcggattgatgtccaagctgcctttatggaagtcgtcgtcctcttcgaccaaaaccaaaatgccggacagtctcaaatcggacatacaaccaccaagggcatcatcatcaaaaacgaaagacaagtcttcgtcaacaatcccggacagcaaatatgccatgctgacgcataagcattgaacggaacggcgcggacggacggacgatgatggcattgatattgatgatatcggatggatttcatatttaattgctgtgttaatgatgcataactattgtattgttttagcctgccattgtcgatgctcacacattcatttcc

SEQ ID NO: 87855 - DNA, 400 bp, Heterodera glycines
  SCN-specific regions: Sequence locations=1-400
ttgacgatggtgaaagaaagtggcaacgacactcttacccagcacaatggtaactgactgactggtcgatatctcgctacatctgtactaaatcgaccactaactaatcaggcttactaatactcatatattcacatctcgaatcggcatcttcgtcgagctccacagttccatatgtatgcacatacttctccatttatctgtgtcgtacaagcatactagcaccaacacaatatcgcctaactttctatttcaccctcatatggacagtcatgaaatataagaacaaaagccattttcacccacaaaaagtgccgatttgcacaataacagcttaactcacgcgtctgaaagcatatctatcgaaatgaatacaactgattttacaataaataatgaa

SEQ ID NO: 87856 - DNA, 712 bp, Heterodera glycines
  misc_feature (707)..(707): n is a, c, g, or t
  SCN-specific regions: Sequence locations=1-162,184-712
acaaaaagcgtttcgggactgcacatcgtgggcgtcagcagcgcgatcggaaacaccttagtgaaactgttcaaacattgacgtggagatggaaatgccaactgagaccaaagaaagggagagggaaatgccggaagttgaaattggcggagaatgtttcgggacggcgaggggtgcggcgccagtggcaactaagacgacggagagcccccaaaagttgggcattcaaatgggcgaagaatggcgcaaccacgtgagatgcacccaattgtactggcccattgcttgctccttttgctttattcacccaattcagctatcaacattttttccaacccgagtaccataagaatttgtgtgaatcgcttttcaatgaatattcgcacgctttaacgaatcgaatttggaatacttttggcgactccgaatgccctgttctcaattacaacttcaatgccgaattcaatcaaagaactgttttctgcgcgtaataatgaaataattaattcagcaaatgatggcagtgatttatttgggcattttaccgcaagtgcaaccaaacaacttcgctatttggagactactgaattacggctggaattggtcaaaattcaacccgagttgagtcacagtttcatcgaatctcttattcaacttctacctgacccagaatgtcttgtaaatgttcaaatagtgcatcaaaacanaatgc

SEQ ID NO: 87857 - DNA, 716 bp, Heterodera glycines
  SCN-specific regions: Sequence locations=1-716
ccaaccgtgcccaaaagatctgtccggagacagtcgttccggtgcctatctttttctgcctgatggtccggctaagcctttgtcggcggatggcaacagttttctggtcgtttctggccccgttcgacaatatgttcatgtaaaaggacccgtcgaagttggcattcgtcaccaaattgcgctggacgtccatgcggggcatttggccattctaaacaatgtcaatttggctaccgagtcggccgctgaccggggagacagggcacagcacgcgagcaaacatcgaattggccatgcgtctgcgagtgccgttcatgcgacaggacaattttttcaccgatttgaacggctttcagatgattcgacgaagaaggcagccgcaattgcccctgcaagcccatttctacccaatgccgggcgctgcgttcgttgaagacgcggacattcgcctttcgctgatgggccgtcaggcactcggagtggccaacttggagaaaggcgagatgcaggtgatgctggaccggcgacttgttcaggacgacgaccgtggccttggacagggcgtggaggacaatttgttgacggagagtcgcttacatcttctgctcgagcacttcgaccgcttctgctacactcctgcgtcttcttccgccgatgggacaatcgctcttcattcattggccgtccaccattcgtcacttcgtctccattatccg

SEQ ID NO: 87858 - DNA, 589 bp, Heterodera glycines
  SCN-specific regions: Sequence locations=1-140,162-256,279-589
aaaatccttctgattgtgcttttggccgtcatctcattccgtctctcggcttctactggtgacaaaaaaaactgctaatgatgggagtggaaacaactcatcagctgggattggtacgaagatcaaaagaattgtccccgctggactgctcttcacttccctgtcgacgggtggggcggaagcgattgggcgaagcaatgctcacggaggaaatgccgccggattggtgccatcgcatgtgaccaatcgctcaatggctccaccacctcctcctgtgcaatttgaaatgggggcaaatcgattagaaaaaatgagggcacacctacacgaacttgctgagaaaatgccggtcaatgaatcgaagcgtctgtcaccgagtggacccgacccacatcatcattatggccatggatggatctaacggaggaagaaagaatggatgtttacttttcagattctattctatcctcttttattgattagttcttcaaaacaaatttctttcacaactttttaaactatttgttgctgtgaatctttttagataaatctaaacccccaaagtcagataactaaatttttaccgaat

SEQ ID NO: 87859 - DNA, 595 bp, Heterodera glycines
  misc_feature (594)..(594): n is a, c, g, or t
  SCN-specific regions: Sequence locations=1-169,191-285,308-468,491 -505,534-595
ttaaagatccgaaaaaatgccaacattttcaaatccttctgattgtgcttttggccgtcgtctcattccgtctctcggcttctactggtgacaaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgtttagttttcagattttattctatcctcttttatttattagtttttcaaaacaaatttcttccacaactttttaaactatttgttgttttgaatctttttagataaatctaaacccccaaaana

SEQ ID NO: 87860 - DNA, 528 bp, Heterodera glycines
  misc_feature (505)..(507): n is a, c, g, or t
  SCN-specific regions: Sequence locations=1-57,79-398,420-451,473-528
attaggactgtgtcaacactttgaaagaagcatttctccgtgccatactttttcttctgtctgctacagaattcaatttaatttgttcatcgacgaagcaattgttccatttgaattggtcaacaacagaagcaatgaaacgatgacaatgagcaaacaaaatgccaattgggtgatgaagcgatgccaaattgggcaaatggttcagtgggaggacgaaaagccgaacaatttgaacaatgccggcattttttatttgagcggcaacagaaaacatcctggttggaacgactttaataatatctgcatttgtttgtgtggcgacaacaaatcctttgggcctttttctccaccagcggcgagtcaaagcggcgaaaaagatgagaaatgatcggctattttggagaatattgaatggacaaattggtctgctgatcacttttgatgctcatttttgcttgttaattttgatgtgtctttctgacgaaaaaattcatttcttccnnnccaaaaaaataataaaaaaaa

SEQ ID NO: 87861 - DNA, 196 bp, Heterodera glycines
  SCN-specific regions: Sequence locations=1-196
agatcaaaataattgagaacactggactgttgttcactaccctggcgacggctggggctgaagcgattgggcgaagcaatgctcagggaagaaatgccgccagattggggccatcgtatgtgaccatttgatcaatggcgccgccacctcctactgtgcagtttgcaatgtgggcaaaacgggtgaaaaaaatgag

SEQ ID NO: 87862 - DNA, 570 bp, Heterodera glycines
  misc_feature (567)..(567): n is a, c, g, or t
  SCN-specific regions: Sequence locations=1-108,130-280,302-312,334-570
tcaaaaactcgcaattgccaaaacagcagcgcaagtgaaagaaataaagtcaccagccaagccaatggttctaaaagcagtgccgccccaccaaatgcatttaatgaatgagaaagttaaactgctgtgtctccacccgcccatgctcgttcacttgcgaccgttccttacagtacaccgatggcagccgaccgtaactcactgccatcgtacacttcggatggcaccaatttggacatggcccatgagaatgatgattatcagaattattactacggaacggaagacagcagcagagaatttgatgcatcggcggaggaggaggatgaactgtatgaggagggggacggggcaatgagttggcagacggacgactacggtattggcattggacaggagtacggtcaccaatcggtggaagtgccaccaaagtcggtgatgctcgactgaagaacaccagcaggatttttgtaaaaacatatttctcagatttttgaacatttgcattttatattcgcttagaagctaattttttttatctagctctaattatgtaaaaattaatanttc

SEQ ID NO: 87863 - DNA, 695 bp, Heterodera glycines
  SCN-specific regions: Sequence locations=1-35,71-77,155-155,190 -190,220-229,299-300,399-400,436-451,476-530,605-607,664-695
tatccggtgttgctacatatgctccgctgaacccgaaggctaacagagagaagatgacccaaattatgttcgagacgttaacacgccggccatgtacgtggccattcaggccgtgctgtcgctgtacgcctctggccgtaccaccggtatcgtgttggactccggcgacggtgtcacccacaccgtgccaatctacgagggttacgcgctgccccatgctattctccgcttggacttggccggccgtgacctcactgactacctgatgaagatcctcactgagcgtggttactccttcacgaccaccgccgagcgtgagattgtccgtgacatcaaggagaagctgtgctacgtggccctcgacttcgagcaggaaatggccaccgccgcttcgtcctcatcgctggagaagagctatgagctgcccgacggccaagtgatcactgtcggaaacgagcgcttccgttgccctgaggcgttgttccagccatctttcctcggcatggagtcggctggcatccacgagacgtcgtacaactccatcatgaagtgcgacattgacatccgcaaagacttgtacgcgaacacggtgctgtccggcggctcgaccatgtacccgggcattgcggaccgtatgcagaaggagatcaccgcgctggcgccgtccacgatgaagatcaaaatcattgcgccgc

SEQ ID NO: 87864 - DNA, 652 bp, Heterodera glycines
  SCN-specific regions: Sequence locations=1-130,152-164,186-541,563 -621,643-652
taagcgggacaaaaattgaccttaaaatgcttcttctacgtcaactttgccttctgttgttcgctgtgttttatttgattgatgcgcgaactcaatccgtcgcggtgaaaggacgtctgctgtgtggtacggcaccggcacgaaatgttcgggttaaactgtacgatgaagacgctggtgtcgacccggatgaccaacttgatgccggatattctgacccaaatggcaactttcaactttctggccatacctcagagctgacgaacatcgacgttgtttttaaggtctaccacgactgtgacgatgggattaagcccggctcgcgcaagttgaagttcaaaattccgaattcatatgtcacggacagtgcgacgccaaagaaaacgtttgacatcggtgtgctcaacttggagactgtgttcaaggacgaggaacgcgagctgatcgtgaccatgaagaagaagcggagaagccaccgttaccaagactttttggacattttgccatgaaaaagtttcgagaaaatgacaaattgccaagaaaattattttcaatttaaaaatagaagcggtatttaaaatggaaatattgattattaaagttaaaataaattgtaaccatttaattttacaaaattaattgtgacgttata

SEQ ID NO: 87865 - DNA, 230 bp, Heterodera glycines
  SCN-specific regions: Sequence locations=1-19,41-230
cgaagttgtcggatgaactggtggcgatggggctccatgctcatacggtcgtggacacctacacacacgcttgaagtgatgcacagtatggacaccattcatcgactacgaacattgaaattgccgccgagtgtctcttcaatgaaatgatgatccgtacgctttgcctccggaatgttctcatctccgccctgatgaatgatgacagggggcaaccggggatggaattg

SEQ ID NO: 87866 - DNA, 252 bp, Heterodera glycines
  SCN-specific regions: Sequence locations=1-252
agcctactggatgccgcgggattctagccgacatggcaacgctcaaggtatgatagtgcctcctgataggtgccgtactttgtgactcggttctcaaggcgtaccaccaccgacatcgattggcaataaaccctgctggcgaacttgccgagttaaaatgagggcacacctacgccaacttcctgacgatgtgccggacgatgtatggcatcagtctgtctcaacttggacactgtgcacatcgtccatgag

SEQ ID NO: 87867 - DNA, 721 bp, Heterodera glycines
  misc_feature (659)..(659): n is a, c, g, or t
  misc_feature (674)..(674): n is a, c, g, or t
  SCN-specific regions: Sequence locations=1-214,236-721
ccttttgtcccgcctaaatgccgcctattaattttttggcttcataaatatcggaagtgtttttcgaagaagaaattcgaggaatgcccaaattttgtcctcgctttttggaatggcttaacctcaacaaattggaccaaattctccgcctccgatgcaaaacgtttagctgctgcgattatgagccatttgaccaattggacgtccaattcaatttgaaacatctccaaacggaaattatggacaaagcgaacgggacgatcttctcggatgaactgctccaccttttgttcaatggaaatccgcacataaaagcatttagcactcgctgggtgatcaattgtggcgacgacttcaccgatcggctgattgagcatgccgccaaaggtttaaacgctgaaaaaatggtcccttcgattcgcttcgttccttcttttcaccgccaaagagaattgccaattccaaccaaaagtttgacggcgtcggagaaagtgcgactgatcagaagagaaacgaacgattggcgattgggagaatggcaaattgacaatttgcacaaagaaaacatcaaatttcgggtcgttttatacatttacaatgacgcggaaacgggggaagaagcgatcagccaattcagtatggacagagtccactgacanatgagggggaaaganatcagtatggacataattgtattcatcagtttattcacatacagtgt

SEQ ID NO: 87868 - DNA, 318 bp, Heterodera glycines
  SCN-specific regions: Sequence locations=1-318
tgttaacaacttacatacacaattggcctgtgatgcccaaggcgcatgattacatctgagaaggcaattccactaccgatgtactccaagaaaatttaggtacgctgaacagtgcttcatattgtcaaattgtcaggtcaagacttgctcgaattgtacacagtgatacaattatgcttaattccggacaacactgacatcttaattggggattattacggaagcactaatcataatttatacataataaatgagccgcatcatgtcttggaattgacatttgtttatttgacactattgcaaaactcggagaatgaa

SEQ ID NO: 87869 - DNA, 433 bp, Heterodera glycines
  misc_feature (158)..(158): n is a, c, g, or t
  SCN-specific regions: Sequence locations=1-433
cggagtgcagaccaaagggaaccctgcccaatacgtggaatatagggacatgcgcgtgacgccaaccgacgaccaacagcaaatggaagcaatgatcgccaatcggtgcaaagaggcgggcccggacgacacttacgagcacggcccaaagggaatgngctaagagctgacccccaccgacgcctcatgcccgaggaggcacgcgcattggtcggcgctaagcgaacagaaatgcgctttttccaaggagattttcatcggtggaacggacacgcatcgtctgagagagaaaggcatgccggcgattggcaagtcaccgacgaagaacacgcccattctgttgcacgaccacaacgaatttcgcaacgaaggcggttaactgcgcggagcgaaaatgcacaccaaaatgatcccacggagcgccaaaccgcca

SEQ ID NO: 87870 - DNA, 575 bp, Heterodera glycines
  SCN-specific regions: Sequence locations=1-190,212-575
caaagcgcaacaatgtcttctgacgaatcgacgacttcttctgccagtgttgtgagcgttccgctgcgtgaagtgcccatcaaagacttcaaggacgtgcttccggtgctgcagaaaacgctcaacgaattggaacatccgttcatcaagaaggccgaagaaataagcggaatggaacgtgagaagctcttctacatcacttcctctcttgtgctgctcgtgttgatgctctgccctggcaatatgcttctctctactcttatcactgtggcctacccaatgtacgcgagcttgttgaccctcaacactcaaaacacatcggaatacacccagtggctcgtttattggtgcgtgttcgccgagttttgccagttcgactatctctttggctctatcaatggccttctgctgctgtacgtgcctctgaagaccgtctttctgctctacttggcccttccgcaaacttatggcgctcacaacttgtacgtgaagcatatccgcaaagtgcttgccgtgacgaacgtattggacaagatgaagaagatgttctgatcgagcagataatgtatcactgt

SEQ ID NO: 87871 - DNA, 427 bp, Heterodera glycines
  misc_feature (19)..(19): n is a, c, g, or t
  misc_feature (56)..(56): n is a, c, g, or t
  misc_feature (68)..(68): n is a, c, g, or t
  misc_feature (142)..(142): n is a, c, g, or t
  misc_feature (151)..(151): n is a, c, g, or t
  SCN-specific regions: Sequence locations=1-427
gcacgcccccggctcccanacacccccaaacaacggccccggcgcgcacagcacgnaggagaggcaanacgagaagaaacgccgttggtgtccacacaggcacggcgagggcgccccccccacacaggacgggtacgggtcnacacacaantctcccggaggagggaccgcacatcgcccgagagacgctcgccgcctacgagtgcaagactatggacccccccgaaccgccttataccgacgaggacacgggtcccacagaagcgacgggccaccctacgacggtcacgctctggacaatcatagcgaaggagcgcacggagacacacatgaggggcgcgggcaccgcaccgggcgaagcgccgccctcttacaaggcgagagcggcgcgaccgtcgggacaccagccggacagcgaggaacaacc

SEQ ID NO: 87872 - DNA, 811 bp, Heterodera glycines
  misc_feature (678)..(678): n is a, c, g, or t
  misc_feature (746)..(746): n is a, c, g, or t
  misc_feature (809)..(809): n is a, c, g, or t
  SCN-specific regions: Sequence locations=1-128,153-811
ggaggtggaacccatcatcggcccggcgtggttgagctgatgctgaagggtgccattgaccgtgtgttgggaatgtgcgttggctatttggacaacggagtcgcccatcggccgttggacgtacaacggagagaacacattttgcacttggccactggacttggccaatccgggctcagggttattgcaatggcttgtggcaaagacatgaactcattgtattatgttggtttagtcggcatcatggacccaccacggcctggttgccgacaatccatcgagacggtacagaatgccggagtctccgtcaaaatggtcaccggcgatgcgttggaaacagcgattagcattggcactcgactaaacatcttcaactccggggacaacactctttcgggtgctcaaattgacgaactcacggacatggatttggaaagattaattcgcggagtgtccattttttaccgttcgtcgccaaggcacaaacttcgcattgttaaggcactgcaaaatatcggagaagtcgtcgcgatgacgggcgatggggtcaacgatgcggtggccttgaaaaagtcggacattggcgtcgccatgggcaatggcactgacgtgtccaaggaggcagccgacatggtgttgatcaacgacgatttcagcacgatcaaagcggccattganggaggggaaagggcatctaccacaacatcaccaacttcgtaaagttccaacttagcacaagtgtttcngccatttcgctgattgccatctccaccctcttccattttgaaaatccgctgaacgcaatgcanat

SEQ ID NO: 87873 - DNA, 637 bp, Heterodera glycines
  SCN-specific regions: Sequence locations=1-585
agaacggaaggtgatacgagttccgtaatgtttcggtgcgcgactcttcttcgagggacggggtcgaaatggatggcactttttcgttgggtggcatccttcggcagagagaatgcggcggattctttggcattggcgggggccgcgagggcaatttccaatcgctgatgctcgaacttttgcatacctgcggacgaaaaaaggcaatgcttttgaaagtgagattaccaaaattggacatttcggcgataaatgcgcgagggaaaatggcagaattgcgcggcatttcgatcgatttggacatcagcaagggcgggtgggacatgcaatgggtggactatgagaaggttcgaccaaaacagacggtgccggaacagccgcaagacgaggacggcacttttggggggaggcgaacgatggagacgcaaaccgagccaccagaacagaaagcggcacagcgaggagaaaaagccgaggaaaagcccaggggtcagtggcaagaggataatcgaccgcacgcagtgatttgactgtttgatcggttagccgacatttgcggaccattatttatgggttgaactgtctaaaaaacaaaaaaataaataaatttataaaaaaaaaaaaaaaaaaaaaaaaa

SEQ ID NO: 87874 - DNA, 738 bp, Heterodera glycines
  SCN-specific regions: Sequence locations=1-241,263-738
gtggagctgattccgtccgtctccacgaggaagtgacttttgaacttttgtctgtgaatgacgaactcaacaccacctttcgaaaagtacgaccgatgcatggccaattacaacgcaaaaggcgtcgacctttcgatggtggccagcggaagtgggacaaagcgacaaaaggagggggaggacgaactgttgatagacttgggaggagcagcggatggcatggggacgaagggaattgcggacaaaatggcacaaatcgacattcaccgcgacagaaaccaacgcgaagggaaaggcgccgggatgagcaacgaggcatacgtccacgaccaggccgagttgcccatgcgttcggttgtctataacaaaacggaaatggcggacgaaaagaacggcgaggaagcgccggaattgccaaagaaaaagccattggtcgacgacgggctctgacgattttagttcaaccaaagccccggaggcaatttgttggcgacatttttatactctttggacagagttccccccccccccctccatccgtcccataattttccaatttttaacttaaaatgcacgctctctcctccctttatattgctgcagctttgtgataactaaatattgacacgatattttactgtactgcttgtgtagcgattcgaatgcatcaaatccaccgtatctctgttctatttgttttgcagctaactttggaaatttcaatagatgtttgattag

SEQ ID NO: 87875 - DNA, 610 bp, Heterodera glycines
  misc_feature (589)..(593): n is a, c, g, or t
  misc_feature (600)..(600): n is a, c, g, or t
  misc_feature (602)..(606): n is a, c, g, or t
  SCN-specific regions: Sequence locations=1-168,190-284,307-466,489 -504,533-610
taaaagatccgaaaaaatgccaacattttaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgaccctcatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaacccctnnnnnaaaaaanannnnnaaaa

SEQ ID NO: 87876 - DNA, 699 bp, Heterodera glycines
  SCN-specific regions: Sequence locations=1-699
cagttgttggaggagtgcggcggatggaccgagccaaatcgttacaagatttatttttcctaccgaaacatcgaacatgaacatatttcgcatgaaaatgttgccgagttggcttcaggctcaaccatcggcaattattttggttccatcgaagacgtagagaacattagtgccaccgttgtacgacccaaatttcacacggtccaaacgcagacggaggacactaacaacaacgaaatgttatcaaacagcagtttttgcgccgagccgggtgcggacaacgacatggacggctccaagacggaggggatgacggcgcaagaattgcgcatgattgactacgagagggacattgaacggctggaaatccaatgctcaaagcagcacgaacaactgatcattctgagcgaacgtgccaagcacgtggaactgttggaggaacaaaaggtcgacctgcaaacgcagacggacattttgcggagacaaaatgcgcaactcattcgtgaccatgaggagctgaagtgtttgtttggcggcggttccatctcacgcaacggtttggaggagttggtgcgcagtgccggccaattgcgcgaaaagacatagagctggagaccaaactgaaactgttggactcgcagcagcaaccacgcgacgcgccaaccgtcggcgagtcgcgacgaattgcgcaactgttca

SEQ ID NO: 87877 - DNA, 234 bp, Heterodera glycines
  SCN-specific regions: Sequence locations=1-234
actcactaactctgccccctgtcattagttgtgtgtgtttctctgcttcttaatgcgtttggatgatgactcaaactgtaggccaaccaacttttgatcatgatcatgattttacgccccccatcaatcacaccactaattttacattgtattctctttttcgtttatacataattactgggagacaaaaaaaaacaataatccacactaattacaaatcaaaaacaaaaaaaa

SEQ ID NO: 87878 - DNA, 629 bp, Heterodera glycines
  misc_feature (624)..(624): n is a, c, g, or t
  SCN-specific regions: Sequence locations=1-36,90-629
gacgaagacgtacagcagcaacaagacgaagacgtacagcagccacagcaacaacaaaacatggaggaggaggaagagggacagaaaagtgacgacggaaaagcggaggaggggcagcagacgaaacgccaaattggcatggacgacgacgaagtggtggcggtgctgggccacgaacttggccattggaagttgggccataccatgctgttgttgacttgcactgaggtcaacttgttgctgatgctggtcatcttctcgctgttccatcaacaggagagtcttttcaccgcttttggcttcccacccgcgcaacaacagcccattctgatcggactgttgatcatcggccgatttgtcatggccccctacaccgaacttttgtccgttttgatgaatgtgatcacgcgaaagtgcgagttttcggccgaccgcttctccgcacagctgggccatgcatcgcaactgtgcagcggactgaaaaaaatgtgtaaagacaatctgtcactgcccattgacgacgtgctctactcgtggtgtaaccattcgcatccgccaattcctgagcgaattgaggcgttgaagaagtacgaatagggcgacgttgtttgatgaatgaagcancgaga

SEQ ID NO: 87879 - DNA, 725 bp, Heterodera glycines
  SCN-specific regions: Sequence locations=1-358,382-535,564-703
aaaaaggcggaaaattacctgttgaagcgaaagtctgcaaaaagttcttcctcaaagaatcggaaaaggccaaaagttacgcacagtcataaggcattggtgccccaggcaaaagcgaatggcaattccatcgatggcacaaacaccgaaaaaaggggttccgcctgtgcatcttcaacagcagcagcgaagaatgatggatccattcctatggaggattttgtactgccggcacagattaaagaaatcgtgccgaagacagacgctgcggaagcgccccttttaatcagcgaagtggacgacgggggaacggcaatcgaagaaggcccaaagaatgatgggccatcggagggaagtggggcggacgagacggaggagaagcgcaggtcggcacctcctcagctgaccaaagagtgtctgccgacgatggtcacgggccgttacagggaggacttgatcttttacacgccgaaggcacgggccaaaatcagagagaaggaaatgcaacgactctcttcaggttcttcgcgtcgtaaacagattttttcctccttggaactgacggaaagtgatgcaatttcgttggttggttcttcgacttcgagtagcaaagaccagcaaaagatggactccgatgacaaatcagtgccacctccacccaagccaaaagaccttggccaagttcccgtctatctgacggaacaccaaagggatttgttttttaa

SEQ ID NO: 87880 - DNA, 312 bp, Heterodera glycines
  misc_feature (302)..(302): n is a, c, g, or t
  SCN-specific regions: Sequence locations=1-265,287-312
ttcacgaagaaattctgcgagatctgtcggagctggattgacttatttgaggataaaattcaagtggaaaagttgatgatgcacaagcgttgcttcgtttgcgcaatttgcgactgtccgcttgagccgggcaactgttcccgagatgacgggatcatctactgccaattcatgtgcaacgaccgtgtgcctgtgcggttttgttctgcccatatgatgttgggatcgggcgaaaaatgccaattgttgaaggaaaaatggatgaaggaaaatgaggaaaagcaggaaatatgacacaacanatgattaatg

SEQ ID NO: 87881 - DNA, 637 bp, Heterodera glycines
  misc_feature (611)..(614): n is a, c, g, or t
  misc_feature (616)..(616): n is a, c, g, or t
  misc_feature (621)..(623): n is a, c, g, or t
  misc_feature (626)..(629): n is a, c, g, or t
  misc_feature (634)..(634): n is a, c, g, or t
  misc_feature (636)..(636): n is a, c, g, or t
  SCN-specific regions: Sequence locations=1-162,184-411,438-488,525-637
tgcatgagttcttcgtcttctgccgccccatcggacccgcagcaaaaaagcatttatgaattttcggccaaagacattgacggcaatgagaccagctttggcaaataccgtggcaaagtgctgttggtggtcaacgtagcgtcgaactgcggcttcaccgactccaactacagtcagctgaagcagttgctggacaaatacaagtcgaagggactcgaaatcgcggccttcccgtgcaaccaattcaacaaccaggaatcgggctgcgccattgacatcaaagactttgtgaccaaaaagtacaacttcgagccggatctctacgacaaaattgacgtcaacgggcccaatgagcatccgatctacgcctatctgaagagcgtccaaggcggcatcctcggctttgatgcgatcaaatggaactttaccaagtttttgatcgataaaaacggcaaagtggtggagcgttatgcgccgaccaaagaaccgaagaacattgagaaggaaattgagaaattgctggaggcctgatttgatgaaaaaaacttgagcttttcagacttatatgcccatagaataatttgtaatctaaataaaattcttatgctcannnnanaaaannnaannnnaaaanana

SEQ ID NO: 87882 - DNA, 119 bp, Heterodera glycines
  misc_feature (110)..(111): n is a, c, g, or t
  SCN-specific regions: Sequence locations=1-45,74-119
gcaattggaatcttttccgcacttcatttctttttattttatcccaatttttagttttatttatttttaaatagcgcataaaaaatgacgacaaattgggagaaacttanngaaaggaa

SEQ ID NO: 87883 - DNA, 629 bp, Heterodera glycines
  misc_feature (608)..(612): n is a, c, g, or t
  misc_feature (614)..(614): n is a, c, g, or t
  misc_feature (619)..(623): n is a, c, g, or t
  SCN-specific regions: Sequence locations=1-629
gtgatctcgcctttggtgacatgcgctactctgatacatacattgcgattagttattggcttgccattggcttggccattgcctcgttgttttatttccgtatgaaaatgccaaacgcaccgaggccaatcaaagtcaatttgattttccccgctatctttctgctcggctgtgtcgctttggtggttattccactcgttggcaagccaaaagacacggcaattggaattgcgattatgctcacttcggtgcccgtttacctcgttttcatttgttggaaggaaaggccttcctttttaacaaagcgtccgcgtccattaccatcttttgccagaagcttttcttagtttcgaatgaagcagaaaaatagacttacaaatgacagtttttatatttgtgattagtgactgaattttgcattttaattagagagtttttcaggtggggtcactaattacaatgttatttattactttaattgttgactttcgtattcttttcttttactttttttttgttgaaatgacttttttgtaaatttttaattgtgaatgttatttttgcctaatttgctaaagttaatgcaatacaataaaatgattaccgcnnnnnanaaaannnnnaaaaaa

SEQ ID NO: 87884 - DNA, 442 bp, Heterodera glycines
  SCN-specific regions: Sequence locations=1-206,228-442
ggagaaggaacggctgagaaaggatcgcacgacttgccttgaatcacagtccagggacttttcatgcgttttgaccgcttccgaaggatattcaagtgcgagaaaatcaagccaaaagccatccccagcatgacttctcactttcttcttaactgagttttcgcgggttcaaaagccgctaatgccgggcgggtacagtcgctacgaccaggagattttccagaaagagacggtggccgactttgaaattgaaaccgatctgagctttcacggaaatgctgcgctgaaccaacgcattggcgctgctcaccctcaaaatacgccaactgcgctaacatcgaacggcgtccaaaaggcggacccacgacgacccatcaccgctggagttgctccgtccgtcatgcgacaacaacacggcccgggccaaaaacgtgcgtcacgc

SEQ ID NO: 87885 - DNA, 660 bp, Heterodera glycines
  SCN-specific regions: Sequence locations=1-121,145-153,175-660
tagaccgggaaaaggacgcacaaattacactttgggtcgacaaatacgcgccgagcacctttctggatttgttgaccaaagatgagacaaatcgaatcgtgctgctatggctccgtctttgggatgaatgtgtttttgagaaaagaggaggcaaaaaatgggaggggaaccaccgacgcattttccagcggaacaatgccaatgcgacgtctctgtgggacaatttggaggagagggaccgaacacttcgaaatgtaacggccaaagggcactgacaaccgaatgccaaaacaaaaaatcttggcactttttgggaacgtcgttggcccgcgtggcggcggagcaggccggctaccggccggtgatcataccgatcagtgaactgcaaaacatggcggagctgaagtcgcgtcttgaaaatgccaccgattgcacgtccattgacgcgccttccacaatttgtccgtctccgccgcttcgacaggtgaagcaccgccaccacacgtcggcactcggccgtgctgtttcattgtggacgcggtggaacaagcgtcgccggaaatggttcaattcctttgttcatgggtccgtcgttcccgcgcttcctccgtcgtctgtcggtgtcccgtcatttgcacttgcgccttccttttgcgtgcg

SEQ ID NO: 87886 - DNA, 616 bp, Heterodera glycines
  misc_feature (593)..(595): n is a, c, g, or t
  misc_feature (605)..(605): n is a, c, g, or t
  misc_feature (607)..(607): n is a, c, g, or t
  misc_feature (612)..(612): n is a, c, g, or t
  SCN-specific regions: Sequence locations=1-168,190-284,307-466,489 -504,533-616
taaaagatccgaaaaaatgccaacattttaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtccgtcaccgagtggacccgaccctcatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaacccctaattnnnaaaaaaaaananaaaanaaaa

SEQ ID NO: 87887 - DNA, 460 bp, Heterodera glycines
  SCN-specific regions: Sequence locations=1-264,286-460
cgccttaactccttcaacaatcagaccagcaccgatttccctggccttccgaccgttcccccaccaattctttagccttacggggctccgcccgggtgggccccgccgcctccatcccaacaaaaggtccgcttgctttcagccttattgtggcgcttcccaattgtcgcttcattcccgtgaacagttcccaattctcagcggtgcttcttcctccacagcccaacaacaacaaaataatatttggggacaaaaagcgacgactgatttgtttaaaaacaaacccgagcaattgccgacgaaaaaagaggagccaaagcgatcaaaagtcatttcgcccccggacatttggcctgaaggaatgccagagcaactgaaggcgcgggagttgggattgcccgacccgcatccgattgtgccgccgcattggctaaatccacccaaaaaaaaaaaaaaaaaa

SEQ ID NO: 87888 - DNA, 594 bp, Heterodera glycines
  SCN-specific regions: Sequence locations=1-155,184-594
tctcgtctttcgtctacctaacaagttaacatgtacatgaacagcatgggctctcgtggtgcgtcatccgctgctgttgttgcttctgcagcagcattgtgcctattttcggcaatggcagtggtggtgtacggtgccgaaagcgctgggcctaaagcagaccaggccatggctgccaagcagttcaacccgtccgcatttccggccatgccaccagagcttgagaaaatcctgccagccgatgttgtgcaaaagttgaaagctgtccatgccgatatgtcgttgaacatcatgcagaaacaagacaagattgaccgtatcatgagctccttgccgggagaggttttggaccaaatcccggccccgcccggctttgaacgtctccccgacgatgtgaagaaccgtctgaagcagatcaatcgccaaaccaacaaagcatgggccgacaagcaaaaggaactgcaggagtatgtcaagacattgccgcaggaacaacgtgccattctgatgatgggcccaatgggaggttcgccgccgccaccgcccagctttggccggcgccgatgaagcagtgcttatgtgcatatatgttgc

SEQ ID NO: 87889 - DNA, 359 bp, Heterodera glycines
  SCN-specific regions: Sequence locations=1-359
ctcaccgcttatggaaccaccgttataggacccaaaaattgagcggactttcaacgaactttttgagcgagacgtggctggtgttctctttgtcggcactggcaccgctgccaatgcgttgtcaatggctcatgtgaatcgcgcgggtggcatcattttcgcgcataggcatgcccatctgattgaggacgagtgcggcgcgcccgaatattttacgggcggcgccaggttggtcggcgtaagcggcgccgagggacgcattgacccggaagcattaaaggaggcaatccaacgctctccgccaaatcccgtttcaatgcacactggccgccctatggctgtgcccatcacccaaagca

SEQ ID NO: 87890 - DNA, 458 bp, Heterodera glycines
  SCN-specific regions: Sequence locations=1-283,305-429,451-458
tggaggaagttctccgctctctgatgatgccctttacggcggaaggacatcagaatgtgcaccatgatgcacgccctgagcactatctcgtacaagatattgtgcacacgcggactaatagcctttaccctgtggccgacggctaaccgattctttattgcacaacccggccactaattgggagcgtggcgttggcttccaatccccgtggccctgagatgcgcacaaaaaggagggggacactggcggctaggggaagaatcactgaccggtgcccactgaccgatggatgatgaaatgaatggcacggtactcacacgatctttcacatttgtgacctaatttatgcgctttccgctccaccacgatgtataaaattatggtggctctacacagttagggctctcatgatgatgttcttctttgatatagaatgtggataaacgacatactcctcc

SEQ ID NO: 87891 - DNA, 628 bp, Heterodera glycines
  misc_feature (562)..(562): n is a, c, g, or t
  SCN-specific regions: Sequence locations=1-284,307-628
gccgtttttgcccctgacatggaaaacattccgcagcagaatcatcagctgtgcaacctcatggtttgtgagtcggacttaaacgacggaattgccgagagggcggcagagccgacgactgactttgacgctgtacggatgacttatcggcacgaggagctgcaatatgagccgttggtggtggtgtcatacgaagagacggttgccctcgggacgaccgccgtacgtcctcatcccggctttcggtcgttgtgccgggaacgatccaccgaccacattgaggcggctgcaatggtggcggtggagggccacggactgcaaagctttgtgcctggtcatgcgggacagtttgcggtagacgcttcaaacaccgagttggcctgcccaaaggcgttgctcgtcggcgttgtcacttctcatggaccggcggacaaagtgacggctgagcatgtgggcggtggctgataccaggtatgctacacggtgcaagacgacacggaagcgttggtgtttgtcaaatatggcgaaaacaatgtggacggcagcccgtttagcgttcgtncgatgcgtttccgcaacaatcacaatgacgacgctgtcttggcggaaatgcgaacagacgatgtta

SEQ ID NO: 87892 - DNA, 704 bp, Heterodera glycines
  misc_feature (600)..(600): n is a, c, g, or t
  misc_feature (603)..(603): n is a, c, g, or t
  SCN-specific regions: Sequence locations=1-575,600-704
gctaacctgattgtgccggacccgtggatggtgcagccggtgcgcgcggtgcacgacttggacaacatccgggtggcatcggcctccaggacattgttgcggtgtttcaacttcggcacattttgctggacggccattgttttgaggacccatcgggcaatccgccgcgtggactccaatttgtgctgggcacgcgcgttgagccggcactgttcgacaccattgtgatggccaacctgggctacttccagctcaaggccgggccaggtgcatggattctccgtcttcgggatggccgttcaaagcaaatctacgcgctcaagagcagcgtcgacgcggaaaacattggcatttttggacagacagaagcgggtgccaacggaggggagggagggggcgaaggcgatgtggaggagcttcatgtgctggtggacagtttctccggccgtacaattcgtgtacgggtcgaaaaacggaagggcatggagcggaagagtttgctaagcgaggaaaaggaccaaaagcagcaacaggcgacgggtgccgaagacgggacggatgccgtcgacgaacttgacgaggaggaggcggaggaggacnaanacaactccatttggtcaaatttggcgccgaaaaaagtcgtcaaaaaaattgtccagcaaattgatgggcaccggtcaatcgtacgatcggattaacatctt

SEQ ID NO: 87893 - DNA, 465 bp, Heterodera glycines
  misc_feature (435)..(435): n is a, c, g, or t
  SCN-specific regions: Sequence locations=1-389,412-435
gatttggtactttccgacgcgccctcaagaatcggaacggatggaaaaggaaaggcaaatgttggcgggcgagcgcggagtgtgcgccgcgtgctgcgacttttgctgcggcggctccgccgtcctcctttggctcgtactcactttggtcgcgctcggattcctaagcttccttctcatcgccatttactttctttgaaattgaaataccaaatgcaatttaatcgccagcagaagaaatgcagtaaatacttcacttcaattttcatttccgattggacaatcaaacgcaaattgaactttttttccaataagaattataattactattttcgtttgttgaattatattcgaattttaatcaattttaaaatgacaaatccactcgttttcaaaatatttatattttgtttccgataaacatatgtaacatcnaaaaaaaaaaaaaaaaaaaaaaaaaaaaaa

SEQ ID NO: 87894 - DNA, 114 bp, Heterodera glycines
  SCN-specific regions: Sequence locations=1-114
gactaggggcgtggatgataactctcttctatgaataatttctgactctctccggacaagtgggactacctgaacaaggcccccgtggccccctaattacgtagtgccggacac

SEQ ID NO: 87895 - DNA, 742 bp, Heterodera glycines
  SCN-specific regions: Sequence locations=1-77,108-170,215-215,238 -269,294-515,537-692,716-742
gcaatgtgggcggatgatgttgaggagtttttgcgctttaaatatgatgtttacgaggatttgcatcatccatcttccgctgcctcaactcttcttcaaatgctttgcaaacgccaaggaatcatggactctctgttggtatttatcattgagaatttgtcttcaacttccgacgttcgtcaagccgacggtgcccttcatatggtcgcgattgtttcctctcagttgcttaaactcaaaaaatacagaaaagacgtcgaaaaattgttggatgctcatgtgattccgcgcactgcacatcaaaatcgttttgtgcgtttgcgtgcctgttatgtgcttcactatgcctccgaaacgccattcaaaaactcgagaattttggaccgtgcgattcattcattggtaaaatgcctaaaggacgataccgaattgccggtgcgagttcaagctgcaattgccatacaatcactgatcaatgatcactcgcaaaaagggacagtggtccaaattgttcgccctcatatctccgatttgctcataaatgtgttgaaattggtcaaggagactcgcgtggaagatttgcctgctgttgttgacgcactcattgaaaactttgaggaggacgtcattccaattgcctacgacgttaccgttcaattggtacaaacattccatgcaatggttgttggtcaagaagatggaaatgaagaggaccgaattgctgaggattacagcgttgggg

SEQ ID NO: 87896 - DNA, 354 bp, Heterodera glycines
  SCN-specific regions: Sequence locations=1-221,244-244,266-328
acggcctggcttcggttcccgcaggtggtaaactcaaacgcaggagagatggaggaaagcgcgaggcccccagccccaaatcgtaacaggaggaagagcacagcgaagtgaaagactgtttcaggtgctgctgcttccggaggcgtcgtagaaaagttccccagcagaatgtgaaatgacctttgacttttaattgaattctttgttctttataacccctatcaaataattcatttgatgattatcacacatattttatatatatttctctcctattccgtattccaatgggtgtctgtacgtgttgattggttggcattaaaatttcaaaaaaaaaaaaaaaaaaaaaaaaaa

SEQ ID NO: 87897 - DNA, 608 bp, Heterodera glycines
  misc_feature (534)..(534): n is a, c, g, or t
  SCN-specific regions: Sequence locations=1-534
caattccgtcttctccgactgttccattctcaaaagcgtcgtaccataacgtcacacacatcataaccctcatgaccactccagcaaacgcggcgagggcccggagtgccaaggcgaagctgcgcgatgccaagcggaggagggcggcagttggacgcgcaggatacacaagaaaagcgcagcggggcgagcgatgtgccatttgtatgaccaacgtgagcgccatcacgcggacgacgctcggctgcacccatccgttccatcgccgctgcttgtatcgctggatccgctaccacaccaattgccccgtgtgccgctacaacttcgcccgcaccattccgcgcggtgagcgtaaccaaccgctgtaagatgccatgtgttgtgatcgccgtacgatgtcatttgtgtgatcatatttgtatcccattgttcggttatgcgtatgtatttgtacaatggaatgtatgttcttatatgtactctgtatgtacagtatgtataatactcgtcagtaaaatactctccttgttcttnaaaaaaaaaaaaaaaaaaaaaaaaaaaaaaaaaaaaaaaaaaaaaaacccaaaaaaaaaaaaaaaaaaaaaaaa

SEQ ID NO: 87898 - DNA, 645 bp, Heterodera glycines
  SCN-specific regions: Sequence locations=1-532,554-645
ggcaaaacttcgccgttacgccccatcgccgctctgatcgttatatgtgtgcctatggcgtcggttgcgccattccgtggctaatttccagtgaaattttccccaccaaatttcgcgctgctgctgtgactgtcgctgttacggtcgcttggtcattgtcttttgtcgtctccacgtgctatttgccattccaacaaattgtcggcacttccttcagtttcgtccctttcattttggtcagtgccggtggcgctgtgttcgtttattgtttgttgcctgaaacacgcggtaagcgagcgacggacattgtgcgcgaaattcgccaacgagtgaagtcaatttcgcacggccaatcgccgtttgcggaagggtcggcggaagcggcgacgacgacggcacaaccaaacggacaaatgagcgaactgacggcactgctgaggttacagcgtcaaaaaacacttcaaaaacagcagcaaaagaacagttggcacgacggatacatgagtatggataataatgcttaacattgttgacgtggatgagaaagttttgcggaggaaaagcaattgtaaaaaataatcgaaatccgggccatgtacaaatttaatgtttttttattagtttactgtttggattatttttgct

SEQ ID NO: 87899 - DNA, 717 bp, Heterodera glycines
  misc_feature (528)..(528): n is a, c, g, or t
  SCN-specific regions: Sequence locations=1-442,464-684,706-717
ttaatgctcgggtgaaggagtaatggttgatgaaaaggaccgatgtaaaaaatgtgttggaaggaaaacggtgcaggaacaaaagataatcgaagtgaaaatcactccgggaatgcgcgataatcaaaagattgtcttctacggagagggggaccaggagcctgggattgaaccgggggacgttgttttggtcatcaaaacgaagtcacacgaacaattcgagcgaaagggcgacgatctcttcatgaaaaaaacggtaagtctcgcagacgcgctttgcggtttcactacgaccattaaacatctcgacggaaggcaaattaccctcaccacgatgcccggcgatattataaagccagaatccatccgaggagccatccaagaaggaatgcccaagcccaattcaccagagcgcgggaatctttacataatctttgaagtcaaatttccaaagaaacattttctggactccgagagcaaatacaataaattgctttctctgctgcctcctcgtccggatcagcctgngattgctccgaattcggaagtggaggaagtgacgctgaccgaattcgacccgcgccgctatgaccgcagttcgggcggcggtggaggtcgtgaggcgtaccatgacgacagcagcgacgacgaagtgccgacggggccgggcggggcacagcacgtgcagtgtcagcagcagtgatctgagagagcgaa

SEQ ID NO: 87900 - DNA, 793 bp, Heterodera glycines
  misc_feature (722)..(722): n is a, c, g, or t
  SCN-specific regions: Sequence locations=1-332,354-411,434-565,587-793
acattttttttcctttctatccttaattttgaaaatttgaattgattgaaaataatcgtgtccattcattcccgcttttcccattaaaatgtcccaatttggcccggcattcgctgtcaatgccaacaatccgtacgctcacttcaaatgctgctgtgcaacatttaatatcaaagaccatgcccagttttgcggtgtgctcagtttcgcgctgttcctctgcctcgtgctcatttccatgatgcttttcgggtcgctttctctgttttacattttcgttggtgtcgtcgtttacattcttttgatgaaaactctctttggcgtcgtcaacaaattgtcccttctcttttacatctttttcgaggccattcaaattggcttttacttggctttgatgctttacataattgtaccgttgctttttcttgaaattccccgtcgcaactgtcggaatgttgagatcaacagtgaaatttgcgacgaacccagaaatcgctccgaagattacgtggaattgcttttgtttgtctcccttttggcctcaatcaaactgcactttgccagagtgtttgcccatttctacagatatttgacttggaatgagcagtgttcggtgcatcgagctcaatacataaacggacgaggcattcacatcaccatggatcagccccaattcgctgcttcgttttccccttattacggatgggacactcacaccgtanagggatgcgacagaaggggacaacagaatgagacaaacaatcctaatcaattgcccataacggaactgccg

SEQ ID NO: 87901 - DNA, 716 bp, Heterodera glycines
  misc_feature (69)..(69): n is a, c, g, or t
  SCN-specific regions: Sequence locations=1-282,306-406,428-444,505 -541,572-615,639-679,707-716
cgttcccagcgtcgggtgatcattgtcagcactgttcggaacaacgaaaaggagggcgatcggatttcntgatggtcggacacagcgtttcaacacaataatcactcgtgcggaagagcttttgatcatcgtcggaaatgccaaagtgatgatgagggattcgtcttggaaggagatgatctattattgccgcaaaaacggtgccacagttgacatgccgtctgaagcggagcttttcccatcgggccaatttcaaaatgatgtgctgacggacagtgacaagagcagcagcagtagcaacagcgaagttgatgagaaggagcgaactgaccaacttgtgaagaagggcacgtcgagtgccgccgctgctgaacaacagaatctcagggccaaggcatcttccgccgaggaagaggatgaagacgattcgagtgttgctggggagacaacgacggaagacgatgacgaggaggaagacgacgaggatgaggacgactttgacgaatcctcttcctctggagatggggacgaatttttgacggacacagacgaggaggaggagcagcactgactgaagggggcccaccgacgggcgtggatatggacaattagcgctttttatggtgatttggttttttgtatgtttcgtctgagctttatcctttatttgagtgcatttcctccgttttgttttccccccttctccgtttgcttat

SEQ ID NO: 87902 - DNA, 319 bp, Heterodera glycines
  SCN-specific regions: Sequence locations=1-296,318-319
tccataagtctcgcaataccgtctgactgagaataagaacatcgcgcattcggcagcacatcgtggactcgggtttttcacggtggggacacgcctctgaaagacccggccttcacccccaacataatgaacgggacatcggctgtgttggcccgccacggaaggaaatgcatcccctgagcgaacaaattccgatcaagagggcacagctgcgccaattccaaccttcacaaggtccggaagaggcgtggtcgcacctgggcataatgccgacaatgagggaggaactgtggaacaacccgatgacctccatttacat

SEQ ID NO: 87903 - DNA, 292 bp, Heterodera glycines
  SCN-specific regions: Sequence locations=1-167,190-292
ccaaaattggtgaatccggacgaattgaccaaacggacgggcgccctctattataagttggatttggaagaccaagtggcattatcaaaacgaattgcaattatgaaattggagcgcaacttcaccaaggaggacacgtacacattggacgcacagacaacgaacgattttaaggaaaagatcgcagaacttttcgaagagacggaaagtgacgaggatcaagcacggatggttttggaagggtcggcatattacgacgtcgaagccaaagacggagtttggatacgcatct

SEQ ID NO: 87904 - DNA, 491 bp, Heterodera glycines
  misc_feature (52)..(52): n is a, c, g, or t
  misc_feature (294)..(294): n is a, c, g, or t
  SCN-specific regions: Sequence locations=1-491
atataaaaatgtttcctaaccaatttggaaattgctcaaaatggattgtctntcattgtcagggtggagattgggaccggaagaatcggctccgctcctacgaggctctctacaaaatggcaattcgcgaaatgcgcggggcggcgctactctttttgttggtcgtttccacctttgacgcctatgagctgatgagctacgaggacctgaccttttacactgtgatttgctgcgttgatgctttggaccgacccgattcgaaggagaaggtggtcaactgcagcgaaatacagnatcaattgaacgccgaaccgacagacaaaaatcgtcatttgcccttggccaaacaattgctgaccaccttttaccggtcggagtctgctcagttcttcacggcacttgtcgagctggatcagtacatgaagcaggaccgttatctgaggccccactatcaattttactctcgtgccatgcgtgtccgggcatatcag

SEQ ID NO: 87905 - DNA, 577 bp, Heterodera glycines
  SCN-specific regions: Sequence locations=1-173,212-526,548-551
gcagggaaacgcgaagaagcttgacgcgagaaaaatggtgctttattcttcgacgactcgactctgctcggccttttgtccgtccttaacgtcaaagtgccgagcaatgcgctcgatttgcctccgtattccgcttgtgccatgatcgaattgtacgaagaacggcaaaacgccagaggcaacaaaaacttttttgtcaaattattttatcgacgaaatcaaattttggagccaatggcaatcgccggatgtgaagcgaaatgcgatttgatcaattttcttcaaattcttgagcctcggtcaatccgagggggcgaagaggaattgaaaattttatgcgatgaaaaagtgccgaattcggccgcccggcgcatgggaaacattcccggttttgcaaaaagtttaattattgccatatttataagcattgcagccataaatcacggaacacaaagcacagtaataaatgtacggtaaaaaagttttaaaaattctgcattttctatttgttaaaaaacttcaattgaaaaataataaattctgtgtgctacaaaaaaaaaaaaaaaaaaaaaaaaaa

SEQ ID NO: 87906 - DNA, 586 bp, Heterodera glycines
  SCN-specific regions: Sequence locations=1-586
acccgcttatggcgccagcgttttggacagaaaaattgagcggactttcaacaagtttttgagcgagacgtggcggtgttttttgttggcactggcaccgctgccaatgcgttgtcaatggcttatgtgaatcgcgcgggtggcatcattttcgcgcatcggcatgcccatctgattgaggacgagtgcggcgcgcccgaatattttacgggcggcgccaggttggtcggcgtaagcggcgccgagggacgcattgagccggaagcattagaggaggcaatccaacgctatccgccaaatcccgtgtcagtgcacgcgggccgccctatggctgtgtccatcacccaaagcacggagagcggcacgctctactcattggcacagatccgtcgtattgcgaacattgcgcattcgcatggcattcccttgcacatggacggggcgcgattcgcaaacgcaatggccgccttgggctgcacggcggccgaaatgagttggaagagcggcgtggacattttgtcgttcggagcctccaaaaacggctgttggtgtgccgaggccattctcgtgttcaacgaccttgcag

SEQ ID NO: 87907 - DNA, 575 bp, Heterodera glycines
  SCN-specific regions: Sequence locations=1-79,101-315,337-344,380 -454,476-575
caccgtattccgaatggaagacagactcagactaccgtacacccacgcggttgaaagccttcgcttgtccaaccttcttccgctgaacctccacaaagtgcttcaaacggacgtcgaaatcggtggccataagctcaaaaagggcaccgccgttgtcaatcaaatcgcaacagtgcttttcgacgacaaaattttccctgaccatgagaagttcatgccgagccgttttttggaggaagacggaaaaatgcgaagagtggacgaattaattccgtttggaatcggcaaaaggtcgtgccctggcgaaaccctcggcagaatggaattggtccttttcacggcgaatttcttccacaaattccatgtttatccttgtgatcctttaaatccgccgaaatttgaaaagcgacaaacattcgctgtcaaattggcggattacaaatgcaaagtgacgaaaagaaagtgagaaaagagcaaatggaagtgccaatttggacattattaagcacatccatttaactttttgctgttgaaattgccaaacattcgcttaattaattaaacaaacattccgg

SEQ ID NO: 87908 - DNA, 768 bp, Heterodera glycines
  misc_feature (714)..(714): n is a, c, g, or t
  SCN-specific regions: Sequence locations=1-163,185-234,256-350,372 -562,584-768
agccgccaatttgggaagaggaagaactgtcaacagcagtcagtgaagagcacatcgaagacagcgaacatgcacattctgtggagccaacggaacttcaatttttggacgaatcggttgccgatgaagaggcggttcttggcagtgaaattacgctacaccaacacaaaatggagaaggaagaggaaaccacttttgaagagcacgacgacatgacagctccgaaatcggtttttggttcttcttcatttggctgcaacaaaagggagcactgcaaaagtgatgacgaggattattgtcacagcgcttgtgaagaggggccgacagaggagacaaagaatcattccccgccagaagaaagcagcaaagagaaggagggtgaacaggcggaagacacgggaactgggatgaccgacattgttgaagcagaagcgcttactgaacctggcactccccttcggcagatggacgagacgactaattcccagagaaatgaggaagaaacgtgcccaattcgagaggaggaacagcagacaaagacagaagagaattcgacggaagcgacagaagaaggaagaaggagctaaacgaagtgttaattgtgaaggtcggattttattaatgatattttagttttatcacattaataatggtgtctaaatgtttgaaaacccaccagaattactcgcctgattgacaaatactcccagcccnccacattcaagtatttctacattcacctaaatatttcttctcattgaatatttc

SEQ ID NO: 87909 - DNA, 726 bp, Heterodera glycines
  misc_feature (683)..(683): n is a, c, g, or t
  misc_feature (714)..(714): n is a, c, g, or t
  SCN-specific regions: Sequence locations=1-179,201-726
attgtgacggaagcaagaaagggatggaggcggaattccacaacagacggagacactggcttaaagtggaaaagctatacaaaggaatatttgttgcgcaactctggaaggagcttgaggttcaagaaggccacacttcctttgaacacccagaagacatcgcttccctccctacgaccctattaactgatctcttgacaaaacaactaacagcggtcgaagaatgtaaatctgtcacttcgatgcccattcaattatgcgaacatggccgtatcaagcccggcccgtttattcggggtgaaataaaggcggtgaacacttcggctgcccgacgcctgatcagggaatttaatgtgaacacgactttgtacacgggagcgaacatctgtatcaactgctgctcaagacttcgtgatcaccaagaaactaggcgaaggggacggacagaggcgattttatactaccccgaaggcgctactttgtttatcaaattgaatggggatgagaatgatgggaacacaacaaagggcaagaaaaccaccactggaccatccgcggcagtgacgcgtcgagcagcgtcaaaagggctaataaaaattcgaatttgttcggatgagacgatcaatgccctgaagttgcgcatttacgagaagatcgaccagtctccagtcgaccagttgctntacatgggcggacaagtgttggatgggaatntgacgcttgaga

SEQ ID NO: 87910 - DNA, 447 bp, Heterodera glycines
  SCN-specific regions: Sequence locations=1-173,195-447
acgctgcaaatggtccgaaaaaggcttttccatccgtcacaccgtcaatgccagtcacacaacatccgatcattcccaataacatttccgaaatgttttcaaaaatgcacatgaacaccagcgaaccgcaaaagaagcatcagttgtatatttttcacacccatcggttgcactgtcaaaaaccatcaaaaaccaccgctccgcaagcgaagtgttgccgacggcagtggcgaccgtgagaatggcacggctgccacaattaattgggccaaagcggacctttcagtttggcttaatgcgtacaaaaatgtctcttctcctgcggattcttttgccgcggtgataaattccgtgaaagcattggcacctgaccagtggttgttgttcaaggttcacaacacttccagtgacaaccggcagtaaaaaggtgcccgcttctttcaccat

SEQ ID NO: 87911 - DNA, 513 bp, Heterodera glycines
  SCN-specific regions: Sequence locations=1-353,376-513
acattgctccgtttccgcactttcccctaaatcctttgaacttacattctcatggtcgtggcgaagaatatttgccggacgaaaaggccattttcggatttaaatctgttgttgtttctgagttttgtcctctgttctgagtttatcccggcaacgaatgcgaacgaaaacggcagaagcgcgccgtggggacggagaggagccttcaaagtcatcgcctttcgtccaaggcgcgccttggacattttggaatcggatggttttggcggatttcggaaaagagcattggatgtgatggacggcgatgggttcggttcatttcaaaagagagcgttggattcactcgaaggcgacgatttcatggggctgaagaaaaagaaggctttgactacagcggacggggacgacttcactgatttgggcaaaagagcattggatgttcttgacggagatgattttgttggcttcagaaaacgcagcgaaatgcaaaaaataaaaacataaaaaaaaaaa

SEQ ID NO: 87912 - DNA, 662 bp, Heterodera glycines
  misc_feature (623)..(623): n is a, c, g, or t
  misc_feature (635)..(635): n is a, c, g, or t
  misc_feature (637)..(639): n is a, c, g, or t
  SCN-specific regions: Sequence locations=1-624
ccgaagatcgaactccgatatgtttaactcggacggagagattgaaattgatggacttttgataatggagcggtgcccgaattgatcaagttgtactttgatggtgggccagaagataacgagcgtcaactcactttgcgcatgtgtgccgcgccgtgcctttgcgatgggcttccatgcgagtgtaaattgaccgtttgctatgtgggactaatggacccggcgactgaagcgatccaatcgcaattctttcttgaaaatttcgagaaagacaatgaaattgccaacgattgtaaacaagcacaaaaaaaatggaaagcctttaatggacaagtgcttcatggtttccgactggaatatgatgcggatctccacacgctgaaagtgtcaacgtcaatcaactcgacaagaaaggtgcgatcaaatgctcaggcaaacgatgtgaaaagagcaaatcttctgtaattaacgggccgtaatgggctttcaagaaccgccagaatggagagatgtttcaataattttctaatgaatttaatctgtgaattatacctaaaattttaattgctattaaatattatatgaacgtattggatggaagcttgtgataaatgttatggttntaaaaaaaacanannnaaaaaaaaaaaaaaaaaaaaaaa

SEQ ID NO: 87913 - DNA, 701 bp, Heterodera glycines
  misc_feature (642)..(642): n is a, c, g, or t
  SCN-specific regions: Sequence locations=1-77,99-103,126-659,681-701
aaattaaaaagacacaagaaaataatgaaaatgaaagaaacaaaaataaattcattcctgccgaaaatttttgtgagaaaataattaaaattcttcaaataccaaagtaataaattctttccttggctaaatgttcatcgaatttctctctcttccaatggatttgaaatgccgtggagaaaagtgaaaattgacaattagtggcggcatttctgcagagacgaggatggttttattaattcggcacaacaaaaaagagaaacaatgccattaattcaagcggaaattatccaatcggtggcgtcgaattgtgcttttacttcgtcgtttggctttcccattcgcttttggcatttttgctggcgaccaatgcctcgcggagtgtcggccattggctcgaccattggctggagccgagcagctattcgcgcgcactaagaatggacaattcggacattgaactgaaattgttccgtcaatcacttccaaatgtgctgggggcttttgccataaattcggtggtctttcgcctcatttttcgccttggaatgtccaaaaatggtcgttcccttttgctcatttcggtttggtttgcgcttaatgcgtacctcgcgagtgtccgatgccttcttttggtcattnttgccaccttcgtcctcctctccgtcactttgctctccaattgccaattgtttgcctgg

SEQ ID NO: 87914 - DNA, 860 bp, Heterodera glycines
  misc_feature (809)..(809): n is a, c, g, or t
  misc_feature (832)..(832): n is a, c, g, or t
  SCN-specific regions: Sequence locations=1-98,123-585,607-617,639 -765,787-860
attttatttaaattatcctccaaaatgcgcaccattctcttatagccatggtttgcttggtgatggctgtcctaatggaaatggcaaattcaaaggctgtcaaaaaatacaacaaaaaaggagcagtggcggcatcaccagcaaaaggaaaagcatcgccaaaaggaggcaaaagcccagcaaaaggaaaagcggcaaaaaaattgaaacctaaaaaggatgctaaaggcattaaagctaaaaaagcaaagccagcaaagaaaagcaaagcggcaaaagcagtaaagggagcgcctaagacagtcaaaaaactcgcatttgccaaaacagcagcgcaagtgaaagaaataaagtcaccagccaagccaatggttctaaaagcagtgccgccccaccaaatgcatttaatgaatgagaaagttcaaactgctgtgtctccacccgcccatgctcgttcgcttgcgaccgttccttacagtacaccggtggcagccgaccgtaactcactgccatcgtacacttcggatggcaccaatttggacatggcccatgagaatgatgattatcagaattattactacggaacggaagacagcagcagagaatttgatgcatcggcggaggaggaggatgaactgtatgaggagggggacggggcaatgagtgggcagacggacgactacggtattggcattggacaggagtacggtcatcaatcggtggaagtgccaccaaagtcggtgatgctcgactgaagacaccaggatttttgtaaaaactatttctcagatttttgaacatttgcattntatattcgcttagaagctaattntttttatctagctctaattatgtaaaaa

SEQ ID NO: 87915 - DNA, 758 bp, Heterodera glycines
  misc_feature (683)..(683): n is a, c, g, or t
  misc_feature (757)..(757): n is a, c, g, or t
  SCN-specific regions: Sequence locations=1-27,49-728,753-758
gtaacttgatgtgtgttttttgggtcgaaatgagaaaaatactcgacacgaatgtttcctatttgagcatgggcctcttactgtaccttggcggacattcgcacagccattcccaccatgggcatggcacacattcgcaacggcaaaccgaccgtacgaactttgcagagcacgagtggggtacggtagacggacggccgggccaaaacggtggcaatcgccagacgcacggcacgcggagacagacgaacatcaacgtcagggcagcatttgtccatgtgctcggtgatctgatccaaagtgtcggggttttgttcgccggattgctaatttattggaaaccgaattggcacattctcgacccaatttgcacgttgcttttctccgcaattgttctcagcaccaccatttatatcatccgcgatgcgctcgttgtccttttggaaggtcgtccgtcgaccatcgattttcgccatgtttttgacgcacttgagcacattgaaggggtcaaaaaagtgcatgaccttcgaatttgggctctcactatggacaaagttgcaatttcggtccatttggaggtcgaatcggctgcggactcccaacaaattctgagggccaccactttgatgcttcgacgcgacttcaacgtgcacgagtcgaccattcaaattgagggctatcancccgaaacggccaattgtggccaatgtgtggtgccgacaaagtgaaaaagggcaaaacggaaggaaaagagaana

SEQ ID NO: 87916 - DNA, 721 bp, Heterodera glycines
  misc_feature (648)..(649): n is a, c, g, or t
  SCN-specific regions: Sequence locations=1-721
acccgatagaatttattactttcctaataataagtttttttgtacaaaatgagcaactttatatttgtcgcctttttaactgcagcgttttttagctcaggcctcgctctaccggctccttatgatgctgaatcggtggtatcttctgaattaaatgtttcactactttcagctgacgcaaatgttgaagcagcaattaccaatgaaagtgatgctgctgctgagatacaagctccatcaattccggtaccaattgaacatcaaactgctgctgacattactcatccaactgaaactggcaatgagtcttctattgcatcatcatcatccacgccgaaaagtgagcagacgccaaaaaaagtgatgaacatgaaaagcgcgatggaaggcgcggcggccaacgtgtacgggtggcttccgttagaccagcagcccaagacgatcgctgaagcggcagcaaaagcaaagcagacgcccgccaaacttccggctgactacgacgtgaaccgcgtggcggaacgcgcggcggcccgtgtgtacgggtggcttccggaagacaagcagcctaaggcgatctatgacgcggcggagaaggcaaagaacacgcccaaaccgccgggcgactacgacgtggagcgcgtggcgcannaagcggcacggctcgtctacggtgtgctgcccatcggcatgcagcccagcttcgccggccctagcactgaca

SEQ ID NO: 87917 - DNA, 733 bp, Heterodera glycines
  SCN-specific regions: Sequence locations=1-344,366-733
tttccatcgaaatacaatcttctctgtttccctctacatatcccaaaattgttccccaatgctgcaagctcatcagtaccaacttcggcaaggtcatcgtcgcgtttctgctcgcagcattttggcccatttcggtttcgaattctcgaacgactaccgacttggctgcggacattacagtaaagtgtacaaaggctatttcaaggaagcgcaacgcacttttgccatcaaagtcaccgacttggaaagcgtttccgagaagttcaagcaaaagtttctgccacgtgagctggaagtttggcgggaattggaccacccgaacctcgtctatttgtacaaagatttccagtggaacaattatcagttcgcagtgatggaattggttgttggtggtgacttgttcctccaaaaatgtggccacgtcagcgaaacgacctgtcacaattggatgctccaaattgttgctgctttggattatctccaccgtaagggaatcgctcatcgcgatctgaagctggaaaacgtccttctttgtgaaaacggcgtcatcaaagtcactgactacggattctctaagcagagttctgatttgtcttcaacattttgcgggtcgcgttcctattcgtcaccggagaatttgcttggcatcgcttatgacatgttcaaatcggacatttggtcattaggcgtcaccgcgttcatcatgatcacaaacacaatgcctttccatgaa

SEQ ID NO: 87918 - DNA, 558 bp, Heterodera glycines
  misc_feature (533)..(537): n is a, c, g, or t
  misc_feature (539)..(539): n is a, c, g, or t
  SCN-specific regions: Sequence locations=1-465,487-493,515-558
caaagaaatggacgaaattcgagaggaggaggaggagtgcaagcgaaaattgttcaactctcggcactcgcccttcacttacccgaacaatgggtggcagtcccatcagcagttgaacgccagtcagagagcatccatcaatgggggtggtggtggtgtgacgaatcgccgggttcaaggctccaaatgggtcgaaagagttcagccgatgtcgggccagcccgtgccgtacaatgggggcggcaaaggcgggggcggtgggcagaaacatcgtgctggtggaggcggtggtcgaaggtctcaggcgccgcagcgcaaccgacgggacaaggctgatgacgaatgaaaagagcaaaggatgatgatgcggaggaaggaagagtaggggaagagagcaatgtgtgggcgcacaatgtgtgaacaatgaggggaatttgactgatttttggcgccgaatttggacaccttttgttttatttctataatggtttcgtccctttctttctcttcttttgtgcgtaaattatgatccnnnnnanaaaaaaaaaaaaaaaaaaa

SEQ ID NO: 87919 - DNA, 537 bp, Heterodera glycines
  misc_feature (2)..(2): n is a, c, g, or t
  misc_feature (500)..(501): n is a, c, g, or t
  misc_feature (504)..(504): n is a, c, g, or t
  SCN-specific regions: Sequence locations=1-61,83-501
cnttctgtccgtcccctgttccgctcagttcgccctcccttctccgacaacggcctcgtctcccccattccttcacttcctcaatggcacaacaacagtttcttatgacagtgatcaggaattggagtttccgttgtcattggttcgcgatgacggagtcatttacgccactcagctgagtgtgtcttacacgagaccacgggaacaacagttcaggacgggaattcaaggaacacaaccgaacagctagccggggaggacctttatttggttggatgttccgttctgttttctatccattgttattctcaatccatttgtcttaagttttcttccttatttattacagcatttacacttgcatagtttcataaatgtcattctaaatctattcaataattattttcaactaatgataatatatggtgtcgattacttctgtgtctgtcattgtttatccgttatcttgtctgaaaacacgaataaatctcgttgtcgcnnaanaaaaaaaaaaacaaaaaaaaaaaaaaataaaac

SEQ ID NO: 87920 - DNA, 688 bp, Heterodera glycines
  SCN-specific regions: Sequence locations=1-49,71-286,310-397,419 -547,569-688
attgaccggggacggcacgaatgacgggcccgctttgaagaaggcggacgtgggatttgccatgggaatcaccgggacagacgtcgccaaagaggcgtccgacataattctcacggacgacaatttcgcttctattgtcaaagcagtgatgtggggtcggaatgtgtacgactccatcgccaagttcctccaattccaactcactgtcaatgttgtggccgtagtcgtctcgttcgttggggcatgtgccattcaggacacccctctgaaggccgttcaaatgctgtgggtcaacctcatcatggacactttggcttctttgtctcttgccactgaattgccaacggaagatttgctgaagcgaaagccctacgggaggacaagtccgttgatttcgcgcacaatgatgaagaatatcattggccatgccgtttaccaactcaccgtgctgtttacgcttatcttcgcgggtgcctccctcttcggcattaccactggtctttacgctccgctctatgcgccgccctcgcaacacttcaccattgtgtttaacacctttgtgatgatgaccctctttaacgagatcaatgccagaaaaatccatggagagaggaacgtttttcagggcatgttcaataatccgatttactgcaccattttgggtgtttactctcatcctccaatttgt

SEQ ID NO: 87921 - DNA, 727 bp, Heterodera glycines
  SCN-specific regions: Sequence locations=1-178,200-218,240-727
agtgccgaggattggcttgagtttgtgctgcccgaaagtgtcggaatggacggggatggggtgccacgaccattgtccttaacgtcgtgctgttcaaccacgacggggtaaagcgcaatgagccgatcggacatttcaccgtggacgccgagtcggcacttttcaacgcgacgttcaaaagggcggaggaaggcggagaaaaggcggaatggcacgcaataatgccattctgagcagcaggggaaaggcggaaacagaaaggacggaagagccccggggaatagactgatcggacggaacggaacccccgggggacggattgatcggacggaacggaaggaaagaccctcggtgggacaaactgatcggacggaacggaacccttggaggacggaaccgaaaaaaacagcctcaccaattcaattttaaatgaccctccggcgactcttttttcgctctttttgccgattttaaggaaaggaaaaacaacaaatttacaagattcataccaccaattattaattattacctatgatctccacggaacccaccaaaaatacagtatcccctcctcagttactgtaccccctcattcattcgtaataatcggaatgtactgtatttctatacccaacaaaaccaaaagcattccattaaagcaactgctgaccgactgactgatcgatacattcgcaatttatttgtcaaaatataaatggaaaaaagc

SEQ ID NO: 87922 - DNA, 357 bp, Heterodera glycines
  SCN-specific regions: Sequence locations=1-7,34-124,146-336
tggcgaaaggcggaggaggagcagcagcagcgggcgaagggacgcgagtatttttgcgacatttgcggacggacactttggtttgcggacaatgtgcaggcgatcaaacacaaaaagggacaccagcaaaaggaggaggagaagccgaagcaggacgaagacggagaaagaacagatggatgaccaatagacactccgtttcaaaaaacgagagatgaaccaataaatagggagtgcacagaaaaaaacattcttattttggcgtactatttctttgtctctgataatagagaaaaatcgaattaacaccgatagagaaaaaaattctgcatcgacaaaaaaaaaaaaaaaaaaaaa

SEQ ID NO: 87923 - DNA, 365 bp, Heterodera glycines
  misc_feature (344)..(344): n is a, c, g, or t
  SCN-specific regions: Sequence locations=1-341
cactgtctatgtgattgacctcgcccaagccatggacatttcgcatccgtcctcgctgcgcttcctccaccgggacatcacgaatgttttgaacttttttggtcgcattggctgtgagccgttgcccacgccgcacgcattctttcacgaagtgaccgacattgagttcgacccgaacaaaaatttgtatgttcaggtggagtctttcgagcgcgagaatcggaacatggacttgaagggggcgaaggcgtcgccagcaaattatgaactccatttacaccagcaggagagcacaggccgagcggactcgccttcacggccttacaattgaacacgaaacgaanaaaaaaaaaaaaaaaaaaaaa

SEQ ID NO: 87924 - DNA, 559 bp, Heterodera glycines
  SCN-specific regions: Sequence locations=1-403,425-559
attttaaggagagccaccacaatcatatgcctgaaggttatgagtctggtcggggaaaatttgagttcgctctcggttacatcggttgttcggttatcggaggattcggagttggaagtgttcgtggaatgttcggcgagttaggaaatccacagaacagaactttggcttggaatccgtggtacactcggatgctgaatgccgccactaagcatggcagcggatacgcacaaactgctgggactgccatgtttctctattcggtcactgagttggggctgaagctgtcacgagccgatgacttgcttaattcttttatcgccggaccaatcgctggcggacttttccacggattgcctcatgggctgcgtgctggcggtgttggtgcattggccggactgggtttggtcaccgtctggaatttgtgtgatcgagacagcagaagagagttgcgcgaaatcctccgattgtcttaaatacgttgttgctcaaccttctttattatagtcgttattgaataaatttgtttgaaactcaaactcaaaaaaaaaaaaaaaaa

SEQ ID NO: 87925 - DNA, 152 bp, Heterodera glycines
  misc_feature (42)..(42): n is a, c, g, or t
  SCN-specific regions: Sequence locations=1-120,142-152
cgtgatgggactcttacattgaagtgatatgagaagcgcgancctttcttcaacttaaagaaggagaaagtgatcgcaagaggaggaatttgctgatcactcccttaaactggcaaatgccctccctccgtttccctcccccgcccctttcg

SEQ ID NO: 87926 - DNA, 783 bp, Heterodera glycines
  SCN-specific regions: Sequence locations=1-413,437-783
cacttctcggcctaatgtttacttaaacgcgctgatgatgttaaagtgggaccgaattcccagcgcaatgttttgccgtcggtggtgaagcgcgactttcacttctgccacctttgccaatcgaattcgcctccgcgttcatttcactgtccggtttgcaacttttgcgtcttccgccgtgaccaccactgttccttcaccggttcttgcgtgggtcacttcaatcagcgttattttgttgccgctgtatttaacctgtggccagtcgtgttttcatgctgcgtttggaattggcatgcgcttttgctcgccttctctccgatcagtctgtccgactttctcaaatgggtcttcccgcacatggctttgctgttccgcttcgtctctttccaccaattcttcgtgattttggcctttgccttctctttcatcactttgctcttcactacttatctcatctttgcccagattttctgtttttggcatggccaaacgcgtgtcgaatatttgatggatgtccacgcttataatttgtcctttcgagaaaatcttagcgcctgtcttggctcgcgatggcccttcatttttatttctcctttcattccatcgcagttggaaaccgatggaacgtttttcaggacacgcgaaagggaagaaatcggaaaatcgacaaagtatttttaggaagatgaaaattctactgctacttaataatgtgctttaatatctcattgtgtctctccctctgtgtgcgtaaatcacgattaatcatttgaattcatt

SEQ ID NO: 87927 - DNA, 741 bp, Heterodera glycines
  SCN-specific regions: Sequence locations=1-211,235-596,619-741
ccggttttctgatgaagaaggagttggagtattttgccaaggcactcgagtcgcccacccgtccattcctggccattctcggcggtgccaaagtggcggacaaaattcagctgatcaacaatttgttggacaaggtggacgagatggtcatctgcggtggcatggcattcacttttactaagtgctcaccggcaaatccattggcaaatcgctgtttgacgaggagggttccaaaattatcaacgatttgatggcaaaagcgaaggacaaaaatgtgaaaattcaccaaccggttgattttgtggttggcgatgagttcaaagagggcactccattcgccaatgttgacgcaaaggatggaattccgaacggaaaaatgggcttggacattggtcaggaaactctcaaacaatttgccgaagtgattggacgtgcaaaaactgtcgtatggaatgggccggcgggtgtgttcgagtggccaaactttgcgcatgggaccaagggcatgttggaggcggtcattggcgcgaccaagtcgggtgcaacaaccataattggtggcggcgacacggccaccgcggcggagaaatggggagcagaggacaaagtcagccacgtgagcaccggtggtggtgccagtcttgaactgctcgaagcaaagttctgcccggcgtccccgctttgagcgatgctccgtgaacaaactgaattgcctcgactgactgacaattgaattggctg

SEQ ID NO: 87928 - DNA, 648 bp, Heterodera glycines
  SCN-specific regions: Sequence locations=1-168,191-339,361-590,612-648
gaattttcgaagtgtccccggaagaagtgaagcactgccgaggaattctccgagaggctgcgaatccatcttcaaacgtatctttggagaatacaatgcggaggaaataatccagatgcgcgacgaaggagcatccaatgttgaaattgaggagaaaatcacagaggcactgaaccaaattcgaagtccgcagaagcgacaggaggccggccgatttgcgatgtcatgtcgccgaatattcgcaatgattgaacgtcgtcgacgatcggcggataacgccgaacattcgctggatcaactgttcaaatcgcatttgatttggctgaatgagcagcaacgggaggagctgaagcaaatgaaagggtccggaaagggacggacggaaatgcagcagagagtgatggaatggtacggacagttggaggggcaagagaagcagaaagcgcgagaacacctgcgggacggctgccgggacatattggcacaagtgttgggcaaagaaaaggctgaccaactgaagcaattgagagaaggcggcatgagcgggacggaattggaagcaaaagccaacgaaatggtggaccaaattcaggaggaggagaagaaggcgaaggccaaagaatttgggacagtgtgcagaaagatact

SEQ ID NO: 87929 - DNA, 283 bp, Heterodera glycines
  SCN-specific regions: Sequence locations=1-18,40-222,244-283
acaaacgcgaacccaacattttctaattttcttccttctgctaatttgtgaaatgatcaactcattcccatcaaagtcgagtgaaagcggcgaaccgcctgcaaatggagcagaagtggcgcaaagtcgcaagaaacgtcaggccgaagaagtgaccactgaagagccaccatcagaaacaaacgatgccgaggatcaccaatctgcggcagcgggaaatggaaaagcaccaaaaaataagggcacaaagaacaagagcgacagcagcgactcgtcaagttcg

SEQ ID NO: 87930 - DNA, 690 bp, Heterodera glycines
  SCN-specific regions: Sequence locations=22-690
cactgacttctggactttgttgaaaggacaacgagggcattcgacgcaaatgttcatcgcgttcggccccaccatgggcaaaatttggttgccggtcggctgcgagctttgctccactcggacttgaaccgatccgagattgccgaatcgcaccggcactgcggcaaggtgcaggacgcgtacgcgttgcgctgcgtgccccaggtccacggagttgtgcacgacacaattgcatttgtgaagggtattttggagacggagatcaactcggccaccgacaatccactggtgttttctgagattgaagaagtgatttcgggcggcaatttccacggtgaatatccggcaaaagtgttggattatttggcaattgccgtgcacgagttggcccagatgagtgagcgtcggctggagcgtctgctgaaccaccaactcagtgggcttccaacttttctgacccgcaacggcggactcaactcgggcttcatgacggtccaattgtgtgccgcaagttcggtgtccgagaacaaagtgttatgccatccatcatcagcggacagtattccgacaagttgcaaccaggaggaccacgtgtcaatgggcggcttttcggcacgaaaggcactgaaaattgttgaacacaccgaagcagtgcttgcgatggaactgatggcagcttgtcagggaatg

SEQ ID NO: 87931 - DNA, 151 bp, Heterodera glycines
  SCN-specific regions: Sequence locations=1-151
gctaccgatcagacacacaatttgttccttgggagtggagataattacctcttacacgtgtacatgagtcgctagtgctcgaaaatatacacagcatttcctacgggtcgaccattctgcgtgaggggccctagaaggatcgtcggactct

SEQ ID NO: 87932 - DNA, 332 bp, Heterodera glycines
  SCN-specific regions: Sequence locations=1-332
tcgcgcaccgagcggctggcggagcattgccgcgaggcggacattctcattgctgtagcgggcctgcgtgggatggtgcgcggcgattggattaatcccggcgcggtcgtcatcgactgcgggatcaacgcggtgcacattcctggttgaaaagcgccacctggtgggcgatgtgaatcgtgatgaggccaaggcggcggacggctttctgactcctgtgcccgggggtgttggcccaatgaccgtggcaatgctggtccgcaacaccttcctccaggcggtgtgccaaaaactgaactgccgtgtctgatccccttgggaccgttataagc

SEQ ID NO: 87933 - DNA, 678 bp, Heterodera glycines
  misc_feature (670)..(670): n is a, c, g, or t
  SCN-specific regions: Sequence locations=1-467,490-637,661-678
tgggtggttgacggtgaattcgtaccacttcaccccacccgcccgtactgaagtgccggctcagtcaggcactcgaacaaattcagccggccatggccgtgggtgtccagccagctaatctgcacaagttcaactcaatttttaaacggactatcgccaattggtttgtccagtcgagtgcggttgactttctccaccttttactcgtctgcatgcgatggttgtgccgagaatatgaaatcccagcccgttacgtcatttcaattcacgacgaagttcgttatttggtcccggaaaaggacaaatatcgctgtgcgttggctctttcactgagcaatatgtatgtgagggcagcaatttctgaggcgttgggcatacgggaattgcccaggtcggtcgcctttttcagtcaggtggacattgactcagtgctccgcaaggaagtggacttggaatgccgaacgcccgatggaaaaacaattgaaaagggtgaggcactaaatatcgaacaaatcgtagagcatacgaacggacgccttggccgatgatcaacgatctcattttctcatatttctttactttctaagtgccttttccattcccgcggatctcaatagtttactcaacacttttatgttttatttggtttttcatttacatattaactaanattctcat

SEQ ID NO: 87934 - DNA, 784 bp, Heterodera glycines
  SCN-specific regions: Sequence locations=1-333,355-688,710-784
ccgttgcgtggagtatttccttctatccgcagattattctcaacttccagcgaaagagtgtcattggtcttaacttcgattttttgctgctgaatgtcattggtttttcctgttacactgtttataatgtgttgctttatttcgatccgaatgttcagagaatttacattgaacggcatggacagcgcagtctgatcccagtccttatcaatgacgttgtgttcgcttcccatgctttgttggcatgcatcataacgggcgttcagtgctttttctatgagcgtggaaaccagcgcatttcgtacattggccgtgcctgggcttcccttctgctctgtttctcttcggtgtctttggcgttggcgcttttccgtgttttgaattggctcgatttcatcaattacctttcttactcaaaaatggccgtcactctgagcaaatatttccctcaggctattctcaactttaagcgaaaaagcaccgtcggttggagcattggcaatgttttgttggacttttccggtgggttcatggacatttgtcagatgtgtcttcaggcgaccaacacaaatgattggagcgctttcacgggaaaccctgtgaagtttgggcttggccttatttcgatgcttttcgacattctcttcatcatccagcactacgttctctacattaaaaaggacgtcaactcctcctcctcttccaacagagtagacaattcccacgccgtcacggcaacgactctcccaccgcctctcattgctgcgtctcccatggattacca

SEQ ID NO: 87935 - DNA, 531 bp, Heterodera glycines
  SCN-specific regions: Sequence locations=1-190,212-531
taaagcgcaacaatgtcttctgacgaatcgacgacttcttctgccagtgttgtgagcgttcagctgcgtgaagtgcccatcaaagacttcaaggacgtgcttccggtgctgcagaaaacgctcaacgaattggaacatccgttcatcaagaaggccgaagaaataagcggaatggaacgtgagaagctcttctacatcacttcctctcttgtgctgctcgtgttgatgctctgccctggcaatatgcttctctctactcttatcactgtggcctacccaatgtacgcgagcttgttgaccctcaacactcaaaacacatcggaatacacccagtggctcgtttattggtgcgtgttcgccgagttttgccagttcgactatctctttggctctatcaatggccttctgctgctgtacgtgcctctgaagaccgtctttctgctctacttggcccttccgcaaacttatggcgctcacaacttgtacgtgaagcatatccgcaaagtgcttgccgtgacgaacgtattggac

SEQ ID NO: 87936 - DNA, 769 bp, Heterodera glycines
  SCN-specific regions: Sequence locations=1-2,26-769
cctgcgggaaatactcccgagaaatgggactatgaaccaggtctgtcgcctcccatttcattgtcaacaacgtacaaacggaattggcctgggatgcccaaggggcatgattacataagagaaggcaatcccactcgtgatgtactccaagaaagcatagcgaccctggagagtgctcgccattgccgaattttcagctcaggacttgccgcaattgcagcagtgtcccatttgcttaattccggacagcatgtcatcgtgtcgggggattgtaacggcggcacgaaaaattatttcgacaaaatttgtgtgccgcatcatggcttggagctgagttttgtggatttgacgcgattggaaaacttggagaatgaatttaagcccaacacaaaaatggttttgtttgaaacaccctcaaatccgcttctaaaaatcgtcgacattgaagcggtgtgccgtatggttcgagcacgctcaaaagattgtgtcgtcgttgttgataatacgttcatgacaccgtactttcaacgcccgttggaacttggcgccgatgttacggtgcaatcgctcaccaaatacatcaacggacacaccgatgtgctgatgggcaccgtagttaccaacaaggagcagcttgatcagcacatatacgcccagcaaatttatgctggcgccgttccgtccgcctttgatgcctttttggtgcttcgtggcatcaaaacgctcccattgcgaatgcgccagcacatggaaaatgcgctggcaattg

SEQ ID NO: 87937 - DNA, 303 bp, Heterodera glycines
  misc_feature (266)..(266): n is a, c, g, or t
  SCN-specific regions: Sequence locations=1-88,114-198,222-303
tattggccgtgtgggcattgtcggacatcgcgaacggcacccgggttcctttgacattgtgcacatcaaagacaaagttgtgaagggcagtacaaactgtgcaaggttaagaagcaggcggtcggtgacaagcaagtgccgtacattgtcgcgcagacgcgcgaacaccattcgctacccggacccgcacatcaaggcccaatgtgcgatttgctgtggtccgacccggacgattggagctggacgacgagctcaactactccttnctgcagtttgacccgccggccgcgcgtcggggcgagc

SEQ ID NO: 87938 - DNA, 720 bp, Heterodera glycines
  SCN-specific regions: Sequence locations=1-641,671-684,706-720
gcccaagtttgagagtttccaaaaaacattctgcccatatggtcactttcttcgccagacattcagcttatttttcagtcagttgaccgcgatcggtccggtcaaatcagtgccgatgagcttaacaggcgctgtccaatggcacatggaagccgttcaaccccgagacgtgccgaatgatgatttcaatgttcgactcaaacaacgatgggggcatcaattttcaggaattcggcgcactttgggagtacatcaacgattggacgcgcacttttcgcactttcgaccgcgacaacagcggaaacatcgaccgcgacgaattggtcaatgcgttgacacaattcggttatcgtctgtccggcactttttacgatatgttaatgcgcaaatttgaccgaactcaaagcggtcgcataaacttcgacgacttcatccaactttgcgttgtgctccaaacactgactaccgcttttcgagaaaaggacaccgaccgggacggatggattcgaatttattatgaggaattcctcgccatggttttctcgctgaagatgtcaatgatggctaaacaatgagcaaaagaagggggaattattgactgataaggatttgctaatacagtaacccacttatttttgtatgttttctgttaaacattatttacatatcactttcaattttacgacatttttgtttgaataaaaatttggaaacttgctt

SEQ ID NO: 87939 - DNA, 410 bp, Heterodera glycines
  misc_feature (27)..(27): n is a, c, g, or t
  misc_feature (31)..(31): n is a, c, g, or t
  misc_feature (33)..(33): n is a, c, g, or t
  misc_feature (68)..(68): n is a, c, g, or t
  misc_feature (70)..(71): n is a, c, g, or t
  misc_feature (84)..(84): n is a, c, g, or t
  misc_feature (100)..(100): n is a, c, g, or t
  SCN-specific regions: Sequence locations=1-1,227-229
ccccccccccccccccccccccccccncccntncccccccccccccccccccccccccgctcccctcntnnctcccctcgtccncgccccccctttcttnccccccctcctccttttcccccccttcctccccccccctcccccccccccccccccccccccccccccccccccgcccccctccccccccctttccccctcctcccttcccccccccccccctccctccccctcccctcccccccccccccccccgtccccacgccccttcccctccctctcccgcccccgccccgtccccccccccccccccccccctcccgcccccctcctccccccccctccccccccctccccccccccccgctcccccccccccccccccccccccccccccccccccccccccg

SEQ ID NO: 87940 - DNA, 585 bp, Heterodera glycines
  misc_feature (583)..(583): n is a, c, g, or t
  SCN-specific regions: Sequence locations=1-523,545-585
ccttttagtgattggttaaagaaaatttttaaatttttttgccttaatatttctactctatgcgaatttgacaataatgtgtgatttggtcagcagaattgctagattttgaatgggaatacgatccaaggatcatcatcaatctcatcttttccttatgggcgttgcttctgctgatgatgactcagtgcctgatccaattgtgattaagttgggcgagtcattgagcctttctcagcttgtgcaaaaaattgaacaattacaaaaccgaactgttcgagagctgcttgttaccctacgtcgtcgcacgtacaaaatgcctgttgggcctcccgacccaaatggagatcgctttttccaaaatgggcatctcctagtggaagatgttgtgtacaattgggtaagaaaaacgcgtaactccatccacggaattgtccagcttcatgtgttatatgaggggattgcaatgctcgatgaagtcaattatcacttttagtgattggttaaagaaaatcttgtaaaattatctgccttcatattttgtactatttgcgaatttgacaataaatttgttccaatgaanaa

SEQ ID NO: 87941 - DNA, 347 bp, Heterodera glycines
  SCN-specific regions: Sequence locations=1-25,49-318
caaacactggtcgtactcgaactgctggcggaggagggggcggaggaatgaacagcggcggactgtggcgcttttatactgaggactcgaccgggttgaaaattggacctgttcccgtgttggtcatgtcgttggtgttcatcgcttctgtgttcgtcctccacatttggggaaaatacagtcggactcattgaattctcactttgccgattcattcggtctatcggcagaaatgcgattttattcatagtttttacaaatcacttccatttaatggaatatttgttttgtatgtaattctgataaagtctttgttataaaaaaaaaaaaaaaaaaaaaaaaaaaaa

SEQ ID NO: 87942 - DNA, 283 bp, Heterodera glycines
  SCN-specific regions: Sequence locations=1-60,82-283
aagagctctgagaccttgacctcgaccagtttattttgtacgactacgatgactataacgatggcaagactgaaatcatagcatacctatgcaatgaaatcactgagccgccggctacgacccttggtaattgccaaatgagacctggtaccccatgactgatatacattggtcaacacttgcaaatgttgatgacattcgtaaaggagtctctggcattatagacgaattgtctcctatgcgaactcgagtcaaatacactgacacttcgactgcgagcaat

SEQ ID NO: 87943 - DNA, 377 bp, Heterodera glycines
  SCN-specific regions: Sequence locations=1-21,43-239,261-377
acagcatatgacaataccgatcattttggacacacccaatcaatgatacatgctaacattgtgccggccagcgacccaaaagataaactttaactatatcgggaggaacgtagcggattatgtgcttcgtcataagatattggacaatatcgatgatgactaaccaatggcaaatgccaagcgaacgaattttcatcatcacagctccattaatgatgacagtccgaatggacggccttactgactgataaaaagcaaaagggcgaagaaactagtgatccaggcgaatggaaaaaagaaagaccaatgccatgatataatggttaataatgcacacattgtgcgtgtcaccataaaaccggctaaccaacgcaatt

SEQ ID NO: 87944 - DNA, 336 bp, Heterodera glycines
  misc_feature (38)..(38): n is a, c, g, or t
  SCN-specific regions: Sequence locations=1-336
gcgctgtttgaaagcctatgggcaaacatcaaattgcnatcgattgctcttcgtcattgtttgtaactgttgaacatgggaaatgacacctttaagttcaacaataaaacgtgaaagtcgcaaaaccacttgcggatgtggcaaaattgggtcagaccaacaaagagacagttcgactatgaagggactgcctgaagaactaccatcacaactcatactatgccattggacaccattctgcgatcccaacaatatggttatgtactcgacattgacggcaaaatgaacgacaccatcaaattgagctaataagtttgggctgttccgacattacat

SEQ ID NO: 87945 - DNA, 724 bp, Heterodera glycines
  SCN-specific regions: Sequence locations=1-628,650-724
gctattttgcgattttgtgctatttttgcctccctacatattaccattttcgtttctttttaccacttttcgagaattcaatcttcatatattctgcactaaaattttttggaaaacgaacatcctgctaatggacattcaaaaacaaaattacaccgaacaatctttggaacttttgagtcaggaattgcggtccattttattggatccaaactcacaaatgccgactgaaacaacggaatccaacgaaaagaaagaaaatcccgaagacatttcgagcactgtgttctttgagcatcagcaggaattattgaatgagacagtttcgagtggtgatgaagattttcgttgtgtgtctgtaacatctaacgaatctgagattcaagaacctcgcttgtcaactcccacctcacaattgccgactgaaacatcggattcaagcggaaagaaagaaaatcccgaagacatttcaagcactgtgttctttgagcatcagcaggaattattgaatgagtcagtttcgagcggtgacgaagattctcgttgtgcgtctgtaacacctcccgaatcagaggttcaagaagctcgcttattgactcccacctcacaaatgccaactgaaacatcgaattcaaacggaaagaaagaaaatcccgaagacatttcgagcactgtgttttttgagcatcagaaagaattattgaatgaatcagtttcgagcggt

SEQ ID NO: 87946 - DNA, 775 bp, Heterodera glycines
  misc_feature (743)..(743): n is a, c, g, or t
  SCN-specific regions: Sequence locations=1-549,575-685,714-775
ccggtctgttcttaacacagacagtgctgttgtgccgggtcgcgcacttttgtggacgcaaaaatttacgacgaattcatccaacggtcgaagcaaattgcggagaaacgcgtgcttggcaatcccttccatttggacaccgatcaaggcccacaaattgacggggaccaaatggataagatcctccagtacatcgaccagggaaggaaagagggcgccaaactgatcaccggtggcaagcaattcgggggcaaaggctttttcgttgagccaacaatttttgcgggtgttgaggatcagatgaaaattgcacaggaagaggttcattttcagtcctccccctccccatgattcaaataacattttgcttagatattcggccctgtgatgtccattataaaattcgacgggctcaaggacctcgtagaaaaggccaacagcacaatttatggtttagcagcaggagtaatgacacgtgatttggacaaggcgctctatgtggccaataacatcagagccggcaccgtttgggtgaattgctacgatgtttttgacccggcggctccattcggcggttacaaaatgtcgggcatcggacgcgaacttggggaatacggactatctgcttactcggaggcacggaaaatttaattatggtaatttttcgattcttaaggtgaaaactgtgaccatcaaagtgccccaaaagaactcttagtgggaaacaattaataacgacatanattagttaaacttttgaatttttatttcataa

SEQ ID NO: 87947 - DNA, 799 bp, Heterodera glycines
  misc_feature (792)..(792): n is a, c, g, or t
  SCN-specific regions: Sequence locations=1-323,345-799
gcaacctttttggcgtcactttccattccaacggttctacggggccaatggttttttactcggaatttatggaatttgtcagcggagaaaactttagcaaagcgttgaaaaaggtcgatgccaatggggaaagtgaatcttccgacgccaaattaaacaatgccaacaaaaacaaacgccgccgttcccccggcggtgtttcatccttttcaatgccttcgccggtccgtgccgttctctccaaattcctcttcgccgctttctgcgccattttgctgctcattttcggaaattcgtctgaccctgcccaaattgtgtctccgtgggcttggcgaatgccgtggctgcaatggctgcttctcttttggtttctcattttcatgcagcgcgtccaatattattacgcgtggacaatgaccgatgccatctgcaatattagcggttttggcttcgatgggttcacaagcgatggaaagcccaagtgggacttgaccaccacagtggacgtgtggaaagtggagacagcgcaaagtttcaaagaaacgctggacggatggaatttgaaaacgatgttttggctgcgttacattgcctacgaaagaatgccgaaaaactacagaacattgtccacctacgcactttccgccgtttggcacggccttttcatgggttattacctttgttttgccaccggtgctctgataacagtcgccgggagaatgtctcgccgttgcattcgccaccatttccaacggaatgcatttcttcaccatttgtacaatttgctgactnttttggc

SEQ ID NO: 87948 - DNA, 589 bp, Heterodera glycines
  SCN-specific regions: Sequence locations=1-159,196-589
ttactccccccccctaaacaattgcttattcaagaaggaattggacagctgatttccctcccaatctttgaattgtacaaagggaggcttaaatggggcggggggtgagctgctggcggtggtgacacacattccctgtaaatccccccagggactgacatcactcactcactcattcatttgtcagttccctcgtgcccattgatccgtcttcccttctcttcccaaagcgaccgatcggaggaattccctcaaacttataatagtggtcattaatgaattgtgcccatttggtctgatcagtcgttcgctgcttttgatcattcgttcccttccctccgctccctttcagtccgctgatctgtccccccccccctttccccgctgcttttccctcctcatttccgtattctcttcgctttccctgctgctgaaatacaaattagatggctaccatggtgcacatgtcctcgcatcatcagcagcataaaaaattgaaaacattccaagcttatcttccccccggtgcccgcacttacagttgcgcccattgccgtgccaatttggcccattcacaatgagctgatct

SEQ ID NO: 87949 - DNA, 599 bp, Heterodera glycines
  SCN-specific regions: Sequence locations=1-32,56-599
atgacggcccaaccattgcccaggatccgactccctcccctcggcgtgtttttctccgtgacctttgttccctcttttgttgcccgccgctcccttcggctattgttgccaaattggcttttatgccaccggaaccgagttaccgaattttgaccagcgactcgggacggacgacgttggagctgatcgacggcaggacagagtggccacatgggcaagatgagctgaacaatgtcgaggtgttcttcacccgtactcaacgtcgcaataaaatcgcctgtatgttcgtccgacccttcgaactttcgcatttcacccttttgttttctcacggaaatgcggtggatattggccaaatgtgtaacttttaccttgggctcggctgtcgactgcggtgcaatgtgttcagctacgattactcgggttatggtcagtctacaggtcgtccttcggaaaaaaatctctacgcggatatcgctgcggcacttaaatctctcgaaagccgttatcaaattccaccggagcaggtcattttgtacggtcagagcattggaactgtgccttccatcgacttggccagttgttatccgcgcatcgct

SEQ ID NO: 87950 - DNA, 688 bp, Heterodera glycines
  SCN-specific regions: Sequence locations=1-63,88-276,299-667
cactgcccgccttggggccaatttggccgactccttcgggagtcactctcccttcggacgaagaactccatctcgtcaacaccacggggcatcccaagggccgaattcacaaagccatgccaaacattgagcaaacagcagtacccaaccaaatgcattggacagcctacacaaaattgtagtggaaaaaaacgaccggcggaagcctacaaattgtgctcaaatccattctgtgtgcgatggcaccgctgcttcgaattgggctgtttgcagttgatatttttgccatcatcggatctcatttttatgcccatctttcgtctgactcaagcctatctgttatcaccaagtccccagactttaacgacgccgctgaatttgtcgcaacattcaaatccatgacggatgcaagtgccgacgttcttgataagatttccaacattggaaacggcgcctttactctcctcaagtttgcgggcccaataggccaaatggtacacattggtctatccatcggattgaagcagcaagactcgcccgagctccgtgcaatacaggccttacagagacaaatcaccgaacagttcgaaacactcttccgtaaaatcgatgactctattgttccgcaggagtatagagacttaatgacagactaccaaaagatgagtttatttttatttttttaaaa

SEQ ID NO: 87951 - DNA, 777 bp, Heterodera glycines
  SCN-specific regions: Sequence locations=1-311,333-346,370-777
ccataagttttttccgtctatataaaacttaatggcggaaattgatatggccgaatttgagggtgctggtgaacgttataagtttttgatacaaccagtaaaggatcttgcagccaattgggatttggatattgccaaaacgcttgaggattacatccggaaagttgttgcggaaactaaaagaatcgatgccgaagctccggatgatgaatataggcggcacaaagttttcaatttcgctgaggccgctttgctcatccacgggacgacgacagtttatgcgcgaaaagtcgactacgtattgcaaaaagcccaaaacttttttgatcaattgagggaggacgaaaacattcaccaccagcagcagcaaaaaggaaaacgaaggaaagatgacccattggaagaaggtgctgaagcgacaggggaagagatggacgaaaatgcaaatgcggacgacgcgggcgagggaagggaaaaacgccaaccgaaggctaaccaaatcaattacgcttccctgggccatttgctcgatcgtctcattgtcagccagcgtcggacttcgcttcttcccgtcgttccaatcgcttttttttcactcactgacttcgagaaacgaaatgtgtcgctttgcacgcgcacaaatccaaccgaagtgttcgggtagatggaggacttcaagctcaattcgtgccacgtctatgggtcaattgctctgctcgatttcaaaacattgccatcgtccacaaattttcgcaattagtcatttactcccaaaaa

SEQ ID NO: 87952 - DNA, 689 bp, Heterodera glycines
  SCN-specific regions: Sequence locations=1-544,566-631,654-689
ccgggtcgaagtgaaattaccaatatttcgaacactttttgaaggggcacgcaaaaaactaatgcgattcgatttacgcgattatccgacaccgccaaaagcgaaaattgaggagagtgtaacgcgcaaattcactgctagcgaatgcgtcgaattggagaaggactaccaacaaatgctcagacaatttcgaatatttctccgcgatttgctccgacaaataattcgggagccccgcttcaaatgtttccatttgccggtcgacaaaacggacgccgaagattactacgaaatcgtcaaacaaccgatgtgtttgagtcagatgatgggcaacatcgacgtgggcctttatgcctcaaaggatgcctttgcgaaggacattcaattgattcgcaacaatgccatcgagtacaacccggacaccgacatggactccaagcaaatacggcacgccgcaaatgccctcgtggacatgacggaggcactgttcagcatggaaatggacgacgatttcccgaccaaattggaggaggcgcgaaaattggtggaggaggcgaagcgatggacagaaaaaatggaatcggcggagaaagacgatggcacgaggaatggagggcgagaaaaaaacattgtgccgtcgacggtggcggaggacgagcgacggggcgacgtcggcacagagacacaac

SEQ ID NO: 87953 - DNA, 94 bp, Heterodera glycines
  SCN-specific regions: Sequence locations=1-94
attacttttctctacttcggccttttgaattccaggagcgcggcctggtcgcccgcggcgatcacgttcgcccgtccttctccctgtgcttgct

SEQ ID NO: 87954 - DNA, 648 bp, Heterodera glycines
  misc_feature (563)..(563): n is a, c, g, or t
  SCN-specific regions: Sequence locations=1-5,29-80,125-127,154 -165,201-287,309-327,457-648
attccaatattttttttaattataatttccttttccaaaacctttaaaatgcgcgccattctcttcctggccatggtttgcttggtgatggctgttattcttgagacagccaattcaaaggcagtgaaaaataagaaaggagcagttgcaacgccagcaaaaggaaaagcggcgccgaaaggagcagcgaaaggaggaattaaaaaagacgcaaaatcaaagggaaaaggaaaaaaggacgccaaaggcaaaaaggacaaaaaagctaagccagccaaagggaaaggagtgcctaaaaatgacaaaaagtccccagcggcaaaagccaatgacaaaaagagcccaaccaaaccaatggcagcagtgaaagccgtgccaaaggcggcggagaatgctcagaagggaccgtcgagtgcggaagtggtggcggaggaaaacaacttggacactgaggcggtcgacgacttgggggcggaagagtcggactttgaccaattggcagaggacgaactgctcgaggacgacgccatggacggcgaggcggacgaattggagggcatggngggaagagacggagatggacagccaaatggcactttgatggacaaaatgaggcaaattggacaagtggctaacggaacaaaacga

SEQ ID NO: 87955 - DNA, 693 bp, Heterodera glycines
  SCN-specific regions: Sequence locations=1-113,135-197,219-248,272 -324,346-693
gaattgtaattattgatcgtctccccaatggcttcttcactcaccattgaaaaacgctgcaaacttttcaacacaaaacaaatggaatgccaattcgatggaactgaagccggaaaatgtgctttttgtgtaaagcttccgtgtaaatttggagcagttaattgtgcagaggaagtgagcatctcttgtgtaaatccgcaagaattggaaaaatgctgcaaggcgcgtgacaacgaatgctgcgtgtgtgtgctatgcgagaaaaacaaagttatgaaggttttggtcgaatgttgcggaaagcgcaccgaaacgagtgccgaggccgggaaagcgctttgcatttgtgtgccgaaaattggtggaggcaaatgtggaggacaagtgcaagtgaaacaatgcgatgcgaagctggttgacgagtgctgcgcagctaacacggagagtggcgactgctgttgcgtctgtttgagctgcaatgaccaaaagtgtgtggtcaccgtccgttgtcctgctggagaagcaaagtcgactggtccaacttgtactgcttcaaaatgcgaaagtgtgaagtgctgctgaagtcaaaaaactgatcgaagactgaaaggatgcatgcatttaactgactcagttttaaaaatgctttttcaattagcaaataaataattgccaaaaaaaaaaaaaaaaaaa

SEQ ID NO: 87956 - DNA, 649 bp, Heterodera glycines
  SCN-specific regions: Sequence locations=1-566,588-649
aaaatatctgtaaagatgggttgaaataccatcctttctgtaacattggtgtactgcgaaagaccgatgataaatcattaatgaatggacagttggcgttagaggttttaaaatggaaaaatgggtgtgaaatcgtggcactttatttcggcgcccacatgagtcagcgatgtcgtgaatttataccggtgctcaagcagttctatgatcagttgaaaaaatctcccgaaacaatgccttttgaaattgtttttgtgccctttgaccgttccgaggatgaattccgcaactctttgcgcgatttgcacgacgattggctgtacattccctatgggagtgttcacattaacccattggccgcgaggtttaacatcattaattggggagtcattccgacattggttgtgcttaaggaggacggcactttgataaccatggctggacaagcagatgttcagtattcgtcagcatcagaagcaatggcccgctggcgctctactcctaaccccgaatccggattcaaagatttttcgaaattttaaatttccatatcttttttgttaatgttgctaaagcattggtttgatgtgtacaaccaacatgtgtgtcagggatggcacggaattccgatttccgaaatttttgatta

SEQ ID NO: 87957 - DNA, 86 bp, Heterodera glycines
  SCN-specific regions: Sequence locations=1-1,24-86
cactctctctccctctctccattccctttttttttgcatacattaacgaaaaatgccaattccccccattcattttgctctttttc

SEQ ID NO: 87958 - DNA, 660 bp, Heterodera glycines
  misc_feature (25)..(25): n is a, c, g, or t
  misc_feature (648)..(650): n is a, c, g, or t
  SCN-specific regions: Sequence locations=1-25,47-70,92-154,176 -205,229-281,303-634
ccattgaaaaacgctgcaaactttntaacacaaaacaaatggaatgccaattcgatggaactgaagccggaaaatgtgctttttgtgtaaagcttccgtgtaaatttggagcagttaattgtgcagaggaagtgagcatctcttgtgtaaatccgcaagaattggaaaaatgctgcaaggcgcgtgacaacgaatgctgcgtgtgtgtgctatgcgagaaaaacaaagttatgaaggttttggtcgaatgttgcggaaagcgcaccgaaacgagtgccgaggccgggaaagcgctttgcatttgtgtgccgaaaattggtggaggcaaatgtggaggacaagtgcaagtgaaacaatgcgatgcgaagctggttgacgagtgctgcgcagctaacacggagagtggcgactgctgttgcgtctgtttgagctgcaatgaccaaaagtgtgtggtcaccgtccgttgtcctactggagaagcaaagtcgactggtccaacttgtactgcttcaaaatgcgaaagtgtgaagtgctgctgaagtcaaaaaactgatcgaagactgaaaggatgcatgcatttaactgactcagttttaaaaatgctttttcaattagcaaataaataattgttgataaaaaaaaaaaaannnaaaaaaaaaa

SEQ ID NO: 87959 - DNA, 162 bp, Heterodera glycines
  SCN-specific regions: Sequence locations=1-162
ttgtacttcgactaccacttgcttttctgatggaccctcccgatctatccgagactcagccgaccattccgaaaaggggccaccaccaccggcgtcgcgtggatatctccgcctcgcgtttgccccgcgctgtgctcgtccgcatctttgggcatttgagtg

SEQ ID NO: 87960 - DNA, 512 bp, Heterodera glycines
  SCN-specific regions: Sequence locations=1-45,67-86,108-214,236 -473,495-512
aacgcgaacccaacattttctaattttcttcctttgctatttggaaatgaccactattcccatagagccggtgaaagcggggaaccgcctgcaagatggagcataagtggcgcagagccacaagatacgccaggccgatacaagtgaccactgaggagccaccatcaaaaacaaacgatgccaatgatcaccaatctgcggcaccgggaaatggaaaagcaccaaaaaataagggcaaaaagaacaagagcgacagcagcgactcgtcaagtgtcgaagagttcgtctatcgaaagtgacgagaacaataagctgaagaggatgaacaagcactgagcatcggtcgactcactaatgaggccggttaataggattgcggtcattagcgaagagtggactgtcagcaattaatgactgcaaaattgtaaagcggttattcttcgatgggaataaatgttattagtggaaaatggcaatgccattttaaactataagagataaattcacctcgt

SEQ ID NO: 87961 - DNA, 728 bp, Heterodera glycines
  SCN-specific regions: Sequence locations=1-3,39-50,85-85,115-124,194 -195,294-295,330-346,371-425,500-502,559-601,671-672,720-728
tggggccgtgctgtcgctgtacgcctctggccgtacacccggtatcgtgttggactccggcgacggtgtcacccacaccgtgccaatctacgagggttacgcgctgccccatgctattctccgcttggacttggccggccgtgacctcactgactacctgatgaagatcctcactgagcgtggttactccttcacgaccaccgccgagcgtgagattgtccgtgacatcaaggagaagctgtgctacgtggccctcgacttcgagcaggaaatggccaccgccgcttcgtcctcatcgctggagaagagctatgagctgcccgacggctaagtgattactgtcggaaacgagcgcttccgttgccctgaggcgttgttccagccatctttcctcggcatggagtcggctggcatccacgagacgtcgtacaactccatcatgaagtgcgacattgacatccgcaaagacttgtacgcgaacacggtgctgtccggcggctcgaccatgtacccgggcattgcggaccgtatgcagaaggagatcaccgcgctggcgccgtccacgatgaagatcaaaatcattgcgccgccggagcgcaaatattcggtgtggatcggcggctccatcctcgcctcgctctccactttccagcagatgtggatcagcaaatccgagtacgacgagtcgggcccgtccattgtgcaccgcaagtgcttctgattgagcg

SEQ ID NO: 87962 - DNA, 367 bp, Heterodera glycines
  misc_feature (362)..(362): n is a, c, g, or t
  SCN-specific regions: Sequence locations=1-213,236-367
gaacagaagaaattcccggatgcaccggcgacctgacacctcttctgaccagtctgttgaccgctgtaaagcgatctcttcggctgtccgcaaggcgggattggcacaattgtacggagttgcgggaaatgtaaatgtgcaaggggaagacgtgaagaaattggatgtgctgagcaacgaactgatgattaacatgttgaagtcgtcatacaccgtttccactttggtttctgaagagaacgaacaggtcattgaggtggaagtgagcggcacccaaggcaaatacatcgtcacgttcgacccgctggacgggtcatcgaacatcgactgtttggtgtccatcggaaccatcttcggcatcnttcag

SEQ ID NO: 87963 - DNA, 558 bp, Heterodera glycines
  SCN-specific regions: Sequence locations=1-558
cctttgttttggatggtaacgcgtaaaagttctaacaaaatcctgagcaaattcgtgaaatgatcaaagagactgccattccgcccaccgttttgcgagtgcacaacgaacgggcgaaggagtcgcttcagttggtcaacaacgaatacttgacgaaagcgtccgttcattttgacacaacgccactccatgtcgattaccgtgttcttggtccgccagcaactctctatcggaacaaccatcgtgtcactcctgccacgtcaaactgtgaatggcgtccgggtgacgctttggtgaatgcacaaattggcacctgggtagcctatgcgtttgggaaccctgtgggtgactcggtgcgacgattaggcctaaccgaaacgatgtggagaaatttcgtggacaagtatgcaagtgaaatgcgtaacaagggcattgtttgtgtgcctccggtgcgtgtctctatttgctggtatacgtccgtgaacgaggtcttgaatattttgcacaaggaagctctgaacggggggcgttgagttctgtctcattggtcatgcgaaa

SEQ ID NO: 87964 - DNA, 556 bp, Heterodera glycines
  SCN-specific regions: Sequence locations=1-325,347-417,439-556
ttaccgatttgttgaagaaatacatttgtcacatcaatcaaatgcctaaatcgaaagagttggatgcgttgcgtattcgttttgaatatttgtcggcacttcttgaacttttggatgctctttttccatctattgaatcgcttctctcgaattccaatgacattgaaacaagatttgtgcccgatttgaaacggtccaacttgctactaccaaaatgcattcaacttaacaaaatgatttcgaacacaatatgtgttggttcgcagccttccgatggatttgactccgatttttcttggcttcccgtctttgatgccaattcgtctttatattttggacttcccagtttccctcgtaaatcaaggcttcttccgagagttggcgcgtgcgaatactttaataatctgttggaaaaaattttgtttgttgtttccaatttgccggaaataccacttaccgtcgagggaataattgagcttcttcaacaaattggtgaggatgactcatgcgttctcatccgttcactcactcaacttctcataatgccgaatgacca

SEQ ID NO: 87965 - DNA, 465 bp, Heterodera glycines
  SCN-specific regions: Sequence locations=1-19,128-239,262-367,401-465
tggagcagcaaaaaaacaagagcgggagagagagcgcgagagggacagagagacgacggcgaaggagaaaaaggagcgaaagcgaagcaggtcgcgggagaagaagcgcgacaaggacgaggaaaagtcttcaaaaaagagcaaaaagagttcctcgagtgatttgtcccattcgcccaaaaaggcaaagaaagagccgcaaacgccgccgtcggaacggacaaacgccagcggtaaaggaaaggaatgaatgaaagcacagaaaaagggcgaaaacggcttttcatttgcattggacagacaaattgcaatttttttgctttgttaatttatttttcctttaaagtgtataaatttttgtttgtttaaaaaaaaaaaaaaaaaaaaaaaaaaaaaaaaactctgcaataagaaaccaatgattaataaaaattaccgaggacaacatggaaggccgggagcatg

SEQ ID NO: 87966 - DNA, 417 bp, Heterodera glycines
  SCN-specific regions: Sequence locations=1-15,37-170,192-286,309-417
ttaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccga

SEQ ID NO: 87967 - DNA, 753 bp, Heterodera glycines
  misc_feature (743)..(743): n is a, c, g, or t
  SCN-specific regions: Sequence locations=1-293,315-753
cccgagaaatgggacatgaatacggtggttccaccaatttcactggcaacaacatataagcagcaatttgctggaatgcccaaaggtcatgattacgcacgaggcggcaatcccacccgtgatgtgctacaacaaagcattgccgcgctggaaaatgctcgtcactgtcgcgtgttcagctccggactttcagccacagcagcaatggcaaattggcttcattctggcgaccacattattgcgtcggatgatggctatggtggcactcaacgctattttcggcaaatctctgtccagcatcatggcatggaattgagctttgttgatttaacgaaattgtcaaacttggagaaggaatttaagccgaatacgaagatggtgtggtttgaaacaccctcaaatcctcttctgaaagtgatagacattgaagcagtgtgtcgtgcagttcagtcacgatcaaaagaatgcattattgtagtcgacaacacgtttatgacaccgtactttcaacgtccgttggaacttggcgctgatgttgtgatgcattcgttgaccaagtacatcaacgggcacaccgatgtgctgatgggtgccatggtgaccaacaatgatgagcttgatcaacaccttaactcacagcaactcgctgctggtgccgtcccgtcaccgtttgacgtctatttggtgatccgtggcatcaaaacgctccatttgcgaatgcgacagcacatggaaaatgcatnggcagttgca

SEQ ID NO: 87968 - DNA, 280 bp, Heterodera glycines
  SCN-specific regions: Sequence locations=1-280
tgaggaatttttcgtcgacagaattctcctcccagcgaatacagaataagctgtttgcgaattcttcttccatcagttcggatggccgcgaacttcagattgaatattggacttcactcggttacccatttccttcatcttcgacagcgcactgcaattacatttcaccaaatgatgtgggacactcgaacaatgcaaatgtcgggagcaaattttcgatgaaagcatctgtccggaccctttccattgttcgtgaaccgatgtccaatttgctgtcaat

SEQ ID NO: 87969 - DNA, 393 bp, Heterodera glycines
  misc_feature (391)..(392): n is a, c, g, or t
  SCN-specific regions: Sequence locations=1-232,254-322,391-393
tcccgccgcctgtctgctgttggcacttcgcatgaagggcatcggcgaatggggacccgttttgcacaagtacaccggcttcaaacattctgatattgaaccgctgatgtggcgtctcaatcggatgatcatcgaacgtaaacagcattatccggacttggacactgttttcctaaatatagccatgaaattttcttcgaagtggcgaagactaagcagctgagggaacattgattgaattatgccatttttgattgatggcctattggcattaaagtatttgtgtcattttttttaattaacaataaactgaaagaaggataaaaaaaaaaaaaaaaaaaaaaaaaaaaaaaaaaaaaaaaaaaaaaaaaaaaaaaaaaaaaaaaaaaannt

SEQ ID NO: 87970 - DNA, 465 bp, Heterodera glycines
  misc_feature (391)..(391): n is a, c, g, or t
  SCN-specific regions: Sequence locations=1-251,273-281,391-391,419 -435,458-465
caatgcgatgcgaagctggttgacgagtgctgcgcagctaacacggagagtggcgactgctgttgcgtctgtttgagctgcaatgaccaaaagtgtgtggtcaccgtccgttgtcctgctggagaagcaaagtcgactggtccaacttgtactgcttcaaaatgcgaaagtgtgaagtgctgctgaagtcaaaaaactgatcgaagactgaaaggatgcatgcatttaactgactcagttttaaaaatgctttttcaattagaaaaaataaataattgttgaaaaaaaaaaaaaaaaaaaaaaaaaaaaaaaaaaaaaaaaaaaaaaaaaaaaaaaaaaaaaaaaaaaaaaaaaaaaaaaatttaaaaaaaaaaaaaaaaaaaaaaaaaantcccctggggggtttcccccctgttttaaaacttataaaaatttcgggcccccccggggggcccccattttggg

SEQ ID NO: 87971 - DNA, 712 bp, Heterodera glycines
  misc_feature (675)..(675): n is a, c, g, or t
  SCN-specific regions: Sequence locations=1-585,607-712
tggacgttgcccgtctcttccccttctactgttcatattgttccattatggagttgttgttgccattctacataaattgtttccccggatgatgccttctacgtttcaggacacctccaattcggaacaacagtacaaaaggcagctgaaagccaagaatgagacggccaaatttttgcaagattcgctggaagaaattgcgctggctcgccaggagcaagggcatgcccacggggcgcaagcaatcgaatttgctcaattccttaaaaaggttcgtacgggtgagggcggctatgtgaacaaccaggagctgttcaagttcagcaagttgttcgaggacgaactgacgctggacaatctgagcatggtccatctgcgagcgttgtgccgtctgttgggcattgctcagtttggaacgccggaaattttgcgatttcgtctgcgcatgaaactgcgcgagttgaaggcggatgaccaactcattgaacgggagggcggtgttgaagtgctttctgcccaagagttgcaggcggcgtgccgcgcacgcggaatgcgagcgcttgggctcagcgaagaacgacttcggcaacagctaaggcaatgggttgagctgtcgttggatgagcaggtgccgccctcactgttgttgttgacccgtgccatgtactttcccgnagacgtggacttcactgctcgcattcgttccattggt

SEQ ID NO: 87972 - DNA, 531 bp, Heterodera glycines
  misc_feature (483)..(483): n is a, c, g, or t
  misc_feature (509)..(509): n is a, c, g, or t
  SCN-specific regions: Sequence locations=1-70,92-122,144-401,425-480
catcttcttccgatgacgctgataatgaagaaaccgatggatgtgcgtgccctgctgaaaagccacaatcaccgcatcattcctcctcatcatcaccagtgatgccatcatcccccaaacattcttctttgccttcatcacccaaacatcattcttctgaggatgaagcggaagtgaagcaatcaccacctcatcatcattcatcttccgactcggaaaaagaagaacaaaaacttcatgcctgattcataggcaccagaaccagttggatttgaacagatgaatttgagaagtaccatctgcaaatagggacacttttttcaaatattaccattttacgaatttccacctttttaacacacactttctatcttttatatcatagattaatgatatggaaatttttattctatcctttaaaaattgtgtcgtcttgaattgttattattaatagctattttaaagaaatgatttgcacttaanaaaaaaaaaaaaaaaaaaaaaagccnaaaaaaaaaaaaaaaaaaaaaa

SEQ ID NO: 87973 - DNA, 327 bp, Heterodera glycines
  SCN-specific regions: Sequence locations=1-51,84-242,264-327
attgcctattaattagtctttatgatgatgggccatcctcatgcccatggtccctctgtgcctctctcctccgctctctctgtcgctgcctctgatcagcaagatcactgctgtgccgtgtgcggctgcgtcggtgccaccatttattgttccgttttttcgtgccgtccctgcgcttctttctttcgccgttccatcaaagaccaacgcgagtacaaatgccgcgcgaatggcgactgtccaattgacaaaggtgagagagagaaagccaagagtatgaatggcaagtggttattttgataacactttgttcatctttggattagg

SEQ ID NO: 87974 - DNA, 155 bp, Heterodera glycines
  SCN-specific regions: Sequence locations=1-155
tactgtccacattttgctgtcggatgttgcgtgcgactgagtgatgtgaacttgaccagtttatttcatgcaagcgagatggatatagctagggcgaggatgaaatcctcagaatcctacgggatgaaatactgcgccccgggtacaaccatctt

SEQ ID NO: 87975 - DNA, 645 bp, Heterodera glycines
  misc_feature (643)..(643): n is a, c, g, or t
  SCN-specific regions: Sequence locations=1-379,639-645
atttccccgtgttaccgtatgcgatttttctgtttttaaatattctcaacctgtcaattttaccattgaatgcgttttgccgttgaatatgttcaacgaaaaaattttcgtgttttttttcttttggctttgttttttgttggcattgaccgttttctcaattttcctttggttggaccgtgtgcgaaatcggcgagactatttccgaaaattattgcagatttatgcgcgaaatgatcacaaaattatgtcggaagagtcggcgctcaatttgtgctcatttgggtccgaccttcgcattgtttttggccttttgcacgacaaaattgggctgattttttgtgcgaaaattttccggagaatgtgcgaaatcaaaagtgaagaagaaaaagggatggaggaaaaagaaaaaagcgaaaaaggaagaagggaaacggaagagaaagaaaaagaggaggaaaaggaatgaaaaggaaacggaggaaaaggaagaagggaaacggaagagaaagaaaaagagcaggaaaaggaagaagggaaacggaagagaaagaggaggaaaaggaatgaaatggaaacggaggaaaaggaagaagggaaacggaagagaaagaaaaagaggaggaaaaggaatgaaaagganac

SEQ ID NO: 87976 - DNA, 544 bp, Heterodera glycines
  SCN-specific regions: Sequence locations=1-544
tactgaaatgggcgtaattacgtggggccgcaagaaatcgccgtcgtccctcacggcgtccgtttctccgtcgacgtttccgtgccgagccgcggttatcttctggaagatttcgacgagacattttcaacttcccgaattgggcccaatcggtgccaacggattggcaaatgctcattgttttcgcattccgaccgcttggcttgaggagagagagactcatttcatcatcatcaacaaattacaaggacaactcttcgccgctgaacagaatcattcgcctttcgatgtcttcgcttggcgtggcaattattttccgtataaattatacttgcgtcattttatgagtgctaacgagcggggcttttgaccattgcgacccgagcattatcactgtgctcaccgtccctggccttcgtaagggcgtcgaactcgccaattttgtcattttcccgccgcgttggttcgtcgccgatggcactttccgtactccttatttccaccgaaattgtctgagcgaatctatgggtctgatcgatgggcg

SEQ ID NO: 87977 - DNA, 640 bp, Heterodera glycines
  SCN-specific regions: Sequence locations=1-618
agaacaaagccgcagtttttttcgaggaaggaaaatacgacgaatgcatcgaaatgtgtggaaaagcggtggaagttggacgagagaatcgggcggactatgcgctggtggcaaaggcttacgctcgaatggcaaacagttacaaaatgaaggacgaccccaagaaggcactgcacttctacgaaaaggcattgtcgggacatcgcgacccggacattgtgaagaagcacaaggaattagcgaaggaagtcaaagagatggagcagaaggcatacattgacccggaattgtcggataaagaaaagaacttgggcaaccaattgttcaagaaaggcgattaccccggggctatgagacattacaacgaggcgattaaacggaatccggacaacgctgtgctctactcgaaccgtgccgcgtgcttcaccaaacttatggaattccaaagggccgtcgacgactgcgacctttgcctgaagaaggacccttctttcgttaaggcgtacatcagaaagggcgctgctttgtccgcaatgcgcgagttcggccgagcccaaaaggcttatgaggacgcattgcaaatggacccgagcaatcatgaagcgatggagggactgcgcacgtgcatgcagtcgaacga

SEQ ID NO: 87978 - DNA, 680 bp, Heterodera glycines
  SCN-specific regions: Sequence locations=1-308,424-464,495-534,564 -586,618-628,669-680
cgccactgcgaaaagcgtacccaaacttggacatccagtggacggcggggtcggactggacaacatcgaacactgtgcgaacgcaggggccaatatgatcgtttctgggactggaatcgttcggtcggctgacccgcgtcagacaatgcaaaagatgagggaaactgtcgaaattgcttcctcaaaagaaacactcggcgtttaaatcgttttccattttaaaataacgaagatcgtttttgatttattgttatcactttctgttcacttatcttaagttagatagtctaaatgaaattcatttgttcaaaaaaaaaaaaaaaaaaaaaaaaaaaaaaaaaaaaaaaaaaaaaaaaaaaaaaaaaaaaaaaaaaaaaaaaaaaaaaaaaaaaggggccaataaaaaaaaaaaaaaaaaaaaaatccttttggttgttccccccggttaaacccctaagaatatcgggccccccggggggcccacttttgggaaaaccccccaccgggggggggcctaaccttgggtttttttttggggcccccaaaaaattgggggaaaaaccgggcaatacctgttccctcgggagaaaattgttttcctttaaaattcccccaaacaataaaaccgggaaacataaaagggaaaacccggggggccccttaggggggcccccccccca

SEQ ID NO: 87979 - DNA, 744 bp, Heterodera glycines
  SCN-specific regions: Sequence locations=1-744
ccaaagcggcggtgaagcagcggcggcaattcgtgtgctcgtgacgggtggcaccggactggtcgggtcggcaattcgacaggtggtgacggaggaggagcagcaacagaagccccagcggttgcaggagcagtggtttttcgtgggcagcagcgagtgcgacctgaccgacttggagcagacgcgggcgcttttccgccacgttcggccgacgcacgtggtcaatttggcggcaatggtcggcggactgttccacaacttgcgccacaacctccaattctttgtcaagaatttggcgatctgtcaaaatgttctccaatgctgccatgagactgacgtggaacggtgcgtttcgtgcctttccacgtgcattttccccgacaaaacgccgtacccaattgacgagacaatggtacataacggaccgccgcatgacagcaattttggctattcgtacgccaaacgaatgatcgatgtactcaaccgcggatatgctcaggagcacaatcgaaagtacacttcggcagtgccgtgcaatgtgtttggaccgcatgacaatttcaatttggagaacgcccacgtggtcccggcactgatccacaagtgctttttggccaagcgcgacggcggccctttggtggttgccggctcgggcaaaccgttgcggcaattcatttactcgttggacctcggccgtctctttgtgtgggcaatccgcgaatacgaggacgtggaacccatcat

SEQ ID NO: 87980 - DNA, 643 bp, Heterodera glycines
  SCN-specific regions: Sequence locations=1-310,332-490,512-581,603-643
agatttatgcctgggccttacccgcgtaacgaagaagaacgaagggcggctgccataaaatacggactacggcccgaggattacaagccccatcacccactcgacttcgtcaaccacattggagactatcccgaaattggcgttgtcacgtacgaacagagagacccttacgacaattactcgcacacaatgcatcgtcgcaattggaatgaacccgtcccacgccaattcacgcggtaccgttacgaccgctggtcgtataccggactggacgaagagaactacgagccgagagaagtgctccgcactttgctgatgtactttgtgcctgtgtttttgctggcttattggttgatcagaacgccggaagaccctttctactggtttaagcaaaaatatgagccggtgtatcgtcctcgagtaatgcctcgccaatacccttacgactatttccgcgcgtggccattcgaagagtacacaaagtatcccgttctgaactacacttttgagccggcagacgaaggatttgacccgaaagaagctgaagtgaaacatccattcaatgagacatctcgcgtccccctttaagcaaagaaaagattgcctttccgtttgtatattgcaggaaatagacaattttatt

SEQ ID NO: 87981 - DNA, 620 bp, Heterodera glycines
  misc_feature (565)..(565): n is a, c, g, or t
  SCN-specific regions: Sequence locations=1-541,563-572,594-620
ctcggacttgagttggtactaaaattgaggagctgttcaggaatatatttgttcgaccgggcgatcgtctgctccttctttccgtggatcatctattggattaagcggaggaacagtcacattctcacaggattcacttttcgtcgtcggaacatttcatataccgatctgaagatgacaatccctcgtttctcttctccgttttaccattgctcggcggttgcgctcgatgctttgtacagatggagtatcaaagtctgtcttcctcactttctcggtgttgacatgttgctcattgagcgtggcgaaatttgcgaaaattttgtgagtgaaatggttgaccagggatttcacatgtgcgtgtggactgttaacgacaaaaatgaaatggcttggatcgcacataagttgaaaatcccatttcttacggactttccacataaggctcggggggttctggacggagcaaacggagtgcccacggaattgaccttcgaattgaattaggaacataaaatcaagtttttgtatgaagtgtatgtttgtttcattgtatagtaatatntgatgtctttaccggtatttatttatttacttcttggaaataaacgcaaaacctt

SEQ ID NO: 87982 - DNA, 646 bp, Heterodera glycines
  SCN-specific regions: Sequence locations=1-379,645-646
atttccccgtgttaccgtatgcgatttttctgtttttaaatattctcaacctgtcaattttaccattgaatgcgttttgccgttgaatatgttcaacgaaaaaattttcgtgttttttttcttttggctttgttttttgttggcattgaccgttttctcaattttcctttggttggaccgtgtgcgaaatcggcgagactatttccgaaaattattgcagatttatgcgcgaaatgatcacaaaattatgtcggaagagtcggcgctcaatttgtgctcatttgggtccgaccttcgcattgtttttggccttttgcacgacaaaattgggctgattttttgtgcgaaaattttccggagaatgtgcgaaatcaaaagtgaagaagaaaaagggatggaggaaaaagaaaaaagcgaaaaaggaagaagggaaacggaagagaaagaaaaagaggaggaaaaggaatgaaaaggaaacggaggaaaaggaagaagggaaacggaagagaaagaaaaagagcaggaaaaggaagaagggaaacggaagagaaagaggaggaaaaggaatgaaatggaaacggaggaaaaggaagaagggaaacggaagagaaagaaaaagaggaggaaaaggaatgaaaaggaaacc

SEQ ID NO: 87983 - DNA, 659 bp, Heterodera glycines
  SCN-specific regions: Sequence locations=1-636,658-659
gtgagcaaaacgtttgaagaaactggcattcctttgacaaagtcgattcgaccattgaaaagaagctgtcagatgaatacgctgtgaaaggatttccaactctcaaaatactccgaaatggccgaaggttcgattataatgggccgagagaagccgacgggatcgtttcgtatatgttggaccaggccaagccggccgccaaacggctcaattcggcgaaggaggtgctcaagttcatgtccccctctgatgtgacagtcgtcggctttttctcctccgaaagcggcgctttttacgaagcttttgctgacgcggcggaaaggacgcgcggtgattttgccgttgggtacgccttggacggtgccattgcgcagcattttggcgcaaaatttggcgaagtagtactcttctggccagagatattccattcggagtacgagcccaaacggaagattttcccacgagagacggccacaagcgaagagttggtttccttctggcgcgacaatgccattccgttggttggccaaatgacccgtgccaattcggccacgcggtaccaccgccgcccattggtggccgtttattacaacgtcgacttctccttggcctacagagatgggacgcaattttggcggaagaaagtgttggccattgcc

SEQ ID NO: 87984 - DNA, 260 bp, Heterodera glycines
  misc_feature (22)..(22): n is a, c, g, or t
  misc_feature (27)..(27): n is a, c, g, or t
  misc_feature (43)..(48): n is a, c, g, or t
  misc_feature (73)..(73): n is a, c, g, or t
  misc_feature (80)..(80): n is a, c, g, or t
  misc_feature (83)..(83): n is a, c, g, or t
  misc_feature (100)..(100): n is a, c, g, or t
  misc_feature (194)..(194): n is a, c, g, or t
  SCN-specific regions: Sequence locations=1-136,163-197,227-260
tatcgtccgacaaaaaaaacangtggnaggggaaatggatttnnnnnnaaggaggtggggcagatctctctcnttgtttnctnacctttcctttgctttnttttgcatgttttcaatgcaatgggaaccctttaacttgttggggcttttggggccccccaatgaaaaaagggggggcctttggcccaaaaaanaccaaaaaggggggcgcgcccccaaattttttgggggggggggggttttttttttggggggggggg

SEQ ID NO: 87985 - DNA, 251 bp, Heterodera glycines
  SCN-specific regions: Sequence locations=1-251
ttatattttatgatacaatctccaaactccgacgatgattcattgaagacgctttgttatcagctgctcgtgccaacttctgctgctaatatcggtttcgcaatcggtgattttcaaattcacgtgcagccagaaatgcccgagattattaactttgtcgttccggagctcattccgctcttaaaacacacaatgaaatcgctgaatagaatttttgtctttttcgaagaacttttgtcatgccgatttcc

SEQ ID NO: 87986 - DNA, 525 bp, Heterodera glycines
  SCN-specific regions: Sequence locations=1-64,86-153,189-392,415-501
tcatttaaatcgctttttgcgtcggacgagggattgcgacgtggtcgagtgggcctattgcttcgatgtccatttgaatgcttttttcccgttgctcattcttctccacgtcattttacctttgcttttctacggattggttgattaccaaaattttctcgcccgcttttttggcaattccatttggtgcattgccaccatttattataattacattactttcctcggctataccgcacttcccacgctgaaaaacacgcaattcttcctctacccaatcactttccttttcattttcttcgttgccgccacaagcgccggttggaacgtttcgatcaccgcgatggacttttaccatttccgagtaacgaacgcagaccgtagaggatgacatggagagagagaaagaggaagcaaaatagacgaaggaccatccccaacttaaaaccaacccaagtcattgtccgttccaaaagagtgcataaatatattccatagaccaaaaaaaaaaaaaaaaaaaaaaaa

SEQ ID NO: 87987 - DNA, 824 bp, Heterodera glycines
  misc_feature (751)..(751): n is a, c, g, or t
  misc_feature (761)..(761): n is a, c, g, or t
  SCN-specific regions: Sequence locations=1-824
acaccgccgctttaactgcatcgtcgacgaacacttcaagacacgcaaatggaaattgggctgcatgcgaatttgcccaaaattggagaaaatggcactaagcaattgcaaattgtcaattccgatgcaaagccattgccaattccgcaaaatccgttgcccaacaaagtcatcggattcagacacattcagatccattacatcgatcaaaatgtcatcgcatttctccgccgttttcaccgtcgtattttcgatgtttgttcaatggttttgtacattcacacagacaatgaccgcattttggactactttttgctcaacatttggccaatgtttcgtcattcaatgcgtctgatgaatttgaattccatctctttacgccgtctgcgccaattggccggcccgtcactgctcagcgattgtccatcacttcgctttgtctcttttaatgaagccattctgcccgcttttccgcctgatgaaagtgccaatgcttcggatggccaagcgctggccaaatggctgttcacgccccgtccggatggtcagttcaagtggttcagaggctttgtcaattcaccggatcaatggtctccaacgatggaacagctgaaaacggcattttccaatgcttcttctccaattacttaccgtatttccttggcgttttcgtccacatcaattgactccgttgtgccatttgatgatctgatcaacgaagtgactgggggagaaattgacactggaacanaatgacacanatgattgttggctcagccgttgtccaattgcatgggattaccgaaagtggaaaatctgtcaga

SEQ ID NO: 87988 - DNA, 388 bp, Heterodera glycines
  SCN-specific regions: Sequence locations=1-114,137-388
atgttccacattcagcactatcgcatgatcgactagtgacgtgacacagagacctggaccagtttattttattctattgagatgaaactgcgacggcgaggatgaaatgctcagattccccgggaagaaatgctgcgccccgggtacaacacatctataatacaatggatggctgatccccataactgaccacattgggtactttctgaatctgttgatgccgatgataaggtttctttggcatagtaggcgcattagtaccttggtgtcgtggatcagataaaaccacttcacttgtgcctgattcgtgagccccagaccctgcgtttttgcacctgataaattgatttccctcggccgcgatcgacgtatggagcatctttcctca

SEQ ID NO: 87989 - DNA, 791 bp, Heterodera glycines
  misc_feature (757)..(757): n is a, c, g, or t
  SCN-specific regions: Sequence locations=1-791
tattgtcgtgatgtactccgttatgagaatgaaacactttcgagacagcctgagtgtgaacctttactcactgattggatacataggctgcttttcgctcgaatacggtcggtctttcccggtactgtcccaacaaattggtcgatgtggtaaactccggccacattttgtccttccttagccaatattacacttcgccacgcattgttttggcaggcgtgggtgttgaccagcaatttcttgtcgactcgggcaaagagttgttcgacccacgcgaaaccacttgggagaagcatcccgaacgtctcttgacacaattgccgcccgtggacgaatctttggcccaatacacaggtggcgaagtgctcattgagaaggacctcagtcagatggcacttggccctacgccattcccaaatttggcacatattgtcatcggattcgagggtgtcaatgtgagtgatgccgattttgtgcccttttgtgtgctccaaagtttgatgggcggtggtgggagtttcagtgccggtgggcccggaaaagggatgtacacgcgactatacgtggatgtccttaaccagcaccattggatatacaatgctaccgctttcaatcattcctacatggactccggtcttttttgcattcgcgccagcgccgacccgactaagcttaacgatttggtggacattattctcgcggagttcggccgtcttactaagggcgcgtggctggatgaattggagagggccaaagntcagctgaagtcgcaactgttgatgaacctcgaa

SEQ ID NO: 87990 - DNA, 480 bp, Heterodera glycines
  SCN-specific regions: Sequence locations=1-255,277-480
gttgctcaagttcatcaacagtaccattctcaacaacacctatcaaaatggcacgacaaatgaaagaagcgggaaagccgtcgtacaagctgtacgttcgacggatgctgaagcaaactcacccggacaaggaaatctcaacgcgtgtgttgaacatcatggagtcgttcctcaacgatttgatggatcgcattgcaacggaagcatacgctcattgctctctataaccgccgcaagaccatgaatcttcgtgatatgcagtccgccgtccaactgtgcctccctgtcggaatggccacgcgtgcgaatcgcaaggcatatgatgtggtggcacagtacaatgctgctaggaaacggaagggcatcttggggcaattctgcagttggttgggattttgagggagcaatgaggacgatatttttgacatttgatgtacagtgaatatattgtaatgcaagtctgtatcacatgttcaggtg

SEQ ID NO: 87991 - DNA, 359 bp, Heterodera glycines
  misc_feature (300)..(300): n is a, c, g, or t
  misc_feature (307)..(307): n is a, c, g, or t
  SCN-specific regions: Sequence locations=1-359
actcgtcgacggcgggcgtcttcgtcaaaaaaagtcgacacaaagtctgggcccattccatcgccgctggaagcgtttttgaaaccgcagctgaacaacgcgatgtccgacccgtctcagaactgtctgattcttctgcaagtgctctacgggctgaacacattttggtggcgaatttttgatgcaaatgatgccgacactgatgaggacgacaatgatgctgctgatgaggaggagggctccgatggagaggaggaaacgacggatgaagtcgaggacaacgagcagaaacaaccgcanacaaatntaccaccaatcacacacagaccgatcatcgccccgagtttcttctactcacc

SEQ ID NO: 87992 - DNA, 139 bp, Heterodera glycines
  SCN-specific regions: Sequence locations=1-139
acatcctttcggcgatctgagcggcggcatcgaagagaccctgtccgaacgcgtcctgaatcaggatgagatcgacagcctgctgggctttgacatgggcgacgacgacggctctgagcggtcgggcatccgcgccatc

SEQ ID NO: 87993 - DNA, 337 bp, Heterodera glycines
  SCN-specific regions: Sequence locations=1-337
ctcacgacagaagatacttctggcacagatcgcgtctttggattgtctgtgaacgtatgagggctggtgagccacgtcatctttcgccgacgcgggggatgtacaccgtataccccaactacaacaatggcttccgaacaatcgaactattcctcgaccactaccttcgcaccggaacatctgtcaccaccgagcgattcgtcactctcaggaaggccgtgcaccgggcgaattgggagctgtcgcactcatccatcaccgtcagctcagagttggggagaggggcattcagcgtggtcaaataagcagtgctcacctaacgcaatgggaacaacta

SEQ ID NO: 87994 - DNA, 746 bp, Heterodera glycines
  SCN-specific regions: Sequence locations=1-44,67-746
acatcgtttatttcttttgtattcacatcgtttaaaatcaaaacaaatgcctcaaaacgagcatattgaactacacagaaaacgccatgggcgaaaattggatcacgaagagcgcacgcgaaagaaactggccagagctgttcatgaccgttcaaaagtggccaagaaattgcggaaagggaaggcgaagttgtaccacaagaagagatatgcggagaaggtccaaatgcgaaaattgatcaaacaacacgaggagaagaagcaaaaggggacgacggacactcaaacggagggagcagtccccgcctatttgttggaccggcaaaaggaaacggcggggaaggcactttcgactgccatcaaacagaaacggaaggaaaaagcggcaaagtaccaagtgcctttgccaaaagtgagggcggtcagcgacgcggaggccttcaaagttgtcaatacgggaaaaactagacgaaaagggtggaaaaggatggtcaccaaagtcactttcgtcggcgaaacattcacacggaaaccggcaaaattcgaacgattcattcgtccgatgggtctccgttttaaaaaggcacatgtcacccatcctgaactgaagaccactttttgccttccgttggttggcgtcaaaaagaacccttcttctcaattgtacacttccctcggcgtcatcactaaagggacaattatcgaagtgaatgtcagtgaactcggaatggtcacacagggcgggc

SEQ ID NO: 87995 - DNA, 204 bp, Heterodera glycines
  SCN-specific regions: Sequence locations=1-10,33-204
caaaaacattgtttgaaatttttaaataatttctgctaaatgaaatatttaatagccgtgtaacgctaaggtagcgtaatcaaaagtttattaattgtaaacctgtatgaaagaagagtcgagaagtagctatccctgcccaagattttgaaattaaagaatattaaaaaatagattctctcttacaagacgagaagaccctag

SEQ ID NO: 87996 - DNA, 594 bp, Heterodera glycines
  misc_feature (580)..(580): n is a, c, g, or t
  SCN-specific regions: Sequence locations=1-82,104-169,191-594
caatttcttatcgtcagcttctgttcattgctgcttttctcttcatcggttgtcatgcgcatgatggcgttgatacacgcatctggcgagcttcacttgtgccacggcgaaggacggtgcaatcaatggcttcacagcgggtgacggtggtctgacaattggttccgacgccactaatgccactggtgctattatcctctttggtttccagacgagcaacaagaaggatttgagcttcaaagtctttgcgccaacatcagcatcatgcctctcatcagtgaacaacttcgtcatcagcggccgaatttgtaaactcgaagcgttggagacagagactgaatcggctaactgtccggaagaagacagcgctggctccggttgcaactcccgcagtgtcacctgccaaatgacaaccaaagaaatcgcggaatcggatgacggtcgagtgttcaaagtcgacttgggaaatctcacacaagtgacgtcactgtgcacgaagtggaaggcgcatttcaccaacgttcgtcaagtgatggaatcaagcggaggcggagaaccgcgtgtgtctactcgtacttcngcggcgggcggtgg

SEQ ID NO: 87997 - DNA, 774 bp, Heterodera glycines
  SCN-specific regions: Sequence locations=1-774
accgtagttgtccataagcttttccttctcccccaataattccgttcgctttctccgctttttctctccgatgacttccccctttcactccctcgtggagtctcagcgggaattctttcggacgggcaaaaccgccgaattggcacatcggaggcagcagctgaagaaactgcgcaagacaatcctcgacaacagcgaatttctctgcgaagccgtgcaaaaggacctgaaaagggacgcgaaactgaattatccgctcgaaatttcgtcggtgatcattgaaattgaatatgtactcgacaatttggagcgatggacggcgcctttaaatgtcgaaaagactttcaccacacttctcgactccccgcaaatcgttcgcgagccgaagggcgtcgttttgctcattggtccatggaattaccccctcaacactttgctaatgcctttggtcgacgttttagccgctgggaatactgccattttgaaaccgtccgaagtcgcgtcgaacaccgccgccgccgttgacgaaattatttcgaaggcatttgaccggaattatttggcagtggtgcagggcggcattgaacagaccggcgaattgctgaaggaaaagttcgaccacattgtgttcaccgggtcagcgctggtcgcccgccacatttccagggcggccgcggaacatttgacgccctgcactttggaactcggcggaaaatcgcccgtgttcatcgactccaacgtggaccttccgatcaccgcgcgtcgattggcctg

SEQ ID NO: 87998 - DNA, 173 bp, Heterodera glycines
  misc_feature (170)..(170): n is a, c, g, or t
  SCN-specific regions: Sequence locations=1-173
ttgtaaatttcggcatcaccgcagcaggtccactcctactatgtccagggggacaacccctacgatcagcatgcggatttggatgtgccgcaccgtcccaagaacaacagccgtttaattcgaacatttcgcggagcaaggcaaggccgggatgccgaagaacgacctgngct

SEQ ID NO: 87999 - DNA, 352 bp, Heterodera glycines
  misc_feature (312)..(312): n is a, c, g, or t
  SCN-specific regions: Sequence locations=1-352
cagctgtcggatgagggcactacggctgctgccctctgccaaggccatttgctgcatggaccatttgcactgctgccccgaggacacccaatgcgatttgccgcaacaaaaatgtgtgaattcggacggaaattcgcagccattccatcggaaaatgccggcaaaaactcaaaacggagagacagttgagcaaaaaggaacggacaaagaagcgacagaagaagtgatttgccccgacggaagttcgaagtgtccgccccgtgccacgtgttgtccgctcggcgacggattcggacgccgtcgaaaagactnttggcgactcgaaactaacgctcagcaaagcatatcctac

SEQ ID NO: 88000 - DNA, 677 bp, Heterodera glycines
  SCN-specific regions: Sequence locations=1-135,157-219,241-270,294 -346,368-677
aagcggggtttcttttgcattataattgtaataattgatcgtctccccaatggcttcttcactcaccattgaaaaacgctgcaaacttttcaacacaaaacaaatggaatgccaattcgatggaactgaagccggaaaatgtgctttttgtgtaaagcttccgtgtaaatttggagcagttaattgtgcagaggaagtgagcatctcttgtgtaaatcagcaagaattggaaaaatgctgcaaggcgcgtgacaacgaatgctgcgtgtgtgtgctatgcgagaaaaacaaagttatgaaggttttggtcgaatgttgcggaaagcgcaccgaaacgagtgccgaggccgggaaagcgctttgcatttgtgtgccgaaaattggtggaggcaaatgtggaggacaagtgcaagtgaaacaatgcgatgcgaagctggttgacgagtgctgcgcagctaacacggagagtggcgactgctgttgcgtctgtttgagttgcaatgaccaaaagtgtgtggtcaccgtccgttgtcctgctggagaagcaaagtcgactggtccaacttgtactgcttcaaaatgcgaaagtgtgaagtgctgctgaagtcaaaaaactgatcgaagactgaaaggatgcatgcatttaactgactcagttttaaaaatgctttttcaat

SEQ ID NO: 88001 - DNA, 544 bp, Heterodera glycines
  misc_feature (320)..(320): n is a, c, g, or t
  misc_feature (346)..(346): n is a, c, g, or t
  SCN-specific regions: Sequence locations=1-298,320-544
taattcctgcgtattattgcggctgctgttctctgtccgtgccatcatcaaatcaaatcaacgaaagctgagccatcggaagtgtgcacaaatcgactaccaaacgaaactgggcaccacaaatcaacaaaatcatcattatcatcagcagtaaaagtggtgcagaaggaaacgcatggaccaaatcggcggcactttcagcgaccaaatttggctcgacacattggcgtggattggacgtggcgaggtcggatggcacttggcgctggtcaacgcccgcttcgccgccctggtgaacatgcagctgcagcagaggcggntggtgtttggaggagtttcacatcantgagcggaagccgaaacggactggcgccgaagtgttgagcttggcaaacaacggctcctacttctcgttgccattggccacctcaccgttgccggacagtgtcatcggattcaacggcacattcaacatttggtatttggacgcagaagtgatcaattttctgcaacgatttcggcgcctcttcaacacgtacatctc

SEQ ID NO: 88002 - DNA, 707 bp, Heterodera glycines
  misc_feature (507)..(507): n is a, c, g, or t
  misc_feature (677)..(677): n is a, c, g, or t
  SCN-specific regions: Sequence locations=1-685
ccgcaacattaagtgacgaattggaacggttgaaggaggaattgacacggaagacggaagagaacggcaaaatggaatcgaaatttggggaagtgaatcaatggtggaacgacgccaagtggagagtgggcgaattggaggccgaaacggcacatcgaagccatctgttggacagagcccaccatcgaattggtgaattggagaggagattggcgaacaatctttccttcgaggatttgaggcgagagaaggaaacgctggagggacgagtggccgaactcaccaaagcactcgacgacgcaaaatggagggtcggagaattggaagcggaaatgacacggaaggacaacttcgaggaacagaagcgaaagttggagtggcgacttggagagatgacacagtggtggaacgacgcgaaatggagaatcggcgaattggaggcgactttgggacacgagggaagcgcacgcaataaccgaggggaaggcaatggagacgacaacttanctgagactttgggacggttcagggaactgttgagcgacggcattttgctcatcagaaaacagtcacatttggacagagacaagtggaagatgatgaaatatgagcatgcactggagaaggatgttcgtctgaggagttgttggttccaagtcgattctgaaaggcatcangaagtgtttctgattggcacttttgtgaat

SEQ ID NO: 88003 - DNA, 443 bp, Heterodera glycines
  SCN-specific regions: Sequence locations=1-160,182-194,243-243,270 -326,349-376,399-443
ctccctattttccccgtcattttggtgttgaaaatgtcttcagaaattccgtatgtttattatttccattttcctattgtttttcatttcttttgctcgactttaaccaattttagagaaaaaacaaattttgaaagtttagcttttttgaagcttaaacatcaattttgggttccctcactttgatgctgcttttcccttcccttcccttcccttccattcccttcccttccattccattcattcattcattcattcattcattcatttctcttattcattttcagttggtctgccgtgtttcttctattggtcgattgtgccaccattcttttttggttctttttggacaatgcaaaaaaacgacgacgcccacacaaaaaagaaatctttatctgcggcgattgttggcttttggtgttcgattttcttgcgccttctca

SEQ ID NO: 88004 - DNA, 720 bp, Heterodera glycines
  SCN-specific regions: Sequence locations=1-2,24-720
caagaaattgtcctttaaggccacctaatctgtctgtctgtaatatttgtttgcttcgccaccgtcgaatttatgcaacttttggcaaccgatgattattattttattaaatctgttaaaacaattctgaaatgctgcaggaccacagcgaacatttcagtttttcgccattgtgaccttgccgcacttgaagattttgagctattgggagatgtttttgcatttatcgggaaaatcactgtcgatgacatttcttatcttcttctcgtctccgaatgttcggagatagccgaaattgaaacggtgaatgcaacattaacacgagttgagagagtatgcgcattacctgtgttaactgatggtatgatccataagaaattgttcgacattccgtcacttgacggttttgaacgtctgaaaaatcgtccgaggaatttgcttaagcttatgtcacacaaagtgccgatcaaaaacctgccaacttcgcctaaactcatcgacgaaattatcgcctttttcaaccagccaaaaagtttctatttttcgcataatttcgacataactaaaacattgcaacagagtggctgtcttggttcttccacttctgacaatcgctttttttggaacaaaaatttgctgaaggaaatgttcgtcaacgacggttcgccaattcctgcattcaaagaatgggatactccgctcatttaccgattcatcgag

SEQ ID NO: 88005 - DNA, 455 bp, Heterodera glycines
  SCN-specific regions: Sequence locations=1-455
gcattgccatgattatcgggcggggcgtaaacaagcggacgaaccaatgttaaaggtggaaatggctgctggtggtgatcatcccatgttaccacattggtcactggatccactcaccttgttctgagccatatgaaatggggggtggtacaaccgaaaaagtgtcggcacgcctgcacaaactgcctgaggaaaagccggtactggaattacagcgtccgatgccgagaggacccgacccacatctttattagggccgtggatggatctaactgatgaacagagaatggatcgataattgtcaaattgtataatatggtcttttatgccttagttgttcaactgaacaaatgttccacaggtctgtatgctccctgcagtgatcgaatctttgcagaaagatcgaacggcctcatatttggacagattggaattgcgaaaaaggactgctctgt

SEQ ID NO: 88006 - DNA, 720 bp, Heterodera glycines
  SCN-specific regions: Sequence locations=1-114,136-345,367-441,464 -673,695-720
gaatcgttttattacggcggcaattttaatgaagagaatgtcatccatgttcaaaaaggaaaatgatcagaagaacattttggaaaaaatcagtgaattggagaagcagacacagaaaaaggggtttttaaaattccaagaaaattgttgggattccttcgcttgtacaaggacatcgaaatcagtggagacaaaagtctcattgtccagcataagggaaatgattggccctccgtcttcgctaaatatccgattgtgctgaataagcatttgtctgactttttttactacgaaattccagttatgaaaaaagacgaaaggcattatgggctcgcttttggattcgctgttaaacagcagacaaaattggatgtagacattcgatataaaaagggcacttatgcctatgaaagcgatggctatttatgtattaacggaggaggaaagggaccaaatgccgaatatttatacggtgctggtgataccgtaggaattggcgtcaattcggccactcgacagatcattttcaccaaaaatgggcttcgtttggatacttctgattttttcgttgatccatcttttgctgatgattctctttatccattcgtttctttgcttgactctggtgacaaaattgaggcgaattttgggcccaatttcaaattcgatttggcgactctctgaaggaagaattaattattcactaatgttttcgatcaa

SEQ ID NO: 88007 - DNA, 644 bp, Heterodera glycines
  misc_feature (626)..(637): n is a, c, g, or t
  misc_feature (641)..(644): n is a, c, g, or t
  SCN-specific regions: Sequence locations=1-644
ctgctgtatacaaatgtctttccgtctgctgggcattctctgcgttcttctcttcgtggcgcaactcacaaacggcgatgcagcttggaacgatgccaatgatgtgaaccccttcaaaggtcatcaggaacgcgctctggcattcaacgagaaactcaagcatgcggaagagaacacacccgaaaatgtcagccctacgccgacgccgtccatcaacgctacggagacgcctgatacgaacgcgacgatgactacctccgaggtgactggcacgtcgaccgaaggcccaactatcaagacgaccgcaaagcctgctccgccctcgaccagcagcttccaaatgacgatcctcaatatcgtcttaacgggacttatcgccgtgattcttcttgtcgacatcgtcctggctgtggtcaagtgtaagaagtaggaagaactgaaggaagaaggaaggaagagccgacctaccgctggtgtaaacaattgctcgataccaaataatctgtgtggcctgttcatcgtgatcttttatatccatgtgtcttgtttggagaccgtattctccctattctgttgtctaattgtatgtatatatacctataaacgatgtgcgcggaaaaaaaaannnnnnnnnnnnaaannnn

SEQ ID NO: 88008 - DNA, 505 bp, Heterodera glycines
  SCN-specific regions: Sequence locations=1-333,357-478
cattcgctgaatttgttgtgcacttttgggtaaaatgcattttgcagaataagtttgaaacggcgcgcaattttctcgaacttggcgtcaaaagggtgacgctgctgcccgaaaccgagccgaccattttgctgtccttttactgctgctacgctgaggcgctgttccacaccggcgacatcgaacgtgcgcttgactacgccaagcgggcgcaaaaactgtcgcaagggagtgacattgatgcggctgtgcgggcgtacgtgcgcgacttctcacggcaaatcgaacgcgacacactgcgggcatctgttcggtcaaacaacgaaaggacggcttcttcttcttcttcaacttcactttctgcagagggcgcagaaggcacagaaaagggaatttcgaattggctgtggcccttcaaataatttaaaaaattgttttgcctaattttgcatcgttttttataaacaaatttgttttgaaaaaaaaaaaaaaaaaaaaaaaaaaa

SEQ ID NO: 88009 - DNA, 712 bp, Heterodera glycines
  misc_feature (651)..(651): n is a, c, g, or t
  misc_feature (664)..(664): n is a, c, g, or t
  misc_feature (667)..(668): n is a, c, g, or t
  misc_feature (670)..(670): n is a, c, g, or t
  misc_feature (708)..(708): n is a, c, g, or t
  SCN-specific regions: Sequence locations=1-29,51-567,589-712
tggatgtgatgttctacggtacacacccgtgggtgctgttcatccgtctgcatgcgatcatgtgcgatcgactagcaaagatcaaaaggcgcactgaagagcttgccgaggagtaccacgtggagttggcgattcgggagaggcaaaagaaattgtttgaggaaaagggcgactcggtagaggcgcagctgatgaacgccgttgacgtgcacttgggactgcgcgacctgaagaaaccgttgcaaaatccggagaatttctaccagatcatgttgcaggaaatgaagaatctgctggatggacaagtcgacgcctccaaattcgaggacacattgagaagcatgttcgacaccagagcatacgttttgttcacaatggacaaacttgtcaacacgttggttcgtcagctgcaaaactttgtcggcgactcggccagcggacaatgtgtcgaacagttcgagaaatatttcgaccagcgagtcaatgggtgcgaaagtgggcaacccgctgctcgtgtggacaaagactacagcgaagcgatggaaaaggtgttgctcaatcagcactgcttcaaaatgttctttttcaatcgcgaccatccggtggtgaccatcgaactgattgacacggacgagacggagagtgaggagnagggaagaggaanaannanagtgccaatgtggtggcactgcacaattggaagcattntctc

SEQ ID NO: 88010 - DNA, 507 bp, Heterodera glycines
  SCN-specific regions: Sequence locations=1-111,133-481
ggaaaatttgacggcggagcccaatcgattcagtgcgatcaatcaaaaataactaaaacgtggcgaatttatttgacctcggcattttaaattaacaaatttttatgaaatttcattttttcaaaatctaaattggccaatttgaaaaaagtgtgcggaaattgtcagactgaaccgaccgcggccgcttcatgtggcattttatttctaaggcatccgtgatgtgttccgcgaaatgttgcgcgaggaggggcaccgtgcgctgttccgcggcttcgtgcccgtcatgttgtgcgcattccacgccaacgcggcctgcttctccgggcttgagctggcgctgtgggcatttcgccaagcgggcatttgaaaaaaccatttttgctttaattcaaattcagtgctaatttaatcttattgtatttactgtattatgtcgaaaaattaaaaatcttttgctcataaatctcttatgtttcataaaaaaaaaaaaaaaaaaaaaaaaaa

SEQ ID NO: 88011 - DNA, 806 bp, Heterodera glycines
  misc_feature (702)..(702): n is a, c, g, or t
  misc_feature (724)..(724): n is a, c, g, or t
  SCN-specific regions: Sequence locations=1-14,42-535,557-735,757-806
ttttttgaaaaggcaaaaaaaattaataaaaaaattatttacataagcaattcctttttcgtagcttacaatgttggctttctccttatttcctaactttttgcttctccttttggcaatttgccatgtccacggaatgttcggaagggaaagagaacgaaaatcggaggaaaagcgcacaaacagcagaagcagtagcagagaaaatcgtgagccagacaatggcatcctttccatcgaagttgtgccgagtttggctggcaaccctttacacggctatcgcttcgtcgttcggtgcggcactctcaaatttcgcgagtattcgcgagcggagtctgaagaattgcgatggatttacccaacgaaagagccggaaaaagtcgaaattcaactgaccaaagaacgatgtgtgaatatggccgtgttcatttttatgacaacgcgaaatcagacggacacaaatctttggaataaacaattccaagcgaacaccagctcacgccatttgtccgtcgatttcgtccattactcaaaattgacagtgtcccccaatttgggccaagtggtcagacagtcgtactatgtccaagtgcgctgcgcaaacactacaaagggacccggatgtgcttttccacaccgaattcaaatcggagactggtggttgtgctgctggagaacccgaattgtgtgggtgttcaccgncaaactgtggggtggtgtgggncaaaccaaaagctaaaggaaaacaaacccaaatttgtactgaaaaacatcggcattactcaatcgctcccgtgccacggatt

SEQ ID NO: 88012 - DNA, 778 bp, Heterodera glycines
  SCN-specific regions: Sequence locations=1-77,99-110,132-190,213 -453,477-778
aggcattggaaactgatcagacgaagcaaagcaaagagactaatgatcaaaggaccaaaacgatcgatcagaccaagccaaaggaagagattaatgttcaaaagaagccagaaattactgatcaaagcaacggcctggacaaaccaaaagaagcattgactgatcagagcaacaaaaaagagcatgacatcaacaaagaacaaattaatgctgagaagatgctaaaggacgtgatagctgatcatggaaagctaaaggcattggaaactgatcagatgaaaaaaaacgaagagatcgatggtcaaaagaccaaaatgatcggtcagacaaagccaaaggaagggattaatgatcaagaaaaaccgaaggcgaattcaactgattttatgaagccaaaggaagagactaatgatcaggaagagccaaaaacgatcggaactgatcagataaagccaaaggaagatgctgccaatacttcggtgaagtctaaagcagtgattattgatctgggcgatcccaaagagaataatgtcaacgatcggaagaagacaactacggatgataaagcgccaaaagtgatgccattcgcccaaactgagaaatcattgcacaaaatcaatgaccaaattgatcagcggatcaagccgagagaagaaaaccgggaccacattaagcaaagccgtgccaacactgagcatccattgcccggccaacggatcaagcccacaaaattcaaaaagccattcgatccgttatcaacagtggccgacactttgga

SEQ ID NO: 88013 - DNA, 753 bp, Heterodera glycines
  SCN-specific regions: Sequence locations=1-753
gtggaaaatttttcggataaattatatataaaaggcacaaaaaattcatttggttgccatttttccattatttaattaccggcaattcatcttcatcaatcatcccttctctgtgtacaacgaaaacgacgacaattgagcaatgtcggaccatccagatgctgcgctggccgacctcagctgcgtggcaaacgacgtttggctggacactctgttttggattgaccgcgctgaagttggcacgaagtttgcactgatcgacgcgcgcttcggcaggctggtagccacgcatttcaaactgcgcaaatggaagctgggcgagctgggcattcatcgggcaccaagcggatgggaccggggcggcacggcggctgtcaccgttatggacgaccacccgttgatgaatcgactgccgcttgccaagtgtcctgcaccgaacggcgtgattggcttccgtgccatctacatttggtacgtcgacctggaagtgatcacatttctgcagtgcctgcaacgcgttctcaacctcggcactgctttgcagttcaccatccattcgaaggatgtccgctgctgggcgctgatgtcccaacgcatttggccactgatcgcgcacgccgtcaccacgctgcacgacatgaaggacgtcgacttcgcgctgttgcgtcgccatgtgtcgccgaatgtgctgttcgactgtgtcaagcttcgtgtcatcaccaacacgcacatgttcccggtccaaccgccctt

SEQ ID NO: 88014 - DNA, 483 bp, Heterodera glycines
  SCN-specific regions: Sequence locations=1-483
gccattatgaaatgcactggagaaaaggccttaggctgtgtcattgcgcctgaattggccaaagacaccaacaatgatggacaaaagttgctgaaaaccgtgagaaggcaatggctgatctttccaaatgcaccgaatgatccgattgatctccttgccaatgcgaatccctattcacgactctttgctgactcggctaaaaagcgagatgagcccaagtctcggcataacctaacattcaactcaactgcggatgatccaattgcaacagaaaaggatgctgatcaaacatctaattgggccggtgcccatgacactgcttttctgtctggcactttgtcctccaatcagcgaattgagtgcggcactcaacaaatccgttatgaaaaaggtgttcgcactgctctgtacttttctcgtggtaaaagcaatgccttcgtcacccatgctatctgtgccaaggaaaattcgttgagtactcat

SEQ ID NO: 88015 - DNA, 200 bp, Heterodera glycines
  misc_feature (57)..(58): n is a, c, g, or t
  SCN-specific regions: Sequence locations=1-26,48-200
cctcttctgtagtcctaagaattccctcccctttttctccatttcttaaatgatgtnnccaacgcaaccaaaaacattctcggcactccacaatcgtcgacaatgttagtttcgaccccaaagtgagcgccaatttccttcacaaagccatcgaagagaagcgaaaggatgagattatccatttgctgtgcaccattttc

SEQ ID NO: 88016 - DNA, 282 bp, Heterodera glycines
  SCN-specific regions: Sequence locations=1-282
ccaaattttttttttaatgcatatattaacaactcaatttggctcaaatttctcatcaccgcatttctgttcaaaattgcttgctctaaatttggttcaagtgaaaataaaggcctctttttttattttggttatggtagcaacttgcttgaagaacgtatccatgtacaggtaaaaggtgctacttttgtggcaattggagcgctgaagggttacaggctggcatttgttgatttcgaagaaccgaatcgttggcacagtgcagccgcaacaattgagcag

SEQ ID NO: 88017 - DNA, 680 bp, Heterodera glycines
  SCN-specific regions: Sequence locations=1-680
aaatttctcccgaggaaagcacttcggctttttctgcggtgatttattcgtacgcaaccaaaatgttcttcaaagggctccacggagacgtttcttttgacgacctttgggaattgcataaggaaagacaagcggaagtgttaatggagcgatactatcgagcggacaaatcgaaaggcgaagggccgatcactttctgtgcatttgtgtggcgattggtcaaatgtacttgggagtggcaaatttgctccattttgctgtccgttctcgttgtcttttgtctttacgcaaacgccgtatttctcagagtgatcgtcacattcgttgacctcggcttccctttgtggctgtccatggccgctctttgtgtgctcttttttgtggattttactggcaaggtgatgctcgcgcgtcgcgacttcgattctttcattgctttgctcagtttgcgttccatcatttcttgtgcaattcttgacaagctgttcaaattgtcctcctccgctcgtcagtctttttccaccggcgaagtcgtcaatttcttgtccacggatttgtttcgcatttcttacttttggctcacaattcgcagctttgtctattgccctttcatgattggctttgcaagtttcggactttggatggagttgggggatgagttctgtggttcggtttcgccg

SEQ ID NO: 88018 - DNA, 375 bp, Heterodera glycines
  misc_feature (353)..(353): n is a, c, g, or t
  SCN-specific regions: Sequence locations=1-3,344-353
ggagagaaggaggaaaagaagtagaaagcaggaagcagagaaaaaggagaatgaggagcaaaagcctgctggtaagaaggagaagcgcgccgcagagaaagaggaaaagaagtcagaaagcaaggaagcagagaaaaaggagaatgaggagcaaaagcctgctggcaagaaggagaaacgcgccgcagagaaagaggaaaagaagacggaaagcaaggaagcagagaaaaaggagaatgaggagcaaaagcctgctggtaagaaggagaagcgcgccgcagagaaggaggaaaagaagtcagaaagaaaggaagcagagaaaaaggagaatgaggagcaaaagcctgctggcnaaaaaaaaaaaaaaaaaaaaaa

SEQ ID NO: 88019 - DNA, 835 bp, Heterodera glycines
  misc_feature (14)..(14): n is a, c, g, or t
  misc_feature (136)..(136): n is a, c, g, or t
  misc_feature (152)..(152): n is a, c, g, or t
  misc_feature (182)..(182): n is a, c, g, or t
  misc_feature (239)..(240): n is a, c, g, or t
  misc_feature (302)..(303): n is a, c, g, or t
  misc_feature (338)..(338): n is a, c, g, or t
  SCN-specific regions: Sequence locations=1-448,470-577,601-658,680 -767,824-835
attctgcgcacaanatgtctgcagaaccaaccattattacctcttctcgctggccatctccgacctgcttctgcttgtgcttggccttccatggaattacacggcgttttcggtgccgtttacccatataaatttngcgaattcatctgcanaggtcgcgcatttctaatcgaattcacaangtatgccctccattttgaccactcacttgcttttcagtggaagcgatggctcgcaannttgtttcccgttgcgcataaaaaatttctcaacttttggaccgggccgtccaaaacaatcgnnccccgtttgcttttttggcttttttgggccggtcngccgcgtcctttaatttgttgggggacacaatatgcttgttcccaaggggccacttataaaccttttggttgcccttctgttcttcaaccggcacactttttatgcggcccccaaaattgcccaagggggtttttatgaaaccatttgcacaaagggaaaatttatttttttgggccttcccaattttttttttctcccccccccccctttaaaaacccttggttttttttcaacaaggttccccacagggggggcccccgggagaacacccttttttttgaggcgcaggtgtgggaaaaaaaaaaaaaaacctccccgcaaaaaagaatgtcaaaaaaaatcttttctcccggggggggggagattttttttcttcctggtggggggggttttcttaccaccaccgggggtgttgcggggttttttataaaaaaaaaaaacccggaaagaaaaaacccggaggaaaggaaaaaaaaaaaaaaaacccccccccccc

SEQ ID NO: 88020 - DNA, 590 bp, Heterodera glycines
  SCN-specific regions: Sequence locations=1-338,361-457,480-590
gattcattcaccttcctttctaatacaaatactttctcctctttgatacgctgattccttccaatgccttctgagtacggcattgaaaccgactcagtgactcttcagcgttttgtgctaaacgaacagaagaaattcccggatgcaaccggcgacctgaccactcttctgaccagtctgttgaccgctgtcaaagcgatctcttcggctgtccgcaaggcgggattggcacaattgtacggagttgcgggaaatgtaaatgtgcaaggggaagacgtgaagaaattggatgtgctgagcaacgaactgatgattaacatgttgaagtcgtcatacaccgtttccactttggtttctgaagagaacggacaggtcattgaggtggaagtgagcggcacccaaggcaaatacatcgtcacgttcgacccgctgggcgggtcatcgaacgtcgactgttttgtgtccatcggaaccatcttcggcatcttcagaaaggcgagcaacacttccaccaaggaggaggacactctgcagacaggacggaaaatggtagctgcggggtacgcattgtacgggtcggccactatggt

SEQ ID NO: 88021 - DNA, 126 bp, Heterodera glycines
  SCN-specific regions: Sequence locations=1-60,82-126
gccttctccgcatttgttaagccgccggtctcctctacaaataacacacaaccatcatgtcggaaaagaaagtcaaaaaggtgaagaaaaagtccaggaccgggtccgaggcgagctacttcgacc

SEQ ID NO: 88022 - DNA, 414 bp, Heterodera glycines
  SCN-specific regions: Sequence locations=1-177,199-414
aaattgcgcgctgcacattgtgccaaggactgccattgaggtattgtgcagcacccacgcattttactatggacgaatctatatgaccgggactaacacaaacagaacacattgccacgaatgtatccccacttgggccggaatttacaagcgcatccgattgacaacaaagcgaggcacgtttccagctgtttgtccgtggcttcaaacataccaaatattggttcgaccaatggtaacagtctccggaaaagacattgccaaagcccacccaagtagaattgcaactcccatctgagaaaatggtcattctggattacattatacggaataccgaccgatgaaatgacaattggatgatttgttacacaccacccacagcggaagcacaatctccagagtgggcccggacat

SEQ ID NO: 88023 - DNA, 666 bp, Heterodera glycines
  SCN-specific regions: Sequence locations=1-550,572-666
ccgttgtccgctactttgttttgtgttgtgctgccagcgccgaccattcgtctcagcccttcccatcatttcaaattccattattcccgtgattgtccaaatgatcggcggaatcctggaagatatctggacgagatttatcgacttggtggaggacatctctgatcagtacgacgattctgagcaaccaacaatcatccaccacgaaccggcaacaccaacaacaatgtttgacaactatggtccgattgagaagattgttgtggtcggcaccggcctcatgggcagtggcattgcgcaaattgcggttgagtcgggcgtcaaagtgtgcctggtgggccgtagtcaagaaaagtgtgatcagacccggctgaagatcaacacgggagtgcaaaagtcgatcaagaagcgcatggcaaatgaaactgccgaggcacaacagcagttggtcgaggcgacaatggaaagccttgagctggtggccaacttggatgaagcgggcttgtcagatgccgacattgtcattgagggcggtggttgaaaatctgaaggtgaagcagaagctgttcacggaattggaagccaaggtcagcgagaagtgtctattggtcaccaacacttcgtcctttctgctcgaggacgtgtcctgcaaaatgggcgccgcca

SEQ ID NO: 88024 - DNA, 371 bp, Heterodera glycines
  misc_feature (322)..(322): n is a, c, g, or t
  misc_feature (367)..(367): n is a, c, g, or t
  SCN-specific regions: Sequence locations=1-371
ggtggcgttcttgcgcatgcaacccttcctcagatggcaaactccattttgatgatgacgagaactgggttttcatggacggaagaaaaattggaaaccatcgctttacggatttgtattgggtagcgctgcatgaaattggccatgtgttgggcttgtcccattcgaacattgaaactgctattatggccccattttatcaagacccacgtgatttggtcgattggcgtggcaattacaaaaggccagagctgactcatgatgatgtccgcgcagcgcaacaaatatacggcaaacgatatggtcggttgggcacttccancaactgatcggtctcgtggtaatcctccaactgccgctggtgganggcg

SEQ ID NO: 88025 - DNA, 429 bp, Heterodera glycines
  SCN-specific regions: Sequence locations=1-6,28-234,256-429
ttttcggtggagcaagggaggagtgaaaatcgacccgaagaaatactccgcttatgaaattgagaaaatcactcgcagttttaccatcgagttagcgaaaaaaggatttctcgggccaggtgttgatgttccggcgcctgacatgggaaccggagaacgagaaatggcttggtagcggatttttcatttttgagatttttacaattttaggattgctgatacgtatgctcaaactgtgggacacactgacaaggacgcatcggcttgtgtcacgggaaagcctattgttgctggcggtattcatggacgtgtttcggcaacgggtcgtggactctggaagggcttggctgttttcatcaatgatgaaaagttcatgactaaacttggccttacgactggcttcaagggaaagacattcatcgtccaagg

SEQ ID NO: 88026 - DNA, 741 bp, Heterodera glycines
  SCN-specific regions: Sequence locations=1-346,368-741
tatgaatttgcgaatattacttttctttgctgtatttattccttcagcgaggtctttctatttgccaggtttagcgcctgtgaacttttgtgagggaaaggataaaaagcccacttgcccgaataaagtgactttgttcgtaaacaagcttgacagtgatcaatccgtcatcccatatgaataccacagcttcgacttttgtattggtagtgagcaagagtcgcctgtcgaaaacttgggtcaggttttgttcggtgaacggattaggccaagtccctatgagataaatttcaaagaaaacaaacagtgttcgtacctttgtgagaaggattacaaaagttcggacaaatcacaccaagaaaaattgcggttgcttcagcgtggaatgaagctcaactaccaacaccattggatcattgacaacatgcctgtcactttctgcttcataaatcaacaaaatatgaatgtatgcaccactggcttcccaatgggttgttatgtgacaaaggaggggaagcccaaagatgcctgcgttttggatggacgttaccgacagcaggacagtttttacctgttcaaccacgtagatattaagattgagtacagagacatgtctgatgatccaaatttcctcgatgagaaaattggtggccgtataattcggatcaaagtgcagccaagaagcatcaaacatgaaagcaaagctggaatgaattgcggaatggaagccgctccccagcc

SEQ ID NO: 88027 - DNA, 808 bp, Heterodera glycines
  SCN-specific regions: Sequence locations=1-808
tatttgtatttggcgacggaggaaaaagtctcccattccgtcttggtcagtgcgctttgtacggctccgattgcgtccgttgtgcgcgtgacccgtactgctcgtggtccatcgctcgtcggcagtgtttccccacagattcgtctcattcgggcgccgtcggatggatcgttttgggcactcgtcccacagcgactttcccttcccccgccgacgaagtgaccgaacggtgcgcaaaatatacgaaaactgtggcagtgactgtctttcccggcgattctgtccatttgaaatgtccgagcgaaggacaaatggcacagtggaaacacaacggacggaaaattccatccgatgaagaaatgccacattttgtgcattcgatgagcggcggattggtgctgataaacgcaaccgaaacgatggacggcacttacgaatgcgcgacggaagaaagtgcaaatggaaaagtgccattggccatttactcactgaagtgggacgggcgctgactgcgcccgtcccaaaagtgtggaacagttccgatcggctcaaagggagtggtgccgtcggatggacacttataggagcaatttgtcaaaatgggaaagcattcgcgatgccaatggacaaggcaaagacctttgtgacacaaatgccgaaacggaaaggaggacggactcggggaattttgttgcctaactttggcattttcacacccacaaaatcagaggcttaaattgaccctaagacaaacccaggcaaaacattccatcgtaattctctacttccgattgctcactcatttatt

SEQ ID NO: 88028 - DNA, 259 bp, Heterodera glycines
  SCN-specific regions: Sequence locations=1-38,60-259
ggctgctttctcgtccttcgctttgtcctcccttctccacttttcctcctttccctttcgtcctttgtgttttgtcactttcgcccccattttcctccgttccttcaaaaagcgtcggttgaacaacgtcgtcagtacaacagaatcgtgaccagccaaaacgacaccaaagcacaaatcaacagcaatgtgtataattgggcttcaaatgcgggagttgcgagcgattacaacaatttcacatcggagcagaagcagc

SEQ ID NO: 88029 - DNA, 716 bp, Heterodera glycines
  SCN-specific regions: Sequence locations=1-96,125-716
tcctccttttccgggcaacgacgcagcagtcgaaacaaccgacgcagaagtgggcgcaacggcaccagtcaaacggcacagtgacaacaccattatttatcatcagcaacagcaacagcagcgacgcatgggccaaatcaatctctgcgacgacgtttggttggacacattggcatggatcaatcgtggagaagtcggcatgaagttcgcgctggtcaatgctcggttcaacactttggtggacaggcatttcgagcagaggaagtggtgctttggcgagtttcacatctgtgagcggatgacggaagaatcgggcgcagaaatcatgacatcgatcgacggctccgacttcagcacgttgccattgcccaccactccgctgccggacagtgtcgtcggcttccaatcaatctccatttggtacatcaacgaagaggtcatcaattttctgtgcacaattcgccgtctcctcgccgaagacattgcgctggaattttccacttacttcacagaatatcgcagttggaaagtgatggcacgacacatttggccgctgttgcgggatgggatcagcactttgttcctgaagaagtgtgacttggccatgctccgtaaacacgtgtcgcccaccgtgctgttcgactgtgccggcctgcaccgaatccacacgcaaatgctgcccgagtgtccgtctgctgacggtgctgtcgatggag

SEQ ID NO: 88030 - DNA, 605 bp, Heterodera glycines
  misc_feature (603)..(603): n is a, c, g, or t
  SCN-specific regions: Sequence locations=1-15,37-170,192-286,309 -468,491-506,535-605
taaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaaccccttaaaaaaaaaaanaa

SEQ ID NO: 88031 - DNA, 605 bp, Heterodera glycines
  misc_feature (603)..(603): n is a, c, g, or t
  SCN-specific regions: Sequence locations=1-168,190-284,307-466,489 -504,533-605
taaaagatccgaaaaaatgccaacattttaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaaccccttaaaaaaaaaaaaanaa

SEQ ID NO: 88032 - DNA, 815 bp, Heterodera glycines
  misc_feature (657)..(657): n is a, c, g, or t
  misc_feature (731)..(731): n is a, c, g, or t
  SCN-specific regions: Sequence locations=1-815
tcgcctaaaattccgtttctgaccttcggcgatttggcggaacaatcgtgcaaagtcagttttggatggatcaaaaactatggaccattggcaaagaacattgtcaacataatcacaatcgtccaccaattcggcatctgcagcatgtactatctgtcattgcatcaacctttcaaacggtctttgataaagaaaaagctgacaatgagcccaagggaaaagacccaacatggtttctcgtcatattgcttccgattgtcgctctcaattccattgtgtccatgcgtatcctctcaattatgtgccttctcggaaatgtgttgatgatcaccagtttgacactcattctctttatgctgtcccaaattgtattcacggaaagagctcattccattccgtttgccctgccatccgcagaaggctttttcaaagcgtgtggtaccatcattgtctcttgcctcgcccagtcattggtgcttcctatggagaacaaaatcaaaaaacccagtcaaatgttgggcccttttggcgttttatccattggtatcgctatttcgactatcgtttacgcaattgtcggttttctcggctatagtgcttatggagagagccttcgtgatagtgtcttgaaccatcttgaatgtgttagtaacgcanaagagttgactgttttgacttatatcattcggattgccctctgtctgtccatcttcgcttcttttatgctccanatgtttgttatcgtcgggcgtttgtggcctctactcgaaaacggatcgaaaactttctcgtatttggaaaattggcattcattc

SEQ ID NO: 88033 - DNA, 457 bp, Heterodera glycines
  misc_feature (426)..(426): n is a, c, g, or t
  SCN-specific regions: Sequence locations=1-401,425-431
agttcccgccgtttacgccaaaacgcctccccaaatcctgtgaacgcttctgttgcgcctcccccgccaaaccccgagaactcttctgtgcctgtaccgccaaaactgcagaatggcattgacattgtcttttccgatatggaaattccccttggagtgcctccttctgctgggagtggaagaagcactaagcccggcattggccatcactttgtgatggtttttgttgccgtggctttggtctgcacggcaattcgccatggcattttgctttaagcggagaaatgaaaatgatggaagagcaaaagaatgaaaacggaaatgcgataaagaaaatgatccaaaaataagcattccatttataataaccatttaaatatcttttccaaataatagcaatgattttttatttattaaatttaaagntaattaaaaaaaaaaaaaaaaaaaaaaaaaa

SEQ ID NO: 88034 - DNA, 440 bp, Heterodera glycines
  SCN-specific regions: Sequence locations=1-232,257-440
agactctatttttatgacacttaaaatttctactgacgcattcctactcacgcctttccccggagccgattgattccctattgattatacgcacagattgaaaatgttaatgctccgatgattggatgataaggattaaaatatcagaactggcatttccctgatggtaagaccattcttattggccctgattcgatctcaatgccacttattctgcaggcgacaatgctcaaagcaaaggaccatccacttgaaacatgactgcagatcatgcgtgcactaacggcgcgcaaagtccaagaagagcaaatgcctgctttgtggcaactcatagatgcaccaagattatcaaccaccatgatcagctccgtccatcggacaatcaaactttgactcgggtcacttgagaagattcaaagattctcccaacttttttggca

SEQ ID NO: 88035 - DNA, 820 bp, Heterodera glycines
  misc_feature (545)..(545): n is a, c, g, or t
  SCN-specific regions: Sequence locations=1-820
ccgtttctttatttagaaaatgctaaatgaactttgtaagcgaagaagagttgcaaaagcagcgtgaagctggcgaagaaaagcctgagagttcagagccggtggacaaacgaacactttacgaacggttgaaagagcaaaaggacatcaagcaattggaatacgatgaaacgcacgcattgaagaaccaattccgtggcattgacgaggccgagtcggactttcttacacaagtggagcgggccaaggaggagcaggaggcacgcaagcgcaaggaggagcaggaactggtgcgattgagccgacaattgacgcaacaacacgcgaccggtgccacgactgacaagcaacaacacgcactgttggagaagccacaaaaagcgaccgccgccgcttcgtcagggatcagcagacaggcggcactgatcacatcgctcgtccgccgcaaaagaccgctttcaactgattctgaaccaaaatcggcgcgtggcgaagtgccatcgccgccctcgtcgtctgacagtgacaagcgcaagaccaatganaccgtcgaaggcttcagggcggtccgccaccaaaacaacggcacgaatcgcattgccaaatcattggagtgcttcccggcttaccgaactactccgattcgagtgacgaggccgagagtagcagcaacagcgagagtttggagtcgggattgccatgtgtggcaatttacgcgggtaaaggcgcaccaaagccgcacggagagtgttgaaatggatacgaacgaacgtgatgaggacatgctttttatgacgtatttttgcgaaatccgctcata

SEQ ID NO: 88036 - DNA, 364 bp, Heterodera glycines
  misc_feature (340)..(341): n is a, c, g, or t
  SCN-specific regions: Sequence locations=1-341
tgccgtcgatttcctcccaataaaaagcatcaaattctcgaagaagaaatgaagccatcattcaacttcaaacttttcgcatccgtctttcttgtgctttgtgtggcctcacttgtcctctgtcagcataagccagcagcagcatgtaaaccgcccaaaaacgtgggaagaggcaacttggcactcacgcgatggtggtgggacggccgtagttgtaagcaattcatctacaaagggcagggcggcaacacaaacaatttcccatcaaagaagctttgtgatcaagtgtgcaagccatgaatgagtcgtggaaagaaggtgcagcgtgaagagaccagcnnaaaaaaaaaaaaaaaaaaaaaaa

SEQ ID NO: 88037 - DNA, 772 bp, Heterodera glycines
  SCN-specific regions: Sequence locations=1-6,29-772
cattgcgtccgttacattttaaattcttctatatgcggacgatcgtctacttcaaactgttgcaaattgtgctcggtttggccttcgtgtggcaacttctttcatttcaccaattctgcggcacatttgtctgtccaaaggccttcctccatgacatctctgttggccactgcaaacgctttacgctgatcggaaaggactcaaagacgggcgaattcggcgctgtgttggacgagcgcaaatggcacaaccaactgttcatgagcagcaccaacggtctcccaatcaaagaacagcagcagcaattcatggacgaattggccgccaaattgccgtgccctggacgccactgtattccgattacgacgccttcgttttttttctggactgagaagaacagaaatctcttcgacaatgttatggactccttttccggccaactgttgctcgcattgtgctcgcttctcaccattggcattggcttcgcccggatgttacgccctgcggcagaatatgaatgcttcgactattgcatggccctctattctgtcttttgctggtgttgctctgcttgggcctcatcgtatttgctgctctattggacaccttattggtcttgcatgaacttccgtgcggatgacacaaatgtgccgttggtcacttttgtgttcgacatcgtcatggtgtgttcgttcgtcttcgagatgttcttcaacaattcgctggtgaaaaaacggcccgagatgcttcagtcgctgccgctaatcgcaaa

SEQ ID NO: 88038 - DNA, 648 bp, Heterodera glycines
  SCN-specific regions: Sequence locations=22-648
tttttaaattcttctattatgcggacgatcgtctacttcaaactgttgcaaattgtgctcggtttggccttcgtgtggcaacttctttcatttcaccaattctgcggcacatttgtctgtccaaggccttcctccatgacatctctgttggccactgcaaacgctttacgctgatcggaaaggactcaaagacgggcgaattcggcgctgtgttggacgagcgcaaatggcacaaccaactgttcatgagcagcaccaacggtctcccaatcaaagaacagcagcagcgattcatggacgaattggccgccaaattgccgtgccctggacgccactgtattccgattacgacgccttcgttttttttctggactgagaagaacagaaatctcttcgacaatgttatggactccttttccggccaactgttgctcgcattgtgctcgcttctcaccattggcattggcttcgcccggatgttacgccctgcggcagaatatgaatgcttcgactattgcatggccctctattctgtcttttgctggtgttgctctgcttgggcctcatcgtatttgctgctctattggacaccttattggtcttgcatgaacttccgtgcggatgacacaaatgtgccgttggtcactt

SEQ ID NO: 88039 - DNA, 823 bp, Heterodera glycines
  misc_feature (542)..(542): n is a, c, g, or t
  misc_feature (660)..(660): n is a, c, g, or t
  misc_feature (713)..(713): n is a, c, g, or t
  misc_feature (726)..(726): n is a, c, g, or t
  SCN-specific regions: Sequence locations=1-459,481-507,529-823
cccttttctctttgcctttagtctttttatttcggcgttcttttttgtgtattcagctgatgaatcgattaaaccaccgacaagaaatgttctaatcacagcggaagaagagaaacaaagagatgttgaaggtttcttggcaatcaaagccatccatgccgttctcgacgatgacaattcgggctcaattgatcggtttgaatctgccgatttcttgaaagaagatctcaaatttggcggttcggacaaaataaggcgagaaaatgcatttcacagtaacgacgaggcgataactgtggacgatttgtgggagaattggttccaatccgaggaacgcggatggaccaacaaacaagtggtcgaatggttgaccaaccaagtcaaactgccgcaatatgccaacggttttttgagtgccgaagtgactggcctggaccttccgaaaatggcagtgcaaaattcttcgtttctttccacaaaaattggcataaagaattacgtgcatcgtcagaaacttcagctaaaggctctcgacttggttntgtttggcttccaagacacttcttcgattgccaaagacattgccttggccggtctgctgggactgctcgttgccgttttggtcatcttcaaaaacacaaaaaccgttccaagaaacanatggaggaactgtcgacagtgctgaacaaattgcgcgacatggaaacggattntgcgggagttcanaacagacttgaggatgagaacttaaacgacagccagcagcgaagaatcgaaacatcgattggtgagaaccaattgcgagaattggaaacgacgacgg

SEQ ID NO: 88040 - DNA, 685 bp, Heterodera glycines
  misc_feature (552)..(552): n is a, c, g, or t
  SCN-specific regions: Sequence locations=1-50,84-87,130-141,164 -303,433-658,680-685
caccttttaaatacttaaaatgcgcgccattctcttcctggcctggtttgcttggtgatggctgttattcttgagacagccaactcaaaggcagtgaaaaaagacaataagaaaggagcagttgcaacgccagcaaaaggaaaagcggcgccgaaaggagcagcgaaaggaggaattaaaaaagacgcaaaatcaaagggaaaaggaaaaaaggacgccaaaggcaaaaaggacaaaaaagctaaaccagccaaagggaaagcatcgcctaaaaatgacaaaaaatccccagcggcaaaagccaatgacaaaaagagcccaaccaaaccaatggcagcagtgaaagccgtgccaaaggcggcggagaatgctcagaagggaccgtcgagtgcggaagtggtggcggaggaaaacaacttggacactgaggcggtcgacgacttgggggcggaagagtcggactttgaccaattggcagaggacgaactgctcgaggacgacgccatgggcggcgaggcggacggatgggaaggattgggggaggagacgganatggacagccaaatggcactctgatggccaactaattggacaaattacaaacggaacaaaacgggacaaatgacacaaaatattatttatcatttttggcatatcattgaaaataaatagaatttattttaca

SEQ ID NO: 88041 - DNA, 617 bp, Heterodera glycines
  SCN-specific regions: Sequence locations=1-33,58-617
cattgtccttttgcgacggattagggaaccgacgaagaaaatcttggaattttacacaagtctgaaattgatgtgtcggtgctccccggcggttatttaaccaaagttcgcattgcctgctgcattttgcgctttctgaccgatgaacaggtgaggacaatgttcaacattagcatagaccaattttacggaaatttcgtcactatgctcaaccagcggctttactcattgtgccgcatcgattcgtcgccgaaggatctgaaggaggccgaaagggtggactttgtgcgaaccattctctcgccccaatcaattttccgccaaactcctgaaatcgcccgtcttttggtttgtctgatcgtcgacaatgacattgatggcctgacaacacttggcaaagctgcccaacgtctcgtccaacttcgtctgtccgtccctctcttggaattgctgaaatatttgcgcaacatcaagggaaaggacatcagaaccatcccaaacatttcggcattttttgctaagacctttgaggcactctttgacaagatcgatgcaccagcaactgatcggaaggaacttgcttcgctcgttttcttcttgatcagctgccccgttga

SEQ ID NO: 88042 - DNA, 780 bp, Heterodera glycines
  SCN-specific regions: Sequence locations=1-485,510-780
ggcaccggcgtctttcctcggcactttgtacctgcgcccttcgaacgatacgatcacgaaatcacccaacattcactgcgtctctatgccgatgaggagggtcatttggcccaaagagcgtacattgctcggcagttggagttccccgagctcagactcatcgaatacgattgtggtaaactccaaatgttggcccgtcttctcgagagtcttttctccaataagcaccgctgtctgattttcacacaaatgtctcgcatgttggacattctgcaggcctttctgtcctaccacaactacaaatactttcggttggacggctccactcacatcgatcagcgacaggcgatgatggagcggttcaattcggacagttcggtgttctgcttcattttgtcgactcggtcggggggcgttggcgtcaaccttaccggggcggacaccgtcattttctacgactcggattggaacccgacaatggacgcacaagcacaggacagatgtcacagaattggacaaactcgaaatgtcaccatttatcggctcatcagtgaaaagacaatagaggaaaatattctgacgaaatccatgcaaaagcgacggcttgggggagatggccattgaccagggcgaattcacgcccgacttcttcaaaaacaccggcaatctgcgggatttgttcagcaacgagacagccgttgccaaaataattgcgcccgttgtggacgaaccgaagacatcaaagacgtcgaagcggcaatgaatcgggtcgaggaccac

SEQ ID NO: 88043 - DNA, 130 bp, Heterodera glycines
  SCN-specific regions: Sequence locations=1-130
ttcgaacgcgcaattcggcaacccgcgggcggcgtcaaatggatgcgctttgggaaaaggacgccccagggcaaatggatgcgattcggaaagcggaaaatggcaatcgataggggcaagtgggtacggt

SEQ ID NO: 88044 - DNA, 733 bp, Heterodera glycines
  SCN-specific regions: Sequence locations=1-287,310-733
catccgcaaattgattctcaccatatgccccatgcttatgtgctttcgctgcagttgggctcctcagttgccgaggacattggccgcggctatttcgccaatatgaacgacgaagtggcggccgtgtgccaacagttggccgaggacgcgcgacttgcgaacggttacaatgccatcggattttcacaaggcgcactttttgttcgtgcgctcgcccaacggtgtccgcacccgcccattcgaaatttgatttccatcggagggcctcagcagggcatttttgggctccccttttgccccggttccttttacgtttgctcgctcatccgtcgtttgcttgacaatggcgcgtacaccgaatttgcacaacacaacctcgtccaagcgcaatattggcatgacccaaatttggccgagggctatcgccgcgcgaacattttcctggccgacgtgaactgtgaacggagctgcgacagcacgtatcgcgacaacatgggcaaactgcgcaactttgtgctggtcggtttcagcaatgaccacaaattggtgccgaaggaaacggcgtgggttcggtttctacgccgacaacgacacacaaacgatagtgccaatggagcagactgaactttacaagcaggatcgcattggactgaaaacactgaacgagtcgaaccgtctccattttctgactttcaacggcgaacatctccaaatacccaccgatctgttcatc

SEQ ID NO: 88045 - DNA, 801 bp, Heterodera glycines
  misc_feature (767)..(767): n is a, c, g, or t
  SCN-specific regions: Sequence locations=1-247,269-801
cagtgaaaattttttcggccgaagcgaaggaacttcaatcgtacaaaaacaaaatcatggagatttgggaaatttccagaaggaaggcacgaccaagggccttatgtttggcggtttccaactaccggttacctcgcgctcacttcaatgctttactatggcagtgtgctgattgccgacggctgtttgacctacggcgatctctcttcctttatgctttattcggctttatgttttggcggcattactaatttccagctgttttatacggagttaatgcgcggtttgggcgcttcggcgcgtattttcgaacttcgcgaccaaaaaccatcgatttccagtgaaggtggccttgtgattaatgctctgaataaggaagtccgattcgaatccgtcgctttttcttatttgaaccgagaatccatcttcagcgacattacatttcgcattcctaaggcatcggttaccgcaattgtgggagcgtctggaagtggaaaatcgaccattgcgcatttactattgaggttgtacagtccgactgcaggtcgaataatggtcgacgacatcgaccttaaacaattggacctttcatcttggcggagaatgatcggaactgtcagccaggagcccattctcttctctacctcaattcgtgacaacattctctacggagttgagaacagccatttgataaccgacgaagagctcacagaagcggcagaacaatcgaactgtttggagtttatcagaagttttcccaatggatntgacactgttcttggtgaacatggctcttcatgt

SEQ ID NO: 88046 - DNA, 301 bp, Heterodera glycines
  SCN-specific regions: Sequence locations=1-301
gatgtgctctggttggagttggatgtatcatggagagcgtaaatgctaatccgacaaatggtagatcgaaaactccaacgaacagaacgaatacacgacaaactccgcatggtctgtctgaacggtgggcccggtaacaacaaatggccccaacatctcaattgctggttcgccacactgtacgcagcatggtagctaccagaaccatgctgctggaaattcaccgactgccattccgaaaaaagaaaatgcgactggtgctccggcgggtgcaccaactagaaagagagactgtactcat

SEQ ID NO: 88047 - DNA, 772 bp, Heterodera glycines
  misc_feature (681)..(681): n is a, c, g, or t
  SCN-specific regions: Sequence locations=1-772
gaaacacttttgggtccccaaaaaacgctttcgaagtggcgtggttccgagaacgccgttgaaagtggttgcaccgttggaagaacgcgtggaaatcagtgcggacgacaagactaaggagaaaatcccacttccctcctcgcttgtcgtgagtgtgccgatcactccgctgaagacgtccacgtcagtggtggacatgacactgtcggaagaactcgtggaaagcagtgcggacgacaagactaaggagaaaatcccacttccctcctcgcttgtcgtgagtgtgccgatcactccgctgaagacgtccacgtcagtggtggacatgacactgtcggaagaactcgtggaaatcagtgcgtacgacatgactaaagaaaaaatcccacttccttccactgaagacaactacaacgtggacgatttatcctcaaacgatgaaacggaccccgaagattcgccgaagaaacaaatccccaaatgggcccaaaaagagtacttggcgcagcaaatcaatggccttcagcgaattgacgtgttggaaaaagttgaaaaatattttggccgcattcggcaacctgcactgattgactttttcaagcagtccaagaagaaatatacgaagaggcggtcttcgagcgcagtttgggacagtccgatgtccgaccctacgcccggctntggtcgtttccagaagtttcagaaatcgtctaattgagcattttcaaaccaatcctgatctccgataacgatttatttatttttttactaa

SEQ ID NO: 88048 - DNA, 430 bp, Heterodera glycines
  SCN-specific regions: Sequence locations=1-334,365-430
acgtggaccttccgtatcccgcgcgtcgattggcctggggcaaatggcttaactgtggccagacatgcttggcacccgactacgtaatggtgaccaacgaaatgaagccgagactggtcgaggaactgaaggcggtgcttgtggaatattacgggacgaatccggagacgagcaaagactacagccgagtcatcaacgaagcccactttgaccgtatttgcgcgttgctgaaaaactctgtcggcattgaaatttgcaaaatgggacagcccaaccgggaggatttgttcattccgccgaccattttggaggtgcaaaccgacgacgcactgatgcaatccgaaatttttgggcccattcttccgtttctcatcgtccgttcttttgacgaggccattgacattataaagcgggggagagaagccattgg

SEQ ID NO: 88049 - DNA, 618 bp, Heterodera glycines
  SCN-specific regions: Sequence locations=1-156,178-618
cgatcggtttgctggcacggactaccgcccattcacttggctcgattgggatgaacacgagcgggagttgagcccacagtgagtatttgattgtttctaacaaattgaccgttgtccgctcctcttcgatttgctgcttttgctctccgatttgggtttccatggccttttcttttgtttgccgctcatcaaagcgcaatttgccaatgtactttctcaattggagtgtactcctctcaaagatttgcccatttccgtcgcaattaggcagcgatgcaggcaactctttgcacttctcatttcggctgattttttccccgatctgatcgacatttgcgttgaaatgctccccgagacgacaaatcacgaaatggctgtgttaatgcgtgacttgtggaactttttgaagtccctcttctccatgtcttcctctccaacgtcgcttcattcgtccgatgttcgtccgatgcctccgccgtctccgaatcgaatggacgcgctcacttccaaagagggtcgtctgcttacctccaccattttgctgattggacagcgtcacatcgcatcgatgggtccgttgttggccaaactcgtggaccttttgggcggagttgagag

SEQ ID NO: 88050 - DNA, 425 bp, Heterodera glycines
  misc_feature (423)..(424): n is a, c, g, or t
  SCN-specific regions: Sequence locations=1-425
ggcgtgtggtgtaaggatgtgtcatattgagacctatattttcatggattttgagacaacgggactttttgacgacggccacaacaacccgttgaccaaccccaatcggtccaatgagacggccagagaacgtgcccagaggctggacaacctcatcaagtcagatggaaatcgctttcctaaaatcacggaaatggcttatatgtcggtgccgcgggtgttgttccttgagggaacggagcaaatgtccgcgcgccatttatcatcgatgtcgcaagacggcgaagaaggcattgagccggtgcaggtcgttacgaatgtacacgtgcgacagctgagtccgcagcttaatgacaaggagcggttcaagtaagaggaattgcaacggaaagtgccaagaatggcccggagtcgtccacctgnnc

SEQ ID NO: 88051 - DNA, 520 bp, Heterodera glycines
  misc_feature (467)..(467): n is a, c, g, or t
  misc_feature (469)..(469): n is a, c, g, or t
  misc_feature (518)..(519): n is a, c, g, or t
  SCN-specific regions: Sequence locations=1-467
agtcgatgaggaaacaaaggtggatttgattaaacggcagcgggaagagaacaacgcatccgcgacctgatgctgacaaataccaagaaattggcaggtcgtgatagactgataaggcagcaggagatcaaaatacagagactggaaagggcgaatacgcaaaaatcggacagccttaaacgcaaaatggaggaaatgcaaaaattgaagaagaaggaaaggcgtaagacaatgttcgaaacgaacaatccacgaaagcctctaacgccaataaacgagcaactgactccagagagtaaacatctcgagcgcctgaacacgacatacattgttgatacgccatctgaggaacagaagaaagggcgtttattgggagaattaccggaggaaaaggattccaattatcaaattcccccccttttgagtggttgttgtccgaaaggaccttctgtttaaacatatgattnanaaaaaaaaaaaaaaaaaaaaaaaaaaaaaaaaaaaaaaaaaaaaaaaanna

SEQ ID NO: 88052 - DNA, 140 bp, Heterodera glycines
  SCN-specific regions: Sequence locations=1-140
caaattcgggtttattgtgatggacggaaacggatcactttttgggactttgcaggaaatgccgggaagtgctacacaaattctctgtcgaattacctaagaagcatggaaggggagggcaatctgcactgcgatttgca

SEQ ID NO: 88053 - DNA, 310 bp, Heterodera glycines
  misc_feature (293)..(293): n is a, c, g, or t
  SCN-specific regions: Sequence locations=1-310
tgccgagaggacaagcccatcgacccaacccatctctgatcgactgcttgtgcacctggccaaatttgcgagacaaatcgcgcaaatgctctctagggactcccatttaaatttgacagctcgtttcaacggagtgcgcgggtgggaaatcggttgtccgaatgttcggcccgaagagcctaattcatcgggcgtaatcgtctgaacaaagtgacaacagacaaacaatgagttccaaaatttacagttccatcgtacgcgaagtgatcggtcgcgtgcggctgagtgcgtcnagcaactcgcaaagcta

SEQ ID NO: 88054 - DNA, 767 bp, Heterodera glycines
  misc_feature (658)..(658): n is a, c, g, or t
  SCN-specific regions: Sequence locations=1-767
cactcgccgaagatgttggggacatggcatcactgttggactccaatgggaaataccgctgcaacacctatggattgtgctttgagccaatagacaatgagatttgcttgggctcttccaaccgaattctcattggcatggtgcttgccccggctgaccgtgacgtcacttgccttctctttgccactgctcgttctttttaccaggaacaacaacattccgtcggatcttgtccaaaaattgtaaccaaatgcacggttaacttgcgtcccattgaattcaatctttcggaggagggccgtgaatcgatgtcatctcccatttataatgcccattggacttcgactgaaccgatttggtctttgtgcttcaattcgcaccacatgaaaatttgcgttggcatggaaaaatgtgccaaaatactgaacgtactcagtggacaaaatttttatgtcggaagcggcggaaaaaatgtcatttcgtgtattttttccaaggacggaaataccctttttctgggccggaaaaatgccgatgtttccatgttggacatgcgcatgacatcgaaccataaagttggcgaattggcccagtcgccctctaccggatacatgcatttgctacagacacgtcctcacactttagtcactgagaattntgaaggaaagatcaaactttgggatgtgcgtggccgttgtcaacccttggccgaattggagattgggcaccgcaattcctcacataaattaccttgcttcgttgatgct

SEQ ID NO: 88055 - DNA, 730 bp, Heterodera glycines
  misc_feature (636)..(636): n is a, c, g, or t
  misc_feature (728)..(728): n is a, c, g, or t
  SCN-specific regions: Sequence locations=1-49,88-730
attactttttaattttgttaattattaataacctattttttgcttttttaatttgttaacatttctccttccctctgtccctccctttgccatttcccaccataacgcccatcaccacctttaaaagaacagaacaggcgaatggcgagtcaaaatggggatttggagaaccaactggaaatttgccaagggttggtcaacgaactccgagcggaagtcgattcattgcgcggcgaactgagcgaatgcaaattgcctttccgaatttccaacagcgaacttcaaaatatcaccgttcgtcactctcgcactggcgacgccgtggagcgaattgggccacggaaagcgaacaccaaaagtctgctgaagccacgtgcgcgtctctgttccaacactccgaaaatggctgtgccgtctgaaaagcgtgccaagcgtggattgaccaaagacagcgaagatgacgacaatttccgcaccgcggaatttgtgccgaccactccccgtccgcaatttctgttgcctccgcttgtgctcaccccgctcagcagccgtttcccccctcttccgcggcgttcattttctgtcgaaccaactccaactcatatacagaaaaacgctgaacagcaactgacaatnattcgggacggcaacggcgacatgccgtgtccgttcagtcaaaagcggctgaatgacaacggcgaaattcagtgtccgtcttcctccacgtnct

SEQ ID NO: 88056 - DNA, 729 bp, Heterodera glycines
  misc_feature (726)..(726): n is a, c, g, or t
  SCN-specific regions: Sequence locations=1-50,71-107,143-729
taattcttcctgcatattattgccgctgctgttctccatccgtccgtgccatcaaatcaaatcaaatcaacggcagctgagcacaggcagaagtgtgcacaaattgacgacacaacaaacaacaaaactgggcactgcacaatcaaaagcatcatcttcatcatcggaagaaggagaagcaaaagtgacgcagaaggaggagccgacaactgacaaacagcagcaacaaacaagcaaagcgagcggagcaacaccagcaacagcaggatcaagcagttcaggcaccaccgcggcaacgcatggaacaaatcgacactttcaccgaccaaatttggctggacacgttggcatggcttggacgtgaagagatcggctggcactttgcgctggtcaatgcccgcttcgccgccctggtggacacgcagttgcagcagaggcgatggtacttgacggagttgcacatcaataagcgcaggtcgagagggagcggcgcagaagtgatggtcttgaacagcgaaggcgccttcttctcattgccattggcaaccatctgattacggaatttcgcgcttggcaagcgatggcacggcacatttggcccctgttgaggaacggacttcgcacgctggtcagcctgaagcgcaaacaactggcactgatgcgcaaacacgtgtcgccaaccgtcctcttcgactgtccgaaccttgtcgaaatatcaccccgatnttg

SEQ ID NO: 88057 - DNA, 685 bp, Heterodera glycines
  SCN-specific regions: Sequence locations=1-246,286-548,570-685
gtgggagccgaaaaggaagaaacaagaaaggagagggcaaagcggaagaagctaagaaagatgaagccaaaaaggaggagccgaaaacggaagaggccaaaaaggaagaagcaaagcccagtgccccggccgtcttaactgaagctgccgataatgtgaacaaagcggtcgatgacttaagcgttaaacaggcaaaagcattgaaaaacgcggccgaagcaacggcagagaaaacgccggaagagcaggaaaaagcattgaaagaagtggcagaaaaaggaggaaacgaacagctgaagacggctgtcaacaaaattttggaggcaaaagcgaaaaacgacgcggaattggaaagcgaagtgaaaacgaaaacggcaacactttctgaggacagcaaaaaggccagcgcagagttgactttgataattgaagacaaaaagacgactttggacgagaaggtgaagcggacggaggagctgacagccaaaatgtcggacaacacgaagaaggagctgaatctgaacaacagtgccgacgtcgtcgccttcgtcaagtcgtactccgccgtcgccgtgccggcggtggccacggagggcaaagcatgatcaatcagtctgatcggaggattcggcattgttgtgtgatgaaatgtagccaatagtgaaattcattgattaaattaatt

SEQ ID NO: 88058 - DNA, 94 bp, Heterodera glycines
  SCN-specific regions: Sequence locations=1-20,43-94
tacagttgaagtacttgaatagtagaatatgtttttggtgatttgagatagtggtatgcatgagggttgtatttatggttttatgtttagaata

SEQ ID NO: 88059 - DNA, 318 bp, Heterodera glycines
  SCN-specific regions: Sequence locations=1-141,163-175,197-318
acggctctaagtgaaggggagcattacgcaaaatctgcccaaaatgaaatccatttgtgatcgtccgcttgcttttcactttggttatgtttttcggttttgctattcaaatgtacgtcgtggtggaaatgctgtggcccgaatttgtcaaatttctgcgcaatttatgtccaaattttggggtttataatgaaaatgatcacaaaaatatggtcggcattgaattgctcttccgtgccgcgctcgtcaccgtctccatgctaattggcctcgctgtgcctgaattggagaatatcattccgttggttggtgccaccg

SEQ ID NO: 88060 - DNA, 548 bp, Heterodera glycines
  misc_feature (448)..(448): n is a, c, g, or t
  SCN-specific regions: Sequence locations=1-6,34-82,105-548
acaaacggaggaggaggaggaagaagagaaggaaacagtttcagtggttgcggaaagtgtttatggcgacgacgaggacattgacgaggaggagagagagggggcggagaatcatccgccgcgaaggcaaatgccgtcgattgaacgcaatggaacgacgacaaaaagcaatgggcccaataaagcgagcaaaagcaacaatgtggacaagaggaagggcatcgtcgcacaaaacatgcgttcgggttggatcagcaaggcattgctcagccgtcctccgctgtcgcgaccgccaaaacggaagcggaacaaccgggacaccaccacggtcattgtgcttgagcaagacaatgccgccgacaagggtcaagagcaaaacaacaccgggaatggtcaagagcagggcaacaatgccgccaaacttcgagagcacaagcgcgacacaacnagctgatgtgcttaggtccggcaatgcttcgcctttggcgcgcagcactcctcagccgatggaccaggaaaatgagcaatcgtgcagcaaccgactcttc

SEQ ID NO: 88061 - DNA, 407 bp, Heterodera glycines
  SCN-specific regions: Sequence locations=1-349,372-381
cggagagcttatttacccggtcagcgctgttgccttccacccggtccaccgaactttcgcccgggagggagcgattacatcgttaacatgtgggacccgttcaaccggaagcgcttatgccaatttaggaagttcccaagctctgttgtaagcctctcattctctcctgatggtggaatgctcgcaattgcttctacttatatgtacgaggaggaacgcgatccgaatcccatccccgagagttcattaacgattcgccgtatgacagagctagaagtccgtccaaagtaaaatttgtttttttctcatctgttatctcattccgaacaaagctcaggttcaatattatttttatatttgcaaataaattcactttgttcgaaaaaaaaaaaaaaaaaaaaaaaaaa

SEQ ID NO: 88062 - DNA, 752 bp, Heterodera glycines
  SCN-specific regions: Sequence locations=1-100,169-187,269-269,329 -345,382-401,469-551,573-614,636-752
aagtgcgtattggctttggtgatgccgaccccctttgggactcagagaatgaaaagtacaaagtgctgtgccgaacattcatgtttccaggcagctctgtcattggttacatgcggctgttggtctccttagtgtccagtctcttttttgcgtaccaatacatgatggccgtcactggccgattgtcctccgaccattggattaaccaagtgactgctcgctttatgtcacaggcaatgatgtccatctgtttgcaagtgattgtcgtcgtacttatggtccacggtgtgaaggctgagaagaagtccttgttgcttccttttattgcgtatgctgcgatcgcagttttggctggttcgatcaaggttatgagtgatttggtgtatttggacacgagcgtctacaaaaacaatgaggcggagagtcgagccgccaaagtgcaatttctcactaatctgttgcgcactgtgctccaggcctggtgtctgtctgttgtttggcgttgctatggttacctgaccgaaaaaaaggtggcacgtcagattcgtgaacaactcaactcaactgcgaccgcattcaattacccggagaatttgatggggcacccgtcgatgccgcagcagcctcctccttacgcggctgttgtcactgctccgatcgcaattgggccgtccaatgacaagccacagacttcagcgacgaacacatccgctactgcttctcatattcagcagtagcaatacaatgagatc

SEQ ID NO: 88063 - DNA, 737 bp, Heterodera glycines
  SCN-specific regions: Sequence locations=1-627,649-737
tgaacattctgctgaagtctgttctattcatctctcttctgtcactgtttggtgattgcatgaaaaactcagatcaaattggagtcaaaagaaaatcagcaggaataagaattgaggaaccaaatgatgtaaaaggcaaaggaaaagtcgtcgaaacaagcagaaaaggcaaagaaaaagtcggcgaaaaaataagcgttatgaacacagctgaacgcattgaaaaaatggaccttgcccaagacaaagctaaaatggatatagacaccaatggcaaacccaaacaaaatgaggaaaatgctcctccaaaatatgttttcatttggagcggtagcaatgagaagaagaaccttgaggttgacctcagagtgacccgtcactccaaaaaaaactcagcgaattattccatgccaaaagtgatcaatccgtcaatgcaaaacacggaaagcaggaagcattaccggttccgaaacaggaagctgaaaaaatactgaaggaagtggaagaatggtacgcacatcacaaaaatgataaacataaaaacgctccagtttttgtgttcaagtgtaaagacaatgtcagtctggtgataaatgttcatcttgatgcagtccggctttccaaggagttgtcaaatatgcttgaagatactgccgacgaaggatatccgaagccaatcccgagtccagttccgaatttcaaaagtgacatcacgcttaaactgattaaattgtgtg

SEQ ID NO: 88064 - DNA, 635 bp, Heterodera glycines
  misc_feature (626)..(626): n is a, c, g, or t
  SCN-specific regions: Sequence locations=1-44,66-92,114-635
cactttttgggctgaagttttttgcaaaagactggaatcccattgctatgaatggcccgaattggacaaaaatatttttgcccaaattggccaattatttgcaaatgcaaaacgagaacaagttctaaccttggataagcttgaaagagtgaaaagcgtgcgcattaatttggacaaattgtgtgccaaaattgaccgaatgtataatcaattccgtttccaattgccgaacacttggaaaaatgaattgtgcgcaaatgagacatttcaatacgtctcacattacacaacacgtgctggaaaaagaaaacaatctgaaaatgcaaaaatatgtaaggggtgtaagaatgaggagcgtaaaattgcgttcgacccatgcggccactttttcttgtgcaaaaaatgtgccaataccataaaaacatgtcccgaatgcaaagtgaaagtcaaggagagactggaaatttttaatgtctgacaaaatgccaatctttaaaatttaaatttgtagcgaaatatttatttgaaggtattaaagcatgaaagaaagcggaaatacattcagaaatcgttctatcatttttttaatatccaatgttttgttgataaaatctggcatttcaaanaaaaaaaaa

SEQ ID NO: 88065 - DNA, 696 bp, Heterodera glycines
  SCN-specific regions: Sequence locations=1-696
gtggcatgcgaaatttgatggcattcttggcatgggattttcggaaatttctgtccaaaaattgccgaccgtgttcgacaacatggtcacgcaacagaaagtgccggagccggtgttcgcattttggcttaaccgtgacccgacctctgaatttggtggtgagatcaccattgggggcactgatcagcgacgctttgtggccccaatcacttacacaccggtcacacacaaagcctactggcaattcaagatggattcgatcagtggaggtaatggcaaacttgcgtgccaaaatgggtgccaagccattgcggacaccggcacttccctgcttgctgggcccaaaaatgacattgaaaagattcagaaacacattggagcaattccgctcttccatggcgagtatatgatatcatgtgaacgtattcccacactgcccgatgtgacgatcaacatcggtggcaaggcgtacacgttgaagggcaaggactatgtgctgaaaatgaccagcatgggcaaaagcatatgcctttccggttttatgggcattgatttgccggaacgtgtcggagaactttggattcttggcgatgtgtttattggtcgttactacacggtgtttgatgtgggccaaagtcgtgttgattttgcgcaggccaaagacggaaatgaaattccaattgagcctcaagtgcg
